US012329181B2

(12) United States Patent
Jury et al.

(10) Patent No.: US 12,329,181 B2
(45) Date of Patent: Jun. 17, 2025

(54) MICROBIAL FEED SUPPLEMENT COMPOSITION AND METHOD

(71) Applicant: Terragen Holdings Limited, Coolum Beach (AU)

(72) Inventors: Karen Jury, Coolum Beach (AU); Martin Soust, Coolum Beach (AU)

(73) Assignee: Terragen Holdings Limited, Coolum Beach (AU)

( * ) Notice: Subject to any disclaimer, the term of this patent is extended or adjusted under 35 U.S.C. 154(b) by 30 days.

(21) Appl. No.: 17/185,256

(22) Filed: Feb. 25, 2021

(65) Prior Publication Data

US 2021/0267232 A1    Sep. 2, 2021

(30) Foreign Application Priority Data

Feb. 28, 2020   (AU) ................. 2020201488

(51) Int. Cl.
| | | |
|---|---|---|
| *A23K 10/18* | (2016.01) | |
| *A23K 20/163* | (2016.01) | |
| *A23K 50/10* | (2016.01) | |
| *A23K 50/60* | (2016.01) | |
| *A61K 35/747* | (2015.01) | |

(52) U.S. Cl.
CPC ............ *A23K 10/18* (2016.05); *A23K 20/163* (2016.05); *A23K 50/10* (2016.05); *A23K 50/60* (2016.05); *A61K 35/747* (2013.01); *A23V 2400/125* (2023.08); *A23V 2400/165* (2023.08)

(58) Field of Classification Search
None
See application file for complete search history.

(56) References Cited

FOREIGN PATENT DOCUMENTS

| | | | | |
|---|---|---|---|---|
| WO | WO-2012110777 A2 | * | 8/2012 | ............ A23K 10/18 |
| WO | WO-2018187838 A1 | * | 10/2018 | ............ A61K 35/747 |
| WO | WO-2019178309 A1 | * | 9/2019 | ............ A23K 10/18 |

OTHER PUBLICATIONS

Cambridge University Press. "Syrup". In Cambridge dictionary. Online. Retrieved Nov. 30, 2022 (Year: 2022).*
Frizzo et al., "Effects of probiotics on growth performance in young calves: A meta-analysis of randomized controlled trials", Animal Feed Science and Technology, vol. 169, p. 147-156. (Year: 2011).*
Drissi, F., et al., "Metabolic role of lactobacilli in weight modification in humans and animals", Microbial Pathogenesis, vol. 106, pp. 182-194. (Year: 2017).*
Timmerman, et al., "Health and Growth of Veal Calves Fed Milk Replacers With or Without Probiotics", Journal of Dairy Science, vol. 88(6), pp. 2154-2165 (Year: 2005).*
Frizzo et al., "The Effect of Supplementation with Three Lactic Acid Bacteria from Bovine Origin on Growth Performance and Health Status of Young Calves", Journal of Animal and Veterinary Advances, vol. 7(4), pp. 400-408. (Year: 2008).*
Carroll, Bernard J., David L. McNeil, and Peter M. Gresshoff. "Isolation and properties of soybean [*Glycine max* (L.) Merr.] mutants that nodulate in the presence of high nitrate concentrations." Proceedings of the National Academy of Sciences 82.12 (1985): 4162-4166.
Men, Artem E., et al. "Fast neutron mutagenesis of soybean (*Glycine soja* L.) produces a supernodulating mutant containing a large deletion in linkage group H." Genome letters 1.3 (2002): 147-155.
Chapter 19.3 "Detection of Helper Virus in Retrovirus Stocks" of Current Protocols in Molecular Biology, Ausubel, F. M., B. Roger, R. E. Kingston, D. D. Moore, J. G. Seidman, J. A. Smith, and S. Kevin, 2003.
Chapter 9 "Introduction of DNA Into Mammalian Cells" of Current Protocols in Molecular Biology, Ausubel, F. M., B. Roger, R. E. Kingston, D. D. Moore, J. G. Seidman, J. A. Smith, and S. Kevin, 2003.

* cited by examiner

*Primary Examiner* — Michelle F. Paguio Frising
*Assistant Examiner* — Grant C Currens
(74) *Attorney, Agent, or Firm* — Meunier Carlin & Curfman LLC

(57) ABSTRACT

A composition for administration to an animal is provided. The composition comprises a bacteria of the genus *Lactobacillus*. Also provided is a method of improving or enhancing one or more characteristics of an animal by administering a composition comprising a bacteria of the genus *Lactobacillus* to the animal. The animal may be cattle, such as a calf. Related animals and animal products are further provided.

14 Claims, 7 Drawing Sheets

Specification includes a Sequence Listing.

MICROBIAL FEED SUPPLEMENT COMPOSITION AND METHOD

CROSS-REFERENCE TO RELATED APPLICATIONS

This application claims the benefit of Australian Patent Application No. 2020201488 filed Feb. 28, 2020 in the Australian Patent Office, and New Zealand Patent Application No. 762186 filed Feb. 28, 2020, in the New Zealand Patent Office, the entire disclosure of which is incorporated herein by reference.

REFERENCE TO AN ELECTRONIC SEQUENCE LISTING

The content of the electronic sequence listing submitted on Feb. 25, 2021, as a text file named "11181-007US1_Patentin_Project_ST25.txt" created on Feb. 1, 2021, and having a size of 33,171,000 bytes, is herein incorporated by reference in its entirety in accordance with the requirements of 37 CFR 1.821-1.825.

TECHNICAL FIELD

The present invention relates to a microbial composition. More particularly, the invention relates to a composition comprising *Lactobacillus* bacteria suitable for use as a feed supplement for animals, typically ruminants, although without limitation thereto. The invention also relates to methods of promoting animal growth, development, and/or productivity, typically ruminant growth, development, and/or productivity, using a microbial composition comprising *Lactobacillus* bacteria.

BACKGROUND

Farmed ruminants including cattle, sheep, and goats are commonly raised for the purpose of production of commodities such as meat, milk, leather, and wool. Among the ruminants, cattle are of the greatest economic significance with beef and dairy cattle industries worth billions of dollars worldwide.

A critical consideration for farming of animals, including ruminants, is production efficiency. Various circumstances may influence production efficiency from animals, however animal nutrition is typically a key factor. Supplements, including feed supplements, have been developed to attempt to improve nutrition of farmed animals.

Ruminant animals possess highly specialised digestive systems, including a complex mix of microbes that assist with the digestive process. Accordingly, the development of supplements, particularly feed supplements, for ruminants is associated with significant challenges and there is presently a need for new such supplements. It would be particularly desirable if such supplements showed efficacy for improving productivity from cattle, such as efficiency of meat or milk production. It would also be particularly desirable, in at least some circumstances, if such supplements were amenable to controlled dosing through voluntary consumption by animals.

The reference to prior art in the background is not and should not be taken as an acknowledgement or any form of suggestion that the referenced prior art forms part of the common general knowledge.

SUMMARY

A first aspect of the invention is broadly directed to a composition comprising one or more bacteria of the genus *Lactobacillus*. In embodiments, the composition comprises a plurality of bacteria of the genus *Lactobacillus*.

Suitably, the composition of the first aspect is for administration to an animal. Suitably, the composition of the first aspect is for administration to an animal to improve one or more of nutrition, growth, development, and/or productivity of the animal.

In embodiments, the composition of the first aspect is for administration to a ruminant animal. In an embodiment, the composition is for administration to cattle.

Suitably, the composition of the first aspect is an animal supplement. In embodiments, the composition of the first aspect is a ruminant animal supplement.

In embodiments, the one or more bacteria of the genus *Lactobacillus* of the composition of the first aspect are of a species selected from *Lactobacillus paracasei*, *Lactobacillus buchneri*, and *Lactobacillus casei*.

In embodiments, the composition of the first aspect comprises at least two bacterial species selected from *Lactobacillus paracasei*, *Lactobacillus buchneri*, and *Lactobacillus casei*.

In an embodiment, the composition comprises a bacteria of the species *Lactobacillus paracasei* and a bacteria of the species *Lactobacillus buchneri*.

In an embodiment, the composition comprises a bacteria of the species *Lactobacillus paracasei* and a bacteria of the species *Lactobacillus casei*.

In an embodiment, the composition comprises a bacteria of the species *Lactobacillus buchneri* and a bacteria of the species *Lactobacillus casei*.

In an embodiment, the composition comprises a bacteria of the species *Lactobacillus paracasei*, a bacteria of the species *Lactobacillus buchneri*, and a bacteria of the species *Lactobacillus casei*.

In an embodiment of the first aspect wherein the composition comprises a bacteria of the species *Lactobacillus paracasei*, the bacteria is *Lactobacillus paracasei* strain T9 as deposited with the National Measurement Institute, Australia, on 14 Dec. 2012 under Accession Number V12/022849 (*Lactobacillus paracasei* T9 V12/022849), in accordance with the terms of the Budapest Treaty with the American Type Culture Collection (ATCC), Manassas, Virginia.

In an embodiment of the first aspect wherein the composition comprises a bacteria of the species *Lactobacillus buchneri*, the bacteria is *Lactobacillus buchneri* strain Lb23 as deposited with the National Measurement Institute, Australia, on 27 Oct. 2011 under Accession Number V11/022946 (*Lactobacillus buchneri* Lb23 V11/022946), in accordance with the terms of the Budapest Treaty with the American Type Culture Collection (ATCC), Manassas, Virginia.

In an embodiment of the first aspect wherein the composition comprises a bacteria of the species *Lactobacillus casei*, the bacteria is *Lactobacillus casei* strain Lz26 as deposited with the National Measurement Institute, Australia, on 27 Oct. 2011 under Accession Number V11/022948 (*Lactobacillus casei* Lz26 V11/022948), in accordance with the terms of the Budapest Treaty with the American Type Culture Collection (ATCC), Manassas, Virginia.

The bacteria of the genus *Lactobacillus* of the composition of the first aspect may comprise a genome comprising a nucleotide sequence set forth in SEQ ID NOS:1-383, or a fragment or variant thereof.

In embodiments, the genome of the bacteria of the genus *Lactobacillus* comprises a nucleotide sequence set forth in SEQ ID NOS:1-160, or a fragment or variant thereof. The bacteria may be of the species *Lactobacillus paracasei*.

In embodiments, the genome of the bacteria of the genus *Lactobacillus* comprises a nucleotide sequence set forth in SEQ IN NOS:161-292, or a fragment or variant thereof. The bacteria may be of the species *Lactobacillus buchneri*.

In embodiments, the genome of the bacteria of the genus *Lactobacillus* of the composition of the first aspect comprises a nucleotide sequence set forth in SEQ IN NOS:293-383, or a fragment or variant thereof. The bacteria may be of the species *Lactobacillus casei*.

The bacteria of the genus *Lactobacillus* of the composition of the first aspect may comprise a genome encoding an amino acid sequence set forth in SEQ ID NOS:384-8830, or a fragment or variant thereof.

In embodiments, the bacteria of the genus *Lactobacillus* comprises a genome encoding an amino acid sequence set forth in SEQ ID NOS:384-3504, or a fragment or variant thereof. The bacteria may be of the species *Lactobacillus paracasei*.

In embodiments, the bacteria of the genus *Lactobacillus* comprises a genome encoding an amino acid sequence set forth in SEQ ID NOS:3505-6021, or a fragment or variant thereof. The bacteria may be of the species *Lactobacillus buchneri*.

In embodiments, the bacteria of the genus *Lactobacillus* comprises a genome encoding an amino acid sequence set forth in SEQ ID NOS:6022-8828, or a fragment or variant thereof. The bacteria may be of the species *Lactobacillus casei*.

In embodiments, the total concentration of bacteria of the genus *Lactobacillus* of the composition of the first aspect is at least about $10^5$ colony-forming units per millilitre (CFU/ml) or colony-forming units per gram (CFU/g), at least about $10^6$ CFU/ml or CFU/g, at least about $10^7$ CFU/ml or CFU/g, at least about $10^8$ CFU/ml or CFU/g, or at least about $10^9$ CFU/ml or CFU/g.

In embodiments, the concentration of each bacteria of the genus *Lactobacillus* of the composition of the first aspect is at least about $10^5$ CFU/ml or CFU/g, at least about $10^6$ CFU/ml or CFU/g, at least about $10^7$ CFU/ml or CFU/g at least about $10^8$ CFU/ml or CFU/g, or at least about $10^9$ CFU/ml or CFU/g.

The composition of the first aspect may comprise a sugar or sugar syrup. In an embodiment, the sugar syrup is molasses. In embodiments, the sugar or sugar syrup is at a concentration of between about 1% weight per weight (w/w) or volume/volume (v/v) and about 10% w/w or v/v. In embodiments, the sugar or sugar syrup is at a concentration of at least about 1% w/w or v/v, at least about 2% w/w or v/v, at least about 3% w/w or v/v, at least about 4% w/w/ or v/v, or at least about 5% w/w/ or v/v.

The composition of the first aspect may comprise an acid. In an embodiment, the acid is an organic acid. In an embodiment, the acid is fulvic acid. In embodiments, the acid is at a concentration of between about 0.1% w/w or v/v and about 0.6% w/w or v/v. In embodiments, the acid is at a concentration of at least about 0.1% w/w or v/v, at least about 0.2% w/w or v/v, at least about 0.3% w/w or v/v, at least about 0.4% w/w or v/v, or at least about 0.5% w/w or v/v.

In embodiments, the composition of the first aspect is a liquid composition. In embodiments, the composition is an aqueous composition.

A second aspect of the invention provides a method of supplementing an animal, including a step of administering a composition comprising a bacteria of the genus *Lactobacillus* to the animal.

A third aspect of the invention provides a method of improving or enhancing one or more characteristics of an animal, including a step of administering a composition comprising a bacteria of the genus *Lactobacillus* to the animal.

In embodiments, the animal according to the method of the second or third aspect is a ruminant animal. In embodiments, the ruminant animal is selected from cattle, sheep, and goats. In an embodiment, the ruminant animal is cattle. In an embodiment, the cattle is a calf.

In embodiments, the step of administering the composition to the animal according to the method of the second or third aspect is or includes administering the composition to the digestive system of the animal. In embodiments, the composition is consumed voluntarily by the animal, whereby the composition is administered to the digestive system of the animal.

In an embodiment, the step of administering the composition to the animal according to the method of the second or third aspect includes combining the composition with feed, including food and/or drink, for consumption by the animal.

In embodiments of the third aspect, the one or more characteristics of the animal that are improved or enhanced are selected from nutrition, growth, development, and productivity. In an embodiment, the improved growth is greater total weight of the animal. In an embodiment, the improved development is greater gut structure development of the animal. In an embodiment, the improved productivity is improved meat production from the animal. In an embodiment, the improved productivity is improved milk production from the animal.

Suitably, the composition administered to the animal according to the second or third aspect is the composition of the first aspect.

A fourth aspect of the invention provides a supplemented animal produced according to the method of the second aspect.

A fifth aspect of the invention provides an animal with improved nutrition, growth, development, and/or productivity produced according to the method of the third aspect.

A sixth aspect of the invention provides an animal product derived from the animal of the fourth or fifth aspect. In embodiments, the animal product is a meat product or a dairy product.

A seventh aspect of the invention provides a method of combining a composition of the first aspect with an animal feed.

An eighth aspect of the invention provides an animal feed comprising the composition of the first aspect.

A ninth aspect of the invention provides a method of preparing a composition for administration to an animal, including the step of combining a *Lactobacillus* bacteria with one or more other components. In embodiments, the method of the ninth aspect is a method of preparing a composition for administration to a ruminant animal, such as cattle. In embodiments, the composition prepared according to the method of the ninth aspect is a composition of the first aspect.

A tenth aspect of the invention provides a method of preparing or storing a composition for administration to an animal, including a step of applying a treatment and/or a substance or agent to a *Lactobacillus* bacteria or a composition comprising a *Lactobacillus* bacteria. In embodiments of the tenth aspect, the step of applying a treatment to a *Lactobacillus* bacteria or a composition comprising a *Lactobacillus* bacteria is a step of freeze-drying the bacteria or composition. In embodiment, the step of applying a substance or agent to a *Lactobacillus* bacteria or a composition comprising a *Lactobacillus* bacteria is a step of applying an oil layer to the bacteria or composition.

An eleventh aspect of the invention provides a freeze-dried composition of the first aspect. Suitably, the freeze-dried composition of the eleventh aspect is produced according to the method of the tenth aspect.

A twelfth aspect of the invention provides a composition of the first aspect at least partially covered by a layer of oil. Suitably, the at least partially oil-covered composition of the twelfth aspect is produced according to the method of the tenth aspect.

BRIEF DESCRIPTION OF THE FIGURES

In order that the invention may be readily understood and put into practical effect, typical embodiments will now be described by way of example with reference to the accompanying figures, wherein.

BRIEF DESCRIPTION OF THE SEQUENCE LISTING

Figure 1:
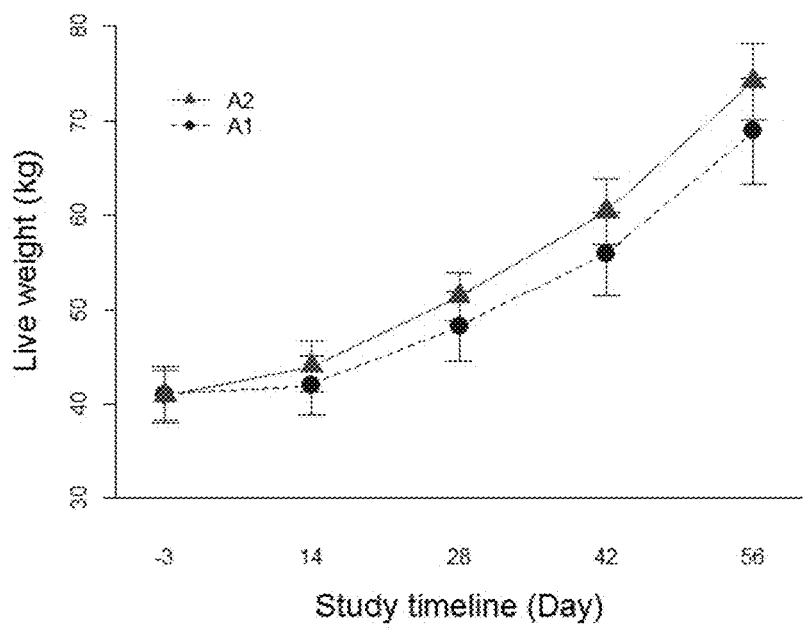
FIG. 1 sets forth line-plots of average live weight (kg) of Experimental Groups A1 (Control Group) and A2 (Treated Group) as a function of Study Timeline (Study Day), as per Example 1 herein. Error bars represent 95% confidence interval.
Figure 2:
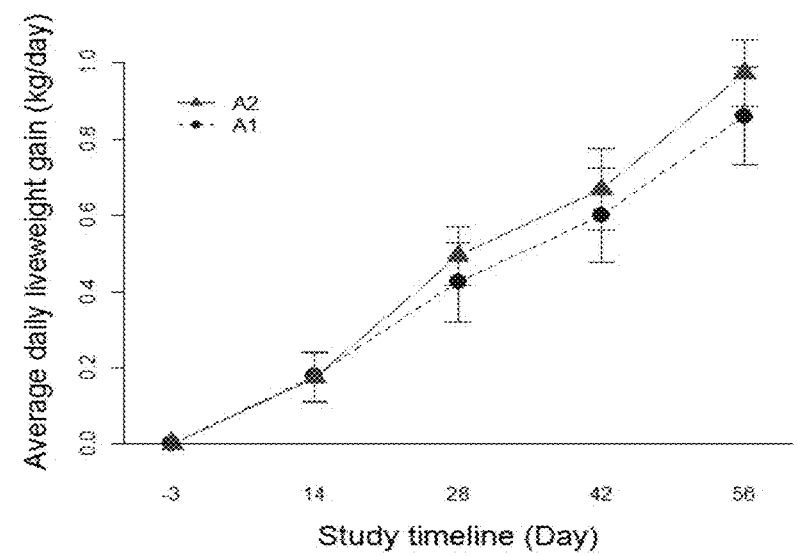
FIG. 2 sets forth line-plots of average daily live weight gain (kg/day) for Experimental Groups A1 (Control Group) and A2 (Treated Group) as a function of Study Timeline (Study Day), as per Example 1 herein. Error bars represent 95% confidence interval.

SEQ ID NOS:1-160: Nucleotide sequences of the genome of *Lactobacillus paracasei* T9 V12/022849.

SEQ ID NOS:161-292: Nucleotide sequences of the genome of *Lactobacillus buchneri* Lb23 V11/022946.

SEQ ID NOS:293-383: Nucleotide sequences of the genome of *Lactobacillus casei* Lz26 V11/022948.

SEQ ID NOS:384-3504: Amino acid sequences of proteins putatively encoded by the genome of *Lactobacillus paracasei* T9 V12/022849.

SEQ ID NOS:3505-6021: Amino acid sequences of proteins putatively encoded by the genome of *Lactobacillus buchneri* Lb23 V11/022946.

SEQ ID NOS:6022-8828: Amino acid sequences of proteins putatively encoded by the genome of *Lactobacillus casei* Lz26 V11/022948.

DETAILED DESCRIPTION

The present invention is at least partly predicated on the determination that certain *Lactobacillus* compositions may offer substantial benefits as supplements for farmed ruminants. In particular, it has been determined that compositions comprising certain combinations of *Lactobacillus* bacteria can exhibit surprising efficacy for use as ruminant animal supplements, particularly cattle supplements.

Accordingly, one aspect of the invention is broadly directed to a composition comprising one or more bacteria of the genus *Lactobacillus*. Typically, the composition comprises a plurality of bacteria of the genus *Lactobacillus*.

It will be understood that bacteria of the composition of this aspect include isolated bacteria. For the purposes of this invention, by "isolated" is meant material (e.g. bacteria, nucleic acids, cells etc.) that has been removed from its natural state or otherwise subjected to human manipulation. Isolated material may be substantially or essentially free from components that normally accompany it in its natural state, or may be manipulated so as to be in an artificial state together with components that normally accompany it in its natural state. Isolated material may be in native, synthetic, or recombinant form. To avoid doubt, as used herein, bacteria of the genus *Lactobacillus* can include isolated bacteria derived from natural or native corresponding *Lactobacillus* bacteria, or synthetic or recombinant bacteria corresponding to natural or native *Lactobacillus* bacteria.

The bacteria of the genus *Lactobacillus* according to the composition of this aspect may be of any suitable *Lactobacillus* species. In embodiments, the bacteria of the genus *Lactobacillus* is of a species selected from the group consisting of *Lactobacillus acetotolerans; Lactobacillus acidifarinae; Lactobacillus acidipiscis; Lactobacillus acidophilus; Lactobacillus agilis; Lactobacillus algidus; Lactobacillus alimentarius; Lactobacillus allii; Lactobacillus alvei; Lactobacillus alvi; Lactobacillus amylolyticus; Lactobacillus amylophilus; Lactobacillus amylotrophicus; Lactobacillus amylovorus; Lactobacillus animalis; Lactobacillus animata; Lactobacillus antri; Lactobacillus apinorum; Lactobacillus apis; Lactobacillus apodeme; Lactoba-* cillus aquaticus; Lactobacillus aviaries; Lactobacillus backii; Lactobacillus bambusae; Lactobacillus bifermentans; Lactobacillus bombi; Lactobacillus bombicola; Lactobacillus brantae; Lactobacillus brevis; Lactobacillus brevisimilis; Lactobacillus buchneri; Lactobacillus cacaonum; Lactobacillus camelliae; Lactobacillus capillatus; Lactobacillus casei; Lactobacillus chiayiensis; Lactobacillus paracasei; Lactobacillus zeae; Lactobacillus catenefornis; Lactobacillus caviae; Lactobacillus cerevisiae; Lactobacillus ceti; Lactobacillus coleohominis; Lactobacillus colini; Lactobacillus collinoides; Lactobacillus composti; Lactobacillus concavus; Lactobacillus coryniformis; Lactobacillus crispatus; Lactobacillus crustorum; Lactobacillus curieae; Lactobacillus curtus; Lactobacillus curvatus; Lactobacillus delbrueckii; Lactobacillus dextrinicus; Lactobacillus diolivorans; Lactobacillus equi; Lactobacillus equicursoris; Lactobacillus equigenerosi; Lactobacillus fabifermentans; Lactobacillus faecis; Lactobacillus faeni; Lactobacillus farciminis; Lactobacillus farraginis; Lactobacillus fermentum; Lactobacillus floricola; Lactobacillus florum; Lactobacillus formosensis; Lactobacillus fornicalis; Lactobacillus fructivorans; Lactobacillus frumenti; Lactobacillus fuchuensis; Lactobacillus furfuricola; Lactobacillus futsaii; Lactobacillus gallinarum; Lactobacillus gasseri; Lactobacillus gastricus; Lactobacillus ghanensis; Lactobacillus gigeriorum; Lactobacillus ginsenosidimutans; Lactobacillus gorilla; Lactobacillus graminis; Lactobacillus guizhouensis; Lactobacillus halophilus; Lactobacillus hammesii; Lactobacillus hamster; Lactobacillus harbinensis; Lactobacillus hayakitensis; Lactobacillus heilongjiangensis; Lactobacillus helsingborgensis; Lactobacillus helveticus; Lactobacillus herbarum; Lactobacillus heterohiochii; Lactobacillus hilgardii; Lactobacillus hokkaidonensis; Lactobacillus hominis; Lactobacillus homohiochii; Lactobacillus hordei; Lactobacillus iatae; Lactobacillus iners; Lactobacillus ingluviei; Lactobacillus insectis; Lactobacillus insicii; Lactobacillus intermedius; Lactobacillus intestinalis; Lactobacillus iwatensis; Lactobacillus ixorae; Lactobacillus japonicus; Lactobacillus jensenii; Lactobacillus johnsonii; Lactobacillus kalixensis; Lactobacillus kefiranofacien; Lactobacillus kefiri; Lactobacillus kimbladii; Lactobacillus kimchicus; Lactobacillus kimchiensis; Lactobacillus kisonensis; Lactobacillus kitasatonis; Lactobacillus koreensis; Lactobacillus kosoi; Lactobacillus kullabergensis; Lactobacillus kunkeei; Lactobacillus larvae; Lactobacillus leichmannii; Lactobacillus letivazi; Lactobacillus lindneri; Lactobacillus malefermentans; Lactobacillus mali; Lactobacillus manihotivorans; Lactobacillus mellifer; Lactobacillus mellis; Lactobacillus melliventris; Lactobacillus metriopterae; Lactobacillus micheneri; Lactobacillus mindensis; Lactobacillus mixtipabuli; Lactobacillus mobilis; Lactobacillus modestisalitolerans; Lactobacillus mucosae; Lactobacillus mudanjiangensis; Lactobacillus murinus; Lactobacillus musae; Lactobacillus nagelii; Lactobacillus namurensis; Lactobacillus nantensis; Lactobacillus nasuensis; Lactobacillus nenjiangensis; Lactobacillus nodensis; Lactobacillus nuruki; Lactobacillus odoratitofui; Lactobacillus oeni; Lactobacillus oligofermentans; Lactobacillus oris; Lactobacillus oryzae; Lactobacillus otakiensis; Lactobacillus ozensis; Lactobacillus panis; Lactobacillus panisapium; Lactobacillus pantheris Lactobacillus parabrevis; Lactobacillus parabuchneri; Lactobacillus paracollinoides; Lactobacillus parafarraginis; Lactobacillus paragasseri; Lactobacillus parakefiri; Lactobacillus paralimentarius; Lactobacillus paraplantarum; Lactobacillus pasteurii; Lactobacillus paucivorans; Lactobacillus pentosiphilus; Lactobacillus pentosus; Lactobacillus perolens; Lactobacillus plajomi; Lactobacillus plantarum; Lactobacillus pobuzihii; Lactobacillus pontis; Lactobacillus porci; Lactobacillus porcinae; Lactobacillus psittaci; Lactobacillus quenuiae; Lactobacillus raoultii; Lactobacillus rapi; Lactobacillus rennanquilfy; Lactobacillus rennini; Lactobacillus reuteri; Lactobacillus rhamnosus; Lactobacillus rodentium; Lactobacillus rogosae; Lactobacillus rossiae; Lactobacillus ruminis; Lactobacillus saerimneri; Lactobacillus sakei; Lactobacillus salivarius; Lactobacillus sanfranciscensis; Lactobacillus saniviri; Lactobacillus satsumensis; Lactobacillus secaliphilus; Lactobacillus selangorensis; Lactobacillus senioris; Lactobacillus senmaizukei; Lactobacillus sharpeae; Lactobacillus shenzhenensis; Lactobacillus sicerae; Lactobacillus silage; Lactobacillus silagincola; Lactobacillus siliginis; Lactobacillus similis; Lactobacillus songhuajiangensis; Lactobacillus spicheri; Lactobacillus sucicola; Lactobacillus suebicus; Lactobacillus sunkii; Lactobacillus taiwanensis; Lactobacillus terrae; Lactobacillus thailandensis; Lactobacillus timberlakei; Lactobacillus timonensis; Lactobacillus tucceti; Lactobacillus ultunensis; Lactobacillus uvarum; Lactobacillus vaccinostercus; Lactobacillus vaginalis; Lactobacillus vermiforme; Lactobacillus versmoldensis; Lactobacillus vespulae; Lactobacillus vini; Lactobacillus wasatchensis; Lactobacillus xiangfangensis; Lactobacillus yonginensis; and Lactobacillus zymae.

In typical embodiments, the bacteria of the genus Lactobacillus is of a species selected from the group consisting of Lactobacillus paracasei, Lactobacillus buchneri, and Lactobacillus casei.

Typically, the composition of this aspect comprises at least two bacterial species selected from the group consisting of Lactobacillus paracasei, Lactobacillus buchneri, and Lactobacillus casei.

In typical embodiments, the composition comprises:
a bacteria of the species Lactobacillus paracasei and a bacteria of the species Lactobacillus buchneri;
a bacteria of the species Lactobacillus paracasei and a bacteria of the species Lactobacillus casei;
a bacteria of the species Lactobacillus buchneri and a bacteria of the species Lactobacillus casei; or
a bacteria of the species Lactobacillus paracasei, a bacteria of the species Lactobacillus buchneri, and a bacteria of the species Lactobacillus casei.

In a typical embodiment wherein the composition comprises a bacteria of the species Lactobacillus paracasei, the bacteria is Lactobacillus paracasei strain T9 as deposited with the National Measurement Institute, Australia, on 14 Dec. 2012 under Accession Number V12/022849, which strain is also referred to herein as Lactobacillus paracasei T9 V12/022849.

In a typical embodiment of the first aspect wherein the composition comprises a bacteria of the species Lactobacillus buchneri, the bacteria is Lactobacillus buchneri strain Lb23 as deposited with the National Measurement Institute, Australia, on 27 Oct. 2011 under Accession Number V11/022946, which stain is also referred to herein as Lactobacillus buchneri Lb23 V11/022946.

In a typical embodiment of the first aspect wherein the composition comprises a bacteria of the species Lactobacillus casei, the bacteria is Lactobacillus casei (formerly Lactobacillus zeae) strain Lz26 as deposited with the National Measurement Institute, Australia, on 27 Oct. 2011 under Accession Number V11/022948, which strain is also referred to herein as Lactobacillus casei Lz26 V11/022948.

In some embodiments, the composition of the first aspect comprises a bacteria selected from the group consisting of

*Lactobacillus parafarraginis; Lactobacillus rapi; Lactobacillus diolivorans; Lactobacillus perolens;* and *Lactobacillus brevis.*

In an embodiment wherein the composition comprises a bacteria of the species *Lactobacillus parafarraginis*, the bacteria is *Lactobacillus parafarraginis* strain Lp18 as deposited with the National Measurement Institute, Australia, on 27 Oct. 2011 under Accession Number V11/022945.

In an embodiment wherein the composition comprises a bacteria of the species *Lactobacillus parafarraginis*, the bacteria is *Lactobacillus parafarraginis* strain N11 as deposited with the National Measurement Institute, Australia, on 14 Dec. 2012 under Accession Number V12/022848.

In an embodiment wherein the composition comprises a bacteria of the species *Lactobacillus rapi*, the bacteria is *Lactobacillus rapi* strain Lr24 as deposited with the National Measurement Institute, Australia, on 27 Oct. 2011 under Accession Number V11/022947.

In an embodiment wherein the composition comprises a bacteria of the species *Lactobacillus diolivorans*, the bacteria is *Lactobacillus diolivorans* strain N3 as deposited with the National Measurement Institute, Australia, on 14 Dec. 2012 under Accession Number V12/022847.

In an embodiment wherein the composition comprises a bacteria of the species *Lactobacillus perolens*, the bacteria is *Lactobacillus perolens* strain TB as deposited with the National Measurement Institute, Australia, on 14 Dec. 2012 under Accession Number V12/022850.

In an embodiment wherein the composition comprises a bacteria of the species *Lactobacillus brevis*, the bacteria is *Lactobacillus brevis* strain TD as deposited with the National Measurement Institute, Australia, on 14 Dec. 2012 under Accession Number V12/022851.

It will be readily understood that bacteria, including bacteria of the genus *Lactobacillus*, comprise bacterial genomes. The skilled person will appreciate that a "genome" of an organism, such as a bacterial organism, refers generally to the complete nucleic acid sequence of the organism.

Generally, as used herein, the term "nucleic acid" designates single- or double-stranded DNA and RNA. DNA includes genomic DNA and cDNA. RNA includes mRNA, RNA, RNAi, siRNA, cRNA and autocatalytic RNA. Nucleic acids may also be DNA-RNA hybrids. A nucleic acid comprises a nucleotide sequence that typically includes nucleotides that comprise an A, G, C, T or U base. However, nucleotide sequences may include other bases such as inosine, methylcytosine, methylinosine, methyladenosine and/or thiouridine, without limitation thereto.

Nucleic acids may, although need not, encode amino acids and/or proteins. Generally, as used herein, by "protein" is meant an amino acid polymer, comprising natural and/or non-natural amino acids, including L- and D-isomeric forms as are well understood in the art.

It will be understood that, as used herein in the context of nucleic acids, proteins, and nucleotide or amino acid sequences thereof, a "fragment" refers to a portion constituting less than 100% of the nucleotide or amino acid sequence. Typically, a fragment comprises at least 1%, 2%, 5%, 10%, 15%, or 20% of the nucleotide or amino acid sequence. More typically, a fragment comprises at least 25%, 30%, 35%, 40%, 45%, or 50% of the nucleotide or amino acid sequence. In some typical embodiments, a fragment comprises at least 55%, 60%, 65%, 70%, 75%, 80%, 85%, 90%, 91%, 92%, 93%, 94%, 95%, 96%, 97%, 98%, or 99% of the nucleotide or amino acid sequence.

It will be understood that, as used herein in the context of nucleic acids, proteins, and nucleotide or amino acid sequences thereof, a "variant" refers to an amino acid or nucleotide sequence in which one or more nucleotides or amino acids have been deleted or substituted by different nucleotides or amino acids. Variants include naturally occurring (e.g., allelic) variants, orthologs (e.g. from other bacteria) and synthetic variants, such as produced in vitro using mutagenesis or genome editing techniques. In embodiments, the variant may have less than 100% but at least 60%, 70%, 75%, 80%, 85%, 90%, 91%, 92%, 93%, 94%, 95%, 96%, 97%, 98%, or 99% sequence identity as compared to an 'original', 'native', or 'wild type' amino acid sequence or nucleotide sequence.

The term "sequence identity" is used herein in its broadest sense to include the number of exact nucleotide or amino acid matches having regard to an appropriate alignment using a standard algorithm, having regard to the extent that sequences are identical over a window of comparison. Thus, a "percentage of sequence identity" is calculated by comparing two optimally aligned sequences over the window of comparison, determining the number of positions at which the identical nucleic acid base {e.g., A, T, C, G, U) occurs in both sequences to yield the number of matched positions, dividing the number of matched positions by the total number of positions in the window of comparison (i.e., the window size), and multiplying the result by 100 to yield the percentage of sequence identity. For example, "sequence identity" may be understood to mean the "match percentage" calculated by the DNASIS computer program (Version 2.5 for Windows; available from Hitachi Software engineering Co., Ltd., South San Francisco, California, USA). A detailed discussion of sequence analysis can be found in Chapter 19.3 of CURRENT PROTOCOLS IN MOLECULAR BIOLOGY, Ausubel, F. M., B. Roger, R. E. Kingston, D. D. Moore, J. G. Seidman, J. A. Smith, and S. Kevin. (2003).

It will be appreciated that, without limitation, nucleic acid and amino acid variants can be created by mutagenising a protein or an encoding nucleic acid, such as by random mutagenesis or site-directed mutagenesis. Examples of nucleic acid mutagenesis methods are provided in Chapter 9 of CURRENT PROTOCOLS IN MOLECULAR BIOLOGY, Ausubel et al, supra which is incorporated herein by reference. Mutagenesis may also be induced by chemical means, such as ethyl methane sulphonate (EMS) and/or irradiation means, such as fast neutron irradiation as known in the art (Carroll et al, 1985, Proc. Natl. Acad. Sci. USA 82 4162; Men et al, 2002, Genome Letters 3 147).

It will be appreciated that nucleic acid or protein variants may also be nucleic acid or protein fragments.

Typically, the genome of the bacteria of the genus *Lactobacillus* of the composition of this aspect comprises a nucleic acid comprising a nucleotide sequence set forth in SEQ ID NOS:1-383, or a fragment or variant thereof.

In typical embodiments as described herein, nucleic acid fragments comprise at least 1%, 2%, 5%, 10%, 15%, or 20%, more typically at least 25%, 30%, 35%, 40%, 45%, or 50%, even more typically at least 55%, 60%, 65%, 70%, 75%, 80%, 85%, 90%, 91%, 92%, 93%, 94%, 95%, 96%, 97%, 98%, or 99% of a nucleotide sequence set forth in SEQ ID NOS:1-383.

In typical embodiments as described herein, nucleic acid variants have at least 60%, 70%, 75%, 80%, 85%, 90%, 91%, 92%, 93%, 94%, 95%, 96%, 97%, 98%, or 99% sequence identity as compared to a nucleotide sequence set forth in SEQ ID NOS:1-383.

Typically, the genome of the bacteria of the genus *Lactobacillus* of the composition of this aspect comprises a nucleic acid encoding an amino acid sequence set forth in SEQ ID NOS:384-8828, or a fragment or variant thereof.

In typical embodiments as described herein, protein fragments comprise at least 1%, 2%, 5%, 10%, 15%, or 20%, more typically at least 25%, 30%, 35%, 40%, 45%, or 50%, even more typically at least 55%, 60%, 65%, 70%, 75%, 80%, 85%, 90%, 91%, 92%, 93%, 94%, 95%, 96%, 97%, 98%, or 99% of an amino acid sequence set forth in SEQ ID NOS:384-8830.

In typical embodiments as described herein, protein variants have at least 60%, 70%, 75%, 80%, 85%, 90%, 91%, 92%, 93%, 94%, 95%, 96%, 97%, 98%, or 99% sequence identity as compared to an amino acid sequence set forth in SEQ ID NOS:384-8828.

In a typical embodiment, the genome of the bacteria of the genus Lactobacillus of the composition of this aspect comprises a nucleic acid comprising a nucleotide sequence set forth in SEQ ID NOS:1-160, or a fragment or variant thereof. Typically, the bacteria is of the species Lactobacillus paracasei.

In a typical embodiment, the genome of the bacteria of the genus Lactobacillus of the composition of this aspect comprises a nucleic acid comprising a nucleotide sequence set forth in SEQ IN NOS:161-292, or a fragment or variant thereof. Typically, the bacteria is of the species Lactobacillus buchneri.

In a typical embodiment, the genome of the bacteria of the genus Lactobacillus of the composition of this aspect comprises nucleic acid comprising a nucleotide sequence set forth in SEQ IN NOS:293-393, or a fragment or variant thereof. Typically, the bacteria is of the species Lactobacillus casei.

In a typical embodiment, the genome of the bacteria of the genus Lactobacillus of the composition of this aspect comprises a genome encoding an amino acid sequence set forth in SEQ ID NOS:384-3504, or a fragment or variant thereof. Typically, the bacteria is of the species Lactobacillus paracasei.

In a typical embodiment, the bacteria of the genus Lactobacillus of the composition of this aspect comprises a genome encoding an amino acid sequence set forth in SEQ ID NOS:3505-6021, or a fragment or variant thereof. Typically, the bacteria is of the species Lactobacillus buchneri.

In a typical embodiment, the bacteria of the genus Lactobacillus of the composition of this aspect comprises a genome encoding an amino acid sequence set forth in SEQ ID NOS:6021-8828, or a fragment or variant thereof. Typically, the bacteria is of the species Lactobacillus casei.

It will be understood that compositions of this aspect may further comprise any other suitable microorganisms, including microorganisms that are, or are not, bacteria of the genus Lactobacillus.

In embodiments, the composition of this aspect further comprises a lactic acid-producing bacteria (LAB), such as a Lactobacillus or Pediococcus species.

In embodiments, the composition of this aspect further comprises an acetic acid-producing bacteria, such as an Acetobacter species. In an embodiment wherein the composition comprises an Acetobacter species, the Acetobacter species is Acetobacter fabarum. In an embodiment, the Acetobacter fabarum species is Acetobacter fabarum strain Af15 as deposited with the National Measurement Institute, Australia, on 27 Oct. 2011 under Accession Number V11/022943.

In embodiments, the composition of this aspect further comprises a yeast, such as a Saccharomyces species or a Candida species. In an embodiment wherein the composition comprises a Candida species, the Candida species is Candida ethanolica. In an embodiments, the Candida ethanolica species is Candida ethanolica strain Ce31 as deposited with the National Measurement Institute, Australia, on 27 Oct. 2011 under Accession Number V11/022944.

It will be appreciated that the composition of this aspect may comprise any suitable concentration of microorganisms or bacteria, such as bacteria of the genus Lactobacillus.

It will be further appreciated that microorganisms and bacteria according to the composition of this aspect, such as bacteria of the genus Lactobacillus, may be live, dead, or inactivated microorganisms or bacteria. Unless the context requires otherwise, as used herein "live" bacteria or microorganisms will be understood to include viable and/or culturable bacteria or microorganisms, as will be understood by the skilled person.

Typically, at least a proportion of the microorganisms of the composition of this aspect, such as bacteria of the genus Lactobacillus, are live, viable, and/or culturable. Typically, at least about: 10%, 20%, 30%, 40%, 50%, 60%, 70%, 80%, or 90% of cells of the microorganisms of the composition of this aspect, such as bacteria of the genus Lactobacillus, are live, viable, and/or culturable.

It will be appreciated that live microorganisms, such as bacteria, within a composition such as the composition of this aspect may replicate and increase in concentration over time. Accordingly, it will be appreciated that concentration of microorganisms, such as bacteria, in the composition of this aspect may vary depending on when the concentration is assessed.

With the preceding in mind, to avoid doubt, the concentration of microorganisms, such as bacteria, as referred to herein may be concentration as measured: directly after production of the composition; directly before administration of the composition to an animal; or directly before addition of the composition to feed, inclusive of food and drink, for consumption by an animal, although without limitation thereto. In a typical embodiment, the concentration of microorganisms, such as bacteria, as referred to herein is concentration approximately twelve hours after production of the composition with the composition being stored at approximately room temperature.

In embodiments, total concentration of microorganisms of the composition of this aspect is at least about $10^5$ colony-forming units per millilitre (CFU/ml) or colony-forming units per gram (CFU/g), at least about $10^6$ CFU/ml or CFU/g, at least about $10^7$ CFU/ml or CFU/g, at least about $10^8$ CFU/ml or CFU/g, or at least about $10^9$ CFU/ml or CFU/g. In embodiments, total concentration of microorganisms is between about $10^5$ CFU/ml or CFU/g and about $10^9$ CFU/ml or CFU/g, or between about $10^6$ CFU/ml or CFU/g and about $10^8$ CFU/ml.

Typically, concentration of each microorganism of the composition of this aspect is at least about $10^5$ CFU/ml or CFU/g, at least about $10^6$ CFU/ml or CFU/g, at least about $10^7$ CFU/ml or CFU/g, at least about $10^8$ CFU/ml or CFU/g, or at least about $10^9$ CFU/ml or CFU/g. In embodiments, concentration of each bacteria of each microorganism is between about $10^5$ CFU/ml or CFU/g and about $10^9$ CFU/ml or CFU/g, or between about $10^6$ CFU/ml or CFU/g and about $10^8$ CFU/ml or CFU/g.

In embodiments, total concentration of bacteria of the genus Lactobacillus of the composition of this aspect is at least about $10^5$ colony-forming units per millilitre (CFU/ml) or colony-forming units per gram (CFU/g), at least about $10^6$ CFU/ml or CFU/g, at least about $10^7$ CFU/ml or CFU/g, at least about $10^8$ CFU/ml or CFU/g, or at least about $10^9$ CFU/ml or CFU/g. In embodiments, total concentration of bacteria of the genus *Lactobacillus* is between about $10^5$ CFU/ml or CFU/g and about $10^9$ CFU/ml or CFU/g, or between about $10^6$ CFU/ml or CFU/g and about $10^8$ CFU/ml or CFU/g.

Typically, concentration of each bacteria of the genus *Lactobacillus* of the composition of this aspect is at least about $10^5$ CFU/ml or CFU/g, at least about $10^6$ CFU/ml or CFU/g, at least about $10^7$ CFU/ml or CFU/g, at least about $10^8$ CFU/ml or CFU/g, or at least about $10^9$ CFU/ml or CFU/g. In embodiments, concentration of each bacteria of the genus *Lactobacillus* is between about $10^5$ CFU/ml or CFU/g and about $10^9$ CFU/ml or CFU/g, or between about $10^6$ CFU/ml or CFU/g and about $10^8$ CFU/ml or CFU/g.

Typically, the composition of this aspect is a liquid composition. More typically, the composition is an aqueous composition, although without limitation thereto.

In some embodiments, the composition may be a solid composition. In embodiments, the solid composition is a powder composition. In some embodiments, the solid composition is in compacted form, such as a pellet or feed biscuit.

It will be appreciated that the composition of this aspect may include any suitable other ingredients, elements, agents, or components. Suitably, in embodiments wherein the composition is a liquid composition, the composition will comprise a liquid solvent. In embodiments wherein the composition is an aqueous composition, the composition will comprise water.

In embodiments, the composition comprises additional microbial components, such as additional bacteria, although without limitation thereto, as hereinabove described.

In embodiments, the composition comprises additional chemical components, such as one or more fillers, carriers, diluents, or excipients.

In a typical embodiment, the composition of this aspect comprises sugar or a sugar syrup. Typically, the sugar or sugar syrup is molasses.

In embodiments, the composition comprises sugar or sugar syrup, typically molasses, at a concentration of at least about 1% weight per weight (w/w) or volume/volume (v/v), such as at least about: 2% w/w or v/v, 3% w/w or v/v, 4% w/w or v/v, 5% w/w or v/v, 6% w/w or v/v, 7% w/w or v/v, 8% w/w or v/v, 9% w/w or v/v, or 10% w/w or v/v. Typically, the sugar or sugar syrup is at a concentration of between about 3 and about 7% w/w or v/v, more typically about 5% w/w or v/v.

In embodiments, the composition of this aspect comprises an acid, typically an organic acid such as humic acid or fulvic acid. In an embodiment, the composition comprises fulvic acid.

In embodiments, the composition comprises an acid, typically an organic acid such as humic acid or fulvic acid, more typically fulvic acid, at a concentration of at least about 0.1% w/w or v/v, such as at least about 0.2% w/w or v/v, 0.3% w/w or v/v, 0.4% w/w or v/v, 0.5% w/w or v/v, 0.6% w/w or v/v, 0.7% w/w or v/v, 0.8% w/w or v/v, 0.9% w/w or v/v, or 10% w/w/ or v/v. Typically, the acid is at a concentration of between about 0.2% w/w or v/v and about 0.6% w/w or v/v, more typically about 0.4% w/w or v/v such as 0.38% w/w or v/v.

Compositions provided according to this aspect of the invention are typically for, suitable for, or when used for administration to an animal. The animal may be any suitable animal, as set out in further detail hereinbelow. Typically, the animal is a farm or livestock animal, more typically a ruminant farm or livestock animal. In typical embodiments, the animal is selected from the group consisting of cattle, sheep, and goats. More typically, the animal is cattle. In a typical embodiment, the cattle is a calf.

Typically, compositions provided according to this aspect are for administration to an animal to improve or enhance one or more characteristics of the animal. The characteristic may be any suitable characteristic, as set out in further detail hereinbelow. Typically, the one or more characteristics are selected from the group consisting of nutrition, growth, development, and productivity. In one typical embodiment, the characteristic is productivity for meat production. In one typical embodiment, the characteristic is productivity for milk production.

As hereinabove described, compositions of this aspect typically comprise live microorganisms, such as bacteria of the genus *Lactobacillus*. However, in some alternative embodiments the microorganisms, such as bacteria of the genus *Lactobacillus*, may be provided in predominantly dead or inactivated form. For example, in some alternative embodiments, the microorganisms, such as bacteria, of the composition may be substantially inactivated by heat or irradiation or other suitable treatment.

Additionally, although less typical, a related aspect of the invention provides a composition derived from the composition as hereinabove described, wherein microorganisms, such as the bacteria of the genus *Lactobacillus*, are substantially removed. By way of non-limiting example, a composition according to this related aspect may be or comprise a culture filtrate of the composition of the aspect hereinabove described.

Another aspect of the invention provides a method of supplementing an animal, such as supplementing the diet or nutrition of an animal, including a step of administering a composition comprising a bacteria of the genus *Lactobacillus* to the animal.

Still another aspect of the invention provides a method of improving or enhancing one or more characteristics of an animal, including a step of administering a composition comprising a bacteria of the genus *Lactobacillus* to the animal.

Typically, the composition administered to the animal according to the method of the above aspects is the composition of the preceding aspect.

The animal to which the composition is administered according to the method of the above aspects may be any suitable animal. Typically, the animal is a non-human animal. Alternatively, the animal may be a human. In embodiments, the animal is selected from the group consisting of livestock, including horses, mules, cattle, sheep, goats, buffalo, oxen, llamas, alpacas, and camels; poultry, including ducks, chickens, turkeys, geese, guinea fowl, and pigeons; companion animals, including dogs, cats, rabbits, gerbils, hamsters, guinea pigs, fish, and companion birds; and sporting or performance animals, including racehorses, greyhounds, and racing camels.

Typically, the animal to which the composition is administered is a ruminant animal. As will be appreciated by the skilled person, ruminants are mammals typically of the taxon Ruminantia within the order Artiodactyla that, in general terms, are able to acquire nutrients from plant-based food by a process including fermentation using specialised stomach structure.

In embodiments, the ruminant animal is selected from the group consisting of bovines, including anoa, auroch, banteng, bison, bongo, buffalo, cattle or cows, ox, eland, four-homed antelope, gaur, gayal, kéwel, kudu, kouprey, imbabala, nildai, nyala, saola, sitatunga, tamaraw, water buffalo, wisent, yak, and zebu; ovines, including argali, bighorn sheep, domestic sheep, mouflon, snow sheep, trinhorn sheep, and urial; caprines including ibex, tahr, bharal, chamois, domestic goat, goral, serow, markhor, mountain goat, muskox, takin, tur, and wild goat; and deer, including elk, barasingha, brocket, chital, huemul, moose, muntjac, pudd, caribou, taruca, and thamin.

Typically, the ruminant animal is selected from cattle, sheep, and goats. More typically, the ruminant animal is cattle. In a typical embodiment, the cattle is a calf.

Typically, the step of administering the composition to the animal according to the method of the above aspects includes administering the composition to the digestive tract of the animal. Typically, the composition is consumed voluntarily by the animal, whereby the composition is administered to the digestive tract of the animal.

In one typical embodiment, the step of administering the composition to the animal according to the method of the above aspects includes combining the composition with food for consumption by the animal.

In one typical embodiment, the step of administering the composition to the animal according to the method of the above aspects includes combining the composition with drink for consumption by the animal.

In one typical embodiment, the step of administering the composition to the animal according to the method of the above aspects includes combining the composition with a milk replacer for consumption by the animal.

Typically, the composition administered to the animal according to the method of the above aspects is administered in an amount of at least about 1 to at least about 100 ml or g per day, or at least about: 2, 3, 4, 5, 6, 7, 8, 9, 10, 15, 20, 35, 30, 35, 40, 50, 60, 70, 80, and 90 ml or g per day. More typically, the composition is administered in an amount of between about 5 and about 35 ml or g per day, such as about 10, 15, 20, 25, and 30 ml or g per day.

Typically, the bacteria of the genus *Lactobacillus* of the composition administered to the animal according to the method of the above aspects is administered in a total amount of at least about $10^5$ CFU per day, or at least about: $10^6$, $10^7$, $10^8$, and $10^9$ CFU per day. Typically, the bacteria of the genus *Lactobacillus* is administered in a total amount of between about $10^5$ and about $10^9$ CFU per day, such as about $10^6$ CFU per day, $10^7$ CFU per day, or $10^8$ CFU per day.

Typically, each bacteria of the genus *Lactobacillus* of the composition administered to the animal according to the method of the above aspects is administered in an amount of at least about $10^5$ CFU per day, or at least about: $10^6$, $10^7$, $10^8$, and $10^9$ CFU per day. Typically, each bacteria of the genus *Lactobacillus* is administered in an amount of between about $10^5$ and about $10^9$ CFU per day, such as about $10^6$ CFU per day, $10^7$ CFU per day, or $10^8$ CFU per day.

In typical embodiments of the above aspect providing a method of improving or enhancing one or more characteristics of an animal, the one or more characteristics that are improved or enhanced are selected from the group consisting of nutrition, growth, development, and productivity of the animal.

In a typical embodiment, the improved or enhanced growth of the animal is greater total weight relative to a corresponding animal not administered the composition. Typically, the greater total weight is at least about 5% greater total weight, or at least about: 6%, 7%, 8%, 9%, 10%, 15%, or 20% greater total weight.

In a typical embodiment, the improved or enhanced development of the animal is greater development of gut structure relative to a corresponding animal not administered the composition. In typical embodiments, the gut structure is rumen structure, such as duodenum, reticulum, and/or abomasum structure. In embodiments, the greater development of the gut structure is greater weight of the gut structure or a part thereof, such as at least 5%, 10%, 20%, 30%, 40%, 50%, 100%, 150%, or 200% greater weight of the gut structure of a part thereof.

In a typical embodiment, the improved productivity of the animal is improved meat production from the animal relative to a corresponding animal not administered the composition. Typically, the improved meat production is at least about 1%, 2%, 3%, 4%, 5%, 6%, 7%, 8%, 9%, 10%, 15%, or 20% greater meat production.

In a typical embodiment, the improved productivity of the animal is improved milk production from the animal relative to a corresponding animal not administered the composition. Typically, the improved milk production is at least about 1%, 2%, 3%, 4%, 5%, 6%, 7%, 8%, 9%, 10%, 15%, or 20% greater milk production.

In another less typical embodiment, the improved or enhanced characteristic of the animal may be a health characteristic. In embodiments, improved or enhanced health of the animal may be decreased scours relative to a corresponding animal not administered the composition. Incidence and/or severity of scours may be decreased by at least about 1%, 5%, 10%, 20%, 30%, 40%, 50%, 60%, 70%, 80%, 90%, or 100%.

A further aspect of the invention provides a supplemented animal produced according to the method of supplementing an animal as hereinabove described. Typically, the supplemented animal is a ruminant animal. More typically, the supplemented animal is cattle, such as a calf.

A still further aspect of the invention provides an animal with one or more improved or enhanced characteristics produced according to the method of improving or enhancing one or more characteristics of an animal as hereinabove described. Typically, the animal with one or more improved or enhanced characteristics is a ruminant animal. More typically, the animal with one or more improved or enhanced characteristics is cattle, such as a calf.

Yet a further aspect of the invention provides an animal product produced by or derived from the supplemented animal or the animal with one or more improved or enhanced characteristics according to the above aspects. The animal product may be any suitable animal product.

In embodiments, the animal product is food or a food product. In embodiments, the food or food product is selected from the group consisting of blood, bone, connective tissue, a dairy product, an egg or egg product, gelatin, cysteine, a meat or meat product, offal, oil, rennet, and whey. Typically, the food or food product is meat or diary. In embodiments, the diary product is selected from the group consisting of milk, cream, cheese, and yoghurt.

In embodiments, the animal product is a non-food product. In embodiments, the non-food product is selected from the group consisting of blood, bone, fibre, fur, lanolin, leather, manure, oil, and wool. Typically, the non-food product is leather or wool.

Still another aspect of the invention provides an animal feed comprising a composition as hereinabove described. The animal feed may be any suitable animal feed. Typically, the animal feed is a ruminant animal feed. The animal feed may be grass and/or hay or the like, such as silage or baleage; pelletised or compacted animal feed products; or liquid feed products, as are well-known in the art. In a typical embodiment, the animal feed is a milk replacer, typically adapted for feeding of calves.

Yet other aspects of the invention relate to the formulation of compositions as herein described, or components thereof.

One such aspect of the invention provides a composition as hereinabove described, or a component thereof, that has been freeze-dried. Typically, the freeze-dried composition or component will further include a cryoprotectant. In embodiments, the cryoprotectant comprises a milk product, such as a milk powder. In embodiments, the cryoprotectant comprises a sugar, such as a disaccharide sugar. Freeze-dried compositions, or components thereof, of this aspect may be in e.g. powder form, or in pellet, feed biscuit, or otherwise compacted form. The freeze-dried composition or component thereof may comprise other suitable ingredients, such as whey, sodium silico aluminate, maltodextrin, calcium carbonate, mineral oil, sodium bicarbonate, sodium chloride, molasses, vegetable protein, corn flour, and/or cellulose, although without limitation thereto.

Another aspect of the invention provides a composition as hereinabove described, or a component thereof, formulated under oil. Suitably, a layer of oil will be applied to constrain or prevent interaction, exchange, or reaction with an outside environment, such as air or water, with the composition or component thereof. Typically, the oil is a vegetable oil, although without limitation thereto.

Throughout this specification, the aim is to describe typical aspects and embodiments without limiting the invention as disclosed herein to any one aspect, embodiment, or specific collection of features. It will be appreciated that various changes and modifications may be made relative to the exemplary disclosure provided herein without departing from the present invention.

In this specification, the indefinite articles "a" and "an" are not to be read as singular indefinite articles or as otherwise excluding more than one or more than a single subject to which the indefinite article refers. For example, "a" microorganism includes one microorganism, one or more microorganisms, and a plurality of microorganisms.

In this specification, the terms "comprises", "comprising", "includes", "including", and similar terms are intended to mean a non-exclusive inclusion, such that a composition or method that comprises or includes a list of elements need not have those elements solely, and may well have other elements not listed.

Where used in this specification, the terms "consisting essentially of" and "consists essentially of" are intended to mean a non-exclusive inclusion only to the extent that, if additional elements are included beyond those elements recited, the additional elements do not materially alter basic and novel characteristics. That is, a composition or method that "consists essentially of" one or more recited elements includes those elements only, or those elements and any additional elements that do not materially alter the basic and novel characteristics of the composition or method.

EXAMPLES

Example 1. Controlled Study of Live Weight in Calves

Introduction

The long-term productivity benefits of improving health and growth of calves in the early stages of development is well documented. A double blinded, controlled, randomized study was conducted to evaluate the efficacy of an exemplary composition as described herein, referred to as "TgM-LB3" on the live weight of pre-weaned dairy calves.

TgM-LB3 Composition

TgM-LB3 as used for this study had the following composition: *Lactobacillus paracasei* strain T9 (Accession Number V12/022849) 10 million CFU per mL ($10^7$ CFU/ml), *Lactobacillus buchneri* strain Lb23 (Accession Number V11/022946) 10 million CFU per mL ($10^7$ CFU/ml), *Lactobacillus casei* strain Lz26 (Accession Number V11/022948) 10 million CFU per mL ($10^7$ CFU/ml), isotonic saline at 0.85% NaCl w/v.

Study Design and Methods

Forty-four clinically healthy Friesian dairy calves (*Bos taurus*) of approximately 3 days of age were randomly split into two equal sized groups: Treated Group (22 calves); and Control Group (22 calves). Calves were housed in individual pens as part of a controlled study design to reduce the risk of cross contamination with commonly occurring health ailments.

All animals were tube-fed colostrum before reaching approximately one day of age. The feeding regime for all animals consisted of milk replacer (Norcovite®, Norco Australia) at 15% of their body weight, fed in a bucket twice a day, plus ad lib access to hay, grain pellets (Calf Starter Crumbles®, Norco Australia), and clean water through the entire period of the Study. With exception to Monensin, there were no feed additives or antibiotics added to the feed.

TgM-LB3 was added to the milk replacer of the Treated Group. A control composition (TgM-Placebo) containing isotonic saline at 0.85% NaCl w/v was added to the milk replacer of the Control Group. Assessments were conducted fortnightly through the study, the assessments concluding when calves reached 56 days of age. At the end of the study, tissue and organ samples were taken from 3 calves in each Group after weaning, for measuring weights of key gastrointestinal organs.

Results

Figure 3:
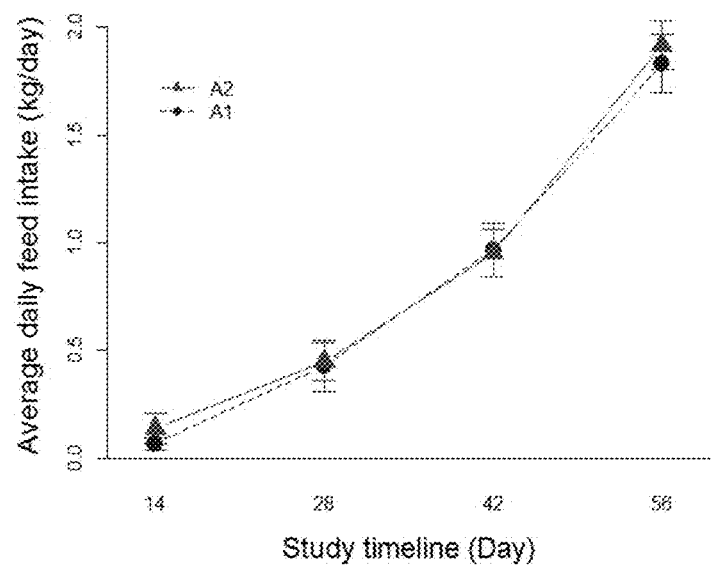
FIG. 3 sets forth line plots of average daily feed intake (kg/day) of Experimental Groups A1 (Control Group) and A2 (Treated Group) as a function of Study Timeline (Study Day), as per Example 1 herein. Error bars represent 95% confidence interval.
Figure 4:
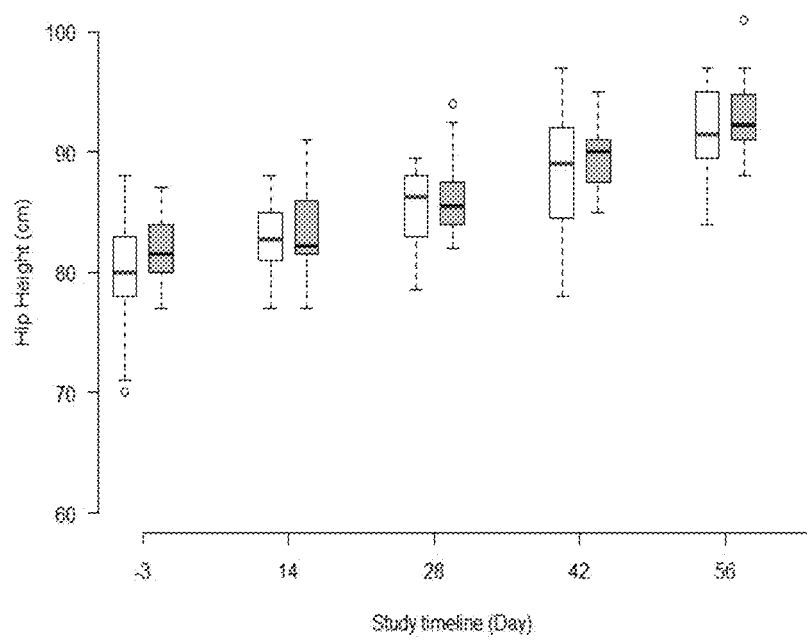
FIG. 4 sets forth box-of-whiskers plots of hip height (cm) of Experimental Groups A1 (white box with red horizontal band; Control Group) and A2 (grey boxes with blue horizontal band; Treated Group) as a function of Study timeline (Study Day), as per Example 1 herein.
Figure 5:
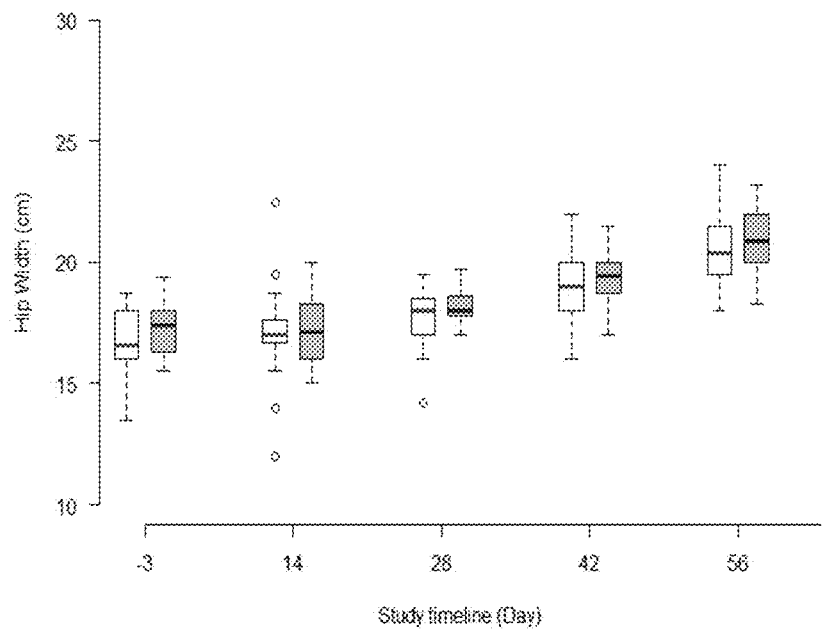
FIG. 5 sets forth box-of-whiskers plots of hip width (cm) of Experimental Groups A1 (white box with red horizontal band; Control Group) and A2 (grey boxes with blue horizontal band; Treated Group) as a function of Study Timeline (Study Day), as per Example 1 herein.
Figure 6:
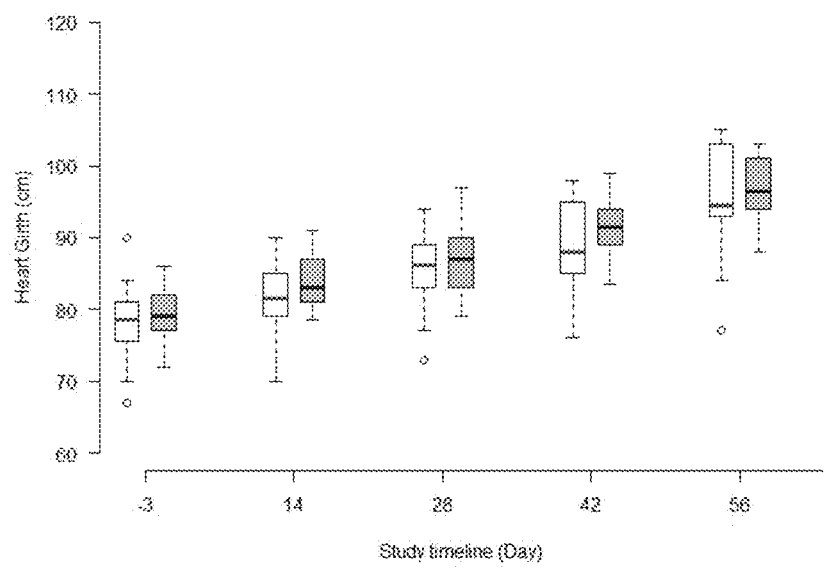
FIG. 6 sets forth box-of-whiskers plots of heart girth (cm) of Experimental Groups A1 (white box with red horizontal band; Control Group) and A2 (grey boxes with blue horizontal band; Treated Group) as a function of Study Timeline (Study Day), as per Example 1 herein.

Calves in the Treated Group were 8.4% heavier, and uniformity of live weights was better, at weaning age compared with calves in the Control Group ($p=0.02$); see FIG. 1 and Table 1. Average and total feed intake did not significantly differ between the groups; see FIG. 3.

Histological examination of the organ tissues of the gastrointestinal tract indicated that TgM-LB3 treated animals exhibited accelerated development of gut structures (Table 2). There was also an observed increase in the surface area of the lining of the gut (Table 3). On average, rumen and intestinal organs folding and crypts in Treated Group calves were greater in length and more dense than in Control Group calves.

Conclusion

Calves in the Treated Group were heavier at weaning (56 days) and had increased development of gastrointestinal tract organs compared with calves from the Control Group. Average and total feed intake did not differ between the groups.

Example 2. Field Trials Assessing Live Weight in Calves

Introduction

Two separate trials were conducted on a commercial dairy farm near Mt Gambier, SA, Australia, running a herd of 650 milking cows. At this dairy, calves are normally grown for a period of 70-90 days or until achieving weaning weights of approximately 120 kg per head. Weaner calves are either kept for future milker replacements or dispatched to other farms for beef production.

Over the calving period, traditionally the first two pens of calves through the operation show good health and growth. The third group onwards are commonly seen to have poorer health and restricted growth rates. The opportunity to run two separate groups one after the other, from the challenging third group onwards, has allowed for performance of a typical composition described herein, referred to as "Mylo", and animal health input costs, to be assessed.

Aim

The trials aimed to determine the effect of Mylo, an exemplary feed supplement as described herein, on the weaning weight of calves, and to observe differences in health indicators of those calves.

Mylo Composition

Mylo as used for this study is prepared as an aqueous solution as follows:
0.38% fulvic acid
5% molasses
$1 \times 10^6$ CFU/mL of each of *Lactobacillus paracasei* strain T9 V12/022849, *Lactobacillus buchneri* strain Lb23 V11/022946, and *Lactobacillus casei* strain Lz26 V11/022948.

The solution containing the above is left to expand overnight at room or ambient temperature of ~23° C.

Design

Each trial used a total of approximately 30 calves (heifers and bulls), divided into two groups of approximately even number. The Treated Groups were given Mylo as a feed supplement and the Control Group was not given Mylo. Each Group was penned then ran in calf paddocks separately for ease of handling and feed management.

Trial Feeding

Calves in the Treated Groups were given 10 mL per day equivalent of Mylo, as an additive to their daily calf milk from the age 4 days to weaning. Control Groups were given the same feeding regime except no Mylo was added to their milk.

Assessment

Calves were weighed close to weaning and ages were recorded. For comparison of weights between groups, live weights were corrected for calf ages at the time of weighing. Average growth rate was estimated after deducting 38 kg (average birth weight) from the live weight of each calf. General health condition of calves was observed and recorded.

Results and Observations: Trial 1

Figure 7:
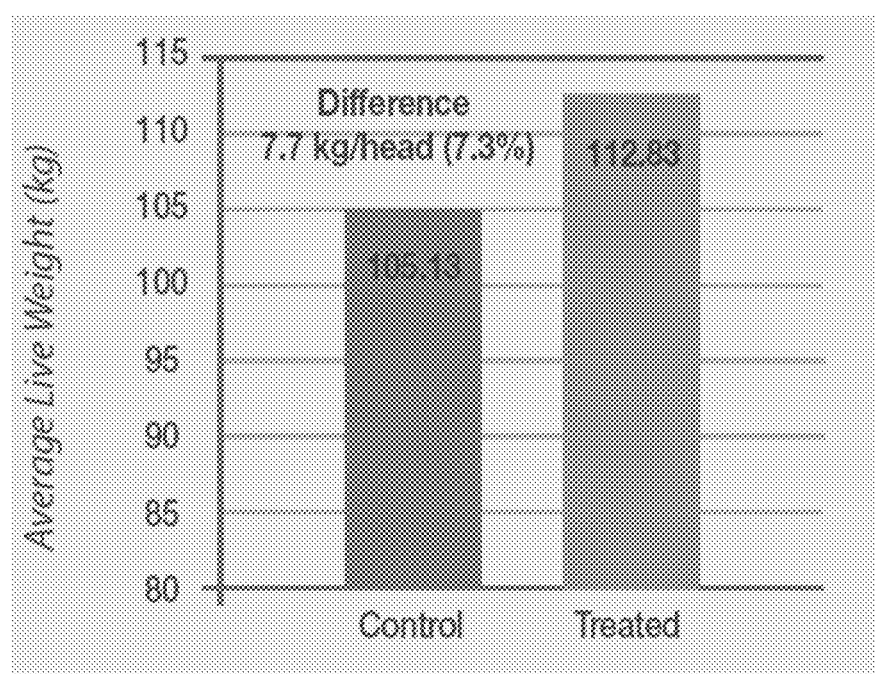
FIG. 7 sets forth average live weight (82 days old) of Control versus Mylo Treated groups, as per Trial 1 of Example 2 herein.

Average live weight of the Treated Group was 7.7 kg/head (7.3%) higher than the Control Group (FIG. 7; Table 4). Furthermore, live weights were taken again after 14 days for five of the calves from the Trial Group who weighed less than 120 kg at the time of the initial weighing. During the 14-day period, these calves recorded an average growth rate of 1310 g per day.

Figure 8:
FIG. 8 sets forth images of stages of growth and improvement in health of calf #6949, as per Trial 1 of Example 2 herein.

After the first few weeks of adding Mylo to the feed of the Treated Group, the farm owners observed many notable differences in health indicators compared to the Control Group: reduced scours, visually more energy, improved appearance and more aggressive feeding. One particular calf (#6949), in the Treated Group had an early set back with a heavy case of scours and was in very poor condition. This animal was given 30 mL of Mylo per day for 3 days, compared to the standard amount of 10 mL per day. Having subsequently made a significant improvement in condition this calf recorded the heaviest live weight in the Treated Group, weighing the equivalent of 118 kg at 82 days of age. Stages of this calf's growth and improvement in health over the trial period are shown in FIG. 8.

Results and Observations—Trial 2

Figure 9:
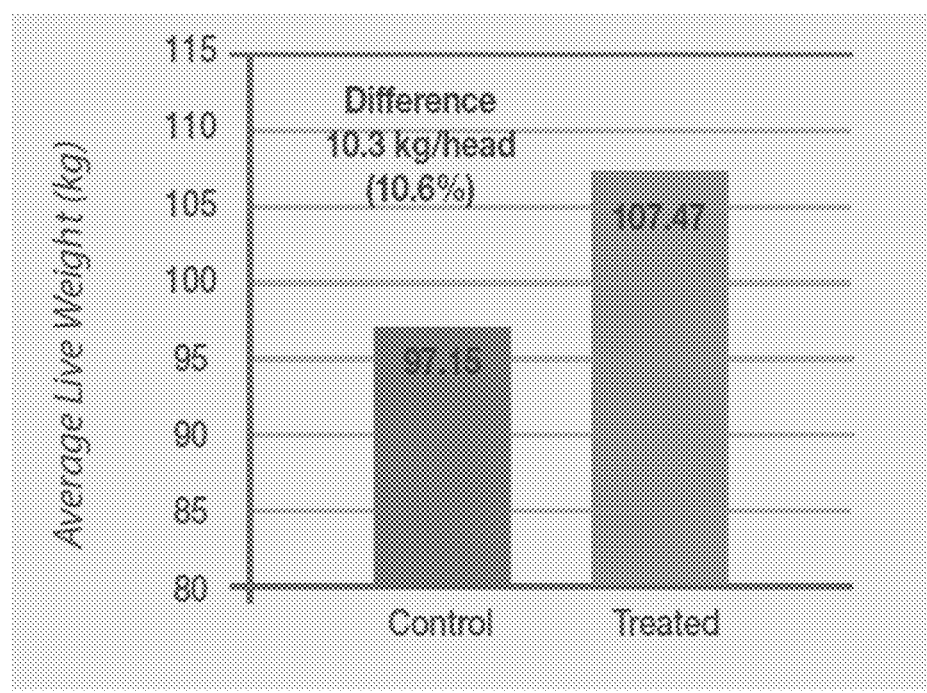
FIG. 9 sets forth average live weight (84 days old) of Control versus Mylo Treated groups, as per Trial 2 of Example 2 herein.

Average live weight of the Treated Group was 10.3 kg/head (10.6%) higher than the Control Group (FIG. 9; Table 5). After the first few weeks of adding Mylo to the feed of the Treated Group, similar observations were made as reported in Trial 1—that is, reduced scours, visually more energy, improved appearance and more aggressive feeding.

An evaluation and comparison of health input costs for the two Groups in this trial was performed, to assess economic benefits of providing Mylo as a feed supplement to improve calf health (Table 6). The Treated Group health costs were AU$16 per head less than the Control Group while the Treated Group achieved 17.4% (123 g/day) superior growth rate, or more than 10% better average live weight by the end of the trial.

Conclusion

A key implication of higher live weights recorded in this study is that calves given Mylo are estimated to reach the target 120 kg live weight at least 10 days earlier than the Control Group. Subsequent savings in feed costs, management time, and health costs are expected to be significant. Furthermore, better development of the gastrointestinal organs, as determined by the controlled study described in Example 1, is expected to confer advantages in health and productivity through maturity.

Example 3. Further Field Study Assessing Live Weight in Calves

Introduction

A trial was conducted on a commercial dairy farm near Meningie, SA, running a herd of 600 milking cows. At this dairy, calves are normally grown for a period of 70-90 days or until achieving weaning weights of approximately 85 kg for Wagyus and 100 kg for Friesians.

Aim

The trial aimed to determine the effect of Mylo on the weaning weight and growth rate of calves, and to observe differences in calf health indicators.

Design

The trial used a total of approximately 17 calves (heifers and bulls), divided into two groups of approximately even number. The Treated Groups were given Mylo as a feed supplement and the Control Group was not given Mylo.

Trial Feeding

Calves in the Treated Groups were given 10 mL per day equivalent of Mylo.

Assessment

Calves were weighed close to weaning and ages were recorded. For comparison of weights between groups, live weights were corrected for calf ages at the time of weighing. The individual birth weights were measured and used for calculating individual gains of each calf.

Results and Observations

Figure 10:
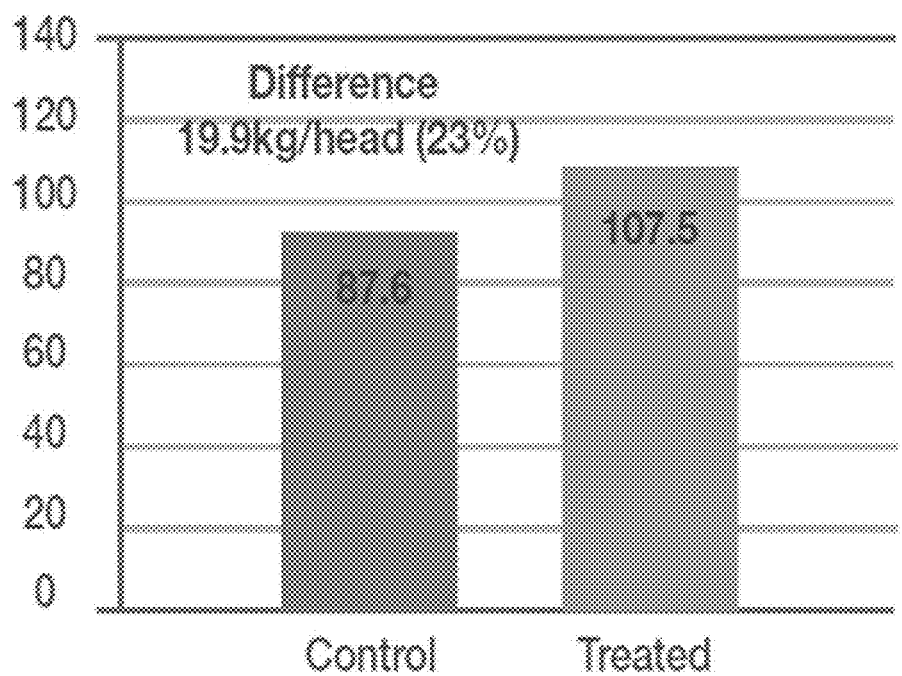
FIG. 10 sets forth average live weight (88 days old) of Control versus Mylo Treated groups, as per Example 3 herein.
Figure 11:
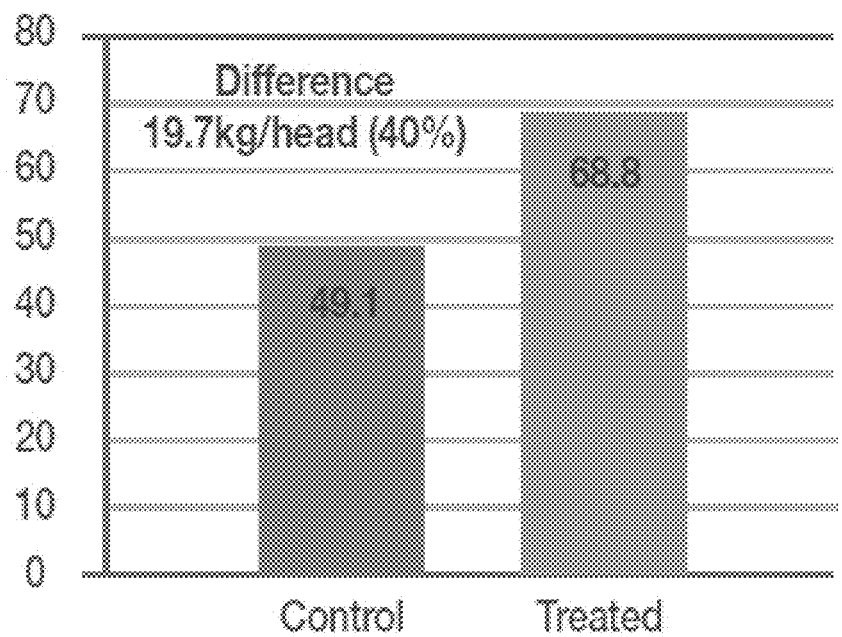
FIG. 11 sets forth average weight gain (88 days old) of Control versus Mylo Treated groups, as per Example 3 herein.
Figure 12:
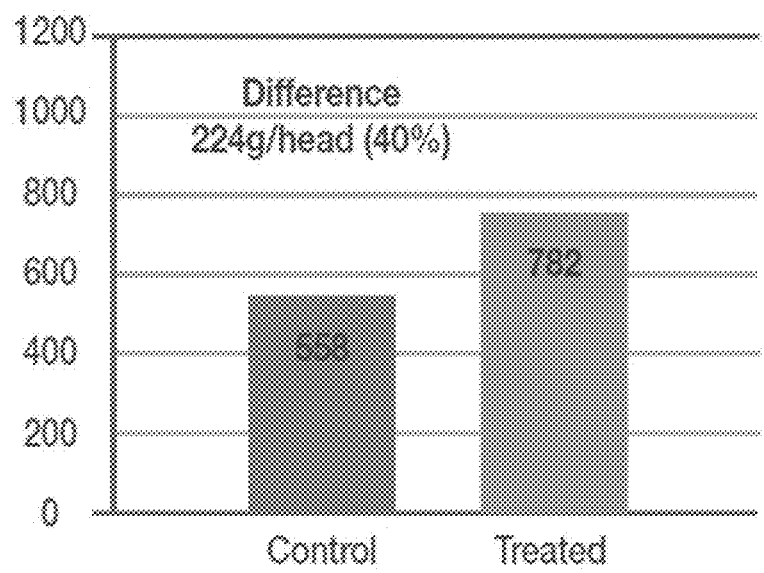
FIG. 12 sets forth average daily weight gain over 88 days of Control versus Mylo Treated groups, as per Example 3 herein.

Average weights and gains recorded for the two groups are shown in FIGS. 10-12. During the trial neither group had received additional animal health treatments. There were noticeable cases of scouring throughout the Control Group unlike the Mylo Treated Group that exhibited no scouring. The difference in scouring incidence may have had a positive effect on the Mylo Treated Group that showed higher weight gain when compared to the Control Group. Calf rearing staff had also noticed significant increase in aggressive feeding habit in the Mylo Treated Group. The calves were more active in nature and the feeding timelines were reduced.

While the difference in daily gain between treatment groups was large, so too was the variability. However, this positive effect on calf weight gain in this trial is consistent with that of previous studies presented herein:
- Gains in weaning weight transfer to benefits in earlier maturity and improved productivity
- Significant reduction in weaning timeline helps to reduce costs associated with fresh milk, milk powder and on farm staffing inputs
- Benefits observed in calf health, and reduced costs of health treatment, add further to the gains in weight Notably, based on positive observations made while conducting the trial, the manager of the dairy decided to treat all remaining and newborn calves with Mylo in place of a previously used powder supplement. In addition to efficacious results, it was considered that Mylo offered benefits due to its easy liquid form and reduced risk of overdosing animals.

Timeline to Target Weaning

Based on the results of this trial, estimated time to weaning was calculated (using extrapolation from average weight gain) for Friesian and Wagyu cattle. Results are presented in Table 7.

Example 4. Alternative Formulations

Formulation details for one typical composition as described herein, referred to as Mylo, are provided in Example 2.

Although Mylo as described in Example 2 is considered particularly desirable in the context of at least some aspects of the present invention, variations of the Mylo formulation may also be desirable.

One variation that may be desirable can be referred to as "Mylo-T9".

Mylo-T9 is prepared as an aqueous solution as follows:
0.38% fulvic acid
5% molasses
$1 \times 10^6$ CFU/mL of each of *Lactobacillus buchneri* strain Lb23 V11/022946, and *Lactobacillus casei* strain Lz26 V11/022948.

The solution containing the above is left to expand overnight at room or ambient temperature of ~23° C.

Another variation that may be desirable can be referred to as "Mylo-fulvic acid"

Mylo-fulvic acid is prepared as an aqueous solution as follows:
5% molasses
$1 \times 10^6$ CFU/mL of each of *Lactobacillus paracasei* strain T9 V12/022849, *Lactobacillus buchneri* strain Lb23 V11/022946, and *Lactobacillus casei* strain Lz26 V11/022948.

The solution containing the above is left to expand overnight at room or ambient temperature of ~23° C.

Example 5. Freeze Dried Compositions

It is considered advantageous in some circumstances to prepare and/or store compositions as described herein, or components thereof, in freeze-dried form.

For this purpose, *Lactobacillus* species may be freeze-dried separately or together. A freeze-drying cryoprotectant is typically used, such as powdered or skimmed milk and/or sugar such as a disaccharide (e.g. sucrose).

The freeze-dried composition may be in powder form, or in the form of a pellet or biscuit. It may be rehydrated in a liquid such as water or milk before use, or added into feed directly. The freeze-dried composition may contain other ingredients such as whey, sodium silico aluminate, maltodextrin, calcium carbonate, mineral oil, sodium bicarbonate, sodium chloride, molasses, vegetable protein, corn flour, cellulose.

Freeze-dried compositions may be particularly desirable for relatively long-term storage and/or transport purposes.

Example 6. Compositions Under Oil

It is considered advantageous in some circumstances to prepare and/or store compositions as described herein, or components thereof, under oil.

For this purpose, *Lactobacillus* species may be placed under oil separately or together, alone or in combination with other components, such as molasses. The composition, or components thereof, may be stored at increased concentration, relative to the composition as administered, or at a concentration for direct administration.

It will be appreciated that if individual components, including *Lactobacillus* species or other components, are stored under oil individually, the components will be mixed to produce a composition prior to or during administration. It will be further appreciated that if the composition or individual components thereof are stored under oil at increased concentration, dilution will be performed prior to or during administration.

The oil used for storage as described in this example will suitably be an oil that is tolerable or acceptable given the intended use of the composition for administration to animals, typically ruminant animals such as cows and calves. Use of vegetable oil is considered appropriate.

Storage of compositions or components thereof under oil may be particularly desirable for relatively long-term storage and/or transport purposes.

TABLES

TABLE 1

Weaning weight at 56 days as per Example 1.

| | Average (kg) |
|---|---|
| Control Group (A1) | 69.18 kg |
| Treated Group (A2) | 75.01 kg |
| Difference Treated-Control | 5.83 kg, 8.4% ($p = 0.02$) |

| Autopsy Results | Treated Group Average Weight (g) | Control Group Average Weight (g) | Difference |
|---|---|---|---|
| Duodenum with digesta | 87 g | 33 g | 54 g, 163% ($p < 0.05$) |
| Abomasum without digesta | 450 g | 390 g | 60 g, 15% ($p = 0.05$) |
| Reticulum without digesta | 357 g | 257 g | 100 g, 39% ($p = 0.05$) |

TABLE 3

Rumen and intestinal organ fold density and length as per Example 1.

| | Control Group (n = 3) | | | Treated Group (n = 3) | | | |
|---|---|---|---|---|---|---|---|
| Variable | Mean (SD) | Median (Q1, Q3) | Min, Max | Mean (SD) | Median (Q1, Q3) | Min, Max | P value |
| Tissue fold density | 1.5 (0.5) | 2.0 (1.0, 2.0) | 1.0, 2.0 | 2.1 (0.8) | 2.0 (2.0, 3.0) | 1.0, 3.0 | 0.09 |
| Tissue fold length | 1.3 (0.5) | 1.0 (1.0, 2.0) | 1.0, 2.0 | 1.8 (0.8) | 2.0 (1.0, 2.0) | 1.0, 3.0 | 0.03 |

Experimental Group

Key:
SD—Standard Deviation,
Q1 & Q3—First and Third Quartiles,
Min—Minimum,
Max—Maximum

TABLE 4

Weight at 82 days as per Trial 1, Example 2.

| | Head | Average Live Weight (kg) | Estimated Average Growth Rate (g/day) |
|---|---|---|---|
| Control Group | 16 | 105.13 | 819 |
| Treated Group | 14 | 112.83 | 913 |
| Difference: Treated-Control | | 7.7 kg (7.3%) | 94 g/day (11.5%) |

TABLE 5

Weight at 42 days.

| | Head | Average Live Weight (kg) | Estimated Average Growth Rate (g/day) |
|---|---|---|---|
| Control Group | 16 | 97.15 | 704 |
| Treated Group | 17 | 107.47 | 827 |
| Difference: Treated-Control | | 10.3 kg (10.6%) | 123 g/day (17.4%) |

TABLE 6

Health costs evaluation. Values in Australian dollars.

| Health Supplements and Treatments | Control Group | | Treated Group | |
|---|---|---|---|---|
| | Head | Cost | Head | Cost |
| Mylo Feed Supplement $0.125/head/day for 84 days | 16 | — | 17 | $178.50 |
| Trisoprim (Antibiotic Treatment) 5 mL × 5 days at $0.20/mL | 5 | $25.00 | 1 | $5.00 |
| Scourban (preventative): 30 mL per dose. Twice/day × 3 days at $0.14/mL | 16 | $403.20 | 0 | — |
| Total Health Cost-by Group | | $428.20 | | $183.50 |
| Total Health Cost per Calf | | $26.80 | | $10.80 |

TABLE 7

Estimated time to weaning.

| Breed | Target Weight | Treated Group | Control Group | Days to Achieve Target Weight |
|---|---|---|---|---|
| Friesian | 100 kg | 76 days | 106 days | Treated Group 30 days quicker |
| Wagyu | 85 kg | 65 days | 89 days | Treated Group 24 days quicker |

SEQUENCE LISTING (8828 sequences)

SEQ ID NO: 1 - DNA, 19025 bp, Lactobacillus paracasei
gatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggcctataagttgttaacttgctagtgataaaaagttggattaacaaaaaagcatcctttccggtaaatttttgcggaaaggatgcttttttattaaatgcgattcaagacttgtaacgcgctaggcaatcccctcaatataaggcgccggacgctgaaagttttgatgaatactgctataaatgacccgaacagctttgtcgtaatcaagatcatgtacgccgattagcaaattgatatcgtcattggtctgactaacgagttgtacgttgagcaggttatcatccagataagcgaggacttttccggcaatggctggtcgttgtcgaagtttacgagaaaccatggcgattaacgcaacattttcggtgacttccattttgtctggttgacaggcagcggcgatttcagcggtcagctcctgtaccgagacttgatgacgcggttcacgaatgagcagactgaaactgtcaatgcccgtgggcagataatcgacaacgagatggtgcgctgcaactactccgagcgcatgttgaataacttctaagtgcaaggccagctggtacttgcggaccgtgataaccaaataatgtttacggccagcaataccagtgattgttttgagatcattggcggggtcatcatcatgaatgatcagcgtgcctgggtcttctggcgcattggtgttcaaaatacgcgtcgggatgccacattcacggaccggttgcaccgcttcttcttggaaaacactaaatcccatgtaggtgagttcgcgtaattcgtcgtaactcatcacatcaatactgtcggcatctttaatgatacgtggatcggccattttaatgcctgaaacatcggtccaattttcatagagatcagcgtgggccaagcgtgctagccatgcaccagaaatgtcagaaccgccgcgcggcatcagcttgacatgtccgtctgcgtcgcgaccataaaaaccgggaacgacgataccatgatggctggctagttgttgataagcagtctgagttttggcttcatcaatggcgcctgctttattgaaaaacaaaagattggcggcgtccacaaaagtatagcctaagtaggctgccattaagtgggctgtcaagaactcaccgcgagagaccagatagtctcgagaatagcgaatggccagatgatggcgaattgtatgcaacagtttgatgagcggcacattgagctgcagcgcaatgttgatggcctctagccgagccaagacctgattaaacagcggttcgacatctcgaccggcttccatgccgtcagcaattaaatagagcgtatcagttaattttcgggtagcattaccatattttccagctgcgctaatcacgatgatttgccgattcgcatcctgatcgattatggctttaactttctggaattgaccggcatcggccacggaactaccgccaaatttaacgaccttcatccgatcacctcctgatcttgctggtgaaggacgtctttagcagccaactcactgtctccgattgctgccataaaagcatcggcatcaatggccaaaacgccgcgcatgagtttgtgcatgtcgccagttggtatttgcttgatcaccagccggtcattgacgatctcggtttcgcgatcattgaacatcgcgaaggtcatgggatcggcgcgcaaaacgtaatcggtgacattcaggttggcgtcaaaatgcagcggctgatcgaagctacggtccagatgcggggcattttcaaggatatcgtacagatcttgcacgatagcgttggctgtcgggtattttccggcgccttggccataaaattgcaggtcgccaatcgtttgtccatgcaggcgaattagattgaagttttcaaatgtattggccgccaaggcggtttctgaatacaagcgcggttccacgaccatactatagtggtcaccgtcacgtttacttttaccaatcaaccgtaaaacctgatgttgacttgcgaaaaagtcaatgtcggctttgctgacgttgcgaataccaaaagttgggacatcacgtggtggggccatgttgtaggcaagtgctgccgaaattttcagcttgttgaccacatcctcgccatcaatatcagcactgggatcggcttcggcatagcccatatctttagcggctaggagcacggggtcaaaatcgaggtgggcgcgttgcatctgatcgagaatataattgctagtgccattgaaaatgccttcgatggtatcgatctgatcaatgcgtgcggcgcgttcaaggttgcgaatccacgggatgccgccgccagtagtggcttcgaagtaaaattgcacgtgatgctgggcagcaacagcggtaaactccggcaaatatttagcgacaacggctttattagcggtaaccacgtgcttaccgtgctgcaaagcctgtaaaatataatcatgtgctggatgaagaccgcccattgtttcaacgatcacatcaatagtaggatcgtttaagatggcgtcaaggtctgttgtcatctcaggcatggtcgcagggtgcgttggccgaatgaaaatagcggtgacgcgcattcgggtatcaccatttgcaataatatcgtaaacgccgctgccgacagtcccaaaacctaagatggcaattttcataaattctcagctccttgtttataaaacatagacacttgtttttctgatgcgaacagattatcatatccatatcgttaattcaagccgaatgagataggagttcttcaaatgcgatatacgagcacacgggatcatcaggttagcaaaaccagcaaagaggcaatcaaacaaggtatttctgaagaaggcggtttgtttgtcctgccgcatttggccgatcagacgctgaacattcatgaactgttagatttagattatgaaacgattgctcagcgagttctcatgatcctgttgcctgattttaacaccgactcactaaaaaaagcgattcattttgcctatcatcagcatttttccgatgatcgcatcacgccagttcgttctgtcggggattttcatgtcttagagttatttcatggaccaaccagtgcctttaaggatgtcggcttgcagttgcttccgcgcttgatgcagttggcacttgatcctgatgatcgggtcatgattttagcggcaaccagcggtgatacgggaacggcggctctacaagggtttaaagatgtcgcgcagactgggatcacggttttctatcctaatcatggtgtcagtccaattcaggagcgccaaatgttaaccgtgggcagtgacaatacgcgagttttcccaattgctggcaattttgatcaggcccaaagcgcagtgaaaaccttgttcactgacactagctttgctgctcggttgcaggcagagcaagtaaccctgtcagcagccaattccatcaacattggccgactgattccgcaagttgtgtattattttgcagcgtacagccaactggttaaaacacaggccatttcaatgggagatgaggttaatttcactgttccaaccgggaattttggcgatgtgttggcgggctactatgctaagagtctaggcttgcctgtccataaactgatcgccgccgccaatgccaacagcgaattggctgattttctggcaaccggtgtgtatgatcgcaaccgaccgtttttgaaaacagtggcacctagcatggatattcaaatttccagtaatctggaacgcctgttgtattataagagtggcgaagatagcgcgtatgttgcgcatttaatgcaggaacttgagacgactggtcgctatcaagttcggccggatgtgttgaccgcgattcaagcggactttgctggcggttttgctgttgatgaagaggtggcagatgccattcgcgaggtttggcatcgggatgggtatttgctggatccgcacactgctgttggttatgcggttcaacagcagtaccgggcggcgtctggggataacaccccgaatgtgcttttagccaccgcaagcccttataaatttccacgcgtggtggccaaggcactacaatcgcacgtaccggatgatgactttgctgcgatgcaaatgttgcaacaggttagcggtgtgccgattccgccgaatcttgctcgccttcaacagctaagaccgcaggaaaagattgttgtggcaccaaccgatatgggccaagctattattggggcggcgaaggaggtattcaacgatgatcagcgtgtccgttccggcaacgagcgctaacttagcggttggctttgatgtgctgggacttgccttagatctcaaagctcattttacgtttgaaatgagcacccaaaagcttgagatcattggcgatgacccagctttcgccaatagtgagaacttgatttatcaggcgtttagcaaatttgccgaggcgattgatcagcctgttcctaatctgcggattgtggttgattcagcagtgccgagtgcccgcggtttgggcagttcagcaatatgtgtagttggtggtatcgccgctgctaatgcgtggtatcaagccggttgggatgatacggcgctgctgcgatttgctactgaaatggaaggccatccagataatgcggcaccagcgatttacgggcagctatgtgccacgatcatggcgcaaaatgaaccagtcgttcggcagtatacggtcagctcaaagttgcactttgtgaccttgatccctgactatgctgtcagtaccgctgatgcccgccgaattttaccgcgaaccatgacttatgcagatgctacctatcaaatgggccgttgtaccttgatgacccgggcactggctgatggcgacatgtcgttattacgccaagttgcgactgatcggatgcaggagccttaccgcgcggaattaataccagactattcagcggctcatcaagtggtgcagacggccggtggtgttcttttgatttctggttctggttcgaccatgctagcgatcacagcctcatctgcggcagccgcacagatacaagcgcaagctcaagaaagttggaaaaagtggcaagtacaggtggtggcgccaagccaacaaggcgtacaagttgaacagtttgagtgagtttcagaaaatactaggtagccatgacctagtattttttgattcatgattattgaaaaagtgttatggtatcctgacgcaagtgaacgtggtggggcattatggtataattcgggggcaacggacggaagctgattgataaaatcaacttcgcgtcttacaaaacgagtctaacgatgactgctgtcaataattgaatcggcagacaaggttttaaaatgaaaatttcaagacgcacagttgaccgaattcgcgtcttattgaacgaggagattatcattcagatgaaaaatgcacccagttttacccccatcctgcttggcagtgacatgaatgtgtatggtatggcgcgttcgttccacgagatgatcggtggggcgattgatgtttatgcgcgcgaacaacttgcgccaacgcgtttttcgcggatcgtgaatgtccatctgatcgagcattttgattccgatccgacttttattgaaaatatgcggcaggtagccaaggtacatgcagatgctccaggcaaactgttgttaatcgcttgcggggacacctatgcccaacttgtttccaaacataaggatgagttgagccagtggttcatctgtccatacgttgattatgaattgttgaagcgcctgaatagtaaggagagcttctatcaagtttgcgaagagtatcatttgccatatccggcaaccaaaatcgtcaccaagtcgatgtatgaaagcaacgcaaccatcacggcaccgtttgaatttccagtagcactcaagccgactgattccgttgaatggttgaacattcgctttgaaggtcgcaaaaaggcgtttacgattcactcgcaagttgaactgacgaatacgattgccaaaatctatgataacggctatacgtctgatctcatcttgcaggactttgtaccaggtgatgacagtaacatgcggactttgaactgttatgttgatcaatatcatcacgttaaaatgatgtgcttaggtcatccgctacttgaggatcctacgccttcttcaatcggtaactatgtcgcgatcatgccagctttcgatcaggatttgtacgatcagatcaaaacattcctcgaagcaattaagttcaccggttttgctaactttgatatgaagtatgatcatcgtgacaagacgttcaagctgtttgaaattaatattcgtcaaggccggagtagctttttcgtcactttaaatgggtataatcttgccagctggcctgttcgcgattacatcgtgggagatttgaaggacgcgccaacggtttatggtaatgatgaccacagcaagtataaattgtggctaggggttccagagcgtgttttcaagcagtattctgcagataacgaagctaaaaaggaagccttgcagttacttaaagagaaacgctatggtacgacggtcttttataaaccggacatgacattcaagcgctggttattgatgaaatatatgttccataattatgttggtcggtttaagcagtattttgcggaaaataagggcgacatgtgataaaatggcattgttagggatacctaaacttgcaagggggcatttcttttggttactgaagatgatttgacgattgaatccatgcattataaccggttgttattggcggttgatgatgatgatgacgactcctcgcgcaaggcattgaactacgcctgcacggttgccaagatttatgacattccgttggggatcgtgtcggtacttgaaaccggcgacctcaatattttccaatcattgacacctgatgatgttgatgcggcccgggaaacactggctaaggatctgaacacttacgtcgaaaaagcaacggcatttggcgttcaaaacgcacaaccgatcgttgcagaagggcggccagcagctgccattcttgacgaagtgatcccagccttcaaaccggatttggtgattatgggttctcatgttcgccgcggtcggttacgtcttggtcatgttgcgagcgaagttgctcgcgatgcatcggtctcggtgattatcgttcgctgatttcggtcaagtgcagcaaaaatgagcagtcgtaccgattcttcatggatcgttgcgactgctattttcatggcggccaacacccaacaaggggaggaagtaacgcatgtactaccaaaatgtcagcgtcgggcagctcatcaaacgggtgagtcgctttaccgttgaaattgacctgaatggcaccgtcgaacctgtccacatgaataataccggacgcaataaagaaattttgattccgggatcattagccagtgtccgctatgttgataacccaaatcgcaaaacgcactatgacttgctggctgttcaacggcaaggtcgctggatcaacatcgacagtctggcacccaatcatgttgccaaagaatgtttagaagctggcaccttaaaattgccgggactcgccttgccatacgccgttcatccagaatcgacttggcgcgattcgcgactggactttgctgggaaagccgctgatggccagtcgtggtttgttgaaacgaagggcgtcacgttggctaatggcaccctagcagctttcccagatgcgccaacaactcgcgccgtcaagcatgttcatacgctgacgatggcgcaggcagaagggtatcaggcatttttattgttcatcgtgcaattaccggatattcgccaaatgaccatttatcgggaccgttttcctgaactagtgactgccatcacgactgctaaacaaaatggcgttcgcgtgctggcttatgacaccatgactggcccagatcaaatcacattaggcaacgaaataccattcgacgaacacttgcctttttcagagattaatcttaacagcttgtgaataatgaaaaagatcccatctaaatttcatctatccttgactttcagagaagctcttaaaattcgagtcgctgattgtccctagcccataacctcatgcggatacgggctttttttgtgcgcatcaattgcagaacgtcatgtggtgcttaatggcggcgaaaatgaaaatgagattccgtgatttgaatcacacacaaactatctctagaatggatagcattgtttcaattcgatgacaaacgtttttcaaaacaaggagtgagtagatgcaacacaaagttgaaagtaatgccgagacaaaaattgaggttcgcgggctaaccaagattttcggtaagcgcgtgaatcgcgcgaaagaaatgttgaaggccggcaagaccaagcctgaaattttaaaagcaaccggcgcaacggttggtgttgatcgtgctgatttttcgattaaaaccggtgagatttttgtgattatgggactttccggttctggtaaatcaacgaccttacggatgctgaaccggttgattgaaccgacagacgggcaagtactgattgacggtgatgacattgccaaacttgataagcaggcattgcgtgaagttagacggcaaaagctcagcatggttttccaaggctttgccttactgccgaatcggaccgttctgcaaaatgctgcctttggacttgagattcaagggatggagaaagatgaacgcgagatgaaagccaacaaagcactcgatttggttggcttaaatggttttgccgatcaatatccagatcagttgtctggtgggatgcagcaacgtgttggtttagcccgcgcgctggctagcgatgccgaaattctgctgatggacgaagctttttcagcacttgatccgctgaatcgtcgcgatatgcaagatgaattattggacttgcaagaagatatgcaaaaaaccattgtcttcatttcgcatgacctcaacgaagcgctccgaattggcgatcacattatgattatgaaagatggcgaaatcgttcagattggcacgcctgaagaaattttgagccagcctgctgacgattatgttgagaaattcattgaaggtgttgatcgcagccaggtttatacggctgccaatgtgatgattcgggccaacacagtcaatattgatagagatggtcctcgtttggctgcacggcggatgcgggacaatgaaatttcaagtttgtatgttgtggatactaaacgtaaactcgtcggtattttggatgctgatgatgtgcggtcagctattgatgccggtcaaaaggatctgcgctcaattgttaagtccgatgtgccaacgactaaaatggatacgccgttggcagacttactagacgccgtttccaccacaccggtaccatttgcagtggtagacgatcatgatcgcttacgcgggatcatcattcgcggtgccgtcttaggtgcattatctggacaggaggtcaatgtcaatgtctaacattttaagcagcattcccacattaccattggcccactgggtcgattcatttgttacgtggttaacccagttttccggcttcttcggggttttaacgaacttcatcggcggcattgtgaatgctttccaagctgtttttgattttattcccatctggttattcatcatcctggtgctcgcgttaacttggtatctgaaacgcgaccagaaatatcgcagcttactgatttttgaattacttggtttactgttgatttggaaccttggtttctggcgtgacatgacccaaacgttaaccttagtgttgaccgcaagtttgttagcgattgtcatcggggttccgctgggaatttgggcggccgaaagcaagtcagtttccgcagtggtgaaaccattgatggacttcatgcagacgatgccggcctttgtttacctgattccagccgttgctttctttggtatcgggatggtacccggggttgtagcctcggttatcttcgcgatgccaccgacagttcgtatgacgcagcttggcattacgcaagtaccagctgatttaaatgaagcagcggtcgcatttggggcaactggttggcaacaattgttgaaggtgcagttaccgtttgcccgcggaaccattatggccgggatcaaccaaagtatgatgttggccctgtcaatggttgttattgcttcgatgattggtgcgatgggcttaggtacgaaggtttactttgcagtcggccgtaatgatgctggcggcggttttgtcgccgggcttgccatcgtgattttggccatcattcttgaccggatcacgcaaagtctcaatcgtagtcgttaggaggtggccgtttgacttttttgaaaaagattgccgcggcgctagcggtgttgatcacagtcggtgcacttgccgcctgcagcagcacacagcctaagtatgacgctaaagagccgctgggaccgcaaatcaattacaccattactgggattgatgctggcgctggggtcatgaccagtacagacaaagcgctgaaagcttatggtcttgtggataaaaagtggcagttgcaaccaagttccaccgccgctatgaccagtacgttgcaaaaggcgattgccgacaaacgtccgattgtggtcactggctggacgccgcactggatgttcaccaagtttccactaaagtttctcaaggatcctaaaaatgtttacggcaaaaccgaacagattcatacaatcgtgcggaagggccttaagcaggatgcaccgcaagcttatcaggtattagatcagttccactggacgcctgaagaaatgtccagtgtgatgctggcggtcaacggcggcaaggatcctgccgaggcagccaaagctttcgttaagaagcacccagaacaaatcgcacagtggaccaagggtgtgacgcatgttagcggcaaacctaaactgacgatgacctatattgcgtgggattcggaaatcgcatccaccaatgttgttgcaactgttttgcggcaaatagggtataacgtgacgattcgggcaatggaaccacaaccagtttgggcttcagttgcaactaaagctgccgatgctcaggtttctgcttggttaccgaatacgtcagcaaaactttattctgattataagaatcaagttgttgatcttggcgtgaacttagatggtgcaaaggtcggcttggcagtgccgaagtatatgaagaatattaatagtattgaagatttgaaataagtttgatgacggcgaatgctttccttgatatggggggttcgccgtttttttgttatgcgattgggcggtttagatgatgacggctaatcgagcggaagcttaggactaacattctttgccgtgccaaactccgcaatctccggccagatgtggcttgcgacgcggagctagagcgtgacggcgcttcgaacccaaagcccggtctcgaagtcgcctaacaacatcagcgacgaaacccggtcgctgtgttgtttgcacggctgagccccatctggcctacgattgctccgccttggcactggtatctttaaatctcaataaaattgatccatgagaataaggccaactatttcagctttgtatggaaattgtcgccttgttgttggctgtgaatgatgtcccaacctcacctcgtgctctgaacaaaataattgctttatgcctaaaacaaatctagtataaccgcgagagatattgaataacgcgctcgtcgtcgcagaagcccacatatgtgccgacttctaaacgtgcctgttcgcgctcactttttgggagggattcttatggtaaagaccattaaggctggtgtcgccgcgttgaagacacttgagagctggggtgtgacacatgtttacggaatccccggcggtacttttaacaatatgatgtatgcgctggatgaagagaaagacaatttaaagtatattcacgtccgacatgaagaggtcggtgcgctagctgcagtagcggatggtaaattgactgggcatattggcgtggcatttggatcagcgggacccggcgcaacccatctatttcaaggggcgtatgacgctaaaatggataaggtgccgacgttatttcttgtgggtcaagttgaacaacgcttcatgaattacgatttcttccaagagctggatgaagatccgatgtttcaagatgccgctttgtatgcgcggacggttaccacggcggctagtctgccgcatattattgacgaggctattcgccgtgcttatgccggccgtggagctgcgattgttgtgattcccaatgatttggcagccgaagaaattccagccgatggctactacagtgcagcagctacccacgccaccccagttttaccagctggcagcgacgagcaagtagatgcggcgttgcgcttaattggcgcagcgcaacggcccgtgatgtacgttggccaaggcgtccgtggggctgctgatacggtgatgacgctggcaagaaagctacagatgccagtcattacgacagcacttggcaagccgattatcccttacgaatttgaatcactgcttggttctgcagctcgggtggcttcaaaaccagcgaatgaagcgttgcgagttgctgacttgatcatgtttgtcggttcgaattacccgtttgctgaagtcatgttctcaccgaacgccaagtttattcagatcgaggcagattcgaagacattgggcaagcgccatcacacagatgttgccattttggcggatgctccggcaaccttgaagaaaatgattgatcgtagtgacgatgcaccacgcagcggctggtatcaagccaatgtcgacaacgtgaaaaattggcatcagtataatgacgatatgatgacccggacaaccgggaaaatgcgtttcgaaccagttttcggccaaattaaccgcattgctactgatgatgccatttttgcgattgatgtcggggatgttacccaaaatgctgtccggttactgaaagtcaatgggcgccaagcgtggaccactagtgggttgtttgccacgatgggcgctggattgccggccgcattagccggtcaattgagcttcccaaagcgacaggtctttaacctggctggggatggtgcagcggcgatggtgatgcaggacttggataccgaagtccgttatcatttgccaatcatcaatgtggtcttttcaaataatgcactagggtacattgaagatgagcaggaggacgatggtcacgagtggttcgggatcgacatgccagcgattgactttgcgacggttgcgaaaggcatgggtatgaccggcattactgtcacccaagttgacgaattaccagcggctttcgaaacagcagaagccaaccgggctgccggcaaaccaaccttgatcgatgccaaaatcaccaacgaacggccaattccagttgagcatctgcaactagatcctaaccagtttgacgcagacacgattgctgcgttcaagaagcgttactatgcggaaaaattggtaccgctgagtgaattcttgaagacacacaaggtgcctgtggcgtaactggtgatagaagaaagatgagtattaagcagtacggcgatggccgtgctgtttttagtcgctgtgttgccggcgattgagaaaggtgatttttcaagcgcaatacgtgtctagctgccttgaaaaaggtatcatatgataaaagtggtcatcgctgataaagaatatcatcgctttttgaccaattatctaatgagacggagtaaggaaaatgccttttgctgaagtgattatgaatcccagtgcggggaatgcccgctggaaaaagcaattacctgagttagttgcaatcattgagtctcactttgcgccactgcatattagtcagacgcgcaaggctggtgatgccaggttggtgaccgaacgactcatcaaggcttatcaacacaagatggacgatcttcaactgatcgtgattggtggtgatgggacgctacacgatgttgtgaatgggttgcagcgacaaggtcatccagaagtcgccattggctatgtgccaaccgggaccggcgatgattttgcccgcgccaaccatattcctctggacccgaaaaaagctgcggcggctttgacaacggcaatgccgcatgccttgaaaatcggggtggcagactcggccaagtacgggactcagtattttattaataactttggtattggcatggatgcacaaatcgtgtatcaaacaaaccattccgatcacaaggcggcattaaatgccctaaagcttggtcatctttcgtatgccgccagcattctgaaagcacttcggcaacagaaaagatttcccgcgacttggcaggcagacggtcaaggcatggcgatcgacaacgcttatctcaatgtttttaccaatcatccattcttgggtggcgggttgcgactgttcccaaataaagcagataatcgcagcaccttgtcttttgtccaggtgcatcgcgaaaaattgggcattttgcttcaggtgctgttcgccattctcagcggccgttccgttcaccgcgccatgcaccacgcacaaggtcagacatttgaattcgccacgtcagcaactgtgccgattcaaattgacggcgaagaatattcaaccccgattcaggtgacactgcaccaaaccaagaaactatttttgctgccaacttaaaaaagcgtgctagccgcctgcaacaaagacaagggtcagcacacttcatgaagttattttttgcgtaagaaaatcaattttgagaagagataattggcgatcacgatgatgacctgatctaaaattttgacgagaatctcattaccatgcagccaatcgaccccgatgatcatgatcaagttatccagcaacaaggagaccccacgcaacacaagaaagctgattaactcgaaccagaactttttcttacttgagtagtcactgtggaaaacgacacttttgttggcaaaaaaagcaaaaatgacactgacgatattcgccgttgtattggtcaaaactaggccaataccaaaataccgcatggcgaagaacgtgacaaagttaatcaacgtggtcaaaccaccgataaacaggtaattgatgatcatttcataacgcttatagagttgaaaaagcttcttcaaaacaggcgcctcctatgcaaactttcaatagtataccatggcaggtggggcatgtagaacttcaattgtgggtcgttcttgcatgagtagatcagaataccgttttaaaattaaaatagaatatggagagctggcggagcggcgatgggctcagtggtgaaatccttgttggcggtttaccgcctacaaggagaccgagcttcgagactgcgcgcgggttttgcgcgtgggctcgaagtcgtgcccaccactctagcttcgcggtcgccaccccgaatcgccgcgtagccagctcggacactaaggataaccttccaacgacagcagaacagaaaaacaacttatttatcaaaataacaaaccgcaattgagccattcacccgagcacccttgcttgaatctcacaacgtttcaaggtatgatttccccgaggaggatgacgatgacacaatctaataaaaaacagccaccgcgtaaacatcgttggctttggcgaaccatttttacgctcggtatccttctgggattagcgctgatcttcaatgaacccattaaattatttgtggtcgatcatcttagccagtggacgatggcacaagttgaccgtgacaatgtcaacaaaaatgaaaaacgcaaagcaacctttgatttcaaaggggtcaaggcgcttgatatcaatacagttggcaatgccgcgcttaaccgtgacctgcatcctattggcaaagttgccattcgcagtgtcggtttgaaattgcctatttttaaagggttatcaaacgagaatctcagtgcaggggcaggcacgatgaaagccgatcaaaaaatgggcgaaggtaattacgctttagctggtcactacatgaccaatcaaggtattttgttttcaccgctcaaaaatgtgaagcaagacgacatcatttatatcaccgatatgaagaaagtttactcgtataaagtgaccagtaaacaggttgttaatgaaacccaagttcagtggattgatgatgttgccggtaagaaactgattacaatggtgacgtgtgcatcgccaactgaaggcgaagtggatcgcattattattcaaggccagcttcagtcagttaaaaaggcaacgaagcaacacttgaaggttttcttataatttcggcaagcgcgagcgaatgcttgcgctttttttgattttgcggcaggcttagtgtatctcgttaagaatgtggggaaaagtatgtcaggttacgaaaagttcatcaataatcttccggttaggcgcacagtggtgttgttttcagtctttctcttgttgtggtttgctcgcagcattatgagcgatattttgttgaccttcattttcgcgttcctagtcagccgcttagtccacgctgttcagcggcatgttcatattcgtccatttgtgattgtggtgccagtttacatactcgtgatcctaggcctagtctacgctgcagtgcattacgtgccagcgattattcatcagacgattggcttgtttaattctgtgcaaaacttttataacagtgaggcgttcgccaacaatcaggtcatgcaatgggtgctgcaaagcacgaagagtctcaacttgacggaacaacttaagactggcgtgaccacggtgctacaatacgccggcaatatcggcgccatgggattgacactgtttgtctctttcattcttagtttctttttcacgattgagcttgacagcttgcctgcgtttggccaactgtttctggattcaccgttcggctggtatttcaaagatctgcaatatttcgcgatgaagtttatcaatacttttggcgttgtgatggaagcacaaatttttattgcagttgtgaataccgtgatcacaacgattacgctactattcttaaaaatgccgaacacccctagtctcgcgattatggtctttttactttccttgatcccagttgccggagcgattatttccttgattccgctcacgattattggttataccgtcggcggttggcaagatgtcctcaccattttgatcatgattgcagctattcatgtgctagaagcttatgtcttgaatccgaagttcatgagcagccgaacacagctgccagttttctttacctttgtcgttttgttagtggcagagcggttatttggcacttggggattgattgtcggcattccgatctttacctttttcctagatgtattgggcgtcaagaaaattgctggtacggcgcacaagcaatcaacatacgcgagtgtgccgcagcccaaggagcacgatgacgatgcataaacaccgttggctgattgtgattgtattggcggtagcgttggtggctgcaacgggcttaacgatggcgtgggtgtatcatcaacgccaagctaataaaattgtggcgcgtccggtgccgcaagcgcaagtcggcaaacatgcccaagccttgattaaaaaaacggcgttcacgggtagtgtggctttgatcaaaaacggtcagattgtttatactggcggcgtcggtgacgcggatcatggtcaacatgaagccaataacggcgagacaatgtttcctttggcgtcggttgaaaaatacttaacggcactggtgatcggtcatttgattgccgagcacaaactgtcatttaataccaaactggccaagtttttcccgaaaattgatcatagtaaggacatctcgattcgtcagttattagatcaccgttctggtattcaaatggacgaactaacgcctgatcaaaccttaacctcggagcaggctattttggactggacattcgagcagatgggatcaactggcgaccacagcttcatttatgctaatgctaactatgcagtgctagcggggattgtgcgtcaagttacgggtaaaagttttgcgaatgtcttacaacaaacgatcatcaccccgctacaactgacgcacacccataactttacggcgctgacggcgcagatgcctgttgcgcagggctacttaacagccggtgataacgattatcaaccagatgagctgagcaacgccctgttgtcgactttgttgggaagcggcagtgtgtatatgagcgcaacggacttggctaaagtcatcattgcggcagagactgggaaaatcatgccgttaaaagtctatcatcagctgattaacgccaattatggggatggtaatccatatgccagtggcgtgatgtggttagacgaccagcggttattacagggaatgtacaacgacaatccggaaagcttcagcaccttagcctattttcgagccgatgcgaaaagcggtgtggtcttgtttggcaatcatacaatgtcaactgataccgtgagtcttgcacaaaacctagaggcattggtcaattgagtgacgaccaaaaaaataggccttaagatcatgacactacccatgtgtcaggtcttaaggcctatttttgtggctctacgccaactggtgttgaagaataaatttatcatttgaggcggttctccatttggggagccgtctttgtcatgttatgccgtgatttggtagattcgtttgaagaagttcagctgattcttgaagccaaaacaggatcgtttgagtgacttgatgaggcggttaacgccttcgat

SEQ ID NO: 2 - DNA, 4345 bp, Lactobacillus paracasei
gaagcaattcaacgatgtcacgatagctgagactgaatctgaaatagtagccaacggctactaagatgatgtccttttgaaagtggcgtcccttaaagtgattcatgcgcgcaatccctcgtttcttggcacccagtatactaaaatcaagtcagcgaggaaaatttgcaccagaaccttcaagaattgcttgaagcttctgtcaatgaacctgatgagatcaagaggaatttttatgattccttatacacttatgttttgcaaaaaagtcaagaagatattattagtcgtccaggtttcgtcatttagccctctaagagcctgctgagggctttttgtttttcctttggtataaattatatataagcagtcttaaaaccgctagaaacgagaaataaggctcttaaaaacgaatatagcagttaaagtcttgttaagattaaaaaggaaggagacaacgaacatatctggtacgatccgcgaaccatgccaaaactggccaataccttagctgataagtttgccaagaaagatccagccgacaaagcgaccttcaaggcgaatgcaaaaaaatacatcgcttcactggacgatctcaatactttgatcaacaagttgaagtcgaaagtaaatggccaactcgttgatgtctccgaacctgtctttgggtacgcgctcgattatctgggctacaaagtcaatgacgatcacttctcgaagtcaaccgaagacggcacagactacagcgcaaaagatatccatggtatcgaaaccgatattaaggaaaagaaaattgccttctttgtcaataacatccaagcaagctcaaagactgtcaatcaactcgtcaaaatagctgaacaaaataatgtgccggttttgaaagtgaccgagacattacctaaaggcaaaaactatcggacttggatgaccagccaataccagcaacttgaaaaaattcaggatcaagcaacgaacagcgcaaaatagcatcacttctggtcacaggggtttatcattccccaatgtttcggcaaagctcaccctctgtcgaagtttcgttaattgctttgatgacaagataaaccatatgcccgggccaacaacaccggacagcacttgaccagaaggaagcccgcgaagaaattcgcgggcttttttgatcgttccgcccacaaataccggtgttacaataaaactgtattgggaacaagaaaggaagattcaaatggcaaatatcatgatcttaggcgcacacgggcaaattgcaacgttagcgcggcatcagttgctgaaagaaaccgatcatcacctgagtttgtttctacgcaatgccgggcggctacaagacgtcaatccgcaacgggagacggtgattgacggggatgtcaccgacaccgccaagttgaccaaggcgcttgctggcattgacgttgtctatgccaaccttggcaacaagggaattgaagatcaggcaaaatccgtcgtgaaagcgatggatgctgcaggtgtgagtcgattgatttggatttcgacgttgggaatttacgatgaagtccccggcgcttttggcaagtggaatcatcaaatgcttgatggtggttatcttgaaacctacgccgcagccgccaaagtcattgaaaattctgacttaaaatatacgatcattcggccagcttggctttccaataaaaacattgtcagttatgaattaacggaaaaaggcgagccatttaagggcacagaagtctctcggcgcagcatcgctgacttcgtcgtcaagctgattaacgatccaagcaaacacatcggtgcttcacttggcgttgaccaacctaacacccaaggcgataagccttccttctattaaagtaaccagtcatcggccaaatcaaaaagagtttatttccgtgttcatcactgggaaataaactcttttctgttgccatgccctttacttggctatcaaagtattatctttttaagctcgtcaggttcattgacagaagcttcaaacaattcttgaatatcaacttgccaaggatcagcaagcatttcatcaattggttttaatactttcttttcgtcaatcttaatgactcctaacatcaaaataatgctttcagtttaaattcacagatcttacagcaccgttattcaaaatttgttaccaagcttataaagattatctgcacaaagcaattaaaaaattttggcttaaaacagcgtaatctgcaacactttttaaatatttaaaacataacaatcctagttaggtgcaaacataaattgaattaaaaatacagtcaattcaacaacggcaaaaactgatttcatggttatcagcagaccgagtaaaacgaggtcaatgcgcacttatacccttgacaagtgtcaagggtagatttaatccccattttgatggggtttatttgtattagaaggctaacgccaactatcaaaaacctagagttaaatcttaagattaatcaatcacattacgaaggatccaatgactataagcaagacgagcacgggggttattacttcaactgtttttgttcattatagaaattacggtaagctaaatagcacgcaatgattgaccccaaactagtcgctgataagagcatgaacgtgaccataatttgatacttaatggcccgtactggatcgacccccgcaaagatcaaaccggacatcatccctggcagactgactagacccacagtctttgccgaatcaatggttggtgacatccccgtacgaatcgcctcacgcacgatggcaatcgaagcatcaagtagaccagcccctaacgccaaccgttcaagcacaccttgccgctggtcatgaaactgactattgaggctgcgataagccagcccaattgcgaccattgaattcgacgcaatcataccagaaatgggaatcatttgcgatggcacaaacttaatcgcaccagatagcacgaggacgccgagtgttacccccgtactaacaaaaatggctaataacgaaatggctaatgcatggtcaatccccggcccccgttttttcgcattccaagccgcattgaagataatgaagcccatcatcgccagcgttagccacaaattgttgactcggaaaatatactttagcaagtaacccacgataaatagttgtacaacagcccgcacgacaccaatgacgatgtccctatccaagccaagtttctgccacaaactaattcctaacgcgacgagcactaacattgccgccaaaaatagcgacgtattattaactgctaaattcatgcgtgtacctccaatctgccagcaaccactttcgctaattgatctgccgcatcaatctctgtcgcgtcatgagtaatcatgatcgttgtcacgtgatcctgctcatttaactgtcgtaaacaggcgtgcacgatttgcttattattttcatccaaaccagctgtcacctcatctaataacaacacttttggtaagaataagatgttgcgaatcagcgcgacccgctgccgttcaccaccggaaagctcggtaatcggctgatgcagggttcgttcggacagcccaacattatttaacgccgttaccactcgttgcgtatccatgacttgcttacgaatttggtacgggaaagctaagttatctgccaccgtctcaccaaataacgtcggttgttggaaacaatatgagacttgccgccgatacatgattgggtcataactttcaatcggctgcccatcaaaaatcaaggtcccacttgttttagaaatcatggccgcaatgatccgtaataacgtacttttcccaccaccggatggtcccgtcaatgtaatatgagccccagctggaatctgccaatcaacatcatgtaaaatatgttgatcagcgatttgataattaactttttctaaactaatcaatgaattcatatgcccacccccgattactaatttataatcattataacctgactgttaggctatgcgtgataaaatttcgttttcttcctccaaaatagcgaggcgcttctctagttgcttgacgtcttttaacgtctttgactgacccttgatcatgattggggtagcttgtttaacccaaatagcaatagaatctttcgacggaccaaattcttctgctaatgatttaagtgggtctacactttctggtgttgagaaataatcaacactgaacgtgtaggccctttttggataacgcaaaaagacacctactcagtgtccatgctatgcttgttagcgtcgaaaccaaaagcaagcgaggttatgagtaaatgtcccaatacgatcctacactgtccgtccttggaa

SEQ ID NO: 3 - DNA, 43318 bp, Lactobacillus paracasei
aggggaccaacctaggtttagcttctcagttaccatccgcttcaacttaggcgttaaaatcgagtgccgaccacaacgatgccgacaagtatcggcatgatcctgagctataatggcgcagtaatcaccttcagggcaacggtgaagctcatgcctaatagaaatacgagagcggcctaaagtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggcataattaatgcctctgttgcatcacctggggccgtatggtaaacatagtcgccgcgctctttcagctggcgcgctacctttgaaggactgatattaattagtccaaaagcaaaaccaagaaataaaataataaaggcataggctatgatgcctggccaatggttataatttatttgattaataatgaattgcccgacatctgtatactgataccctaaggcactaacaacttgcgccggcagaataaatagcatattcaaaaacataaacggcatagccccagccgctaagaaaggaagtggcagataagaatcgctaaagctactttctaatgaaggacgttgaattggaattcgtctttctgcacgaaagaccatgattcccataagaaagacgacaactgtcacaacgacagcaatcgaaatgctgacaggggtcattttcatacgatctgtaccgtaaccgtaaagaaatgcgtgtggtaaattcatcaaaattccagggataatcaaagcaattgtcccgccaaaaccaaagatcgcattttcatttccgatatacaaggcaaacatggcgcctgtcacaagtattaggacagcaactgaaggtcctaaattaatattgtcactaattaaatacaatggtttgattgcatcttgaagatagtacaccatcacaatcccttgaagcgtcgccaagacaagcgttacaaatcgttgcaaaacaccactttgccgaactgacatgttgttaatggcacgaatatccagagattgaattgcttgccaaacgatcatagcggtcatataaggaccgagacctaaagacaataaggtgggcaaattcatctgaccgcctgttgtcagtccgaacatttgcaaaaggctgttatgtgacataatctttctggctaaggtaatatcaaagccaggcaacatgatttgttgtcccaaggcataaacaaatagtatcatcatcgtgaacaaaacacgttttacaatatcttgatgcttcttcatctgtctcatcctaactagtgactatggaaattgaatctcaacagagccatctggttttagcaccaaatcggaacacaagagatttcgtgtgatcccgatattcatagcttgtttcatttttttaaatgtacgacgcgtttctttttggtattcatacaacgggtcacgtccattactgctgcgattcatggtcacagcttgtaaggattgaagattatcaacctgatcaatccaagctgaatcgattgtcttcaaaaccgtcactcgctgaaaaaaatgccactgtttatcatctgtcaaaaaggctcgttttttggcaaactgctctttcatcatcttcacaagataggcgctatctctgactttttccggatgttcggtgattgcttgtggcaaaaagtcacggtcaatatttgtatacacgaagtcaagaaaatctgatatgtcgccatcccggtgttcgtttatatactgctctccaacttgtttaaaaacaccctctataacacgatcaagcgatttggcaaccattattttgtcacgagtcgcatagacattatctcgctgtgccctaaagacctcgccatactgtaaggtcgaaaaacgcgcacttcgtccattgttgctcatttgatcttgcgccctatcgatcactttccgaaaacggccatggcgactgagtttttgcttttggtcgtcagcatgttgataggcatactttcgaacccactttggagaattttgaacgacaattctgtcctcaagcgaagtatagaatatactacttccggggtctccttgacgacctgcccgcccgcgtaactgattatcgacacgtcggttggtcattctttctgtgcctaatactaagagcccgcctttttccttcacaccttttcctaacttaatatcagttccccgtccagccatagaagttgccacagtcacggccccaagctgacctgcttctgcaacgatctttgcctcttttgacgcactacgagcatttaataaactatgagggattttttctcgaagaagtaagcgtgagtaaaggttcgagagtgataaagaacccgtttcaattaataaaggccgcttgttttgataagcggtatgcaccgtttttaaagacgctattaatttggctgcctgagtaatatataactcatctggcagatcacgccggatcatttttttgtttgttgccacctgaaaaactgcgaggcgatatacttccatgaattccggagcatcggtggcagccgtgcctgtcatgccggctaactgtccgaacattcgaaacaaattttggtaagtaacagacgccatggttcgcatttcatcagtaactgtgacgtgctctttggcttctatcgcttgatgttgcccgccctgcattttcatgccgaccaactcacggccattatctcgatcaaccaataacacctcatcgtgatcaacaacgtaatcccgatctcttttatagataaaatgagccttaagtgccagaactaaatgacgatacagttcataccatttctttcccagcagatcatcaacaccgaaataatgttgcatgcgttcaataccttccggcgtaaaccaaactgatttgcgatcatcgctcaattcgtagtcgtctttttcccgaagcatagtgatcattcgctcagcagatccataaaaattggactggacgcgcggaataccggcaataatcaatggcgtttgagcagaatcgagcaaaacagcatctgcctcatcaatcagtgcaaagtttaattttcgtaagtattgatcgctaggatctgctgctaaattatcaaataaataatcaaagccaagtgacgaattagtcgtgtacacaatgtctgcctgatagattttttcccgatctctatcttcgccttcatgccccggctcaggaacacctgctttaacggttaatccaagccatcgatagaccttccccatttgttcagcatcacggttggctaaataaccattagtcgtaataaggaaattccccggaccagtcaagccatgcaaatacattggcatggccgcagtcaaagttttaccttcgcctgtcttcatctcgacgatattgttgtattccatcgccaccgcaccaaggacttgaacaggaaaggggcgcattttgagaacccttgatgtcgcttcacgcaccacagcatatgcttcgacaagcagagaccgtagagatgctccattttgaagacgttctctaaataagactgtctgatgacggagttcctcatcacccatttttttataagttgcttctagcttgagaatttgtttagtttttttgtgataacggtaactcgatccaaaaaaattcatcaatgaaccctttcattgtgccctagttatacgttgcttttatttttttctacctctacactcaggttattatgacaagtaaaaaaagaaagttgctcgataaggatatcgcccaacgtataaaaaaagaaaacgaagaaatcactaaaccagaaaaggaccacgtacaggcaactaagattgtccaagtcggcgtttccctgcttcttgcagtcatggttctttttggtcttgtttattcacttattcagattctgtagttgccagtgaattaaaatggcatggttcctttcacagctagcacgatctgtaaagcggccatttgattgtggacaccattgcggatcaaactacttacgtctgcgactttatccacgagatggttataatcatcttctgtaatgccttcaagaagattaggcaagttgtccaaggaatcaattcccagaccccaaccttgttcattcacatatttgccaattgcactctgattgaacgcaatgactggcaatcccatggacaaatataggctgaatttatgcgtcatgttaattcttgcgtaatcgtcaaagtgattgtcagtgtctgcatcccataatagcccatacccgttgttcaaagctaaggctagctcctcctgacgatatgagcctaaatactcgacggaatcagctaatgaatatggtagattaacatccccatcagcagatccatagactttaaggtggagtccttcaggtacattctgtaagaagccgccttttcgcgtcactaaatttcctgcatagtgaatattttgagaaaatgtcgggcgtctatactcgatcggttgtcgatacccccaaggaccactaggaaccattggaatggtgatgccgtcagcagtcaactgactcttgacgcgttcggttccaacaataagaccatcaaatgacgacaagaaccttagaacttctgctttgtcatattgatctggaaagcgtaagtactcaacatcatgaacaaacgcgacaatctttgctttttgtttatgtactaattctacaatggcctcttcaacctctggcgctgcatacgttggaatctgataaataaccacatcgccttcaccaacagtggcaatcatgccaaggatttcagatcgccagttttcatcattccaactgacgtagcgcgacaaaaagagctcacgaaaaccaattttgccaaaaaaataagcaatatccaatttaggtttaattgtggcctgatcagtctgtggctgtaatggtgaaataatataattcattgattgataacctccgtacactttaatgggccttacccaatcgacaacgtcaattatagcatagcattacaagctgaaaacttcttcaagaattctttatgctaaacgacaatgaagggtaaagtcacggtatttaacgtgattaagtacttttcagcaaacataaaggtcagctgaaaatactcttttcataacaacgatggtaacacatgactcggacgatcgcattacctccacggtttttttaaccgaccaatcaactcgcaagctaagtcaccaatgtctcggcaattaaaaacttactcttatcttattctttcttttttctgagaatacgctttgtcatttttccttgaccagccgcaacaagttacttatcattattttaatagcctgcgactcacttcttatggtgagtcgaacgtattagaaacgtcatttttaatcatttggaggaataaccatgttatgggttagtcgaggaaattacacaacagtcaaagcctatgatcagagcaatcgaactgccatgtataaggcacgggaagactatactgctgatttaatggctatgggtgctcaaccccttgatctatttttttactactggcgtgatgagcctgatgctaatctttccagccgtttagacgggatgttagccggcttcaaacctggtgacaccttaattttacaagtaccattttttattcgaccactgaacctcaagcgactcatcactcagattcaagatgtgtatcaaggtaaggttattggtcttgttcacgattattatcccctttgggctgtagaagcagccaaggaagatactgactctgacccttggcttgatcaatattcatatcgaacctatccggtgcttttctcactatttgacggcttgattgttcatggtgaggcttacaaagaagccatcaaaaaagagcttgattttaaaggcccaattattacacagggacccttcagctatcggtttatcgaagatgaagaaacatcggcaccgaagtttcagaagaaattagtttttgcaggtaatatcaacagttcaaattatctcaatcaagttccagacacatggcgtcttgatgttttcgggggtaagcctaaggaagagcttctaaaaaaagaaaacgttgattacaaaggatcctatacgcccactgaactacctaatcatctcgatggtggttttggtctcgtttgggcatcagacaattttgatcaagtgaccggtgaaactgcccagtataaccgcctttgttatgagcacaagcttagcctttacctctcaaagcgaattccggtgtttatttggaaacatgcggctccggcaaaatgggttacagaaaatcatctaggttttgctgttgaaaacctttcagatatttggtcaattatcgaaaactttaccgaggagcaatatcaagccatgcaacctgatctcactcgagttagtcacttaatacgaaatggtgtctttgccaaacatgcggccatgaacgcgctattggcagttaatgaaacttacacagagttttaaacaaaacccattctgtatcttttctcattagccaccacgactttacatgtttcatagcactttaaaaggcagtctcagttttccttgagccaaggaatattgagactgccttctttaatctcattgaattaattaactcgactttgaggacattttcgctatctgtaatttggactgcactaccatgaagtccctagtcaaaggccgactctttccactaagaagctgactgactggaccagtatttaaaacgtccatcgttgtgtcaacaccccgataaaatataccgtccgtcatatttggaatgatcactggtttcgcgccggcatataattgattcaaattttttaaaatgtcaccaacagcattaatattatattctggaatatccggaagaatccccattgcaagttgcgcattgccactgtttcccataagcgcacctgaatcatgattaatacctagtgcatgacccatctcatggcttattgctgctactgcttgaacgaaacctccttgaaaactagcaccgctgagtatggtatcgttgatttttattatgttttgccagccttcatagacaataccgttgtaaccagtttcggcaacaacaccgttaggcaaatctgcagattttatgacaacatcggcagcagcctttgccactttggctttttgataactcataattaaattaacgccaactgctctattccagtgagctgccgctgctgttatcacgtctttttgtttgatagcatcatcgtcataaatcatcgtgccatgtttgttaatcgttgttatgaatgagaggttacttggtctggcattttctggttcatttttaaacatatctaagtcgttaataaacttaactttggcatcaacttggttcgcgttattaaacatggttatgctggtcataattgttaatatcgataaaaagattctccatctttttctcatggtctcacccctttgtttcgggtctttatatattaactgtacgctatttcgcttaatagcggtagtagctcacgatgaacggatcttttgcttacgagttactagcatactttttcacctaacaacacaatgataatcgaacgttgcccaaagaatctgttatgtaatgttcttactggctcattgttaaccaaaatgattttattgacgtatttgttgacaaagctatgcctaaactgaaattttcataataagaattactttaacagaagccgcaaaaaaacaggttgatctaattgaacacgctcaccgtgccgttaagtcaacctgttattaagtttcattaactcgcacgaaaagttttaatcaacgactttagtaaaatcacttgaaataatcaagtacctgtcacctacatgtatttgataaacatgaaagccatttaccttcacataagtggttaagacttcttgttgagtgcctgtcaacaaaagtgcgttcgttgtactgatacgtccaacacccacttggtaaacatcttcattacctgtaatttcaattgttctatgagtaagatcccgtgatactaaacgagaatcatccttgaatagtttactgattaagtcggtatctaggacatccgtcgtggtgccgttatcacggtaagcatctccagtaataatgacgcgactaccgccgccaataatgtaatattgactgccaactttgatctgataatacctttgggaaccagcactcatgtaaccagttacaattggctgcttcgttttagtcaaattgaatgagttcgtggtgccaacttggcctcgcccgacctgatagacattttcgttgctgagaatttctacggtgccaccattaaagttacgtgtcgccaagtgatcaacacctagtactagttgcgcgactcggtcagtgggcaatatttcctcagttgtgccagcatcgcgataagcactgccatcggtcatgttcggaatcgtgatcggcttcgatcctgggtataactgatccaagtccttcaagatcgcgccaatggcattcacattatagtctggaatagccggtagaatgccatttgccagttcagccgcaccactcgttcccatcagtgcgcccggatcatgattgagacctaatgcatgtcccatttcgtgactggtcgttgaaacagcttgaacaaaacctttttgtgaactagcagcatctaacgtggtgttagcgattttgatgatattctgccaagtttcatatacatagccatcgtaccctgttactccaccaataccagcaggtaaatctgcaggttcaatgacgacatccgcatcggctttagcaacatgggcttcttgataactcataatcaagttaatcccgactgccttattccaatgcgtcgcagccgccgtgatcacatctttttgcttcacagtgtctgcatcataaatcatggtgccatttttattgatcgtcgtaatagtcgatagcacacttggtttggcattttctggctcattcttgtaataatcggcgtttctggtgaacttaacccttgcgtccacttgattggctgtactgaatgcaccaaaacttattgcgataatcagtgctgataacaaagtcttccagaactttttcatgattctcgcctcctatatgttattttaacgctatagaaaacgttttccaatattagactatttataatattgaattgattgtcaaatactctaaaccattttatagcattattcctgcggcctaagcgcaaacaaacagagctgtctgatcgaacactcatctgtgtatcgtcaaacagctctgttattgacagttgaacttttatgttatgaatttacttcttatttgccggcttccccacaggcttatttgcctgcaactttgacgccaaatcaagaatataagcacgcagctcatccttcacttctggatgggtcagtccgtactcgatattggtcttgacataaccaaacttattcccaacatcataacgatcgccggtgaattcgtgggcgaagacgcgttgggtttggttcaaggtgtcgatggcatcggtgagttgaatttcattacccttaccaggtttttgattttcgagaatatcaaagatctctggtgtcaacaagtaacgaccaatgatggccaagtcacttggtgcatcggcaacagctggcttttcaacaaatttcttgacgttgaagagtccctttgaaacttctttttcagggtcaataacgccataagctgaaacttcgtcatgtggcacttttttaacagcaagaatggatgcgtgggtcttatcgtattcgttaatcagttgcttggtcaacggtaccttgtcatgcatcaggtcatcgccgagcatgacaacaaatggttcgtcgccaacgaatgacttcgccaaacgaacggcatccccaaggccgcgcggatatggctggcgaacgaagaagagattaacgccgatgtcagtagtggagtgcaccaactccaacaaggcatctttatgtttttctttcaaattctgttccaattcaggagcagaatcgaaatggtcctcaatagaacgtttttgtttaccctcaacgatcagaatgtcttcaatcccgctggccttagcctcttcaacgatgaactgaatggttggtttatcaacgattggtaacatctctttggctaaagctttagttgctggcagaaagcgggtcccaagcccggctgccggaatgactgctttacgaactttcacgtgtacacaagtcccttctcttactaatttaactacctactatactatactagaaaccgcttgcgaaaagtattggaaatcctgaattctaacaaagaattcacattttcatcgctgaaaataaaaaactcgatcaccattagcaatcgagttgtctttaatcattaatttcatgcacattaaatttcagaggctcgatatgatggtcgcgccaagccgccagtagcggtttgatggcttgatgagaatcaatcaagacaatcccacaatcgccgccaccggcacctgaagattttgccgcgccgcctgcttgttcagctagttcaacaagttgacgtaatgctggtgtttggatcgcaacccccgagaaatgagctaattcatccaacaactcacggttgcggcgaataccagcttgaatactgctcaacgaacggttgcggaacccatcaattaatttttctaaggtttcgcggctagcagttaagaagtcacggtaaagttgtggcttcttcgctttggccagcgtaattttgtcgaccaactgagaggttgaagctggtgaacctgtccagccaaccagcaattgcatgtcagccggagctgtgagcagctcaatcgacaagtccggccagtcagtgttaatcaggtcagctagtgacatctggtttcgtgctgccgccaaccacgctttatcaaacgaacggtaggcaatccatcccccatagacagatgctgcgatgtcacctaaagagccattgccctgaacgtctagatgggcaatggcagccagcttgtagatctgatccttcgacattttcaagtcgtaaaacttggctaatgccttaatcgtggcaacagtcactgctgctgaactgcctaggccatacttcttcccatccttggcgtccagctgcgaatcaatatagagcttatataacgcgagcggtttgtctaactctcgagcgtattgttcagtcaatttgattgccgagagaatgtaatgaaacggattatcccgattatcaaagaccatctcgtcgccttgacgctgccaatacagcgagttttcctgatactgctcggacacgatactgccgaaatgcttcgttgcctcaaccgtgacggtgacgaattgatctaacgccacaatgattgcggggaagccagtttcaaccaccgcgtattcaccggcaacataaagcttgcctggcgcctgcgctgttatcacacaatcagaacccttcaatttttcatttatataggaccccagagggaatccgactgtaagtatagctgaccttacgtcacagtgacgcaaaccaacaaaaaccttactatttctaaagaatcaccttaattattttagcagagattcaactttgtgcaatggtttccgaatttttgatcatttagggttgtcaaatcgaagggttcaccgatttgtataagtgtaaggcaaaaaaatgtcttacgatgccatggcaccttttgatccacctagttgtattttaaagaccgcgtgacctgacttcggccaagtctagtcacacagttgcaattgacgatgaaaagcgcacgcaagcgctgaaaacaaggaggaagtaacatgccacgaacaatcaaagcacaagccattgtctatacgatgatcgacccagagaaggaggattacaaacaagtccggcgcatgaacaacgtcgcgcttgaagctgacgatggtcaattactcgcgatcggcagtgccttcgctagtttgtacccgggtactcaactgcacagcacggtcttgcaacagcaaaccgaactgaacgcctaaacggagggctaacttatgaaaacactttctttcagtttcaaatcttcacttggtaagaccaccagtattcgtttaaacaagtacgaagctgacgtaacggcggaccaagccaaacagttcgcgcagattgtcgctgatgctaaggccttcgtcaaggatggcgtcaacctgtacgcgactccgacaggcgccaagatgaccgagacacaggttactgaaatctaccatgttgatgagaagaaggaaccacaacctgcagaaccacaggcataaccgaagcaccgccacttgctgaaacccccatcagccccttttcgatgatcgctaggaagccgccgctcgcgaaacacgtgagtggcggcttttttgtgcgagtcgtttagaaacaagagcgtaagtggcctcagcgtctagtgactgtgtcttagtcattgaacgctgaggtcactcacgcgaaatattgttgcggctgtgagtgcggttgtccctcgctaggattctcttttcacatcttctggatcatcatccgccttggcaagcttattcaagtcatcgaaggtcggcaagcccagcaactgcgaccatgcgcgcaatctgcctgtcaggctcgttttgttgggcttgtctggattttctgtcgctaaatcgttgacatcgcctgccgagatgacatcttgaaactcgcgggtatattgccccaataccatcccaagctggcggacataaccccaatttttaacaagctgacgtggtgacatttttgataacacaaatagactcagggctgcataacggcgcactgccagcgaggtcaattccggcttgtcatgcgcgagggtcaggaaaacggcgccgagttgatggattgcttctaaatcacgcttttgaaacttggcgtgcacactgctggtcgcattgaaccgataataataccgaggttcgtcaatgaagccgatttgatcaattcgcggcaaaagatggccgataaagtaagcatcctctaacaaattgaaattcgcgacaggcacaggctgttcgaataactcggcacggaataatttattccacaaataaccgcgcaaatcacgatcctctaaccaatagcgatacttgtcatcgccttcgattttaaatgtcgattcacgaaacgcgcgtgccttcatcttcgtactgccaatgtagttgtaataattgacgaccaccatatcgacccgtggtgccttcatcccgtctgccatggtggatagccactgtggatgcacaagatcatcgctatccataaacgtgatcaagtccccgctggcatgatcaatcccaatttgccgagcccgtgcttgaccgccattttgaacccgcacaacgtgaattcggggattttctcgcatataagccgccaagataactttactggtatccatggacccatcgtctacacaaataatctcataattcggataatcctgtgccaataaactgtccaaggcctctgcgagatacttctctgcattgtagactggcatgataaccgagatcagcgcttcaggatctgccatatactccctcttttcgtcctttcctttagtataacgtgaactggtttgattaagtaccattcgtttgtaagttgcgataacgcgcgaatcagcccagaaacctgcgtgtaaggaccttgatcgcaatggtcaaagcccgaccatcacgatcaaggccgcttacactccggttgctaaccgggctgattcgcgctcacatacaaaacggggtgagcaatcatcgtcgccaccccgttttttcgtgccctattatttctgaatgatcgcgttggccgctcttattcaggaagtgttttaagatcggcctcggttaacttgtacttctcgtcaatggcatcgccttgagaagtcaaaatcttcgggccgttatctgtgatgaccagcgtgtgctcgtactgggcacacttgctgccgtcagcagtgacgtagtattcccaagtatcgcctgggacttgtttacccttgatcttccaagtaccttcagtgatcatcggctcgatcgtaatggtcatgccggcttttagtcgtaaaccatgacctggcacgccataatgaggcacattaggactttcgtgcatggttggctgaataccgtggccaataagctcacggacatcgccgtagccgttatcatcttcggtgtaagtctgaatagcagcgccaatgtcaccgatccgattgccaacaactgcttcatcaatccctaagtaaagggactttttggtaacgtccatcagcttctggtcagcttctgacaccttgccaacgccgtacgtccagcaagaatcgctgaagtagccattccagctgacaaccgtgtcaacactgacaacatcgccatctttgagtttcaggcccttacgcggaaccgcatgcgcaacttcatcgttgatgctgacacaagtcacatacttataaccttcaaaaccgacttgttcggccttggcgccatgagattcaaagaattctttggcgaacttttcaatttcccagcttgagatacctggtttgataatatcgcgcaggccaaggtgcatacctgccaaaatggcaccggactttgccatgcctttaatttctcgtgctgatttgatcgtgatcaagcttttctgcctccaatacaagtttagctcgcaattagtgtagcattaatcagggataaacaacagaagtctgagaatggttggttaaacagtgtcggtgtcggttatgacatcagggatcattggccttttcgattcacatccccagaatcgtgtcccctatgctataatcaggcaaatgaacaagaaaaggcagcctcgccgacgtgtaagcccccgagcgctgtgttttaggaggaataagagaaaaatggcaagcgcaaggattgtatatgccagtttgaccggcaacaacgaggatatcgctggtattattgaagaagcttttgaggacttaggggtggacgtgacgacaacagaagtttctcaagcgctggccagcgattttgaagatgtcgatatttgtgtcaccgcgacttacacctattcagatgtcggtgatggcgaattacctgacgaagccgttgacttctatgaagagttgcaagaactcgatcttaaaggtaaggtctacggttgctgcggcagcggtgatcgcttctatgatgactttgccacttcggtagacgactttgacaaggcttttgccaagaccggagccacgaagggtgcagaagacgttaagatcgatctcgcccctgaagaagacgatattaagcacctagaggcctttaccaaacaacttgttgaaaagtatcaggcattgcaataaaaccgtttaaagcaaaaggacttgcgctctcagatgaacgcaagtccttttttgctgctctcagccatggttgctcactcaatgactagcttttcgcttctttttcttcgtgtggtgtccgcacgcggcgtttgacgaaatcatgcactttgcctttactgccatgcagtcggccaatgaaatactcagcggtgagtgcattgatgacagcgccccacaacagcaccagtgcggagaagttaagccataacatgatcgcgatgaaggtgcctatcgtgccataggacagatagcgtgtcccaaaatatttcatgtataaggaaaacgcctgggcaattaacagccaaccggcgaccgtaaaggcggtgcctggtaagactgtccacatccggattttgacgttcggcagaaaataatttaaaaacataataatgacaaaaagcgcggtaatcgtcactggccaacgtagggtattaaatgttcgcagccagtcatcgttgagacgaagcagtgggatcagccattccagaaactggcggccaaatgcgaaaacaatcagaatggcgcccatcacaatgatgagtgtgaaggtcatgagcatcgataataagcgttgaataataaaattctgcgatgactcgacgccgtaaatttgattgaagcccattttcaaaccattcacgcctaaactggccgcccacaaagtcgcaaccgccccaattcccagcaaaccgccactgctggaatccaacagattggcgatcactgggtccaaccaattcatgacattggatgggattgcctgtgtcaaataggcagcaaggcctttgtatgttaggccaaaataaggcaaagcattggcgacaaacagaatcaatgggaataaggacagcaaggtatagtacgccaaggcagcagcactttggccgatgttcgattcggtgatccgattgatggcaagtttaacaaacacccgcattttggtgcggcgtggcaacgccaaatctgccaatgctgcacgcccggattgaatcgcgacttcttgttcggcggaaagcagcggcggctttttttgatgttgtttgcgagccataatcacttgcctcctttctgtgacgccctgctcttcaggcatgtcattaagttaggtgattagcgtcttaactttattttgccagagtgagcgtcatcaggacaagaaaaatctgatctgtcaatcagttccaagatggctcaggccagcatgtgcgtctgaactgcccgcataaaggctgaataatccgcttttacctgattcaaataccatttactccaacgctgaacggcgctgtcaaaacttttatcgagatagccggtaaccactgcagcctgaggcgtctgagcgtgtgccatggccaatagatacgtggtgatctgggtgtagtactgaaactcggggaaagtcagttcctcaaggtccacagaccccttcatatcacggaactggcggacataatagcttttatcacctacgttgaaccagccgaggaatggatcagaggctttctgcaaaatcatctgggatgcgatgatccgctgtccctgactgacttcttgttgtaacgtgatgcgttccgtatttggaattaattcaggtcgcggcggcaaggcttctttgacttgcagcacaagatggctgccacctaatccgcttagcaaaacgagataacaattcgtgccaaagctgccaatacccacgctgtgatgaatgatgtccgtaatccgatattcgctcagtagcaccaaaatatccggccgcgtggacttgcgatactgggtaaagccgtcaaagatcgcctgataagtcgctttatccaacctgacggagcttggcggatcgtctttaaaccgcatgttgccatcgatagtcgtggtgtattttttgattaccgagtcattattacgcttcgtcgcctttttcacaaatttcgacagcaacgccgaatcttcagcgccggggatcgcctgcacaagatggttgacttcggtggactgataaaaacgatccaatgcaccaaccttgaaaagatcccgtaaggttttacgataaatcgatgcatcagtctgtaccaattcatctaatttatctgcatcaaagccttgttggtcgcctaacaaataaacacttgtcagcaaacgcttgatgtcaaactcaaagctgttgatctgcgcttcatcgaagtcgttgaggtcaaaaagcaggttgcgttctggcgatgcgtagaaaccgaaattctgtaagtgggcgtcaccatcaattaacagattgatgcccgacttctccccttgctgcaagtcataggccatcaactcagcagtgccgcgaaaaaaagctgcctgcgaagcgcccatgcgactatgacgcataggcaacagtgatttggttaagttttgttcgacactattaatgaactggacagggtcccgatcaatcttactgacggcagccagactttcaattggtgcggttttacgaatctttttcccggtatcttttaaatcgtcaatggtatatttagcggcgattcgttcgcgtaataggtcttttaggtctgatgaacttcccataataagctcccttgtggttttctgtgttgtcttgtgagacggtagacaacatcgttagttttaaagtagcgcattgtgagatggttttccagtgattcggtgaagtggcgactatgtaaaaggcggcagcagtgtttggcccaaggtcagggtttgcactgttgccgtctttgttaaccggtgggactcattgtcgttgaaaaagcattcgcctttaaacgcgttcgctggcccagaaacctacacataaggacctcaaggctaaatggccaaaacccagccatttagccttgaggccacttatgttccggtttctacccgggccagctcacgctctaaaaaaaccgctccacatcggaacggttatccccaatttgctattaatgatcgttagtatccctgagcgatcttggcgtcttgaaaccaagagatgcgcgggtcgtctgagaagcggccgttaacaatgaagtcttgcgtcacagccgttagaatatcaaccatttgatctcgtgtaatatcaatgaagcctggtgccattaaattggcgatccccgttgcaacgatccataccccgcagatcgtgttgcgcaactgcgcttcgttcaagtgctgtgctggttcgtaagaatcgaaaacgcgcattgcggtgctcatcgcatattcgcgcatttcatcaacaccgaagtgatcttccacaaaaacggcgcgatacaatggccgattttcaagtgcaaaattgatataagcaagccccaaatcaacgactggatcgttggtaaaatgctttgccattttcagtgaaagtagttctttaattcgatccatgacagcctgtttcagctcagccatgtttttgaattctaaataaattggctgtgttgagcagttcatctttttggcgatattccgcgctgtgaaactcttgaagccttgttccacaacaaggtcatacgccgcattgagaatctgatcatgcgtaattgttttctttcgtgccataatgttccccttgctttctttagttatttaaaactagcttgcacacaactcatttacaaacatctttggatacgcctccactccaaaaggcaatctagatgttatgctgttattttaccagacctcataccagaaagaaacactatttgcaaacaaattgacggttttcttaatttttttcgaagtattttttaaagagaacgccatgctttgtggtgtcatttatttgaacataaagcacggacgttttttagaactgttgagcacgtgatgatgactgctatggtagactattgccaacgacggatttggagggaacgaaagatgacattacctaactttgacaaaagcctcaaacaatatgcagagctcgcggttgatattggcgtcgccgtgaaacccggtgacacggtttatttgcagattgccgtggatcaggccaaacttgcgcagttgattgtggctgcggcttatgaccgtggtgccgctgaagtgcaagttcagtggcacgatgatctgatcaagcggttggacatggcccacatggcaacatcccgcctgtacaacatccccgatttcattaagggtcagtttgactactgggtcgatcacaatgccaaacggattactgtgatctctgccgatcctgacaaccttgcaggactggatccacaacgcatcgctaactatcaaaatgccttcaatcaagcttacgcccgcctaatggacgcaatcagctcaatgaagattagctggaccatcatcggcgccgcaagtccaaaatgggccgaaaaagttttccctgatggcaagaccccggaagaagcgactgataaactgtgggcggccattttcaaaaccaccagaattgatcagcctgatcctgaagccgcttggaaagcccatgatcaacaattgcgaacaaaagcggactggctgaatactgagcagttcgatcggcttcattatgtcgcgccgggtactgatttggttgtcggtctgcccaagcaccatatttgggaaggtgctggcgcctataatccgcgcggtgaggaattcatggccaacatgccgacagaggaagtcttcacggcgccggatttccgccgcattgacggtacagttgcctccactaaaccgctaagttactccgggaatatccttgaggggatgcattttacctttaaaaacggtcaagtcgtcgacgcccatgccgatcgaggcgataccgttttgcaaaacctgctaaagatccccggcgcccgctcacttggtgaagtgtcgctggtccctgatccatccccgatttcccaatccggcttgattttcttcaacacgttatatgacgagaacgcctctgatcacatggcgctcggacaagcttatccattctccgtcaaagacggcgttgccatgaccaccgaccaacgcaccgcggctggcctcaaccaaagtaacacgcacgttgatttcatgatgggctcagctgacatgaatattgacggcatcaaggccgatggcaccgtcgttccgattttccgcaatggtgactgggcttaggtatttttctccgccgtaaattgtcttttctccgccaaataaaccaaagtggcggagaaaacctggtaaaaagctaaaaaggccgtgaccgcatccccccgcttcaaaacgggaaagacgcgatcacgaccttttttgatcgacactagccattcaagccttggccttaatcgcctgcaggacatccaaaaagatttgaccatacttatccaacttcgcctgcccgacgcctttgactgccatcaactcatcaagactttgcggcatggcgctgccaattgccttcaacgtcttatcagagaaaatcatataaggcggtaaatgctgctgctccgccagttgtcgccgagtactgcgcagttcctgaaagacagtgtcgtcgacttcgagatgctgctcggctttttgcgccgtcttctggaatacttgcgcttgtccgcgaagaacctcagcgcctttggccgttaagcccagagttgggtactgaccaccgtgggtttctaaataaccgccagccgccagaaaatctatgaaggttgtaatgtcgcgttgacgacgactgctcatcaacccataagttgacaattgatctagatgaaacgacaatacccgctgattgtgggccccggccaacacttgtgccacaacgcctttgccaaaacgttcatgcaagcgaaccacacaagataagaccttctgcgcatcaaccgtaacatccaccgattcgcggtcatccaaacaattcgaacaccgaccacatggttttgtcccgctttgaccgaaatagttcaaaataaactgttgtaaacactgatctgtgttcgcataccgttccatcattttcaacttctcatattgccgctgtttgtgctcgtcatcgccttcggattgatcgatgaagaaccgctgaacctggagatcttgcggcttaaacagcaaaattgcctcactcggcaagccatcacgaccagctcgaccggcttcttgataatacgattcgacatctttgggaatctgggcgtgaatgacaaaccgcacgttgcttttatcaatacccatgccgaacgcattcgttgcaatcataattggtttgcgatcaaacaaaaagtcttcctgattagcagcacgctgcgcttcactcatgcccgcgtgatatttggccacaggcaacttcttatgtgccaaaaaggtatacaaacggtcgacttctttacgggtgctggcatagatgatgcctgcctgatcgacattcagtttcaggtaatctaatagataccgatcttcatcctgatcgcgcacaaccttgaagctcagattacttcgctcaaaaccagtattaatcatcccgtcagccggaatcgccagtcgctggcaaatatcctgcgcaactcgcggtgtagctgtcgcagtcaaggcaatgaccggtggctgcgaaggcaattgagccgccacattcgccagattcaaataactcggccgaaaatcgtgaccccattgagaaatacaatgggcttcatcaattgcaaacaacgaaatatcggtgctgccaagccgttgcacaaaccaatccgtgtcaaaccgttctggggcaacatataacaatttaatccgaccacttcttgcttggtcaaggcgatcagcaatctcttgataatcaagggtactattaatgaaagccgccgggatcccgttatcgttcagcgcatccacctgatccttcatcaacgcgatgagcggcgacaccacgagcgtcaatcccgacaacaacatcgctggaatctgataacacaacgatttcccgccgcctgttggcatcacaaccagcgtgctttcaccagccaaaacgcgactgatggcctgattttgaccagcacgaaaatgatcatagccaaatttttcctttaaaattgtctccgcttgcggcgcaatcatcgtcttccccctactaaagaacaaaaggcttcacttatagattatgacatcgggcacatttgccctctcacttgtcaacattcattcacaaaatgcttgccagtaaccaaatcaagatactgaagagcagcataatcgcatctaacaataacacattcaagttcaacagcgaccaccaagcaaatccagctggccaaaacgtcaaaaaaacataaaaaatcacgattgtcagcaagaacacgatcggggcactccgccacatgttgcgcagatcctgagctgaaagcgcaatgcctggcgtcagcaccaaggcagtgacgataaaagccgcaaaccaaacccagttgatctgaatcaagccgcgcatcgcgagccatttttcattcagactcgtggcggcagttaagactggccaaagccggccatctgtcggaaaaaaggcccatcgtcccatgatcagcaacacggtactgatgccccagacaggtgcactgctggacagaaataatcccagttgtgcccaaggcgagcgccgattgtaccgcaaactgacatgcgctgcactgccgctaaccacatcagctcgcatggaaaagttagtcacttgtaatccgaagagccgcgcaacaaccgcgtgcaacagctcgtgcacaaaaatacccggtttcatataccagagctgcgtattcgaacgcccggcccgattcaccatggcttgcaccgtcgctgcattcacgctgctaatgatcagcataccgccaatgaaaatcaaccagcccggcaaataaacggctgtgaaggcttgcatcgcgtaatctccttttagacaaatccagctaccgcaaaaatgcgattgcactcatttttaatctttaagactttttagaatgtgccctgtgatttccaaaaaagcacagccatcaagactgtgcttcgtactgtgccctatcggaatcgaaccgatgacctactgcttaggaggcagtcgctctatcctgctgagctaagggcaccagacaaagtcaattatgccaaaagccacagggcaattcaaattcatttgcaaatattgactataaagtgttcaacatgcagccaacaacgcctaagccgtcatatacgaccgctcaatcgaatctaacatccggccgtaattacggcggcgtttgttgccgaccaataattcggtcaccatttgcttcaattgcgccgcccagttaaccggctgcacggtttcactgacgcggacttggctggcattggcatttaacggcgtgatcaggtaccggaccttgaaccgcgagaaacgggtgacagtcaacatcgcaaattcacgatcaatcacattcttggtaaccttaactttggcccactcgccatctggaaattgcttgcgataagcataaccaccgagttctgccgccgcaacctgttgattgttagccgccgcaatatcagcttgtacgggcgcaataatcttgctgtataaaaaagctgctggtgtctgtaatgttttttcgattttcatggggattacctctcttgattgcgagcgcgttattgccacggttgcaggcacgtcaaccgcgctgtgccagccgttatttacgcgcctgcacttgctgataaagatcaataatctcatcggcaagccggcgaatggtcatcgcactcattagatgatcctgactgtgcaccatcaataatgtcacgtcaactttttcgcctcgtgcttcatacgtcagcatctgggtctgagcttgatgagcttgcttcaacttggcatctgcctgcttcaacagcttacggctgcgctcagcatggccggccttggcttcgtcaatcgccgtcatggttgcattttccgcatcaccggcagcgctcatcaatgtcatcatggcagccatttgttctgctttcatactcaccatgactgcccccttatcttcatcatacatccgatgctgcattatgcgttatccttgtgcttgcctttattccgctgatctcgcaggcgatgtttcttatgcttgcgacgcggacgaacagccggttcttgtgccacttctggcttaactggctgctgcttggcgactggcgatgcatgcttttccaccgtcgttggtgccgacgcctcggacacttttttagctggcggcgtgtccacaagcttgccatcagacatatagccgcgatgaatatgatactgcggtaccagcttgctgaggtcgcggcgatcatgatcatcccccaaggtcacaaccaggcctgcttcacccatccggccagtccgcccagcccgatggatgtaaacttccgcgcgcttcggtggttcaaagtttaccacagccggcaacttaagaatatccaatccgcgccctgccatatcggtcaccagcaagagcgtgattcgtccgcgccgaaaatcagtcaatgccttctgtcgaaccgtttgccggccttcgcgtgacaagactgcaaagcgaaccgcctgatgacgcaagatccccgccacgcgttccaaggacgaattttgattgaagaagaccaaggctttgaagccatcggtatgggctaaggtgcgtaaccaatcaacctgatgcgcccgatccgtctgcaaaaacagatgcctgacttcgccacgggttcgatcaattgcccgaacatcaatgatgtctggtgttttaccaaaccacttatgcagctccttaaaataagggcttggcgtggccgagaaaaaggccaattgtgcttccgcgggtgctgctgccgcaatctctcgaacctgatcaaatcctggatcacgcaacatttcatcagcttcatcaacaaccagcgtttgcaacccatcaagtttcaacttacgcgactgaatcagttccaataagcgacccgccgttgcaacaatgacttctggcttttcttttagcctatcgagctgacgtttgacattcgccgagccaataaccccttgcacggtgataccaatatctttggcgtaaggggtgagcacatcacgggtttgaatcgccaactcttgtgatggtgccaaaattaagagttgtaagccatcgcctggcaccattttttcaagtagtggtaagccaaaagctaatgttttccctgagcctgttggagcaagcccaacaacatcttcatcggctttcagcggttgatacacggcggtttgaatcggcgtctgttcagtatagccggctgcttgccagcgtttttggaacggggttgcaattgtcacaatattgtcctcactaaaaatccagatttgcggaggtccgcagaattgacatgacttgatgaacctctttggcgagctgccatgccttgtcaaaagcgttgcggtccttgccgacaattgcttttgcaaaataggctgcctcagcttccatcggattagccaacttttctgtgctcagcacttgatcaccgagcttaacggtctccagctcagcagcgttgtccatcatcaatgtttgcttgccagaataaatttctgacggcaactcgctattagttgttttacccgtgatcaatgtcaccgcaaacttaccatagtcgagccgagcaacgccatcgccgtcaatcccgcttttgagaaaatgcggcaaataaacggcattctccggtacaccaaaccacgcaatcgcatcatatacaaggtaaataccgaggtccattaaagcgccgccggcaaattcaggattaaacacattcggcaacttgccagctaaaaaggcatcgtattttgacgaatacttcatatacgttaaggtggccccatcaaccggttgactgtgggtgaaatcattgacgacttcaaagttgtgttcatacacgtgacgcgctgcctcaaacagatataaagaaggtttcttccgcaacgcttcgtccaacttttcaaactccatggtcgtggcaaccaatggtttctccacgattacatgcttatcggcgtctaacgctgccaacgcttgagacgcatgcaaactatttggactggcaatgtaaacaacattgatatcactgccaagaaaagcatccatcgtcgtataagcagtagctggtgccgtgctgtcaataaatgattgcgcgctttcctgatgtcgcgaataaacagcggtgaggtgataagctttcgtcgccatcgctgccgccacgaattgcttggtgatccaacctgttccaatcacaccgagttttaacatggcaaatcccccttttcagacacgccattcagctcagaaactggctgaatcgtgctctgttttttaacgtgctgatgcacatgccagacaccgcgaaaccgcctaagccgtggccttcataaactggcggtcttcaactcacacggtcaatcatcaagcgtcatcacgcacgcttatcccgattcagttgccgtcatccttttaaaaacaaagtatttttgacaagtctctgaaccgcttaccattattgtaacagcccagtaacagaaaaacagcatcactgtaaccactaaaggaaaaagtcatggtagacttaatgtaatgaaaaaatgggaggtcgaataacatggcgagttttttacgcgggctgaaacatgcactcgcgcatcggggtcatcatcaggagtcgcaaaccaaggcagccaatcctgcattggcattggcgaagaattttacggggaattttgcatttctcgatgagcaaaccaacaagacccactcgctggcgatctcgccacaactgcagatcgcaatcgacaacaaagtgcttcccggtcaagtcgtcggcatcaccatccatgagctgacttttctcgaccattacggctataagttggtcatcacggccgacgataatggtccgcaaacgatctacgacgaggctgaagatgccacttatgcgattattgttccgagtgtttaaagtcatcagaagttgatcaacagatttttgccgtgccaaacgctgtaatctttggctagatgtggctcaatcttggcactgtcatctgtaaattctgctgggttatctacgagcgatcaaaaaacggctgattttccaatacggaaaatcagccgtttttatttagttgaattaaccttcacgtctatgaaacgttttggcaccttattgactagtccaactttgccagcgccgcttttggcacctctgctcgcgggacacgctgccaatcagtgacgccttttttatcattgtatatcactttcaaataagcattcattttaagtggtcggtcttgattagcattgaacttcagctgctgcaaactgcctttttcatcatagccgggcaagtcgtaggcgtagatggtgtatttattaccatcttgatcatggtcagtggcctgttgaccagcgtttgtgatcttcgtgtaataagtcgtgccaccataatttgtgatttcaaaaattttcaagccgccaaataccagcacaatcagcacaacaaggccgatcaaaactttcttcatccagtttcacctcgcaactattatgccgcattggtgtcaaggttgacatggcttttcgcgaacaatcaacgaacacttttgtcatatacagccacaaaaattatgattagctgacaattcccgtgtttggcgttaattgactatctgctgagacagttttaaaaaggccgcccgatcccccataaatacggcagcgcggtaatctgcgtgcggtccattcggcaaccgggcgccagacgtgtattgccagaaaccgctgctcgttgtcggcttcttgtcgcttacaacccagcgtggtgcttgcgggtcgactttttgggcagcttttaaaatacttgggctacccatcagcaacacttggcgatgataatgttgctgcaccaatgtgacaaaagtttgtaaatgagttgtcagccattgtgtgcttggcttcttttcagtgtaatagcttaagtaaatgccaatcggtaaatcaccgatattttggccgacttggcgcgtgaattggtcagcttgggcttggggtgtcgtttcaaagctgaacacatggtaaatgccgatgctcagtcgactgccagctgcctgattaaaattcgtattaaaattatcatcaaaatagctgctgccttcagtcgctttgagatagacaaaactgactttgctgctgcgcaaactgtcaaaatcctgcaccccatcggtttggtcaagacgcacacccaacacgggataggtctgcggatcagggcggggattgcgctgatgccaccaaacaaacagtgcgcccaaagcgatgattaaaacggccagcaaaaataagcgtctttgatgacgtttgcgataggtatcagcataaatgacccgactgcgcacagtgtcccctcctcgtataaacgccttcactggcgcatcatccttcacataagaaccttggccgcaacgaccaagccgcttatgctccggctgctacccgcgccagctcacgctctttttaaacgcgatcgcggacccagaaacctttgtgtaaggacctcaagcgcaatggcccaagtgcggccattgcgcttgacgccgcttacacgccggtttctaatcgggtcagctcacgctctttttttaccattgtagcaaagtcgatcattttcgcgaaatttggttttatcaacgtcccagtctgttaagtaaaggccaataagaatagaagcgagcaaaaacaatagtaattttatccaacataagcaaataacttgctttttgaagtcgtcatcgttgtctttccctcacccgtgctttagaattagcgtgtgatagcgattgctttgcaaagctgatgaggcttccaccaaacgcaatcgcggaactgggaaggagacggataaatgcttgatgaacggctcttaggaacgatttttacgttgccaacttcggccgcgagtggcgaaatcaccctttatggcattcattatcattatcgagtccaagatgatgcagccgctggcgacaaggtcgttgtcaacgctatttcgccgttgtatctcagcgtggtaaaaccggaacatgctttgcattattaagccacgccaagttcctaatacatgtcacccgtatcagtagaaattcatagacatctggttagatgttttgaaggagtgatttttatgaatagcattattttgatctcgttaattgttgttgtcctagtcattgtcgttgccattcttttctccagcgttgccatcatccatactggtgaagtcggcattgtggaacggttgggtaaatatgtggcgaccctagagcctggttttcacatggtgccaccgctaatttatcggattaccgaaattgtcaacatgaagcaaattccgttgaaggttgacgaacaggaagtcattaccaaagataatgttgtcgtccgcatttccgaaacattgaaatatcatattactaacgttaatgcttatgtttaccaaaacaaggattccgttctttctatggtgcaagatacccgcgctaacttgcgaggtattattggcaatatggatttaaacgatgtcttgaacggaaccgaaacgattaaccaaacgctgttccagcaaattgctgaaacgactgctggttacggcctgaatgttgatcgggtgaacatcgattccatccaagttgacgccacgattcaggattccatgaacaaactgttgcgtgcttctcgtgaaaaggaagccaacatcatggaagctgaaggccacaaacaggctgccattgccaaagctgaaggtgaaaaacaatcggctattcttgaagccgaagccaacaaacaaactcagattttgcaggcgcaaggtcatgctgaaagtcagcgactcattgccgatgccgtcaaagatcagatcaattcgattaatgccggcctgattgataacggcaatctgtacttgcaatacaagaatgtcgaagcacttgaagcgctggcaaagggcaccgctaacacagttgtgctgccaagcactgccattgattctctcggtagcatcccagcagtcggtaccttatttaaccaaaagaagactaccgacaataactgatccggtcacagccgaatagcacgatgactgctattcggcttttttgggcaaaaagtcagctttttccttctgctagacaaaatgccgtcttaacaggccgttgttggccaatgatttgcaactagctcttgtttttaggcgttaaaaaacactcactgtgtttgaaaagccgtgcggcactttcagaaatagataaaacagcgtaacattgatggaaataccccgtggctaaccacgggcaacgagaggtgaacctaatgtaccagcttttaaccgattcttgctgcgacttaccctatcaaacattacacgatcatcatgtggattttgtctcaatgcattttacaatcgatggtcaggaatacgaagacgatcttggcgaagataaatacgatatcaatgccttttaccagcagctcaagcaaaatgtgatgccaacaacgacacaggtcaacgttggccaatttgtggatttcttcacaccttatgttgaagccaaaacaccgattctatacattggtttctccagtggtttaagcggtacgtttgattctgcaacacaggctaaagcgatgttgttagaaaagcatcctgatgcccaaatttatttaatcgacacattagccgcttgcgcgggggaaggccaatttgtgttggacgcgattgataaacgcgatgctggcatgccgattgctgagttagcgcaatggctgacagatcatcggttgcattatcggatgtggttcaccgttgataagctagattttctgtatcatggtggccgggtttcccggacatcagcagcccttggaacgatgctgaatattaagccggttatggacgtcgatactgctgggaaacttcgcgttgtgcgcaaagtccgcgcccgaaaacggtcactgatcgacttaactgatgaaacgctgaaggctgttaaagccaatccgacgcaccgggtcatcatttcaacgtcaggcgattatgacgccgccaacttcgtgaaagaccgattgcatgccgcctcacctgaaacaccgctgcaagtcggcaacatcggccccaccatcgccagccacaccggctttggttgtgtcgcggtcttctcgatggctactgacgatcggcaatgactgtctctcaggctgaacgataacttctgaaacctacaatttgtcagagcccaaataatcataggaagtgctaagctaaaacttccttgccatgccaaatgctgcaatctttaaattccaacagactatttatgagagcgaagaatgatttgcctatagatggcaaatcactcttttttagtctgtctggtagctattcagaatgtcccaaagccagttaatcaagcatgaaaaggtgctaattaggcgtacttcaaggtaaaataagacaagattatggccaaggaggtttttccaatgtccattcgccctgccatcaccaacgacgtctcgcctttattatcactcgttcaaggttattatcatgacagccctgtcccacttacgattgatgaaagtgccatggctgctcatctgaatcagctacggactgatgccacattaggggctttgcttgtggctgagttggaccagcaactggtcggctttgcgattctttatcgtagttttgacacccgcacgctcaagccgttgctgatcatcaatgatgtttatgtcgcccctaagtttcgccgccacggtttggcccgacaattgatgcaggctgcctttcaactggctgatgagtgcggttatgcaggctgcagttggcaaacacggatcagcaatcatggcgcccagcatctgtatgatcagcttggcgtccgcgaaactggctggattcattatgatcgtgctggcaaagattaatctgaaaaaagagacaagttttcggctgtttaccatgcgttttcgcctgataatcggtcgcagcacttgtctctttttttaattttcaacttaacgactgtttacgctcgtgcagccgatgcaggttcaaccagcctaacagcagcacagctagcaataagagtaacagagcaaaatcatagctacggtgcatgccatagataaaccactggggatggccatgcggataatcatgaatgtaccgaccagcctgcgtactcatattcaggtacaacaagcttgtcaccaaggcaacaccgattgtcatccccaaattacggccaagtgcggccatggaccccgccagtccttgaaacttcggcgcgacattgtccatcatcatcggattgttttgaaaagcgccattggccaatcctgaccacgcgaggccaaacacgatccaacccaacggccagttcggggttgccgcggcaaacaaccccatcggcacacaccagagaaacagcgcgaagaaagacacccgttctgctccgaaatgatcgcccagattcccgccaattggtgcactgataacattggccgccggaattgccatcatacaaaagcccgccgttaacgcactcaagcctaatgtttcttccagataaaacggcatgatcacgctattaaaatagccgagcatatagacgatcatcgcagtcagaataccaatcgtgaaacccggatttttgaaaatggcaaatgggatcagcggatcagatgcatatcgctcaatctgcacaaaagccacaagagcgacgaacgcaagcatccctggtaacagcgtcacccacgacagtccggctgtttgtgcccagaacaccgtgatgaaaaagcccaaaatgattaccgaataactgccatatcccggccaatccatgtgggcccccgccaaggacggccgctgccttggaaaaaccagcacgccaattaaaaacgccaccagcgcaaccggcacattaatcaaaaatatccaatgccagcttaaaaccgccaacaccccgccgccaataccgggaccagcaatattaccgagttgcaacaaggcaccgttgaccccgagcgcgcgaccatgctgattcatcggaaaaatggcggtgatgatgccaaaattagtcgccatcgtcatcgcggcaccagtggcttgaatcagtcgggccgttaataaccatggtaaggtcatggatagtccgcaaaaaagcgagcctagtgcaaacaaaatggtccccaactgaaacaaccagatccgacccacgctgtcagacaacttctcccagaaaataagcaggacacaaatcgcgatcatataaactgatgtgacaagttcgacggtgctcatcggcaccttcagctcccgggcaatgtagggcaaagcaatattgacgatgctggcatccaatgtagccataaaggacacaattgaagttgcaatcaaaatcaaccaacgacggctggcgcacatggtgatcatctcagtttcattttagatttaaagacaactaataactgacacacagcgttatgaaacgatttcaggcacaagataggcctactaatatcggttttatttaaaataaatgtgtttaaatgctaccgacgccaaatcgtgacgcgctttgcgggcagtcgatacataccatcggtcggctgtacatcgaaagcttgataccacgcctcaaagttttgcacagggacattaacccgcaaggtcgccggggcatggacatcttgccgcaacaccgttttagcgcgctctggccgcattttagtcgcccaagaacgagcataggcaataaagaagtcttgcagcactttcgggtcagccgaatcccctaacaagtccaacgccaccgccatgccggcattatcggcgatgttttcgctaaccgtcagtcggccattcactttgacgccttcatacaataaaccgtcaaattgatccgcaatagctgtcactaacttgtcgaaggcttgtttgtcctcaaccgtccaccaattatttaaggtgccgtattcatcatacaaggcgccattattatcgaacgaatgtgaaatctcgtgaccgatggtagcaccggtaccgccaagattttgcgctcgggtccagttcagtgagtagtatggcggctgtaaaattccggctgggaaggtgatgtcatttttcatcggatcgtagcaggcattcacaaggtgccccggcatcccccaaacattgcgatccactggctgacccacctgctgaagccaaaagtcttgcgtctgctggctcaattgcaaaatggtcggcagtaaatcagcctctggctcgacatgcaggatcgcgtaaagcgggaaaagttgatctggataacccattttaattttcatagtcgctaatttgcggacagctttctgcttagtcgctgggcttaaccaagtattatgttcaagttgaacttggtattgttgcaaaatttccttgaccatcgcggtaatatccgctttcgcatccgcgccaaaataagtctgaccatagtactgaccaattgcatcatcaaaatagtcgttggcaaccccaaaagcatgcttttcccaagcttcgggctcaggctgtccagccaaaaaacggtcatattgaccagcaagttggcggctatcatcgcttaaataatcagcacaagccaatagttcgctaataagcatccatgcttgccactctggatagtttgcttcggtgattaatgtcgacagatgcggcagataagcaggcaccacggcgttgaccttcgtcggtgtctgcggcattttagcagccaaagcttcgggaatgcctaagaaaccagcatcttctacaaattcagtccaggttagcggattgtcaaaggtgctatcaacggcaaaatcgacatttgccggaatgaacgcagctaatcggcgatcaaagtttttagccgccgccacatagtgcgcttgtgctgtctggtcaaaaccggcctcacccaaaagcgtcgcgaccattttcgaccatgcagctaaatctgccgcattctctgcatcatcggtttgatacatggcagcgtcaggtaaaatcgtggccggaccaccaagattcaaaatattgtgagccgcatcgtgcatatcagcatcaacgtacgggcttactggcaacacatattgctccgccagtagttttggcagtgctgcacgaaactgggccagcgttttaagcccagcaatcttatccagccgtgcacgaaccggtgtcatgccgagttggttgcgtcgaactttatcgttagccttagcaaatagtcgtgcagcattttgcagtggtgaatcggcggcttgtggtgccgcgtttattttcttcaaatcggctaccaacttgattcgaatgctatcagttagatcactgtcagcactcacgacgcttttgtcaggcgggatcaccgtgttctgctgccaagtcccgttgaccgccatatataaatcatcttgaatacgtggtaatgacatcaaaattcctccttttaagcgcattcgtcgaaccaaaatccgatgctgctcctgcggtttttaaatgcgataatgcaagcatagtttgactaagcaagcgcgtcaattgcttgcacaatgtccttgaaacttctatcttaaaagcaataagacagagagggtgatgagatggcattagaacaatatcggtttgacggtaaaggcaagtttgatatgaaaggcttcacgaccacaccgccagatagttttaaaaataaaaaagatcaaattaaagcagacattgagaataacatcaaaacattatcaaaagtgcaacaacatttagccgcgcaaaaacaatacagtgttttgatcattttccaaggcatggatgctgccggaaaagacagtatgatcgagcatgtgatgtctggggttaatccacaaggcacctcagttgtctcgttcaaagtgccgactgagctggagctagatcatgattttttgtggcgaattcacaaggccttccccgctggcggcgaattaacagttttcaatcgctcgcaatatgaggaagtcctcgttgaccgcgtccatcccgaattgttactcaaggaaaacctgcctggcatcgacagtgttcaggacgtttccgatagtctttgggctgaacggttcaatgatatcaaggctttagaagcttacgcacggcgcaacgggattctaattttgaaatttttcctgcacctttccaaagcagaacaaaaaaatcgattccttaagcgtatcgaggttccggaaaagaattggaaattttcactggctgatattaaggaacgccgctactgggatgattatcaaaaagcctatcaagaggctattcagaacacggcaaccaaggccaatccttggttcatcattccatctgacgataaatggtattcacggctgattgtttcgcagattatcaatcaagaagtcaccgctttgccgctaaaatatccagagatttccgatgctcaaaagcagcagcttgaacatgctgttgaggctttgaaagactaaatagattcgtttaaaactattttatgcagaataaaaagacgcctcgacaaaattgaatcctgtcaaggcgcctttttgattatgctttggccatcgcatattttctgatggcgactgctgcaccatcatgatcgttgtcagggacaacagttttaattgcatctaataccacaggcaacccattggccaaggtcaccccaagtgcagcagtttttaacattggcaaatcattttcaccatcgcccaacgccatcgtctcagtcatggggatggcaaacaagtcactgagttggcgaagagcggcttcttttgacacgccttgccgcacaatttctagataggttcgtttcgaacggctagcgaccaattgccactctggatgggcaagaatgatggcttccgcgcgatcaaccacagcaggctcacccatgcacagcattttatgtactggcaatccttcggccagcatttgttccataggcgcagtttctgcgccaaagcctgtgattgcggcttcttgttggacccacgcatccaccacgttcacataccaatgcgcgccactgaaaatattcagactgagtgccagtttagctaacgcttcgtatgcttggctaccaatgccagcgggccaaggcgttgcggacaggatttttaaatcgccatgttgcggttggcaaatgacggcgccgttgagactggcaagtggcacgtcgagacccatctgatgtgccaatgcagtcatggccaaaggcggccgcgcagaagccagcacaaaggttccgccagcagccgcgtattccttgatggccgttttaacttcatcggtcaactggtgatttgaattcagcagcgtcccgtcaatgtcacttaaaatcagtcgataacgcaaatcaaaagcccctctctttttcataatcccctcgaacgattcttttcagccttcacgactgctggtgggtagccgggtgcaatggatcgttcagggccggaatactctggcgaacactgaaggcaaaacccaaagccgccaacaaaattaagcctgtggcaccgacaaacaacaactgatagctgccggtgccctcaatcaccattgctcctaacaacggacccaatgcgcgaccagctgaagcaaagccttgaatcaatccctgataacgcccttgctgtgccaatggcgtaaacaaggtgacataagtcgagactgctggtaaggccaagacttcacccatggttaaaacaatcatcgccacgatgaacgttatatactgtcctgaaccgttcagcaaaagcaaaaatgatccggcaaacaagacaaaaccgccaatcaagcgcaggcgaatgtgttgcaataaccagcgatcaaaagccgtcaaaattggctggaatagcacaatcagtaaggcattaatcgtccacaagaaactataatccttaatcgtcaaaccttcgcctaacatgaaagcagaaatattactctgccattgttcatacattagccaggtcacaaataaggtcaccatcaacatgactaacctcggcttggctgggttgcgctcgctgctaacagtttgcgtggtcgcagtcgcaatcgccactttatcaattcgataatgcaacaaagcaaccactaaaaataaggcaaataagccagttgccaaagcgaaaacaacgccaataccataaggcagcacaaatccgacaattaaagtgccgataaccaaccctagattcgatgtaaagtagagaatattgaacacgacactcggtcgtttattctggatccgagtcgcataggaattaatcgccgtcgttgtgatgccgctgccaagaccggacacaactaacagcagtggataagccggccatccatggaagaaaatcagcataccggtcgcaaaaagattcaggccaataccagcaagaactgtcccatatggctgccaatgatcaaataaccacccaccgaaactgttaccgatcaccataaacatggaattagcaaaaagaacaatccctgcaaccgttagtggttcacctaaatattcatgcatataaatcgttgttaacggccagatcaggctgatcccggtattcgtaatcaacgaacccagaaataaccatttcattgctaaagtcttttgctgcaccatactcccccatttcttgtcactgctactgatcataagggaaatggccctattatagcaacttgaatgagcaaatatttagggtgttatcatgatttgcccaaaataaaaacctagtgtaaaagttcgagctggttccgcggcaattcaggggtgccgactgcgaagcttgagtggtggacacaactgcaaactcacaaagaatcaagatcttgtcgttcagtcagtgcttgtgccaaatacgagcctcaatcaacaataagatcgacatgctgatcgtgttctaaaatagaatcatgagagctggcggagcggcgatgggctcagtggtgagattggtcttagtggagtggttttctccgcttagaccaaggccgagcttcaagaccgcgggctttgcgggcttgaagtcgtgcccaccacgttccagcccaatcgccgcggagccagctcggactaaggcgaaatctcaactgaaatagaaccgatactgaatcaacaggtattcatacctgctacagtcaaaaagaggcacccgcagcaatcaattgatgtgcgggtgcctctttgagttgcgccatgatagttgtgccgtcttacttcgccaacgtcaaagccgtaatactttcaatatgctgcgtctgcgggaacatgtccactggctgggtttcctttgctgtgtagccaaaagcggctagcagctgcaaatctcttgccaaagtcgcggggttgcaggacacatagacgatctttggcggcttcatataaccgacagcgtcgatgaaacttttatccagtcctttgcgcggcggatcgaccatgagcacatccactggcagttcgttgtctttccagcgttggatgacctcctccgccttgccgacttcaaaggtgacattatcgatgtgagtgcgcaccgcgtttgcccgtgcatcgcgcacagcaggttcaaccacttcgacgccgtaaacatgtttggcatgacgtgccatcgtcaaggaaatcgtcccgatacctgaataagcatcgatcacattttccttaccagtcagaccagcagcctcaatggcctttttgtaaagcacctcagtctgaaccggattaacctgataaaaactgactggcgagatctggaattcactgcctagcaacttatccagcaaatagtcctcgccgtaaatggttcgtgacttgcggcctagaatgacgttggttcgtttgtcattcaagttcacaaccacactcgttacttctggtaatgctaaggtgatctcttcgacaatatctttgagatgcggcacttgccaagtttgtgacaccaagacaatcatcatctgcttcgtataatggccccggcgcaccatgatgttacgaataacgcctttattagcgcgctcatcataagctggcacatggtattttcgtaaaagatcacgcaccaccacaatggcttggtcaattttcggatcttgaatcagaaagtcctcaattggtacgaggtcgtggctgtgttttttataaaagccagtttgcagttcgccattcacggtacgaaccggtacttgcgccttgttgcgatagcctaaaggattcgtcatcccgatggtcggcagcaccgcaatatcaagatgcgcttttttataaagttcttgaatttgtttctgcttaaattgcaattgtgccggatatgccaagatcgacagtggcgcaatccccgtgcggatataagtgctatctgcaccgggaacacgatccggtgagtcgctcaatcgtttgacaactttggcaaagccatattgcttctgcgttttgaggacatgcacctgcattttttcgccaggcagggcatcttcaatgaaaagcggaaagccatcgactttggcaacgcccatcccttcataagtgagatcttgaatggtaacttccagatcttggttcttggttacagctggttgggccaaattagtcatccttttcgtcttgtgagccgatctgtccatcaccatcaatatcttgatgagaaatggattcgacttcggccatgtagtccttctgcttctgcgcgtccgtaccaagattcttggtcgggatctcgtctagattagcatacatggcaatatgttgcttcaaattaataaacgtcatcggcgcatcgccgccgtattcaccatcaaggttaattttcaacggatcgtctccgccggccttcacccgcaactttttagtctttgtatagataatattgggatcatccacgtggcgaccaccattgaagacaagcgccattagcttcagcaaattcgccatgttcgctgttttaacaataattaaggagaacttgccatcaccaagtgcagcatccggcacgatctgctcaaaaccgcccacagaattggtaaggccgaggaaaaacatgctggcgggtccatcataaaccccgccatcatattccagtttcatcggcaccgtccgcaccgctggtaacatctcggcgcctttaatcacataggcaaaatagccaaaaatagatttaacttcagacggcacagaataagtgagttcgctcaacaaaccaccagccgcgatgttcataaaataatgatgattggcttggccaatatccatcgcaagggtttggcctttgagaatcacttgggccgcctcaaccggatcatcccgcgaaatccgcaaagcacgcgcgtagtcattggtcgtccctgctggaataatcgccattttggggcgttttttagctggtgcgatcccattaaccacttcattaatcgtaccatcgccaccagcagcgacaattaagtcgaaaccggcttcagtggcacgctttgcttcttcacgtgcagaaaaaggcttcggggttgtttgaaaggttgaactttcatatcctgcctgttccatgatatccaaaatgtcggggacgaagcgctttaaaccttcgttgccggatgtagggttgtatatcaaacgcgcccgttttctcatcggtcaatgctccttaaacgttttaacaatactggactgctggcccgttgctggcggaaacagtctttgtcataatcgtgaatcgtcaatgtcttgctcaaaagcttcaatcatgagcaacttttgagcctatttttcttggtacttcccatctgctgccacaatagcaagactagcaatttgcgcaataacctcggcatgtaaacaacaaagaacattgtctacatgtcgaggctattatccgaactgaattgctagatagtcagtatcacttatcgttgcttaatctcagccatcaaaatctggttgaccactttagggtttgcctgaccatgtgtttgtttcatgatctgcccaactaggaagccaattgcccggtccttaccagctttgaagtcatcgatactttgctggttattatcgagaatttcgtcaataatcggggtcaatttagccggatcggaaagttggatcagacctttttcatggacccacttatccggatcagtatcatgttgaatgatttccttaaagacctttttggccattttactggaaatcgtgccatcaccaataagcttgatcatgcctgccaaatgcgctggcgtcaaggcaacttgccccagttcaacgtgttgggcattcaagaaaccggaaacctcacccatcagccagttagacgcttgcttggcatcagcgccttgcgccacagttgcttcgaagaaatctgacatttccttcgtctgcgtcaagacaccggcatcataagctgggattccccagtcttcgatgtaacgctgccgccgctctgctggcggttgcggtaaagaagcctgaatgtcgtcaatccatttctgggaaacagccactggtggcaggtctggttcagggaagtaacgataatcatcggcgccttccttaacccgcatcagaagcgtttctttagcatctggatcccagcgccgggtttcctgacgcacttcaccgc

SEQ ID NO: 4 - DNA, 23393 bp, Lactobacillus paracasei
aacggagagtaagggcgaaactagatccctatttaataggcttgaataacattttgtacacattgtgtgcacatcaacaaaatgaacgcaaaaccccatccatataggacggggcggagttggcaaggaattgcttttatctggaagacccgccgagggggcaggtttctaacagtatacagtccgtatgcgcgattattcttggggtgggtagcagcttggcttgccaactcctaaggagctttttactcctagctattggagttttgctccttcaccgtcagtatcgcatggccatgcttggtatgcaaacaatttgctcataataagttacctaagccggcgtatgtaaaccttttgcctttttgcatcaactctgtcaactctatgcacaaaaataagcctcccgccattgctggtaggggggtatttgtgtcttgattagtcacacgggtctaaaacaatccattcacatacgtgtggaacttgtcccttatctctcgataaagatttgggtactggctttgaatcaaacaaattggatctgcggatacatctatactgttcacagtataaaatttgtgcgtgcgaatataagacactggctcattcaagcccagaaacggatatgctctctgtgttaccttaacatcaaaaaagtcatcaatatttttctcgtgactaactttagatacaggcagcaccgaaaaatctgtcggcccataatcgttctcagcaccgattataacaatcggtctgcttttaaacctttcttggcctaaaagctcatcataatatggaagcctagataatctaagttcaccgataaaatcctgattatttagagtcatagattcattgtttctcctgtaaaatcgggaaactcatcaacgtacatatcataaacaggatcataaaggcgttggctttgtgcctctgcttttatcacactcttatcaattatcttgttatccctagaatcatcggatatatcgcctcgagctcgcgaccaagcagccgtatgatgggataactcacgtaatttccatggtgtatactgagcatatttttgcaaggtaaactcaattaccaccttggttgtagcatcaacatgagtagcctcattgctcgtcatcggtttataaccgtcattaaaaatgtgacgaatttcttttaagacagggccgtggcgccagtcttcaaaatcttcatcaaaaagtggcttgttggtcaaagcaaagctttcgacttgtgaaaaatacagtagcttttgtaacttcagttcactgtctaagtcttccccagagattttcttatatctcaataaaacaaaacgaactacttcatcaagattcttcatgttggctgccccctttcatttgtcatactactacttaaaacttttctaagctagcacaaacactttaaatgacacaattttttaatctttcagaaaacataatctagaaaatgaggattcgctctctcggatagatcaggctatagattgatttgccattgttagccgcaagtgtgtacatgctgatgccatacttgctggcaatactccagaagctgtcgccagagcggactgtgtagtacgtgtggcttaccggcgaggtatatccagacgaacgcgagccatagctctccccgccattcacgcccaaggcaacataatgatacctgcctgagtagctgagatagcgtgcccaaacatatgtgccacggatatacacgtgatcataaatcacactttcaccaggtgcatagctaccaacggatgcatagccggtgccggcaccagtgcgaatgttgatcgtcgtggacggcttgaaaacacccgcttgcgcatagtcggtatcactggctgcattcgatttcgctggttggcttggtgccggtgttacaggcaccgacggagttgctggctgcttcgagtatccattatcggtcacaccaagcagatcaatgttaccatcgaggccttgcgacagcccaaatgcgctcgtgtactgccaaatagctaccccatccatactcggaaaataaccgtagtctggtttggtagttggtagataatcacggtaagcagcaatccaaaggctgttaggaaattctttcagaatacgctgataatcgacgtgtgccaatgtatatggcttgtaactgtaatacatgggcgtgtagccttctgaatgaatgcgccgcataccagctaaaattgcatccgtattagctgccatattcccagaagcaccatcttcgtaatccaaagcaacgatgcttccctttggcgtctgcgctttgatacgaggcatataacggtcaagtgcttctaatcccaactggctacttgcaccaacaccataccagatgtaactatgcacacgttttcctgccgccttggcactagcaatttggctatcatacgtccactgatcgatgtacgtaccaccgtaagtcccgccaatctgagctatgacgaacttgtcttgatctgttccatatcgtccacttgctccctgatacttcgcccaatccgggccctgatcacccttggccgcattgacttgtgatggcagggcaaaagaaatagccgccaagaaggcgactaccaaggtgatgagcttagtttttaatttcatggtgccctccttattgctgtggagcaacagatgtcggtgccagctgagccttaactgcatctgccgctgcttgagctgcggcagctaccctgtcttgattagatgcttcctgatcaaccgtcttttgcggataggtttctgccagactatccttcaaatccgcataagatttctcaactgcattggcaattgtctgctcgtctgtgctggtgaagccaagcgaattcaagccgtctttcacagcctgaatggcagtcgatttcttgaccgcaccgtcaatcgcctgtgtcacaccaagctgttctgctgctgttaccgcagcatttgccaacggtcctaatacctttaccaaagtcagtgcttgcttgttagccagcaactgttttgagatccaagccccaatgattgggactgccgctactgcaagtgataccaaaagttctgtcaaattattcatttgtatcttcctttcttatttcaagatcatggactcggttatacagtagttcaccagttccatttccaccgagtgccttgtacggtttaaacaagtagtctaggtcatttagatctgctgtgctgacatagccacgatctaaatatgtctggcatgtcttgtataagtcgtgatgctgtaacccgaccatcgctgttttgagcaactcaactgagtcctgcaaagattctgcttcctttttacggtctagttcatttgcggccacctcgtttagccgttccttcttattgtcttgccatttaccatacaaaattttgatccaccacatcagcaaaccagagaccagccccgctccacccaactttataaataaatccacattgttccacttccattccataaaaatagtcgctagcttttgctggcgacatagtcattgcctgtgatttgcttgtattgatctggggtgatcattatcggtacataaggcgttaaatcaatcccccaactgtaaagtagtgcacactgatcatagttagtcatgacttcgccgcctttagcttagctacttcaagagtaagcgcggcaatcatctgctgttcaggtgatggtccgggtaacggatgatcattcgccggatcgtaaccctcatcggcaacgattttgcagtctacaagagatgcgtgaccctcaaaaaactgagacacatcatctgcttcgatgatttgttgaccgtcacctgttggtcctactttggcatcttccgcttgataggcccagttggtcaggcggttttgctcatctagccaaatcttaatcttcatcttaattcaccaccgcatcattggtcggatacgcatcatgagtaatgaaattcaagctgccagcatacccgccttgtccacgccatggaataatgtaaattccacccgctgaaacatacaattcacaggctgcgcccgtatacgacatgctaccgagcaaccttgctgcatcatcactgttaaatgggctataccccggtcgaatgttcgcaatcttgacccacccattgctcgtcttcatttgaaaagcaatcccaatggtgacatttgggccttttcttgaatacgagatattgaggccactgacatcgttagtttccagtcccgagtctttgtggtagtaatcaaccgcatcatgagcattaaaagtggaagtaatgtatttggcagaattaccaagcccgctaaccaagtctgttagttcaagaacacccatcgaaattctgctggtgtgcatttgtgttgttccatctgtctgcgtaatgtatgacagtaatccatcgggatttacttccgtatgatagttttggccgtttggattgccattagtgtcctcaatattaccggaaatgacatatgaggcaccgttgagggtaagggaaccactggacaatatcccggatcctgcaatgctcacgtgttggaaaggaacgttgatattaggcgaattaatctcagcggaattaagaataattgagttgagttctttaatgtacaaaacagcttgagcaatcgcatcatctacccacttggaaccgtcatagcgctgtacagccgttgtgtcttttaagcttgtaccatgccaccaagtatcaccctttttgggattcgccggggcatctagctgtacataaggaaacggcacatccttgcttccaggggtaccctgaacgccttgaggcccttgtggtccctgtgggccagtgtcgccctttggcccttgcactagttgccaactataaacagccggattagtactgtcagcttgcgtaaagtctgtataactaccgatatacttgcgagagccgggagtatcgagcgaaaagttcgttttgccgtcactgctatcggcgtatgcgatatggaagtatggtgttttaccatcggcacctgctctccctggcaccccatctttaccatccgcgccatctgcgcctttaatgagcgaccagttatagtcgcttggattcgtactatcgccagatgtgaagtcgctgtagaagccaatgtacttgcggttaggggcagtagttgaaaagtcggtctggccgtcttggctgtttgcgtaagcaaagtgggcataagcagtacgaccatcagcacccggtttccctggcaatccttcatcacctttgggtccaacgtcaccgtcctcgcccttaaaaagtgcccagttgtaatcatccggattggtgctgtcagcaagtgtgaagtcactgtacgtgccaatatactttttgccatcgccactggataccgtgaacccgctttggccgcttacatcattcgcccaagcagtgtgaaagtagcttgtacggccatcagcacctttggcacccggaacaccgtcagcaccatccgctcccttaatcagtgcccatttaccagcgtaatcgtccggattgtcgcttgggacggatgtcttatttgaccaaacgattgccatatacttcttaccagttgggaaggcactcatatttgttccttgatcatcatcggcatagcgaagccaaggataatattgaattgtcttgggcatgttggccatctggttggcaagatcgctgagccgttcgtcaaagctgactgtttcatgagcgaactcacccaaagtaagcttgacagaatggttagcacggctgcgctgaatgctcaacactttggcagacaggaatagctgttgattctcatcggcaatgtggacggtttgattaagcggtacgtatggcgaattaaccaaatcaatgtcgtacgtttcgtttgggtggttatactttttcaagtctgccaaagccgcttgcaaaagttccgcctgcgattttgaatcaaacgttttaacccgattccagtcagactgtgttgggttagggttgctgttgcttaacaaacgtgaatatttctgcacagcaatggtatcgtgcaagaacccgtactgatcaagcacaaactgtcctgttggatcagtccatttgtagccgatcaagttgattgggtcctgattagttgatccattcgtactttctggcaccgctccataagccttgatagatgtttccatgtcataggtatcgagatgcgtgacgatattgttgatgtccttattcatttcaaaggaaatcaagctgtcaccggccgtttcatgccgaatgttaatgacacgcttaaccaagttggttccaacaaactcaaagccaaaactaagcactgcatcaaaatcttttgccacggcaataatgcgagccaacgatgattcttcactagtccactcgagtgttcgaacattgtcaggaaattcgttgatgccaatctcccagccagaatcatttgtaaaccttgtgatgtagtcagcgatggtatatggcttgtcggccttgaaggcgccaacggtttcgttaattaaatcattaccagcatcgctggcaacaattgagtgaatgtggcctagtgaatcatggtcaaccgattcaatcaccatttggtgagcgttgccttcttcatcttgatacatgatgaagttggttgctttagccatctcattgactgcttgttcctgatcagtcgtgaagtgaatatcaagagaaagctcgaccgcaggacgattgtcaacactttgtgtttctatatcgttgtcaattcgccattcgcctttgccatcagtcgacccaacgcccaaaatgtttgattttcgatctgcaaagtaatactccatttatagccaggcctcccttatctcgacttcacatgcaaatggttgtgcccagctcgagggcgtgatagcaatctcagtatcaccgggtggcagttcaaattgctcccattgattaccgatcgtgtgaagggtgcggttctcagacccattcaaataggtcttagcattggcaacatcaatggtcagcacatcgccatttgaaaacctgttcttgatgtctgtccaccaatttacgtgctgccagtcaaattgaaccgcgattaatttcatcccagcttgtccccatgtgttgttgcgttcaaaccaaacggaaaatgcttcaacgttctcactaatcatgtctggacgagtcaaaggtggcaaagagacggtcatttcacgaccacttttgccattccatggagagacttcaaaattgatgctcgagccgaatttgctcaatctagcttgcattaacttatcatttgtgaatttcgatcgatcaagtgacatggttcccacttgctggtctttaacataacaattgacctgaatctcgtctttgacagcattgttgtctgtgatcaccatttgatactgaactttgccaccggcctcaagcgttagctccatgcggcccaattcggacaccgtcgtctcaaaatgaagcatcatggatacagtaaagttgttgttacgcgtattttgacttgtggcggcaattggtattttggcggctggaccattccaataagtcccagttgaagcatatgcaggttccatatgcggcccgttgtagctgtcactggcataattgattgatccagtctgcttgtttggtttgcttgaatcaccgccccaattcggattgttagtggctgattgattgtatatcgtgccggatattggtgctgagaagtctccgtttagccctttctccgacacgtcggtagtatatccatctatttcttgcgtgccgaattggagaatacccgggcgatcattaacaagcccaaccatgccattatcagcatgcatagttgccgtaataactggctcaacaggataagttccaccattgtgtaccgtgatggtattggtatagtattcaggatccgctgggttaggcgaccatggagttgctgtctcaccaagctcaatcttcacctgatcaatataaaacgctgttgtgtcggtgttcataaggaaacatagccgcacattatcaatgcttgtcgttgttgtcagcttatatgtgaaactagtccaggtctttgcttttaacgaaacgttttgacggccaaggctactccatccacctgagtaaccactcaattgaactaccttatccgaatctgaatagaggtagccagaaaatgtatacgaagtacttggtaatgggttaggaacaggaatgccaactccgctatctccactatttgttgatgtagtttttaacgaataggctccggagtatgcaacatcatttgattgagaccatttaccagtattcacagttcctgcagatattgcatttgtttcaaagctactattcgaatacaaattttcagagagattcttgtatggcatgttgtcaaacgtcttcgtggctaccgagtgcgcaatgccatcgggaaccatgaataccaaatcaactttagcaatataatcaaatgttccatcatattcctgtgttccttcaaatattgcatcaaagtagcgatctggataattcgatagtttcagttgctttgtcacgtttccgcttaacaatgaaataagatgatctcgcgtttcagcaactgttaagtctgaattttcagaaagtattgtgccttcaatcgtaattggcgttttagcattgcgcgaataagtcagttgttccccgtcagataggccgacctggtcgtatttgttgtccttatataaaaaaggcattgtaacatttgacacgataaaataaggagacaaatcaacatctccgaatgttaccgtaataacttttttcaaattgtgatgccccttcctcgtgcttgcctcttgtcactaattttttgtatctgatcaagatatggatacattatcttcgctacagattgtccatttatggtaaagtcagtttctcttgtcagcaaagtggctaacaacgcttttattgatccgagcaatgtttctatatttctgttgtcagagttattagtgactgtgactgaagatgcttgtccaagcgattgggtcacttgatttgctaggctaagcgctgttgcatttgctggaatatctttaccattggcgtattgaggtaattttggaaacattctagccgtcatccctgcagggacaatttgagcatgcttttcgattggcttaatcacattacgaccaaacggaatttcaatgcccccattaggatggataatagcttcacggaacgttggacctttttgatcgttaaccattgcgagaccgccggcaaagttagaatcgccttttgctcgagtagcgacgtttgctgaacgtccatacgcaccgctaacgacatgctcttcaacataaacggtcttcaagacagacgttttggttcgctcaacaaatgaatcaacagctcgcttagcttgtgcagcagggacagttgactcgtcaatagccttcaaaattgcttgccgtactttagacgatacatcgttccaaacgcctaaatctttaagagtctgctgtagcgcagctcctgtcttggcttgcgcaattaattgctgttgtttaggcgtcaagctatcccatttgctcaagtcttgcaatgtctgttttaatgcagttcctgtcttggcttgcgcaattaattgctgctgcttaggcgtcaagctatcccattgacccaaatcttgcaatgtttgcttcagcgcagctcccgttttcgcttgtgcaatcaattgctgttgtttaggtgtaaagctatcccactcgctcatatttgcgatagcctcaactgttgcgctatttgtcttgttagttgcccatatctgagcttccttccagtcagatacattccactgattgttagcaatcatggcgcttgctacttgctctttagcatttgaagacaaatgtaggtcactctgaatccactgcaaatcgtcccactgcttattagcagccaaggcttccgcaaccatgtcttgggcgtttgttgtcattttgccttcttgtagcaaaagctgaatagcattccaagtcttgccactcttaacggccttttgaacctcttcaacggcattggttttaactttgccgttcttatctgtcagcttaaggttgttccaactttcggcagcctttttgacagagccagataagccatctaatgagacgctgacggctttttttgtttcatccgcggcggccttagttctgctgttatacgtatcccacgcttcagcggcttgcgtagcagtaaacccatactcctgtgtcagctcagaaatgatttcagaatgtgacttgccttgcgctttagcaactctgatatagtctccgccgagcttatccatcgttgcaatgtgttcccgttcaagagcttcaatggccacattcttttcagcttcagaaagctgtgcattaccattgattgctttgagcctttgctcatagctcgacatctcttggtacgaagcatcgccaatggactttgccattgatgacaattgctttacggacatcttgctggtttcaactagctcagcagcaagcacttgacgttgctgcttggctgttaatccaagggttttaatctgagcttcggccatttcattctgaatattgccaatcttaacgcgttgttctgcattaagagcaacgttgttgtcggcggaattttttaggatgtcatgtgcttctttagcatatgacttcatcttcgcaatctctttgttacgagcggtttcttctttgccggcctcttcttcaagagcagcagcagcttcaccaccaatagccttggcaacatcatcagcagcctttttctgagccttacttgccttttgagcagatgtaatcataccgctgaatgctgagttaatagtttttgcattgctagagacggaaccggatgccccagacatggcaacatcaactttgctttggtattgtgacatttcagttgccgcagtatcggccgttttgccgatgtcagatccccatcgcgaagcacgattggaagactcaaccatctgtttgccgaagccttcccaagcaacgacaccaatcgttgctgcaccggctacagctatcatgccaagccctaacggagtcaatgcgcttcctaaaacgcctgtttcaccagcggcaacagtcattcttccggctaaatttccaattaagccacctgtattggttgcggcaccgccagctttcgtcaaggttcctacaacattacccgttgcatctgttaactgacccataaccgtcttggctgcttgcgatttagcacccaatccggctatttttgcaataaggccaactgatgaggtacctaattttccaagtcctgtggttaatcttccaccaatgctaagcactgggcccatggctgcggccaacagcccccacttaacaatgttttgctggacttgtggatttagtttaccaagccaattaacagcatcagtcaaatccttgataatgggctgcacactaggtagaactttttgtgcaagcgtcatccccaagttttcaacattttgctgtagaacttttaactgattctgagcagacttaaggttcttttccgataagctacccacatagttctttttttcagccttatcaacctgatcatttaattcggccaactttttgctattttgtgcaagaataataccggcgttctgaccagtagtaccaaaaagactattgaatacagccgcttttttagttgcgctcatgtccttggtatgctgattgagtacgtccatgatggtacttaagctcttaagctgaccgttagatcctacaatctcgtctttcttaatgcctagagctccaagaacatcttttttagttccaatgttcttgatagcagtgttcaagctgataatcactttacgtagcccggtaccagctttgtcagcttccacaccgttgttagacaaaacagccaaaccagctgcggtttctgacaaggtgaagtgagcttggtgagctgtcgatcctacatatgacataccaacacctaaggactggaaatttgcagcagacaaatcagctgcatatgcaagctcattgacggctgtcttggtgtttctggtcatagttgccgtattattggacttcatgccaaatgcttcaagcgtggatgatgccacagaaacaacatcgttgaaatcatcgcctgatgccaaagcaccttggagttctgttttcatggcagcaatagcttgtttagatgtatagccacgccgtacaagttcttcataacctgctgaaatcttttcaacagatacaccgtaatggtttgagtattgaattgcgtctgattgcatcttgttgacgccagaaatggcttctttagctgactcaccgctagacgtgagcaagtttttaattactagaagctgattctgaaatttaattgccttggcagtagcagccacaaatgcagcgacaattggcacagtgatgccagtagtcatgctgtcgccaagtgacttcatgcgattgccaatagctatctgagcggtaccaagtttgttaattgcaccggtgacgccggttgttttaacactcatttcggcttctgctttggcggtattgatgtactgtttagccagtgatgctagtttcgcttgttcagcttcaaaattagccgctagtctagcggaactttttgtcatttcgccttttgaagtcagtgatccatcatatgccttcttagactcggccacgacctttgactgcgcagcaatcatcttggtcaggccttgttctttagcacttaagccgtctactttacttccaaaagcgtcataaaaagaggcctgagctttcatctcagacccgaaatacttcaactgtgacttggcattcttcagaccgttaccgaacttggtatcatcaagcccaagctcgatcatcatttgacctaatggttctgccaatttgtttcctccttcctacattgatttgataaagtcggcaagcgagactgccttttctttttctggttcactttgcagcagcacctcttgtagcgtctcccaatcagttttcataatgtcattgatcgtgaaccccggaacatttgtaacaaccgaacgaatcattttgtagatttgatttaatgcttcttttctgctgattcgctcgctgccactttttttggatcaatcccgaaaagctgctgattgaaggtgttaaatactttgttgaagtcccaagcggcaacaccgtctaaaattcgttgcttagttacgcttttgtcttcaaaacaagaagccataaattctgcgtttttttccatccaatctgattcatctagatcaggaaagttctcgggagttagttttaagccttcgatcagttttaaggcgggcacgaatgtttcttgaaagtgctcaaccttgccatctttattacgtaaatcaagttttagcatgataagtctccttattttagatgccgccctgaactcaatcagcattgtttatttctgaggcgacaattgtatttttaagcagcagttacggttaccgatgtgcttgctgttttgcttccatcgtgtgtcgtcacagtgacggttgcagatccagccgaaataccagttacaacgccattagcattgacagtagcgactgctgtgctgcttgatgcaaagctaacagacttgtcagttgcatccgttggactaactgtagccgtcaatgcggtggttgatccaactttcacgctcgctgttgccggtgtcagagataccccagacaccgttacgggtttggggttgcctttaaaacctgcgccttcaccgtgctaatagctgttgcatcagacccgacatatttagcaacgtactcgcctttttgatcaccatcatcaggtgaaccggccgcagtaaacgtatagctatcgccttctggtgccttcttgtcagctggatcttgtgtattcaaggtttctttgtccttggcaaacttgccgcggaagaagcctaagtatgcgctgtccccagccaaactttctgcttccaaaagaacgccgcagtatggtgggttagtgtcattacccacataggtaatgcctgcttcggtagttttctggccaaggatctttgcttcagaatcaaatggcagatcaatcaaggtaaagtccacagatacttcaccaacaccctcttgagaaatccaatattcaatatctgatgcagccgttttcaacggattgcttgctaatcctgaaatttcggcggtaatagtaccacctttgttttgatcgccttggataacaattggatcaccatcgggaacccctaatttgtcaaacggttgaatggtcatgcgtggaaaatgtactaaagtcatgtgatgactcctttctaatagttagtgtcataaagctgtgtgacagttcgatatcgccgtgcatcgacataccgtttcgtgtcactaaaaaactcgtcaagcccctcggataattgcgagaagcctaacgagtacatgtgttttttgattgcttgttgtatctgcttacacagcatgcgatcaccggattgcacatcaatctggtaagttagctgttgtgctaattctttatcactggcaccaaaagcagctgttggaggagataacggtttgatgagaacaaacgtttccttagaagctgcctctggatagtcgtaatacttaatcgggtactgagatactagaggatcaccacgtatctctgtataaatcgtgttcagcatgtctttcatagcagtttcctcaattcagccgcttctagctctttaagctttggctgcatttcatcataggatgaccgaatttttcctatgccccttggagcatacgttcgcccgtttcgggtgtacccaaattcgttgagatgaactaagcgccaccgttgttttgaaccatcaccagaccacccaatcttgatattgcgaaccccaccacgaagccgtggctttcccgcagtaatttcattgaccgttgcgccagtgtctcgatagcttgctgcagcttgcttaagctcaacaactgcataccggccagcgatggttaacgcgttgttgacatatttagcaaccttgcgatcactaaatttttgacttagcttgttttctaagtcttctaaacctttaacgtccaaagttactgtcattgcttcgcccccaataccatcgtaatgaacctgttggcttcaaaatcatggcgaacttcttcaatctgccattcattaacttcccgatatcgagagtcgtcaataaacgctgtcattttgttgttcggaatgaattcacccttggtatcgcgaataatcacagtgacgcccaggtcaacctcgtggctatcaagaactaccttgtccttattgcttggcgaataggcatcgcaaagacaaaaaaacacttctttaggctcaatgtctgttggttcaggtgaatcaccaacatcttgagcatagaagtgaatcggtattcttaattttccactatcaacttttggagcctgatactgaaagcttggacgactaaccattgtcatcgtcctcctcgccatatgcttgtaggttcaagccgataatcgtagatagaaagttgtcttcgaaaaattcagcctgatcattgtagacatacctagtgcgttcaatgacaagctctttgaattggttattggtgatatcagacactcctgtcatgcgattaactgcatcgtacgaggcctgcagcatgtttttaagctcagcgtcttctgacgagtggtaaatgctcattcgcgatttaaattccgtcaaaagtgattcaatctgatcatcattcatctgatgtcacccccgcaagtttctgtaaatcggcctttaatgcattgcttgggtaactgattccctttgaatcaagatatgacttcagctgtgcaacggttgagttgctgtctacccccgttatgccgggggatactagtttcccgtcccaccagttgtggaagcacttggcgcagcgatattcagtgcatagacaagcgcagcattactatctgctggcgcaccatagaagaattgcttagcagtgaacaggatcgcgtcctgaatagccaacgtttggttaaagtcagagatgtttaagccaccagccatgtatgcgtcataacggcctttaacaaaagcaatagccttaccatctggaacgtactgagattcgatgatctgaatgccatatggtagcgcgtatacccactgaccattaacgttttgcatggtcattgcacgctcaaagtcaagcgaagcacccggttgtacaactaaaacagtgttgccacgtgcgactaccggcttgccattttcctttttggacagagccttaatgatggtcatcagttcaaacttggccgtgtcagcgtctttaagagttactgtacctgcatcggccttaacaggataggttgtcacgccagcggctgtggcaccttttgatggatcacgatcaagtccaattggcttgctgttaccatcgccatcgacaaatgctgattctgatgcggccgcaaacgcttcggtgatttgggtagtaacatatgtgcgtacccatgccggaccgaatgaatcaagatcattaggcagcactacgaatgccgtcagtttactcatttctgcatcaacagacgtgaacgtagcatcaagctgcccttgaatatcgccaaaaatcttgccccatacagcggcacctgtagcatcagacttccagattttcaagcgcacaccgttgttctgcaaaccaattgcttgcagcagagggtgattagaggtcagatcttcgaaaatcttgtccacagtggtttgtggaataagctggtcgtttttgaacccagtatcagtcgagatatcattgaagaatttaacttcatcttgtgtcatcttcacatcaccggtgttggctgcaatgatgttatcaatttcctcttgggttttattcttaagtttctcttggaagctattgagatcagtggaaagcgcgtccatcatttcaccaaaggccttgccttgggcctcagcgtcaccgccacttttgacaatgtctgcgaatgccttttgtttttccgcaaaggtatctaaattcttaaagctcatagtcatatttttatgactcctttcgtattaaaaaaggaaccctgcaaacttgctttgcttaggttcctcatggggtttcaatttatttgcaagcttttctgctaattcatcggtgtcaatcttcatagccggttctgttggcttgtccttgatttctcgatactccttaagagcatcaacgatctcttttgtcagcatcgtttttggtcccgctaccaaggtaggctgttcctcaaacataatttcatcaacaaatccaatatctttggcctgttgtgctgacatatacgtttcgtccgccattagcttgagcatctcatcagctgtttttccggtttttgatgcatacaagttagcaaattgtttatcttgcattgaaagaacatcgctgtacttgtcaagatcaccggagtttccagaaatgccagagactgacacacggtgaatcatgaatgtagccgtcggtgccatcataatcttgtcagctgacagtgctactactgtagctgcagatgctgcctgaccgataatcttagccgttacagttccgggatagtctttcaaaagcgtcgcaattgagctcccggcggtaaccaatccacctggactatcaatttcgactacaacgtctgaattatcagtcggaagcatttcacggatcgcgtttggagctactaaatccagtccccatgacttcatgacactcgcagtctcatcatcaacaagctgagtgttaattggaattactgtcgtcatcattatcacctcccttcgttgcttcctcatagttctttgtgatgtaatatttctggccgcttccgtctggaattggatcatcgccaaaccagcttcgcacagtgtcacgattgtatacgccgcttgatactagcttgtctattgcatcgctaagattaagagcattaggcttattcagtccccaaacggtgaccttatcttgatcatatgaagactgacttacagccttggcatttaactcatcctcaattttttgattaagcggagcaatgcagaaatttaatagttcttgttgattctgatcaacctccgcctgtgcaccgtgaatcaatgctggtggaattcctagaatttcggcaacgctgtcaactgcctctttacgtgcagcagtaatgtcagaaaatgcctgatctgcgccactatactggctcgaaacttcgtcgtacttaatacccttttgtaaaggcacaattgcaatgtcgttgtctctgaatgcactaaagagcttatcaataaatttctgagctggattctctttcttattgccattcgcatcatctttaggcgtttggctatcaaaacttgtaacgcctgagaaatccaccgttgctcttagctgcttgttacgcatggcaaaactaatcatgcggctgaataaattagcatagtcggacagcaactgatttgtgtatgtggttaggttgtcgttgttgtatttgataaaccaaacgtcatccattccaaacacacgctgaaactgatagtcattgaccaccactccagaaaacgtatcaggatatactgccttgacattatgaacgtagctgtcagcaatcagtaggtcgcctgtatcgtcctgaacgaccagcacttcattatctgtgatgagtttaaagatgagttcctgccaaaaacttgtcgctgtttggttatagtttggccggacattcagcttgtaataaagcgctgaatttttagttttgaactcggactgagaaaccgttctagctaaaaaagaagcacacgtatttaatgcatactgtttcaggtaaacttgcgtctgctgcccgccaattaaatcgagatcataggcaaagctggcatcttttcgttgagtaaacagatcaaataagttgaagttcacgctttcacctcctttcagaagtcgaggtcattcaaaaacgccagcgattcgctgacgtccacatcggataattcattcactcgatacaacgtatattcaaaggccttaaagccatctgtcttacgacgagtttcctcttttttctcataggacttgttcccatttgccttgtttacctttaccagtacgttctgtgtgttccagcgaagcaaggggttatctccccagatgaaacgtcctcttggaaaaccatcgtcaatgatcgatgccaacaaaccgtcaatagaagtgggattgcgaatgatatcaacttcaaaattggcatcctcgaacattttccgcataatctgagcacggtagttatccataactaccttttttatgtcgaatcgatgtgccattgcttgtatccactctaatgcatgtctaggatccataagtggctcgtcaacaacttcgataagtcccattctttcccagtcgtgcagcggaatgttaatccgctgattaggcgtggcaattcgttccttgcggctgtatgcgtaatattgatcacagaagcccttccgtgcccactgcttttcaatggttactaatttatctcggtacctaatcgttactgcagcggcaatgaaatctcgtacactggcaaaatccactgcccctattgcctctctgccgtctaaatcatgcggaatcggttgattagttgctgcaatctcttcccaaggcgcaacactactgttcattgacgtgctgggatagtccattctctttgttaaaaactcctcacgtccgcttggtgcttctactaatgcgtcgtagtctttcttgatttgtcgataaagggtcttaccatacgatgacaacggttttacaatcattggaacggctttttcccacttttctggatcatcaatttcagacacatcgtcgattttgcaaatccaaggaaatatgaaatctggcgcagcctttccactcaagacattggctgcttgctttttcttagtatcaatgaagccatcgcgcacatagccatcggtcccaatataaaagacacgaggattttgctttttgccaagccctgataagtggactttgacattgctgtcatcctgatattcatgaatttcatcgaagataacgaaaccatctcgtaaaccatctttcgtattgccgttagaagttcgatatctcaaagtagaattggtctttttagcttttatgagaccgtttgtccagtagaatgcgggtctaagctttggtcgatttgattccattacatcgtgaatttcttcaaccgatatttttgcctggtcttcgctgttagcaacgattgaaccgttatatgaaggtataccgttaaattctgatatcaaaaacgtccctaacgccgaaatcaatccgttcttaccagagccacgacccatcatccacaaaaagtcttcataataattggtcccgtcttcgtggtacaaaaaaacgaacgcaatcaagaacttctggaacggctgaagtttgaaaaaccacttctcactgaacttaatgcagttctcaatctgctcgttgtcaaaatgcagtgtgtcgtcagatagcacagacttttttagataatcaacaagctgaatacgttccttattaaacagcaagtgcccttcttcataatccttgatgtaatcatcaacatacttgttatgaatcaaagcagatcatcaggatcatatcccgtaccctttccatcaatgccaggcggagcggacaatcccatgtccttgccaagtgaaattaggcttgcattgatcttgttcatatcagccaaagcaggattagatttagtgaaatgctgactgccattctcaatttcaataattggctgcttgatagcttctttttgaagcttgtagaacatgtcaaccattgaaacatatcgatccaccttctcagtttcaattggattagtcttgtctatctgagacaagagcctgtttttaagcttatctagcttgtccatggattatcacctcccatttttggtatagggtaccccccctcgcgcgaaaaaaagaaacatttttgcggaagtcgagcccgtccaccggtcccagaatttcaaaatggcattgaattttttgacccgggggtctgttattttaccatctctcatcgctggcatactgattttttggtctccccaaacgcttataattgaatcgtccgtgtcgcttgttgtgacagtcgcggcagagtgtgcgcaggttatccggatcaagcgctaggtctggacgttcctctagcgtcttgatgtggtcaatctccagcgtcatgtcattgccagtagtcacgcgtccttccgctttgcaccattggcattcatagtggtcacgttcaagaacttgttcgcgcaatgctttccattcaggtgaacgatagaagtgtgcacgaccagcgtggctgtgaacatctcccgtataagatgtgttagtgatgcccatcactcctcatgcaatccaatgacgatccccaatccgataaacaacaccagcacagcaatcataactattagtggcatgaatactagcagccaactccatgcaatcaagccgaacagcttggcaagcacgaatattagtgtgagcagtaataaaaatttgcacatgctaaatcacctctcgattaagacaatatgattgtcgaataggaaccattgccgtcaatatttagaccagtaacatcccatcctgatttatttagcaaactgattacttcattgacaactgctggattgtacttggaaacgccaattgagattggggatgtagtattaattccttgattaatggcatcgttcacatcagcaatcagattgtctttgtatttcttagttgcagtggcacgagtcggcacgtatccttccatttttggtagcactggtgctggtggaggcaactgacggtgagacaattgcctactttggcctttagcattatcgaatagcatgcttatccctccgtgtattgtttaatcttgtcaacctgcaagtcacaccacgtttcgtgggtaccgttcgctttatataccgttacgactggcattgatcgatagcctagcctgcggaaccgctcgtagtcgtccgcgtctgctgtgatggttgacaccggcatgacacgtgacagcttgaatactgttcgccggcacttttggcagtgcggcttcgtgtagataattgcattcatgtgtttctcttctctcgataatctctcaatgattgattgctctgtgcggcttacatatccgtaaccgactcgcttcatcgcattagttgagttcataagtacacctcaatcgcgtgtcgtcataaacgaacgcatacagcagatgtttgcccgtggtgaagccattcttaatctcatagggatcatttggtttcgccgttccaagctgacgccacataatgccacgatcatctttaaaccgctcgctatgatagtggcctgagtgaagctcgtatgtttttgccacactgaatatccttttgtattcaaatgggaaaaggcttgtcagcttgtccttggctacatctccgtgtgcgagcataatgccaacatgccctagcaagtatgcacagcgccagtcggttgccggattactgtcattgagatcaacgtgtacttgtggatagcgatctatcagcgcataaagaaaagcgtattcgagatcacctgaatggttaccgaacacgctcttgattgagacgcgattgctatattcaattgccagcggaacaatttgatcaaacagcttcactgcatcatggaatgcctgacgcatgtttgcgtgatctagttgtgtccctctaaccgtttgtgttgcatgaatctgatcactatggaacagatctcccaattgctcgatcacaatctcgttgtagccgtccatgatgatctctctgagttgactcaccatgtcttttagatcggcgaatgttgtccagccaaagtgcaggtcaggcaatggaattactaggttgcgatcgcccgatttcttcatgccgtaattgaccggaatgattttgtcgttgaacgcttcagccatttcacttatcgataagccttgtttcggctttacgcgaatatgaatgctgtactgcggaactgtgccgtcttcggtactatgctgctcatacactttgtagtcgcctaagaccatctcgaacttatcaggatcgtatccacacaactccatcaaagttcgtgggtctttatttggctcatgcttgagtctcattaaggccgtgactgtttgactaccatcagcattaaga

SEQ ID NO: 5 - DNA, 5967 bp, Lactobacillus paracasei
ttacaatagttatagagcaagaattggtgagttgatgtgggggatcagtgcggttatgttctgtgagaataggccatctttagattattaaataatattataaaatcttttgatagcccggcgtttcatctaatgttaaagcataacgccgcacattaaaggtgggggaaaccatgttagacaatatcgggaaattggtgcaccaacagcgccgcagtttgaacttgacgattgagaagttggcggagcgatccggcgtctcgatcagtctgatttcgcgaatggagcgtggagacgtcaacaatatcagcataaaaaaattgaccgacattgcgcgggctttaaatatgcaggtaggcgacttcttcattgctccggaaatgagcgatattagcacattagcggtggtgaaatacttaacccacttaccagagaaagaacgggcgcgtgtttccgaggtactcatgcaggtgattaacctgtaagtaccacctttttagaacagtctgtcacttgaggctgttcttttttgatatcaaaaatgtcagaatgaccttaaaaggatggcgcaacccgttgtcagtcagctggtaaaacgcgtatactaaatgcactgattttagacaatgagcgcgaactggcacggttagcttggtttgacaaagtggcactggatagttgatcaagtattggttcggctaacaggctttcttcacaataaccgaccgccatctggagaacgcatttcaaaagaaggagaatgatcgacatgacatttgaagcaattttaccgtcccttaaagccggcaagaaggccgttcgcaccggctgggaaggtactgagttgtatgtgcaactagttccggaaggcaaattcgaaggcgacactttgaatccgtattttttgatcaaaactgccgacgaagctttcagtctctggtcaccgactgactgtgacattttggctgaagattggcagcttgtgaacgcatgacgcatttcgacttcaccgacaagaccgtcatcatcaccggcgcggcttctggtatcggtgcggcgcaggcggcggcttttcaggcggctggtgccactgtggtaggaattgacctccaaccaattagcaacctcatagacgccattcaggccgatgtgagcgatcctgccacggcagcagcgattgcggctcaatatcagccagatattgtctgcaatacggcgggcgtgttggatggttatcaaactgtgaccgatacggcgctctcggcatggcagcacattctcgatgtcgatctcaccagtcagttcttaatgatcaaggcgctgctgccggggatgctggctcgcggccacggcgttttcatcaatatgagttccatcgctggcttagtcggaggtggtggtggcgtggcgtataccgccgctaagcacgccgtcatcggcctcaccaagcaattagacctcgattacgctgcccaaggtattcgcgccaacgcgctcgcaccaggcgctatcaacacgcccatgaacgtcgctgattttgccggcgacgggaaaatggctgcctgggtagcgcgcgaaaccccagccaaacgctgggccaagcccgaggaagtcgcgcaattatccttgtttctggccagcgatgctgctgattatattcatggaaccgtgattcccattgacggcggctggctcgaaaagtaaacttaatgcattgcaacaccaaaactgaaaacggaaggcaatccttccacgacgatacttactttcctttgatcgtcgttactactggcatagccacaaaggagaacaaacatgcaaacaacttcaaccacccatcgttcaatcgtcagtctcgccaaaaccgccatgatcacggccatttacgtcgtgatgaccctcatgctcagtccactcagcttcggggtcgtacaagttcggttctccgagatgctcaactacacggcactcttcaaccgccgttatgtctgggccgtcacgctgggtgtttttttggccaatttaacctcgccaaccgcactcctcgatgtcccaatcggcaccctcggcacgctcgtcttcatcatcatcagccgctggttagccaaactcgtccagccaaaatgggctaaattcaccatcatgggcatccttttcgccttatccatgttcaccattgccggcgaactgaccatcctcacaaaagtcccattctggccaacctacgctaccatcgcgcttggcgaagcaatctcgatggccgttggtggcgttgtgatgatgattttgacccggtttgtggatttggataagtaagcgataaggctattgaaagaggctcctatagaagaagcgcttactagcaggaaaggtttcgctgaagcttttcgatctggcagaagggcaagcaggtttgattgctgtggtcaaaagttgtcgcaggggttaggtttccgatgcacctggttttggtcaaacattggttaaatacaaaaagacatcgaggcaatggtctcgatgtctttttaaatggaagggatacaccctgaatttttttttagcaagatgctgatcctaggtaatgagtttttttcgttgttacttttttaatgtctgcatgacatccttagcaatcaacgtgtagtaatggggtcggccagcgtcgttcggatggacaccgtcatcagcaaaccagtcgtcattgccacctgccagataataccaatccaccacatgcagattggcatgggttttcgctgctgcatgaatcaacttgttaaccggatcaatccacgcctttccgggagcatacgcggtcacccagaagacctggcgctcagtcccaagctgatccagaatcccgttaatgtcggcctctgtcatcggtccgttcgtacccaaactgatcacaaccgtgttagctaacttaccactagacttcagctgactaataatcgcaggtgctgcctgcacctgccggccaacctcagcatcaatcgacatctccggaaaaagcaccttcaaatatgccgaactccccagcataatcgaatcgccaatcgccgacaccggcaaagttttggccgcattaatctcgctgtcagtcaagccataaagccgatactgattcagcaccttttccttcttcaccttcgccttagaatccttctgaatccgctgacgcgtcgattggttaaccgcaatcgcctgctcagactgataatgcttgacgtagaaaaaccccgcgacaccagcaattgccaatcccaacgcgatacttaatagccagtcacgtagacgtagcttgttttttttcatgatttagtgaacccccaaaagttgcattgcttatattttaaactaaaaatcaggttagtctggttacaagttagggtcattctgacgggtttataggaaattgtaaagagactgtaataaatccgcttttgcagttaacaacaacgtcaaaagggggctctttcgacttacaacaccgacaatagaagcattagaacgggttaattaaccaaccatgggtagacttgattacacaagctagggtattatgctttggagtagcattatcagcacttctaatttttagttgcgggctgcactgcttgcagtccgtattttagttagtttcaacaaatcaagggattaggtggggaaagagttaatgaacgaacaaatcgacctttcacagctgtggaacgtgattaagcgtagctttattgcaatgatcttactgggaattttggggatgggaatagcctattttggatcaaagacgtttattgcaccaaaatacgctgcatcaacttcgatgttagtcaatcgcaaacaagacactaatccgaacatgcagctgaacgcgcagcaggcagatattcaaattatcaatacatataaggacattattacacgtccggttattttacgtgcggttgccgatgatttgacaagtcctcatcgtgtggttgcaaaaaaaggcacaaaggctgtttatggaacgcgttacaacgctaccactggaattcaggagagatatgttgttaaagcggcagaacctgcacaatataaattaaaacctgcaaagtattcaaatatcactgaagctgacctaggtaaaatggtatcagtctcaaatgctcaaaactcgcaagtgttttctgtaaacgtacgagacacgaatcccgtaagagcacgggatgtggcaaatgaaatcgcacaagtgttcaaagacaagattgcaacgatcatgagtgtgtcaaacgtgtcagttgtttctaaagcaacagcaaacccgagtcctgtttcaccgcgtttaaaacttatgtcgattattggcctaattctaggcgtgctagttgctctattatggggactaattcgtgaactaacggataggacaattaaagatatggattatattactaatgatttaagactggttaacctagggattgttaactatgttcaaaagatgagtgatttggacgaagcaattgaaaaatcacgggatcattcagacagtaaatcaaataacacagaaaatgttgatagacttggctatccacaacgaagccgtcggcgtatttagaaattagatgaggggttaacataaaatgagatggtcatttgatcggattttgccgggacacaaagaagacaaagaatcacaaaaaaatggtgtcatgttggtgacttttgctgaacctaagcatgttgtttctgagcagtttaggacagttcgaaccaatattgagtttgccggagccgctttagataaatgtcaagtagttatgttcacatcttcagcgatgtctgagggaaaatcaactgtatctgctaatgttgccgtcacttgggctcaggcaggtaagaaggttctgttaattgatgcagacctcaggcggccaacggttcacgctacttttcgcacacttaatattgatggggttacaacggttttgactggtaagagtaaggcaagcgaagtaaccgagagcacatttgttaataacttaagcatcattacatcaggaccggtgccacccaacccttcagagttattaaattcaaagcgtatgggtcttctcttggattgggcaagagaaaactacgatatcattgtgttagatgctccgcctgttcttgcagtctcagatgttcaagtattggtacccaaaactgatggagttgtcgttgtagttaacatgggcaagacattaaagggtgatttacaaagaactgtcgaagttttgaagcttgccaaggcaaaaattcttggttcggttgagcgcgttaacgcgaaacatggggatcgtggatatggatatggatatgggtatggagaatcttgaatcaaaaactatgcttatgatcgtgcgtggataagagtcttcaggaatggttatgcacaatgcgcactatgatctttctgaaactcggtatgggctaccatgcacacttcctaataaaagccgtgccagtgtcaagttccaattattaatgtggaggaaaaaatggtagatgtgtttattgttgggtcaaaaggtattccggcgcagtatggtggctatgagacttttgtcgataagcttacagagaaccgttgtaacatggatattaaatatcatgtggcttgtaaggttcgcagagacgatcactcggttaagcgcttttcatataatcacgcagattgttttaacgtgactgttcccaaaattggagcggctgaggctatttattatgatctcgctgcaattaacgagagtattgcctacctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatc

SEQ ID NO: 6 - DNA, 1451 bp, Lactobacillus paracasei
gtattccaaggacggacagtgtaggatcgtattgggacatttactcataacctcgcttgcttttggtttcgacgctaacaagcatagcatggacactgagtaggtgtctttttgcgttatccaaaaagggcctacacgttcagtgttgattatttctcaacaccagaaagtgtagacccgaatctcttcttcactattgcttctcgtatccgtgacaagcaaacaaacgagattcattttccatttgctcaattaaaagatctgagcaattacactcaacatggggaacagtttgttcgagacttaaatcaaacgtatcataagcttttgtcgctaaatgctatgcaggatgatggccataccattactgcgtttgtactcttcacagaatacgaaatagatcgtgataaagaagaagtgcgcattagtgtaaatcctaagtttaaaggcttatttaacgaattaaaaaattggactagatttaatctagaacagtttgcaagtttgaaaagtacttattctaaatccgtctttcggttacttaaacagtggcgaactcaagggaattgcgagtttgccatggcggattttcgtcggttacttgatattcctaaatcgtacaaaaccggtgacattgaccgctatgtgctcaaaccagcgaaagcagagctaacaccaatattcaagggcctaactgttagaaagcagcgtggtggacgtggaggaagaattgtgggctatcgtttctcttggcaagccgaaagaaaagatgccaatgactttaaacacggtcatttgtccgccggtcagcaaaaccgcaacaagaaaaaacgagttgaaagggtacccgaatggccaattgaaaaacatgaagtcactgatgctgatcgaaaaaagctctcggaacagctagaattgttaagagctttgggcaatcaccaagcaacatagttgtagttaaccatcaggtcaattccgaatagaaactgaaaatcacagttgcccagctcgttttctgtctacaggaactcatggattcagctcaaaacctatgttagaatataagtaatcgagagtattcatgacagtcacaagtccacgtagtccgctaactacgcggacttttttgtgttgacggatttacaattcaagtgcaacaaattagtcaaatagaaaagactcatagcctgagtccttgtaaaatggaatcaccacaagaccaactacaaggagaactcgactatgagtccgtacacccatcttaccttaaaagaccgtgaatcgatactgcttggtatctctacaggcaaaactcttgataccatcgccaaagagataggtcgttccaagagtacagtcagccgtgaaattgcacgtaacggcggctggcggagctattcggcagccaccgctcaggaccgctaccggcgggttcgcttggctagcaggcg

SEQ ID NO: 7 - DNA, 88773 bp, Lactobacillus paracasei
gagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggaaagctcatagataaagggataaaaaagtgacaacgtgttgaccaatttctaaaggactttggtacccgcttttacgttatcctctcaagcatgtgttacgttttccattattggtcagcagacgcatactcacttttaaaactagcaaatgtgttggttcttgttgagttgatgatacctgacactattgccattttagcgagcgactgtttcgataaaatcatcaacaacatggtggtaggctgttggcatctcaagtcgttgaagatgtcctgatttaaagaccacaaagcaagcattcggaatatacttctgaatctcaattccttttgatggcccattgacgggatcatacaaaccactcgtaatcaaggtcggacatgtgatttttggcaattcatttctaaaatcaaatgccgttatagatcttagcgctctatcttcatcctcaggagacaagctgtttttttgaaatcctgaatctgttagttgcttgatattatccttatcaatggttaagtggcgaatccaataatctctcctttcaactttgtctaaggggatattgtcattctttgccgtgtcagcaagcgctgatgctggattatgcgcagcggagacattcaaaatcaagccacttaagtcttgtggaattttggttgcaactgcttctgctatgtagcttcccaaggagccaccgtacaagacaaaattgtgcaaattcagttttgagatgactgctaatgcatcttcgatatggttctctagggtaaatggatgctttggatgatctgaagctccatggcctcgaaggtcataacgataaacacggtgatttttagttagaaacggcaaatccgtatcataagtctctttacagtcagtaacaccgtgaattagaagtattgggcttccttctccatgaacatcatatgatatcctagttccgtcttttacagtaatatactcagacataaaactgcctccttagttattgaccaaacattgtcattatatcatttggtttaaagtatgcacgaataaccgtcattaacaaaaaacattaaacaaaaattatattataaacatagcatcagcaatttttgatatagactttccatcttactttcgtcatttcaataacaaatatactattaattctatttatatacatcaaagctatttattaacattaatgctatctgtaggaattgaactctggcaggatcacctgtatcatgcacatcgttctcaaagtgttccatatcccccgcagtacctactatgactggttaaggtgcaacgattaatgccaagaaaggatcaaataactaacgctgctaatgcgctttgcgggacagctttaagtgacccttgaagaccctatgtctcacgtgataaatctcctgcaacttaagaaaggcgtcttgattaagaattttcactctcaatcaagacgccttttgcttagtctctattcagccttgcagttttaaataatgccgaccaacatttaatccttcaatctactacagatcaatcgtagtccctttgtctgctttcgccgccgcttgtaaaattttttcagcaacaacgacatctaaaacggcggtgccaacggccttgaacaatgtgatttggtcatggctatctcggcctttaatatcgccattaataagttgtcctaactcacctgaatactgatcttttgaaaccagcccattcttcagtggactgatcatatctcccgcttcggctaatacgccatccatcgtatcaaagataacaatatctgcctgtttaactagttctgcggggatctcatgcatttgcggagtgtatgcgccgataccgttgatatgtgctcccggtttaacatcggcagcatcaaaagtcgcctgttttgatgttgtgaccgaggtgataatatcagatgctcgaatagccttttgtaagtcaactgctgggagaatttcaaccttaaattgcttaccaaagcgtcttgtcatgtcctgtgcaaactttgcagcacgatctttatcaatatctgaaacgtaaacacgcgtcaattgacgaacgtttagcatggcctctagttgtgttggtgcctgaccgccagtaccgatgagcgttgccacttttgcatcagggttagccatcaaatcagtggctgcaccttgaagcgcacctgttcgaagctgagtaaggtaagtaccgtcaataattgctgacacaataccagtctttgggttcagactaaccattgttgcgggaacgctaggaagacccttatcaatgttattagggtaaacggatacgatcttcacacccaatgctggttctttaccggctgcataaccaggcatgtaaagactttgcccattatcaggtttgacatcaatattcgttctcaatggaacggtggcatcaccctttgaatatgctgccagtgcaatcttatcatcagcgattgcatctttcattgagtaaactgcttgaacatcctttttcgttaaaacgcgcatcataatcctcctataattgttgaacctgaaacagcaatgctatgcttctcccttttgacgcaaggacaatgccatgctgattgcggaataaagtagcacaatgataaccagccactgtaacatactagtatctaagcttttaacgaaaaagacggcaactaagacacccagcacaccaaaagttgaagtgaataatgtgatttttcgactataatcagccaacttaacgaattgaatcgaactcgttgaaactgagaatgttgcggctcccatcatgattggaaaagcagctgatggattgagccccatcgcataaaccgtggccatcgtcaaagcataggaaccaataccgatgttgttaagagcaccataaatgaacagcaggattgcagttagcattaatttccagccagataagctcgttgctgttccgttagcaggaatccaattgaacttacccgctaaaatcattaacgcggcaataatcagacctgctgtcacaaacttcttaattgtgttagctggcagtttaacaacaaacctaggtccgatgtaagcaccaatgactgccgcgatgatacatacggctagcgttttaatatcgacagtaatggcggtgatgtaagaaagtgccattgcagcaacggggacaacacattgcgtgtttaaggtgccaggcagtttcttaattgaaacccatttagccttagggtaaagtgccgtgctgatagcaaaatcagaaatgccaaaagttgaaagtaagaaaataataaatgagctaaatggcaatgcccatgtcgttgcaggttccgacataacctctgaacgatgccggagcaagtcacggataaagtaaaatacaaagcctaaattaattagtacgattaatcccaataagatcttaatcatgagcattcttcccttttctatccatcatataaatatctctgacgccttcgagatccggaccaaacgccttctttgctgctgcatctaaagtttccagcgttctcagatcatacgcatcgtgaatcacatattcttgcgcaatgaaaacaaacgaatgatttctcgtatagatgacatcatcaccttcatccccgaaagtgccataaagaacctcagcaccatcaatgacggcattaacccaacggccgccgaagtccagtagtttatcacgttcaaaccagtgcggatatactcgtgtaaaaggcatgtgatagtcatgacgattactaaatagaatgacgacgaagtgatcaagaatcttagaaagtcgtgttagttctcctaaaatgtccgaactgatatcttctttccagatttgtaagtaaagcgacttctcgcaatgcgctaataagtctgacagtttgtcctgtgtctgttttctgttgggaattgaataaatcagttcaccatcttgtttagtctccacattcgctaatcgtgtttttattcgtgccaactgggcagaagcttggtgtccgagtgttgtcactaattcatcagcagagataacgttgtaatacgttggatcactcttgcttgccaaaacaatgccacgttccgtcatacgattcagaacttcatagatttttgaccgcggaatacctgatcgttttgcgatttcgtacccggtactcgctggtaattgaagcatcgtgacgtaacactgactctcgtacttagaaaaatgaaactgcttgaacaagtctgttagttcaggatccacaattcatcatctcccctcagaaatgaaagtctcaaaatggtagctaccaacagtaactactataagtgaatttattcactagtcaagattatttttaaataaagttgagccttttttctcaacactcttgataaacagctttctatttaaacaactctagcattctcttttgtgcacttcgttacaattacaaaaatccccacaaaaataaccttgtttccaaagctcgggacaaggttatttgaaagctattattaaaaatcgcaagtcttgataactgatttcactatcgggttaagaattcaacgcctctaatcgcttctctcaacgcctccaccaacctccgataatccactgccccataatcattcacatccactcgaatcaactgaccaagatgaaacgtctggtagcctcgatcttgcacgcgattgctaaacacttcaaatgtcggcatgccatcaggcgtttcgctgatgttttcgagtgtatcaccgcgatgatagtgattcatgagatgaccaagatgacggggatcggataggtcgcgttttcgctggcgatcgtagagtaccttgatgtctgcttctaatctgatggtgataaccgcatagtgatgtttggctgccaatttttcgagagctggtttttgcaatcggctgaagggatagtcgcccagaatcattttgtgttcctgcatcagcatgccaatgccgcggtagtatcgtgctctcgcttctgcatcgaggagttgcttttcctcaagattatcaaagcctaactcatcgtaaagatgttctttaaaaagatcgagcggcagggagacgaatccgctgattgcttgcatgatcttatttgcagtatacgttttccctgtgcctggcgcacctgctagcaggaccaagatctgcttttgatcgctcatcatgtcatcctctcctctagacgggctccctagctcggaagtcttcgtttaaggaccttgatcgcaattcatcacagtcacacgtcgacttcagccgggttacgctcttccccacttacgcgttaattggcacttcggcatctttatttaagaacaagccactcttgtgcttgacgatatcgtagacaacttggttgcatggttcgatgttgttccgcagcgagttgttgacctcggtctgaccgaacatttctttggctttccgggtccaaccaactaataattcggtcccaacattgaacttacggaagccgttttcggtcaaacgatgataatcagcttcgttcacgccggtaccgccgtgaatgaccattggtttgctgatttctttgtgcaattcttcaatcaaaggccagttcaattcggtctttgatttgaattggccgtggtgagtaccaacgccgacagctagtgcttcgacatcgacgttattcaagaaggcaatggcttgttgcgggtcagtataccggccttccttgacggtcacaccttcttcagtcccaccgattgtgccgatttcgcactcgactgaaacaccatgttcatgtgcatagtcggctacccggcgtgcccgttccatgttttccttattcggcagcgctgaaccgtcaaacatcacagaggaatagccagcatcaatggcttctttaatggcatcaaatgacttagcgtgatctaaatgcagatcaacatcgactaacagatcttgtgccatggatttgcaaaccgcaacaaagttcttcatgccaacgtattcagccgtcgcaacacttgtttgaatgataattggcgatcctgcatcctttgcagccgtgatcattgatggcaccatttccaagttgtgcgcattaaaggcgccaactgtataatcaagtgcttgcgcttcatccatcaattgctttaagttcttgtacatagtagattgcctcccagcagattaataaccaaaacctgaccgcatgacccgtttggacatatcgagcaatgcatccgtttttgtgacccatttttgaatgtcgtcatcatttttcgcttttgccgcttgttttcgctgcgtctcgtataggttcagcaaggcattgtatgcatccccaaactcttctttatctttgacactcgcttcataagctgcgattgcttctaagtcgttgcctaatttaacctgagtatcgcctaattggttgtatagcaggtggcgtttgtctttatcatcggttatctgttcaatttgagtcgtcaatgccgccacttttttggttagagcagcagcttcggttgtcgaaagtgattgattgacttcttttggcaccgcggatggttgtttctgcgtgtctttctttttaaataaactgccaaacatagtcgtgcccctttctttaaactgctttaagaatcggcgttaggatccaggcatacatcagcatggccacgatcgtatcggagtcagttgccgaagcattcacgaagccaaacgaggtcaaagccgttactagcagcgctggcaacaaggtgatgaacaggccgtggataatgccgccaatgatggccccgcggcggccgccgacaacgtttccgaagatccctgcagtcccgccggcgaagaagttagttaacatccccggcagaatgaccgcgagtccgaaaacaggcatcaagaacatgccaatgacggtcccaatggttgtcgtaatgaagcctaagatgaccgcgtttggtgagaatgggaacaagactggacagtcaagtgctggtttcgcatttggtaccagtttcatcgcaataccacggaaagccggaacgatttcaccaagtaagagccgaacgcccgcaagcaggacatagaccccgacaacgaactgaatgcccatcatgaaggcattcatgatatagttcagactcgtgccgttaccggcgtacttaggacctgcaaaagccgcggtgatcataaacaatggcaccatcacaacagcaacagagagatacgtgtcttgcaagaattccatgtactttggtaacttgatgtcttcaatcgagtgtttcttttcgccacgttcaccgaagatccaagcggcgcctgcttctaccatgtagccgatcgtacaaaagtgtcctaaagcaatggcatcgcctttggtaatcttacgaacaaaaggctgcgcaatggctggcatggccacctcgaaaatcccaccgatgacactaccgacagcaatggtcacgactgaattgaagccagctatcttgccgccgacaaccgtcatggtcgacatccacaacagcgcctgtccggttaggaaaatatatttccatggcgagaaccgcgcaatgataatgttgacaatgaagatgcccaaaaaggttaaggcaatttcatttcccaaccccagcgtattcatggcttgaccattgatcgcctcaatgctgggtacaaccccttttaggtgaaaaccatgttgaaaaatctttccgaaatacgtcagtgctgtgacaataatggcggaccctgctgataatacttgaaatcccagcagtgtcttgaaggttccagttaggaccgcgccaaaggacttgcgttgtagaagcaagcccagcatcgcgattaacgcaatggtgatggctgcctgagtcagaatattttgaataataaagttaaccacaaccatgattgattcccccttttaaacgcgatcactggcgcggaaacctccacataaggaccttggatgcaatggccaaagcccggccatcacatccaaggccgcttatgctccggtttctaaccgcgccagctcacgctctgtttaaacgcgatcactggcgcagcaaccgccacataaggaccttggatgcaatggccaaagcccggccatcacatccaaggccgcttatgctccggtttctaaccgcgccagctcacgctctgttgttcaagccgatttttctgataactctttgataactggcacgagcttggcttcaatttcgtctggatcaacaatgttgtgcagaaagacaaacttgatggctggatcgaggtcatattgtttgaactgcgaagcaaaattttccgctgagacaatgatgtccgtccgtaaacctggtgttgatgaaatcgcctcatgttcaaggttttcatctaatcccaaacggtttaaaacatcttctgcggtcatctggcaagctaaggaagagcctaggccggcaccacagatgaagtaaatcgttaatttcctggtcatttaaatcgtctcctttgacgttttctcgttgaataaaatgtttttaaaggtttgaatatctgtttgttgcgccagctgatcaactttttgctgatcattgatgagttggacaatggctttcatgacattgagatgcgaataattatcgatcgcggccagacagaagatgatcttcacgggatcattgtctggattgccaaagttgattggtttcgtcaacgttgtgatcgtcacgccaagcttctttgtcccatcctctggccgtgcatgggctagcgcgatggcaggtccaatgacaatatacggaccgaatttcttaactgaatcaatcatcgcttggatataatttttggtaatgtaatcctcgtcaagcaatggttttgctgaaatacggatcgcatcttcccaatcatcagctttctgttgaagctggatctggtgatcgttgattaaatctttcaacataggctgaacctccctttcattaatttcgacatggttctccttgaatgctgcttgcaaatcagctaatagtcgtttatcaactgtcacctgatgggttttcagcacatccagaactgtgcgaaatagtcttgttggatctaacgtacggccttcgtacttagttaacgttgtgtgtttcttcaaaaacgctgcaactcgggtcaaatcaacttctgaaggaatgggattaaccttcaaactcgggattttatcgattggcatgtcgactgttttgaaaactaagctgaccggtaatttgcggagaatgccaacttcagacgtgctcaaaacggcaagaacatcaatgttaaaccgttcctccagtttggctgccaacactctgcccgtcgccgtgccgaagttgcagacaactgcggcttgatactgatagtcttggcgctggcgatcctcagcttgtgtcgctgagaaatacatcgccagaaatgccttctcatcatcagacatggtcagctgatagcgtcccgtcttgaagaaacgatcaatcgcgtcatagatcggcccatagccttgctggatcgtctttctcaacggattaaccactttgacgtgctgtgacaagcgcttgaacaaagcggtcatatggttatatagctcttcgaaaagcttttcgtttttagaaaatggaaagccaatttcagtttccatatgatcaatgagcgcaacgctgaaaatctgggccttgacccagtcgtcaagatcaatcgcaccgcgacgattaaaactgttgatcagaaaaccgacataacctaactcgctggcgacatcaatttgtaaggcataatgctgaatgagttcattgagaaacttggcattttccttattgagatcaacggcagtttcatcatctttgacatagtgcccgctgcgaacacggtgtaaccagataatgagtaacacggtcacttgctggctgtacatgtcgttggcggccaaggccccttttggaaaacaacggcgtagtaagtcccggatataggtcacatcttgtttggtaaagacttccttcatcttgtcgacatacatcccgctggcgattaattgctgggcaatcaaggtgaccaaagcatgttgccgtgttaggacatccccaaacatcgttcgaattgatcgctcgttgccttcaatctgtgcgcctaactttgggctggtcgtgagtgttagattgtattttgctagatcagcccgcaagttgcggagatcagaatccattgagcttttactaatctgcatcttttcttgttcatcgacgagataaaccggttgggtggcttgaagcaaatccaataagagatacacagcacgttgctcaggggttaaagcgccttgactgatgctgtcaaaatcaaggacgtcagacagcgaatgccgctgttgcgttgagatatgattgtaggcgacacctcttttgatatcgaataagggtaagtttttctccgccaaaacttcatttaaaacctgaatctcatttcgaatcgtctttgtcgtgacgttgaattgcttgcctaaatcagataaagaacttgccgaactgtccaacaatgttcgcagaagattcgtcaatctttctcgcattgctttgcctccttacagcttctatactaagcaagcgcttacataccgaaaagtagaacctttttccttaacttgggaaacgaagtacaccttgctcatcattcttcaagtttcggcctcggtaagtgacaaaaagccccataacggctaggcttgcctgcctaacaattatggagcatatgaattttgggggttgagcggacaccgccattttcagcgcatcaaaaaagcgattctcatctgacgagaaccgcctttaagtcattcaggttactgttgtgctttcacgtaagccgccgcctgcgttcctgcttggcgaccaaagatcacaatgtcggcgacggaattgccaccgattcggttgtcgccgtgtaggccgccggtgacttcaccggctgcgtatagtgctgggattggttgttgcttctttgtcagcacctcagtcttggtgttgatcttcacgccgcccatggtgtaatggatgcctggggcgattttgaaagcatagtaaggaccggtggtgaggccatggtccatcccagttgtccgaccaaactcggcatcctttttgttggtgaccgcttcgttccaagttgaaaccgtcttggataacgtggccgctggcaccttcattttcttggcgagttcatcaagggttttgccttcgacaccgagcttatccttgatataaaagtcaatggcactcgaccgttggcggacgcctgtatcaatcacgacccaagcatccttacctttttgcttgttaatggcagcggaaaccttgtcacgggtattcatttcgttatagaaccgcttcccgctttggttaactaaaatgccgccttcaccgcgagtcgcttccccaatgagaatatgcttgctttggttaacggttggatgaatttggatcttattcatgtcgatcgcatagccgccgactttctcgatcatcttgatgccatcaccggttgcgccagcttggttagtggtgacgtaatgagccagatcagggcgatatttcttgatcatttgcttacttgccccgaaaccgccagtggtcacaatcacggccttggctgcgatttttttcgtcttgtcttgattgatcttgacggtgaccccgctgattttaccatctgtttcattcaacttggtaatatctgagttcacaaacagcggaatcttttcttttttgacttctttcacgagcccatcaacgagataaccgccaacggctgaaccatcgtgtggccgatgcgtgcgcttgaccgacatcccaccggaaatcgtcaatttgtccagcttaatcccaatcgaatcaagccagtcaatggcgctggctgagttgtcgacaaaatagcgcagcagtgctttgtcattcgtcccgccgccaccttttagcgtttcttcatagaactgatcattgctgtccttaatcccttgggcagcttcaactttcgtctgactggcattcataccgctagaggctttcagcgtattcccgccagcaacgggcattttttcaagaatgacgggattcatcccttgctgcttcgcctcgatggcagctgtcatcccggcaccaccagcaccgacaatcacgatgtcatacttgcccttcatcgttttcggatctgtgtaggcctgctgtgaagccccgctagtgaccttgctgctagctgctttgtttgcttttgaacttgacgaactcgactttgaactcgccccgctactgcaaccaaccagcacgacactcatcagcgccaatagccctgcgattttaacccactttttcaaaacatagtccctcccttatgttgttgtctacgtgaatagattaacaaagtagcgaaaccatctcaacctaaccttgagtttgatgatataaacgttaatcgttttgcaagaaagcgagtttagaagcaggaacgaaggaagacaaccgctacaaacataattgctgctaggacagacagaccaaggcctaaccacgtccagccgcgatgctttgctttaagcctaccaggaagaccgagataccaactaggaaaaacaatagtatcaatagcgaaaagctcattttgatcaccctttcacctaacttgattgccacgatcttatcaagcttcctctcctaaaaataattaataactaatggtatctataaaaataagttgacgtctaaggtttaaaaactgtatgatccaattcataaggatgctatttaattttgagcgaggtgttttgatgttgtcatttttatcgttacggctacccaaaaagcggctatggtttgcggtgtcaattgcattagtcatcagttgtttacaaatggcccagatattgaatcccattcctgtgggtgaatccccttatacccgctggctgtcgattgatccttttaactttactccgatcattttcttcattttgttacctttgattgccagtatcccagctggatcgctactaaaaaacgacgctgactccggtttattagcgaaagttaaactgcattctccttttcaaaaagtgatccgttcttatgttggtatagcttttctttccggtttcacaatcatcgcaattgcgttgctaattaattttttgttttacttcacaatttttccaaacattagaccagataatttactgaatagaaatatacttttaataaatctgaacacaatgcttgtcggtttgtactacgctcatccgctcctccatgctgctatatcgatcttatttgccagtctatggggcggccttttctctgtatttgtcatggttacttccgtatggattaaaaactcttttgttgcactcagtaccggactagttgttcaggttgccattttgatgctcaatcaccttgtaaggctgcctgatctagttagtttttcaccagctgatttcttacacgagctgtctcctgacactaatgtcaatctaactgtgaccggcattgtaacgatgttcatgctaatttactgcgccgtccttgctcagataggggagaagcgtcttgtctcatagtgtgatcagccaacagaatctgctgactaaatccttctttaaagtttatctgatttgcggacttacaactttattcattggtttagccggcttcaatacgatatgccaagctgacttttcacccgaaaacctaattagcaccatctttccgcgccatctcattttcagcgggctaataccaacgtatttactaggtttattacccgcgattcaaatacgtccacaagatattctgctatatcaatcacgaaaaatagttagccttcaagtgctttatcgcgtttgcttcacaatgttgccaatggccatcatttggggcttcgcaaatattttcgtcctttctgtcaatggctatttgaattttttgggagacctctggttgcctattttgattcgcgcagtttacctatggatcacggtttttctacttggcttgatcactgtgatgcttgcaatcgcaaccaagagtaaattaattgcattctttattagtttcgggatcaacagtctgtccttcactttcgttatttcgaagcgaccttcgttattttttgatttttccacgctagattcaaatggtgccctgatttctaagggcatcatcatgttaggcattgcgcttttaatgattcctttaatgacgttcatcgtcaacaggagggatatatgatgtggcgattgtttaacaaccaatttctatttttctggcatattattcggacacgctttcttttctggctcatctttataagtttgattattttaagcactcgaattgccggaaatccgcatctaactgtcttctcactattctttgatggcgtcagttacgccaccgttgaaacccaccgcgtcacgctgcccatattatggtttgcttacttctttgtcccgttgttaatactccttaatagttttcaacaactttggcgaacgcgaacactgcatttacgaggacttcaaatttctcctgggagattttctaaggtcaatttgctgctaatagccctcgtcacaactgtctatgatgtcctatcgataactgtcatgctcattacttcaatgactgcccattccgcagagcttcacgttggcaattggaatggcgcattagcggttggtggtctcttttgtatcacgtggctgggcgtcttcttactcttgttgcttcaggctattggcaatcggtttaacccaccgttggctttaatcattcctgccagcatgctcatcatgtctgcgtatacagcgtttcggcgcaatccagtgagttatctcatgctcactcccatcacagaaacaaatgcttggtatcccattcttattttgcttagtatcactattttgacgggactaagttacttactcatcgaacgtagcctcaacttaaactgaaggagaattttttatggcttttatcgaactacatcaagtcagtaaaatcattaaacatcgtgagctcttacatcaggtgaacgctgaggttcagcgtggcagtattacaaccctcgaaggcattaacggttctggaaagacgttaattttaaaggcgttacttggactcatgacggtgacgggtgatgtatccgttgccggaaaatccgtcaacgttcaagaagcctatcccatcaaggctggtatcttaattgaaaatcctagtctcattgatgactttaacgcttataagaacttagagctattagccaagctggatacgactttacagccaaagcagattcataacctactagattattttgaactcacgaggtttccagaacaaaaagttcgcaagttttcattaggtatgaaacaaaagctgggaatcgctgaggcttttttaggcggctatccactcattatcttggatgaacccacaaatgccctggatcataacagcatcattaaattgattcaactgattcaggcatacaatgtgaacggatcaaccttcatcatcgcctcgcatgatcatgactttgttgaacaagtggcaacccataagctatttgtcagagaagggacgattagtcatgaaatctaaaaccaaaatctgggttatcattgtcggtttaattgctttgattggtattggtggcgcatttcgataccaccaagtcaacgcaaatattaaacaaaaaggggtcctccacgaagtcttcattaaagaaggtcaactcgttcatgccaaaaatgttgattttacggtaactaaagcgcgtgtcctgaaaaacaaagaccaggtcaccgttcccgtcacaatttccatcaatcaaacaggatcggcaaactacggtcaaaaaaagaacaactttaattacttggaaaacgtgtggttgaatattccttatggcatcagcaatcaaactgatactatctttgacaaaaacaacaagcggattgcgcatgcagaaaatcttttggcagcagagcaaccggtcacgatgcatttttcaacaaaccgagccaactatgaccagcgcgatcaaaaaatgagattcagttttctggtgccttcatcagatcattacgttaaatactcactgctgctagaatgattttggcggctacttttaaagcagaagggaaatgcttagcgtgaaaaagttaaccatcaaaacagtggagaacctctataaagtcggatttataagtgctttgctcattgttgttgggctgactttatggtggacttcatacagagatggcggcatcacatactacatcaaagttaaccggccacttagtaaattctccgtgaccgttccggttaatttgcaacaaaaatgctatcgctatcgggcaacggcgaaagataccgctggtcgagagaaagtccttgcgtttaaaaccgacgaatatgatcctggccctttccccaaaggacaaatgctgcgactcacgtataacgttcactatggtgtgacacattacgagagagtctcgatcgaacaggtgccgcgcaaagccaggcattaaattgggttgttttcgctcattaattttgatccgaattatcaaatgaagcgactctttgtgctccttgctcttgcaaaaaccccaaacaaaagcgcaccaaggtctggctgctatgccaagccttggtgcgctgcatgttttcctgcaaaactgaatgttcaagttaccttttcaaaccatcttctcatttcaaagcactatgattcatcgtcaaatcgtgctaactgacgctccagtttctcaatttcgccttcagtttcttccagcgcccccatgacttcttccaatgtcaaaccctcagaactatagcctttgtacttggcactaatataatcttcgtctgctaggcgccgtgcacgttcacgcaagtcgcccagttgcgtcacaagcgtatcgaaatctgcttttgccattcggtcacctctttacgctaaggcatcaggtgctgctaattgtgggatcttgccttgtcgcgccaaaacccaattgtcatagttccacatttcggttgcccgtcgatttctgaagtaatcccaaaacgactcgcgctcaatttcaataatctggttgtcgggcccgatggtgacccagttataggaaccgttgcgatgggcaaacttgatccagtaaactggcgcgctaacctgcatcccgttatcttcataatggcgttcttgctgctcggttcgcatgtagcttaaaccatcggcataatttgggtctaactgattgaataacgtgactgcctgccgtaatgctttatcagctgacggcagtttcccgccatttttgaaggtgctggcattaaaactgatcaagttgccgtttctatcagtcacaagtgtcagatgcttgttgttcggcgtcacttcatcaacgttttgatagcggtctaccgtcacttgcactttatttcgcttgcggacgtctgtttgaaccacgtgatagtcttcgggaattggcaataaagccatcatatcgtttttcaaaattccgaccccttttcagtttcgttaagcacatcaagcatcctggcaaattcaattttgttagcttcagacagttttgctgtcaaagtggcttcataatcggccacaatttgcgtcaccattgggatcaggcgccggccttttggcgtgaggctgataatccaagcacgtttgtcctcgtcggatcggcgttttgcgacgagtcccaacgcaatcagctgggccaatcgtcgtgtgacgttgctgggattaaggtgaatcgttttaaaaagtgtttcctgccgcatttcatcgactttgccaagcttcaagataaagtaatagttactcgcactgagcgtggttggcgctaacgcaacatccaagtcgtgttgaatgtggcgcgctaggatattgactcttgagagcaattcatccggttcttttggcattttctaccttctttcgtaacaacatgacggcgatgaaaaacagagcagctgcgagcatgaagctgataccctgcgcaacaaataaagcttgcggagcggcgtggacggcggtggtgtgcgggctgacgatcccgagggtttgatagaacactaaaccggcaaccgcgctaccgatactcatccccaactgcctagcaagtgaagtggccgcgccaacctgaccgcgcatggtcgcatcgacactttgcatcaacacgacactattaggattcgtgaacagagctgtgccaaccgcaaacgcgactgacacgataacaaatggccaagttgtcgtttgatgaggcagcaaggcaaaggccacattcgtcagaaccagcatcagcaagccgattcgcatgagtcgctggcgatcaaagcggtcactaagcaccccagccactggattggcagccaacgaaacaagtggtgtcagcatcaacaaatacccagacaaggccactggcaagcgtagcatcaactgtagataaatcggtgcgagcagcgtaaaaaaataagccgcaacatagttcaaaaacgaagccgctaaattccgtgaaaagcgctggttgctgaacaaccgagtatcaagcattgcttgatcagtctgccgctcgtgacgccaaaaccaataggcgcagctgccaatcaaaatgaccagaattccggtgaacaacggttgcttgttgatctggatgagcaacaacaacccgccaatcacaatcaattgaaggaagccgcggccatcgacgccccttttcccagagggtgcgtgtgttcgcggaaaaaccgcccattcgactagcaaacacacgataccaatcggcaagttcacccagaaaatgtagccccacggcaactgactcaggatcaggccaccgatcccagggccggccagtgcgccggctgaaatgaagatcgattcaatgcccagcgcacggcccaaaatggcgggtgggaaaacgtccgcaacaatcgcataactcgtggccatggtcatactagcacccactgcctgcactactcgggcggccaatatcaactgaaagttaacgccaaaaccagccaacccagagccaatcagaaacagataggtgccccagatgaacagccgcgttcggccatattgatcagccaactgaccaaagaacaacaggcaaacgctgatcgtggtgagataaaccgtcagcaacaagttcacctgactcggactcaccgccaaagccgaggtgatggtcggtaccgcaacgacaacaatggtgccatcaataatcaccataaagaagaataaaccaagtgtgatgagtatgagccagcgtttgaacaatcactcacctccctgtgaagtattataggctggtttatttgcttgcgcaagcaaatttgctgatctttagcaccagcctttcaaccaatttaactcaccaccatttcttcacaatactcgaacgagtagaatgaccatatacacggagcaaaatcaggaaatggggaaactatcatgaagaaatcgaccctcaccattattggcggtgtggccgcggcgattgtgatcattgctggcggatttggcctttatcagtggtatcaaggcaaatccgaagctgacgcggttcaggccactgcgcaaacttatacgcaggcgtttgctaagcgccaatatgacaaagcagttaaacaagttgataccagccacttgactggacctggttggcattatacggccaaaactttagcggcgcgcaatcaggcggtttttgatcgggttggcgccagtgatatcaagattactaacgtgaaaaccaagaagtacgacagcaaaacctacgagctgacgtttacggccaacatgaacaccaaaatcggcaagctgagtgcgcaacactacgaagcgccgattgttaaagtcggcgataactggcgaatacagtggtcgccacgtctgcttttcccgtcaatggatggcaaagacacggtgcagattgacctgattgcggccacccgtggccagatttatgaccgcaataaccagttgctggcaaaaaatggcgatgtgacccaagctgggctggttcccggtaagctcggaaccggtgccgatcgcacagccaacttagagaaaattgctgccgcgtgggacgtcaaggtcactagtcttgaaaccttgttaaagcaatcttgggtcacagatgataccttcgtgcctgtcaaaatcgtcactgattcaccagtcatgacgggcgcggcctatcagacgatcggctcgcgcacctatccccttggcgaagccgcggcccagctcattggctacgtcggtaccgcgacggctgatgacattcgcaaagatccgacgctaacagctaatagcaaaattggcaaaactgggttggaacaaatttacgacaaacaactgcgcggcacagacggtggtcagatttcaattcaaaacggcgacaacattcacccgcttttaactaaaaaggccgttaatggtaaaagcctgaagctaaccattgatgccaaccagcaaaagacggcctacacccaacttgctggcaaggctggtagtgttgtgacgatgaatccgaccaatggcgaactactgactttagcaagctcgccaagttatgatccaaacgcctttgtcaacgggatcagccagacggactatgataagtatgccaacaacacctcgttaccattcctcagccgtttcgcgcaacgctatgcgcccggttcaacatttaagatgctgacggcagcgattgcccttcagaataagacgatcaccccggacaccaccaagtccatctccggtctcaagtggcaaaaagacagctcctggggtgactacaaggtaacacgcacagtcgatgccgcctctgaaaacatgacgcaggctttggtcaattccgataacatctggttcgcccaagtagcactgaaaatgggcgcctccgcttacctcaaaggcctcgcaccgcttttcaaaacccaggccgacttaccgctgaccatgaaaaaagcccagatttcaaactctggtaagctcgcttccgaaacccttttggccgataccgcctatggtcaagggcagctcctcttgtcaccaattgaacaagccgcgatgtacagcacgattgccaatggcggcaccatgcagcaaccgaccctcattcaaggcacgaaaggcaaacgaaccagcagtgtcttgcaggccaacgcagctaatacggttaaaacggcgctaacccacgtggtttctgatcaagccggaaccgcccacaatctcgcaattgacggccacaccattgctgccaaaaccggcacggccgaactcaagcaaaagcaggacactgacggcaaagaaaatggctttttagtcgccatggatgccgataagaacacctatctcacggtagctttgattgaaggtaccggcagcgacgatgtggtgacagcgatgaagccttatgttgctagtctttattaggtttgaataacagtaaggatgacccccatggatgcaatgagctaccatcatttcaagcagcatcttaaaggccacctgaaacaagtcaatgaagatgccatcccattagtcgtcactttcaagaatccagacgacaatgttgtggtgatgagcaaacgcgattttgacgctaccgaagaaaccatgtatttgtttagtaacccggaactgatggcccgaattcaccgtggggacgcgcaaattacggctggtaaagccaagcgccacgatctaccaaacgtttaatcagggcgcgatagatcaattctcagttcaactaaaacaagaaagctggcaatcgtgtgaggtaagcacgactgccagctttcttgttttgattaaggtaggttttgctccagtgatttactcgttataacctcacttgattttcgctaacgccgcccgcacctcatcccccatcggaatggacgggaaagcgccgagtttttggaccgtgaaggagctcgccatgcttgcgtatgtcgcagccgtgacgatgtttttgagatctgtctgtaagacgctggccaaggcgccaatgaaagtgtcgccggccgcggtggtatcgacagccttgactttaaaggctggcacgatggttgcttcgccatccagcgagatgaaggagccttttgatcctaaagtgatgatcaccccgcgaatgcctaattcatgataataagctgccgaagcgcgcatgctgtcttcatctaccaccggaatgccggtgatcagctcgctttcggtttcgttcggtgcgatgagatccacatttttcagcaaggctgctggcaaatccttctgtgccggcgctgggtttaagatggtcatctttccagcagctttagcaattttgaaggcctctgccgtcgcatccaccggcgtttcaaattccgcgaccacaaagtcggcagactgaatcaagtcggctgctcgttgcacatctgctggcgtcacctcaaaattagcgccatgctggatgataatggaattttggccagaggcttgcagcaaaatgtaagcctgaccggtttgcgtgccaaccgttgtcgccacatattgggtgtcgatttggttcttgacaagttcaccgcgcatgaaggcagcgttggcatcgtcaccaactcggccaataaaactggttttggcccccgaacgcgcagccgcaactgcctgattcgcccctttaccgccagccgcttgcgaaaaggtgtccattttgatcgtttctcccggttgtggcaaccgttgaatgtgcaagatgctatcgacattgatactgccgatgacaacaacatgattaggcataagatttcctccaattgaaacgcgctcgcccagaaactaccgctgctcacgctctaactaaaagaaattgagccacaatttacctttttaataaagatagcaattttttaaatgccgataatcgagcatctttcgaattctccaaaaacctctggtaggatttaaagatctcagtgccaaggcggagcaatcgtaggccagatggggctcagccgtggaaacaacacagcgacggtctttggagctgatgttgttaggcgactttgagaccgcgcactttgcgggctcaaagcgccgtcacagcgttccagccccatctggctggagattgcgcagtttggcacggcatagaactttttgtctagcctctttttgattattcggaatctaacaaatcacaagtcttttgcagggattatgtctcaacttcttttttatcttaactaactattaaagtctcgatttactttaagcgtagcatgaagcttacttgttcgcatcctcggttgtcacaagtgacaatggtgattcaacattcttcttcaccgttttaccgtcgaaatgatcataggctgcttgtaaagccaatcgacccatttcttctggcttctgggcaaccgttgcagccatgtcgccggccttaacggctttaatcccgtccgcttcgccatcgaacccgacaatggtgatctttttaccagcggctttgactgcttgaaccgcccctaatgccatttcatcattttgcgagaagataccgacaatgtcaccattaccctgcaaaatattttcggtaacggtcagccctttagcgcggtcaaagccggctgtttgcttggacacgatatcgagtttgcctttagcggcgccatcgaaccctttaccacgttcacgggttgcggatgcacctgggatgccttgcaattcagcaattttagcgtctttaccaagtttttcgatcatatacttagccgccatttgaccaccttttgtggagttagaagcgactaaggtcaaaactttaccgccgtcactcgaccgatcaacggtgatcactgggatgccggcatcattggcatccttaacggctggtgtaatcgcacttgagtcaactgggttgatgatcagcacatcaaccttcttttgaattaaatcttcaatgttactgttttgcttagcggtatcattttgcgcatcggaaacttgaacattggttttgttctttttggctaaatcttggatcccattacgaacagaaacgaagaatggattggacagcgttgaaagtgagacgccaactttcagatctttgggcgctttcttggtcacttttgtgttgctgtccgatttggagctgaggcctgtgccgccacatgcggttaaggtgaataaagctgccgtcgcaacaacagcgaccattaaaaagcgtttgagtgattgtttcatgtcaatttctccccctagagttttgtcttttgccgcgagcacgcgctcacgttttgttacccattattagaagaccggcgatcgagcagaaccgcaatcaagatcacgatccctttgacaatctgctggtagaaactagaaatgcccagtaagttcatcccgttgttcagtgtgccgatgatcaacgcaccaatcagcgtgccgaaaatgcggcctttgcccccggccagcgatgtaccgccaaggacgacagcggcgatggcatccatttcgtaggatgtcccggcatctggttgcgcggagcttaaccgtgatgtcaggatgataccggcaatagccgccattagcccagaaatcgtgtaaatcagcatggtgaccattttggtgcgtaccccagcgatccgggcagccgtttcattgccacccaaggcataggttttccgaccaaaagaggtcttgtgtagcaggacgaatagcacaccgtaagccacgagcatgatgataatcgggaatggaatgccaaacagatacccgcggcccatgaactggaataagaaactgctgttcattttcgcgccagtgatcggattcccgttggtgaacacatacgtggccccacggaaaatggtcatggtcgccaaggtcgcaataaatggcgcggctttcccataagcgatcaagataccattcagcaagccgaaaatggcgccgaggacgaggcctgccagtaacgcaagcggggccgcaaaaccgctggcaagcatggatgctgtgactgcccctgataaagccaagattgaaccgacagacaagtcaatgccgccggtcaaaatcacgaaggtcatcccgaaagcaatcactgcgttaatcgagacttgccgtaacaggtttaaaaggttagccggcgatacaaaggtgggactcatgatcgtcacaagaatgaccagtaccaccagtgccaataacggtcctaaccgactaaatattttcttcacatcaattttgctacttgtttttgctttagattgctcctgcatgctcttccactccccctgttgccagtgtcatgatcgactcttgcgtcgcggtttttccatctaaaatgccagtgattttgccttcatacacaacagcaatgcgatcactcatgcccaatacttccggcaagtcgctggagatcatgatgatcgccacgtgccgatcggttagttcattcatcaagtcataaatttcgcgttttgccccgacatccacaccacgcgttggttcatcgagaatcaacacttttgagccggaaccgatccatttagccaaaacgactttttgctgattgccgccgctaagactgcctgcggagacatccggtcccatcgccttaactgtaagccttttcattaacatccgaacaaattcatctgttgccttatcatccactaagccatgtttgacgaagccatcaattgaaggcaaaacgatattgtcatgcagcgaatcttctagaataagcccttcatctttccgattttcggttaaaaagccgatgttatggcgaatagcatcttgcggatcgcgaattttgaccggcttgccgtctaataaaatttcaccagactggtatttatcaatgccgaaaattgcccgcatgatctccgttcgacccgcgcccatcaatcctgaaaaaccaagaatttcaccttgatgcaccgtaaagctgacatccttgaacacgccattttcggtcaagcctttgacttccatcgccactggcccgtgatcaggcgtacgatccggataaaaatcgtcaatctcgcgaccaaccatgtccttgactagttgtttcatggtgacatctttggtggcgtattcggtgattgacagaccatcacgcatcacagtaactttgtcagcaatttcaaaaatttcttccatccggtgtgagatatagataaagcccacacctttttccttgagccgccgcaccaccccgaaaagctggtcaatttccgtttcggtcaaggctgcagtcggttcatccatgatgataattttggcatcggtcatgagtgacttggcgatttcaaccatttgctgacgcccaacactcaagttgccgattggttgttcaacatcaagtttggcgccgagcagactaagataatgtgccacctgttcgcgcattgccttattgtccattaagccaaacttggtgcgcagttccttattcaaaaacatgttgtcgaccacggacatctctagaaaattattcatttcctgatgaataaaactgatgccatgctgttcggcttccatcggccctgaatacgtggttggctgaccatccaccagaatctcgccactgtttgcttgatacaaaccagtcagaatattcatcaaggtcgattttccggccccattttcgcccatcaacgcatgaacttcacctgactcaacggtgaaatcaacgccttcaaggacccgattggcgccaaaactcttggtgatcttcttcatttcgatcttcattgtgattcccccaagtacatgctggtgcttgctttttctaaacgcgttcgccttgcgcagaaacctgctcataaggacctcaagcctaaaagccatttaggcttgaggctacttatgctccggtttctaatcgcgccagttcacgctctctaaacggtctggctcacgctctaaaaaacaacgccgctttccaataaaatattcgaataaggtgtcatttcgccagtgcggacgaaggctttggttttgctgaggtcttgtttcatttgatcatgtggtataaaggcgattggcacatcgatgagttgctgtatttgcttgagttgttccggattttcagttttgatttcttctgccagataaaccttttggacttgtaactctgacaaaacgttcttcagaacatcgataaaactcggcagatttttcgagacagctagatcaattttccaagtatcctcaggcaccggcatcccagcgtccccgattcccagtagatcaaagtgccccatatcggcaatgacttgtgacagttgtgtgttaataaccgttccttttttcaatcaaaacgcctcctcttattcggcatctgcaccctatttttttaagatgcacgttatgctttaaatccgatttgtcgatccgcgctcaatcaacttcactggcagttcaatcacgttgcgatcttgatggtcaccagccatctgggccagcaacatgtcgatcgcgcgttggccaagttcgtcaattggttgcgcaatcgtggttaacccgggggtcatgaatcgcgcctgtgacacatcatcgaagccaacaaccgcgtagtcctctggaatccgtttatgatgctcatacaacccgcggtaaacaccgcttgcgacatcatcattgatcgcaataatagcagtagcatcagttttgactatctggtcgacagcctggcgcccgccttccggatcaaatgttgcgcggaagattaactgcggatcgagtgcaacattgtgtgaatcgaacgcatgttgataaccagcgagacgatcccgcagattaaaggtcagcggctctggcaatactagcgcaatccggcggtgaccacgtttaatgagatgatcagcgacaagagaacctgcatgaaaatcatcaatacgaatgctgtcgccagatgtcagcgtggtagcctgatccataaagaccattggcagatggagctgatcttccactttttgaacgatctcctgagatgcttctggcgccgccaaaatcaagccacgctgagtaccacctaaaaactgacgaataaaataatcaacattctcatggaaaccattaattgaaaagatttgtggaaagagtccctgtggaatggctgccttttcgacactgaccacaaaactcgcgaagaagggattcatgatatcgggtatcacaacaccaattgagttgccacgcttaccaaccagcccacgggcaaagaaatccggttcataacccaacgccttcttggcagcaagcacccgttttcgcgatttttcgctaaaccgttcccctttcccatttaaaatttgtgaaacggttgtgactgacaaaccagtttcctttgccacatcagtaatcgaaatcttctttttcatgctgtccacgacctaaatcatttgctaggtaaaacgttttacttaatcttgcaagatcagcttaacctgattttggaagcgttgtcaactaccaagattcatttctcatgaaacaaaataggctaatatgagcataaagagggcatatcctgtataaaggctgcctcatcaaatactaaaaagtgtgtttataaaacttaggccaaaattcgggaactgatagttgagagacgcatctgtattgggtctttcgtttttctgttgtataacagattttcttattgacgccgagtcactcgtgaaacggtgtataagcttgtggaacttttttaataaaaaaagcaaccaccttccttttagcgtgaaaggtggttgcttagtcacatatccgatttctgccttttgaagaagctgataaagcgcttcatttcatcttttttcaacgctagcaatgtgactatgaggacaatgatgtagatgatagcagccaaaatgcccgacaacaccaaatcctcttgaaaaccgggaattggcatgattaggaaaaccataaacgcccctgataccaaaaacgctattgctgtcgctgcaaaatctttccaatcacttctcaactcattagacatcattctgaccctgttcttgcttcatgccttcaatatgcaaatttatcataagccaattcactttgttcatggattattctccctttgaaatttagattgcgtgctagtctgttcaagaagaatgtacaatacaaatcaaagtgatggcacttccttttttaaacgtcgtcaatagaccgataatcgtcgaaattgccatcattattgtcctttgactacgaaaatgtcgttacattttgaatgcgtattcaaaaatgatgaaacatcacccgcaacagcgtggtgacgcctcatcatttagattggcttacatgagtcgttcttttttaacatcacgccttgctaacagcggcatgatgaagccaaaaccaaagagtaccatcacggagatgatattcatcaccagttgatgggtccagccattggtaccgaaaacaacttcctgtggtaagaaaccaagcgtcgcacagatgaacgtgaagacaaagcaccaaccgccaactagataagcaccggccttgcttttgatgaaggtatagccggaagtgaacttgtctgcttgcgcccgcaatgccaagaaagctacaaagacaagcgccgttttgtatggcgatacaataccattcaaattcagtaaccagttgaagatggcattaatattcggcagcgtccctgacagcaacaacaagaacagacaaagtgaggcggtaaaaatataactatggattggccgaccttgcttgtttttctgcaacaaccatttaggcatgaaccgcatggcggtgtcggctgacaatacccggctggaagcatcaatcaacaccgctagctgggcgagcatgaagagcaattgcgtgatggcaaacagatacatcagcactttgccccatccccacgcctgaccaagcatggaaaaggcataataagcgccattcattttgagatcatctggcagatggttggcattgaaccaaacgcctaatgccagcgatccaaaaatcaccagaaaaccggtcatgagcgccagagcccacatggctttaggaaactcttttttcgggttgcgcaactgagcaacataagtggcgccaagttccgcccctgatgtcgcaaaaatcaagagtccggtcgtggcaaagtaatgcagcgaaaaatgtggcttgaacgcggcccaactaaagtttgttgccgaatgcatgcctttggccaaaccggccgccgtcaagacaacgaacagaactgccatcaaaaacatcgccgcaccgccaatcagcgacatgacctcaagtgatcgggagaacaggttctcaaacacaataaataaaagaatgatagcaaaagtcagcaggccaaaggtcagattcgacattcgtttacccaaactgttatcacccagaatcatccaggaaagcgccacgatgacagcgttggaaacatcgactaaatatggcagggtctgagcccaataaatccagcttgtccagtatccccaagtgtcccctagcgtgcggcgtatccaagtcgccaagcctccgccttcatcagcccgggtaaaagtcgtccctaattgtgccgaaatcaaggcgtacggcacgatataaatcactaacaggatgacccagttaacaacaacggaaagcccttggttctgaaaaggataaaaaatattttcaaagccaatgaccgtaataaaaacaagtaagcttaagactggccagctcatataccgccggggcgtcagttcttcttcttgcacaattcaaagcctccaaatacaaactaagagcgcctgtagctcggtactggtcacatatcgggatgcaggctggtttgatagcctcttgatgactggctagtaactaggcgtgctcccaaaaatggccgccaacttggcaggtcatgaattggtaccatccattgaagcgtcacgttcatccgccatcaaaggcatcgcgccctccttgatgtcagtatagcggaaactggtctagaaaaatagtgtttcacaacacaactatcagtagtgatcaggctttgcgtggttattttgcagggattggcaacgtttcacaacaacatgattgaaaaaatcgactttttcaaaaaacgccgaagacatttctatcttcggcaccccttcttaaccttgacgcaaactcactttttcactcaactttgcccagtgatttgtcggaccatggccatggccaactgaaatgccttggctgatggcgccttgcagaaaggctttggctgtcatgatagctgcttttaatggctgcccttttgctaactctgcagcgatacatgccgagaaggtatcaccggttccatgcgtgttcgcagtggcaattcgtggcgcactgagccaataacacgtaccgtcagccaatagaatcagatcctcggccttgtgattctgacgatggccccctttaataatgacatgcttgacgccaagtgtttgaatcatacgcgccgcccgaaccatatccgcgttggtcacaatttttttacccacgagaatttctgcttcgggtagattcggcgtcaccacatccgccaacgggagcagctgttctttgatggtgacgacagcttccgaggcaagcaacgtcgcgccgcccttggctaccatcactggatcgacaatcagcgggccaaaatcaacctgttgcaaattgcggacaacggcttcgacatgctcacgatccgctaacatccccgttttggccgcgcaaatgtcaaaatcggcagctaacgattgaaactgggcgtcaatgaagcccgccggaatcggcagactggcctggaccccatacgtattctgcgctgtcagtgccaccacaatactcatcccaaagacgtgtcgggcctgaaaagttttcaaatctgcttgtagccctgccccaccaccagaatcggaaccagcgatggtgacgacttgcggtgtacgattaacggtcatttggtaacaccgcctttaacttcgtgcgcaaagcctgaactttgtgagcgatatcaggtgcctgcatgatttcgctcacaatcgcaaccccggcgatcccggtatctttaaacgtcgccaaattggcctctttgacgccgccaatagccacgaccggcacggcaacttgtgcagtgatcgcctttaatgtcgcaatcggggtcaccgctgcgtttgccttcgtctgcgtcgggaaaatggcgccaacccccaagtaatcagcaccagcggcaaccgcggcaaccgccgtctcgacggtttttgtggaaacgcccaataccttgtcaggaccgatcaactggcgggtcatcgcaacaggcagctcatcatcgccgatatgcacaccagctgcatctacagctaaacaaatgtcgacgcgatcatcaataatcagcgggatctgataacgatcagtgatgagcttaacccgttgtgccaattcaaaataggctcgagtgctcagcatcttttcgcgtaattgcaccatcgtgacgccattttcacaagcagccgcgattttagccaaaaaagttgcttcgttgtcatcataacgatgggtgactaagtacagttttagatctgttgcgttcataacgcttcccctttcaccatttgaagccagtcagcggtggcagccagtaaggaaagttgattcaaggtaccttcgcgaaatgccgccagtccgccggttcgattctgcgcagctgctacttcgccacagcagttgaagtaactcacagccacgacgactgctgcgtcgttgtccaaacctgtccccaacagcgcggcaatcaaggcaccgacaatgtcaccagtcccggtgaaacgatccagttgcggcaccccatttttcaaataccaagtccccttcgcactcacaacgagatcaatcttgccggttgccaagaaggtagtggtgggaaacgcttgggtcagctgctgcaagctcgcggctagttctcccaaggcggtcgcactttgatctaactggcttccatcaacgccgcggcctgtactttttagatcagcgaatcggcgcatttcagaaatgttacctttgaccacgttcggatgattggctaacgattgatggcctaagtcatagcgcaactgggtggcagaaacgccgaccaaatcaatcaccgttggctggttggtggcctgcgcaaacttgccagcggctaatagattctgctggcgcacttcggaaatgtgtccaagattcaacagcaacgcatcactttgagcaaagaattccgggaactcgcgctgatcatcagccatgaccggcttcgcatcaatgtaaagcaacgcattagccatggattcgacggtgatttcgttggtaatgcattgcaccagtggggatgatgttaatggtagggcggttttgaacgcggtgtaaaaaacgtcagtgattgcttttgacatggaaaagcctcctagaaaattttttgaatacgcttggtgatgccaatgtgatcaagttcatataggacaaacaagccgattaacgaccctgagatcgatccaccaaaaaaacgtggggtgtaaacgaaccagtagagcgattgcgcgctgccggtgaaccaaaccatcacgggataagacagtaaggacccgatcaaaccagtgccaagaatctccccagcggcggcccaccaattgtgtttgccaaaacgatagccgaggccagctaaaagcgccccgaatattgcaccggtcaatgccagcggtggaatccccaataatgccatgcgaatcagagcacaaccaaaggccatgatggtggcatatagcggtcccatcatggcagctgccacgacattgaccacgctggacataggtgccatcccttcaatgcgaaataagggtgaaagcaccacatccaaggcgatcatcatcgctaatattgccagtttcttaacgctgctttgggtcatcaaccttcgctcctttcggccacgcttctatgtgatacgccatctcccaaaagctgtattccatttgactgctaattcgaaaagcgttcagcatttgttgctgctcagtcggcatgctttggtcgtacaaccgatcaatcaacgcaatcgccgctcgctgatcgtccgcattgtccgcaccgctataagtgtcaatccaacgctgataaatcggcacgggtgattttcgttgctgcaactgctgcgccacctcctgatacaaccatggacatggcagcatccccgcaatcgccacatgcgacgtgccttcaaccaattgtcggtacatatgggaaacatagtgatacgtggtcggcgcaatcgtggtggccgccagctcagttgttgagatgttcaattcggcgaaaaaatcgtggcgtatcgcaatttcaccttgggccaaaccttcagccgactgcagcgcataagctttcaattccggctcctgcgtctgtgcggcaatcagcgtatataaatgtgtaaaatgttgcagataataagcatcctgaatcagataaaagcggaaaatcgccggatcaagggtgccagcttgtagctccgtaataaatgggtgagtgaagctgccttcccagtacggaacaacttgctgccgagctttttcagaaaatttcatcatcgtttgctccttcaattctgtctatcttgaccatattcaaagcctaaaaacagtatttttactagaatcaagttttttatgacgttaatggccaataagattcaccatcacgaacactgcgcctgccatcaacaaaccgcggcgggaactggtcagttgccgttgaatcgttcgcgaaccaccctccgtgtagccatgcgcatacatggcggtcacatactgatcctgccaagccatcgcaacgaagatgaccttgacgtaaatcagcggcgaccaaggacgcagtttctgaccgcgcaactgactcgcttcccgaagatcagccacttcccgcatgatttgcggcagggcatggatgaccactaataatccatagacaaaattcggcgatagtttatgctgctcaagccacaacaataacgcttccaaatcaacgccagtgagaaacaccaagcccaaagccgtaaacgcgtatgttcggacaaacagtaacagcgcataagatgtgtctgttgcatgaagcgtgatggcccaataactgctcgcggctgggatcaacggcagcagcagtaacacgatcaagcttctaaaggctcgccgccacccaagaaaacccagtgctaacacgatcaatgcgacattcagcttcaccgcgtgactaaacgaaatctctagcgttaaggctagaatcaagaggctcaagttgagtgcatctgtcttcttctgtgccatcacgttacccctgcacaacctgcaaccgctgattggctagcaaaacctgttgctggctgatgccggctaacggtaccaatcggtgcgtcacgatcaaaaacgcttgcgtggccgacttagccttaatccatgcggcaaagtactgacaggcgcgatcatccaaaccgctaaatggttcatctagtagtaaaaatgacaaatctaagctcagcatcgtcatcaactgaaccatctttttctggccttcactcaactggtaaagactagtggtctgcttttctgctagtccaagataagctaatgcggcttgttgtttttcccgcaccgcagccggtaacgccggcccaaacgctagctcatcagccagcgtcaacgtcacgaattgttttgccgcggcttgcacggccagcgtcatagtttgataaagtcgtttccggggacgcaagcgttgttggccaaggaacatacggccttgataaggatggcgctgcaccatcgatcgcaataaggtggacttgccactcccattggccccagtcaaggtggtgatgccatcgttaaaatcccaactcggtgcttgaagcaagatatggtgattttgctggcagacaacgttttccagatggaagattttattggtcgcctgccgtggttgcgtgaggttaaaatgcgtcggtagcgtggtcagcgttgcgagtggtagccgacttagcgcgccatttttcaaggcaaccagttgatctgccacatcggcataatctgtcaggtcatgctctgcgatcacaattgttttgccatgatcacgtaacgtccctaattttccaattagcagatggcgacttgtcggatcaatgctggcaaacggctcgtccagtagcaaaatcggtgcatccatcgccagcaaaaccgttaacgccgcgcgctgcttttcaccgcctgataaggtactcaagtcacgattcagcaatgcctgagtctccccaagagcaaccgcctgggcaaagcgccgctgaatttcagcaaccggcaaattcagattttccaaggcaaaagacaactcaccgctcaaggttcgcatcgtaaactgctggtcagggttttgaaacatcatgccaacatgctgtgctttgacttgcatcgcggcgttccgatcatcatgaccatccagcaaaatcgtgccttcgtatggcatcgctgcaaatcccgcgatcaaactgagcaaagtcgacttcccgctgccgctatcaccggttaaaacggtaagtgctcctgttggaaattcaaaattcaagtccgtaaacaaatccgtctcgcgatgaaaccgtatcgcttttaatacaatactcatttgccgctacctgctagccaagtgcttggcaccagccgcctgttcataaagtttcagaacgagttggaccagcacaacgccgaaaaagatcactgacaacaagcgaaccaccacaagcgccaaaatcatgcgaagactgtaagcgccgtatccaagtttgaaatactcgtaggtaaaactgaacaccgtggtcccaatcgctgcgtacaaaagactcacgacgtcataacgccgataacgtgtcaccataaagccggcctcgctgcccaaaccttgaacaaacccagaaagcaagactgctgggccaaagtacgacccgtaaagcatctccgctaaagcagcgaaacattcgcctaaaattgaactgcctttttttcgcaacagcatcgtcgtcatcggcgccgccatcacccacatgccaaacaacaattcattgacaaacggtgcataacccagcggtgtcaaagcagctgctacaacggcataaatcgcatcggcacccatgaaaacaccgccgaagaggaaggctaaaaacgccagcaaaaccacatcgcgcaaagaccatttatccatcaaaataacccccgttttcctcaaataaagacagacgggggctaaaaacgcgaatcattaccaatcacgccaacacctattcatgttcaaaaaaggacccatcaccaaaatttggtggggtccatgaaaacacaaacaagcatcgttacagaacgattcacttcttcgacatttccctgcggcagtcctaactgcatcaggttccatgggtatcatctcagctttacagcaccccaaatgtttctattcgattgtaaagggagtatatcatgttttatttggaaccgctagcaggcaagtgtcaactgacgcagaaatctgatactgaacttgatatcaacggattgcgttcgccgtgcttaaaatgatttctccactagaaaaagactcacaagtcatgctatactgaaatcagaaaaagccgttgcgctggaacgcaacggccgggcaaagtgccctcacagaaccatccaatgaacgatggctactagaataggcaactaaaagccgcgaaatcccagctgaaggactgcggcttttagtttgcctatttttctcgaactttgtcgagcgcctgttggcattcggccactgctaaaatgcgctcactggcgcagaagcctgatactgaatttgatatcaacgtattggtgttcgccgtgcttaaaatgatttatccactagaaaaaagctcacaagtcatgctatactgaggtcagagaaaaagccgccgcgtgcaaccgcgacggccgggcagaaatgccctcacagaaccatctaatgaacgatggctgttggaacaagcaactaaaagccgcgagattcccctgaaggatgcgcggcttttagtttgcctatttttctcggagttgcccgagcgccctgcggaattcggccactgctagtagcagtctggtactggctttgactagccttgttaaggcagccaccagtatcacgcacgaaaccacacaggccgtgatcgtcgttaatgcagcgaccacagacaagcttgtgtacctttttcttcaacgtgtggctgataggtttccccatacgcaccaccacctctctgatccgataccaccgctcattatccttttctgtgttgcaatcagtctatcagaataaccgattccgtgatgccttcgtgacggctatactgctttttaaaaaagcttgttcgaaatttacaagcacttcatctctaggtaaaatggcgcatatatcattctttttgttccacatatttttatctattattttctagaagtaatgatcaaagctattattaatcatcatgcccttttaaggaggccatccccatgaaaaccacaatccgccccgaacagccatcagattaccgccaagttgaaactatccatcgcaatgctttctggaatctttatgtccccggtgctgatgaacattttttagcgcatatcattcgagatcataccgatttcgttcctgaactggatcttgtgcttgaacacaatgcacaagtgattggcaatattatgtacacgaaggccaagttagttgatgaaaatggtaatgagaaaacgattctgacgtttggtccggtcgccattgatccagcctttcagcggcagggtttcggtaagcaattgatggaagtgtccatgaagcgagctgctgaacttggttacgacaccatcgtgattttgggtgacccggacaactatgtcgagcgcgggtttaagagttgccagaagttcaatgtctgggcggcagataacacgcagcctactgccatgatcgtgaaggttctcaagccaaatgcactggatggcagaaagtggacttatcacgagagtccagccatgagctatgacaaagaagacgcgactcgttttgacaccaccttcccagccaaggcaaagggttatcaagctagtcaagaagccttctatattttgagccactctgtgttgaagtcgtgatgtgatgccatcccatgaatggcttctgaagtaaacatgcatcgccgcgcttcccaacccagaaacctgcgtgtcagaaccttggtcgcattaaccaaaacgcggctaacactcccaaggccgctttacgcgccggtttctaaccgcgcgagctcgttttcaaaaaatagcgcgtcatgctgtctgggctatatccagataagcatgatgcgctattttgattaagcatgttgttcgtgactacttgatatacgccgtcttgaagtcatacggggtgccgtttggattaaacgatacgcccttgaccgttggccgcagtagttgcaggttattcgcctgatacagtggcaacgtgccttgatcgttcatcaagatcttttcagcatcttgcagcattgtccaacgtttctgcggttcattgccgtacttagtctcagtttcgctaagtaattgatcaagtttggtatttttataaccagaagtgttgtagccagaattgctgatccaaacatcaaggaagttgtaggcatcggcgaagattgattgccaaccagtcacaaccatatcgtaattaccagacatcatggcttgtagccgttgcgccttaggaatgctcttaatcgtaactttgacatgcggcaaactttcgaaagccccttgtaagtattcagcaacttgcttagaaacgtcagcatcgtctgccaacagcgtcaggttaagctcactctgaccagattctttcatcccttctgcaaatagcttcttggcctttgccttgttataagcaacagcactcttgacctgcgttgtctgggcaaaatcagcacctgttttttggttggtctgtaacccaattggcacgaagcccaacgctggtttggaaccgtcctttaagacgttcttagtgaccgcattgcgatcaacgaccattgaaaaggcttgccgaattttgagatttttaaaagccggtacctgtttttgattcaagtcaactcgtgtcatattggatgacagacgcttaatcgcatccttatcattaagatgtgctgcggcctgctcaccagtgagaacaattgaatcaagtttgttggtctgataaaggttcatacctgtttgaacatccttgatcacagtctcgttgactttgctcaacttaacattctttttgtcccaatattctggattcttaaccaatgtccagctatcactggcgccgttccattttgttaatttaaatggaccgctataaacctgcgcagatgatgttgtcccgtatgatttgccatatttttcaacagttttttggttttgcggataatataatgggaaagctaacattttcttgaagtaagccgttggattctccagtgtgatcgtcagatgtttgctatctgtcgctttaatccctaaatcactcgcaggtttagtgcctttaataatagcactggcattcttaactggcgcgaagtaaaaggcatctgttgccttcgttttaggatccactgtgcgttgccaactataaacgaaatcctgtgccgtgatcggatcgccattactccattttgcattacgcaaggtcacattgtaagtcatgccgtccttactagtggtcacctttttggccaaagccaattgagtcttttgtcctttgtctgttagccgataaatcccttcctgcgtattcgtcatcatttgaaaagacacggtatctgtcgacatagatggatcattggtcacaatggaagaaatttctgaccaatttagcgtctgagccttcttcgattgacttgtactactactgctgtttgacgaacagccagcagctaccaacgccaatgcagcgagtggcaacatcagtgtccatttttttaacttaaacatatgtattccctccaaaaatcgcggtaacaatcaactattgacaaaatactaagccagatccaaacttattgcaatgcaatattaatatttttctcatcgaaaggcagagatttcattgacaatacacattgatttgccacagttacaagctgactttattcggtacgctaaggtcaatacacgctcctatccagggcgtgacaccacaccatcaacgccagggcagactgaattggctaagcttttagtcgcacaactgaaggacttgggactccaagatgtcggtcttaatccggctaacggttttgtgacggccacactgccggccaacactgacaagccgacaaaaagtttcgggatcatcgcgcatttggacactgcagattacaatgcggaaaatgtgcaaccgcaagtgcatcctaattacgatggcaaaccgattcattttgataacggcctgagcctgactgttgagcagtttccagcattgaaacggtattttggccaaactttaattaccggtgatggcaccacattgttgggggtagatgataaagccgggattgctggcgcggtagccaccgcccgttatctgttggctcatccggaagtgaagcatggcttgatcaaattcggcttcggccctgatgaagaaatcgggactggtgcggataaatttgatgctaagggatttgcgactgattttgcctacactttggacaatggcgatcctggccaaattgaatatgaaacctttaacgctgcacaggcaacggtgaccatcgaaggtacctcggttcatccgggcgaggcgaaggatttgatgattaacgccaatacacttggtcggcaattggatgcagcattgccactgtttgatcgacctgaattcagtgacggccatgaaggttacttccttttactgaaattccatggcgaaatcagcgatgctcagttggtttatattatccgggattttgatcgccaaaagtttgatgcgcgcaaagcctactttatgaaaaccattgatgagttgaacgccccatttgaccatccgcggtttaaagttgagatgcatgaccagtattacaacatggccgacatcatcaacaaagatccctatccgctgcgcttagctgaagctggcattcaagcggctggcatgacacctaagacaattccattccgtggcggcactgatggttcaaaaattacttatcaaggcattccaacgccaaacctgttcaatggcggtatcaactttcacggtccttatgaagtagtttcgactgaagcgatgggcaaaattgctgagaccttggtccatatggccgaactgaatgcagctggaacggttgactaacatacagttgatacaatgacgatcaatcatttacgcactaaatcgtttttcagaaatcatctgaaaaacgattttttgtttgcataaaaatatcgccaatggttgctgcagaatattttgacaacactctttggagatgaaaattaacgaaacaacgctgttaatattattctatttattatgcgggtaatgattctcatcgtattatagtcgctttcacctcgtcagtaatctgttttgttgttaaactacctgacggataacgagataaaacatcatgctcagggtttcttagctttcatctggacaaacttgcaatggtgacatttttgccaacaacaggtgcaaaagtgggactttttgttggttatattgtccggcataatgacgatgttgatggaagcgcttactgattggagggcgagtcattgcgtgaacaaaccattatcaacgctttacaaaccaacgggccgatgtccgcagctgctttagcagcgacgttgggggtctcgcggcgaacactgcaaagtgatttgcggcaattaaatgaagacaacaccggttttatcattacggttacccgcaatgtgggttatcagttgaccatcaccgatagtgcgcagtttgctgcttatcaagctagtttgcaagatcaagcacaaccggccatgccggcgaaacgattgcctgccttaatgcatgtcttgctgaccacgaccgagtatctaacagtggcgcagttagccgagcacgagctgatcagttcaaaacagttgcaacgcgatttacgcgagctagaaaagttgctgattggcacaccactgcaattggaacgtaaggcacattacggtatccgacttcaaggcgaatggcaaagtcgcattcatgccttacaacaacggggcttgccgccgcatcatcagactttgtgtcagcgtttaatgcccttggggttggatccagcgatcacggcgcagtttgctggcgaggttggctggtcactggcagtcagaggtcagacaacagtgcctgcaccaacgacagcggcttttgctggtttgttagccgatagtcggcttagtgaagaagcatggcaatttttgaccgtcagtttcgcggcgaaacacaaacaactcaccacgcggctggaccacgacctgttgaaaacaaaactgcaagcttatttcaccgctttagatacgcggcacaaaactgatttcgccacccatcccgaatttttgtcgctcatgtattttcatgtgttggcactgatcggacgattgcagaaacatcaaagtttggcagggttaagtctggaaccattggcccgcgactacccgattgcgttcaactgggcggtccagtttgcccagtggctgactcgcgaatatcaaatagcggtaccaaaaaccgagattggttatttgactactcatctgttagtcccgctcgaacaggcacacgaggcttggagtcggcggctgtataagatcgcagttctttgtggcaccggcggcgggattgcgacgttattgtgtttacgattgcgccgcattttccctgaggccgttatccagacattcggtcttaatgaactcactgcaattcatgagcttgaaccagatttactgttcacggtgactgagttaaccgagacgtttgactgtccagtcgttcggattgatgaattggcatctgatctggattttgccaacctgcgtcacgaactatcaatggcggcacgcagcaataatactgacacgttggtcgatttactaacaccggctttgtttttccagacaagtcaggcggcagattatcacgcgttattgctcgcactgaccgccaccatgacttcttattgtggtcagtcagattatgccgaatcagtgatgcagcgggaaaactttttagcaaccatctatgacaacggcattgcgattccacatcccctgtcattcaacgctgaaaagaacgccgttgcggtggtggtcttgccaaatggtgctggcggcagttctcgaccggttaagttagtctggttaatcgcattaaaacgcgatcagctaccgttgcatcgcacactaacaacgcaattagcagccttaatgcaacagccagatgtcatcgagcaactcgtccaccaaactggtttcacccgattcattaacattttacgcacggcactggaaggagcagagcaaacatggatttacaactgatggctgcgctaagtaacgcagatgcaatcgcgtccaacgaaggcgaggttcgcaccattttgcgcgattatctaaagcctgtcgatctaaaagttcagactgatggcctcggctcactgattttcacgaaacgaacggttaaaccagcgttttcggtcatgatttacggtcatatggatgaagtcggctatatggtgcgcacgataacgcctgaaggtctgttacggttgatggtggttggcggcgttaagccactggcaagccattggcaaagcgtccgcgtgaccacggtttctggccaaaaactgccgggtatggtcattcgtgatgagagtttggccgcatttgatcagattctatgtgacgttggtgccaatagcgcagcagaagtcgcagcccttgggatcaccattggcgacatggtcactttttcgactgacttcaccgagtatgctgcagatggcgtttttggcggtaaggcgcttgatgaccggctgggctgttatgtcggcgcacgcctgctgcaggaattagctgaagatgagttaccgtttactttacgttttgccgcgaccagtagtgaggaggtcgggattcgaggggcgaaaaccgcaactcaactgatccagcctgatctcgcatttatcgtcgatgtcgccaccttccaaaatccgcgcgaacgtagcgaagtgaaccaacgccaagtcggcagcggcccgatcctgacgcactttgaccgcaccttggcacctaatcgcacgttgcaacaatttgtgaaagaaactgccgcaaccgcctccctgccgctgcagctggatatgtttaacggtggcggtactgacggtggtgaagcccataaagtcggtgttggcattccgactgtcgtcacaattctgccatgccgctatggtcactgtgcccaatcgttagcgcaggcacaggatgtggatcaaatggtcgctttatatgccgcaatgtgtcgacgactgaccgtggcaacagcggagaaagctcgttcattttgatcgtctggtaccgataaaacgcgctctccagcccagaaacctgcgtataaggaccacaaccgcaatggtcaaaaaccgaccattacggttgtgcccgcttatactccggtttctaaacaggctggctcgcgctctaaaggagattaaacccaatggcaacgacccaagaattagaaattatgcagttgattgctaatgccggtgagagtaaaaccaaggcatttgcggccttgcaggcggtgcaaacacaggattttgccaaagcccgcagcttattggctgaggctaaggcgattgatgttgccgctcataacgcccagacggcaatgatttgccgcgagtttgatcctaatcatacgccggaaccggtgagtcttctgatggtacatgcgcaggatcactacatgaccagccaactcgcacgcgatttgattgaaactttgattaccatttttgaagcccaaacaacgaaaaccaatgtgtgacagggtatcggtcaatggccgtacctaaacctaaggaggaaaataatgatgcgaattcttttgtgctgtgccggtggcttttctaccaatatgttgatgcaaaatatggccaaggtggtcaaagatagccacaaattaaacgaagatgattttaaattcgacgcgattcccgtggacggtcttgaagaagaaatcgataactatgacatcgtgttggtaggaccacagattggtcataaaactggctacattggggaaatctgtgatccacggcacattccatttgctgtcattgataaggatgtgtatggccaaatggatggcgccacggttatgaaactagcactgctgacccatgcgaagtatcaaaaaaagcacgctggctaacgtttcatcggtacgactttgagaggggattacacgatgttcagtcaattcgagtctttcatgaaccgcttcttcatgccgatcgcacacaaggtcgacaatcagcgtcatctaagcgcgatcaaggcggggatggtcgccatgacaccgttcaccatcctcggcagtattttcacgattattccggcgttgcctaacatgctcggtcctaaaaatgctgtctcgcttttcatcactagcaatgctgacttgttcgatctgccggtgaagttatccatcggcatgattggtctgtatgcctgtttatccatcgcgtacaacttaggcaatcactacaaactctatattccaggctgtgtcaccttgtccggttttgccttcctgatgatggtcgcaacgttcactaaaaccggtcagttagacgtcaccaatctaggtgctcgaggacttttcaccggcatgatcgtggccttgctgacagtcgagctctatcactggtgcaaaacccatcacctaacattgaaaatgcctgacggggtgccagattttgtctcccgttcattcgaactgattccagtcaccttgatcaccggtggtgcatttatcgctggccgatttgccttcctgaattttgctggcgagctgccaccaagtattctaacccgcttcttggcgccgctggtcggtagcatggacaatccatgggcggtcttactgctcaactttgcgatttgtaccgtgtttttctttggcatccactcatcggtcttctccccgatcaccagcccgattatggtcacgtttatcgctgaaaacatcgctgcgatgaacgccggcgaagccattccgcatttttacacagctggtgctgtttctagtttcttcggtttcaccggttgcggcatttccatcggctgcgtcgttgcctgcatgctctcgaagagcaaacgctatcggaaaatcggcaaaatttcgttgttcccggcattatttggcatcaacgaacctatcctgtttggcgcaccgatcattctcaatccgatcatgttcatcccccatgtattcggtggtgccatcattggcacgctgccgatgttcttcatgcactggggctggatcgccaaaccgattttcaatccaccatatgtcggcgttttccttgaagggttcctaaccaacggcgactaccgcaccatcttcgccaacgccctccaactcgtgctggctgtcgccctttactggccattcttcaaggtcatggaacgcgcagaactaaaactcgaagccaaaaaagccgcgaaaaagtccattttctcaaaagaagacgaagacaccctcgctggactggatttagacttctagagcgtgactggcgcgcttagaaaccggaacctaagtggcctcaagtgcgatgggcgcactttgcccattgtgcttgatgtccttatgtgcaggtttctggtctggtgaacgcgtttgagatcgtgatctagcgcgcttagaagttaacgcacccttaggaggccaaaatgacacatttgaaaaaaatccaacaagcactcacgatgcaggcaattgacgccttactgctgcacgatcgtcaaagcaaacgctacgttggtgccttgcctggcagtggcgtgtatgtggtggttacccccacccaagcgctacaatttcacgatggccgatatcgcaatgaagcggctgacaccagtgggtttaccaatattgaagtaccgcaaggcgaatacttaccggaactcgttagctttttaagcgctcaattatgtcggcgggtcgcacttgtcagtaccgggttctccattcctgagtttcagactctgaccgcacagaattggacgttgagtttagctgatagcctgctggctgaaagtcgagcggtcaaagatgccatggaaattcaagcgatcacggctgcctgtagggtcacagatcaggtctttgcccatttgctaccgcatattcgggccggggtcagcgaatatgaactgaatgcatggctgcacttctatgctttacaggcgggcacatctgccatggccttcgatccaattgtcgctagcggcccacgtggcgctttgccacatggtcgggcgactgaccggcaactgaaaagcggtgaattgatcacgattgattttggcgttgtccttaacgattatcaatcagacatgacacgcacgctcacaatcggcgaaccgcagcccgagctctcagccgtgcatgatgccgtccttactgctcaactcactgctattgatgccttaaaacccggtgtgcaagcgcgagagattgacgcgattgcgcgtggcgtgttaaccgctgccggttatggcgattgtttcacccacggattgggccatggtctcggactaggcggtgatcaaccgattctgaaccctcagagtcaaacggttttgcaaccggggatggtggtcaccattgaacccggcgcctacttgcccggcatcggcggtgtccgtatcgaagacgatgttctaatcacggatactggtgcacaggtgctgaatcagacaagcaaagacttgatgttactggaggaacaagaatatgagtcagtttgacaccctttttgaccgtaaagccggtaacgcgcgcaaatgggccgatagtgtgttggcaaagaagttcggcctaacgcctaacgcgattccaatggatctggctgacctggactttcctgttgcaccaccgattcacgatgccgttatggcccgcgccgcagtttctgactatagttacacctatatcccagatgcgtttaacgaaaccgttattgcttggaacgcacgccgttttgggcttgaacttgaagcagattggttgaaattgagttacggcacggtgccaaccttgcattatattgttcaagcctttacggcagttggcgaaagtgtactgattaacacaccggcctatgatccgttcgccgaagccgtcgagcacaaccagcgacagctcatcaccagcccgttaaaactagaaaatgaccgctatgtgtttgactttgaagatctggccgacaaaatggcacggccagatgtgaaagtattcatcctctgcagtccgcaaaatccatctggtcgtgtttggacggctgaggaactcgaacaggtcggtgatctttgccttcagcaccacgtcttgctggtaagcgatgaaattcaccgcgatattgtttatcccggcgtccacttcactagcatctggcaggcttgcccagcgattcgcgatcacagtattttgtgcttgtcgcctaataaggccttcaacttaggcgggttaaaaacgtcctatgtcgtcattcctgacgctgggattcgcgatcggttagcgcaacaattcgccgccaattcaatcacttcaccgaacagtttcgccatacctgccctgatcgcaacctataccaagtgtgacgcttggctagatgaaatggtcgcctatgtagctgataattttgtttatctacgcgatcggtttgctgagatcccggagatgcaggtgatgccagctgaatctggttttctggcttggatcgatgtccgacgactatttgctgatgaagccgagttgaagcgtttcttcaccgcttgcgacctttcctgtgtcgtcggcagctattttgtggccgatggtgaaggtttcgtccggctgaatattggcatgccacggccattactcaaagaggccttagatcgaatactcgcgatttacgccacttggcatcagcaagaagcacctgtcccaaaatagtcccgcaaggccaaatcaccaacagccacgctcttctaagaaaaatgcccgttttcaggcgacgatcacacgtcacaacctgaaaatgggcattttcttgtcccgttatacagcaccccttattcagccgcctgctcaatatcttgatccgccgtttgcgtgccaaaatgacgtttataccattgcaacatgtttcgctcattggtattctttgccatccaaattggtttgccaattcgcttagcctcgtctttagcagcatacatctgtccatgatcaacaaaatcggtggtcacaatgaccatgtcggccttttgaacctttttcttcaacatggcgttcgaatctgatcgcggcgagagaatgagcttgccgccacggtcttcaacatgccgtttcaccttgcgcggcatggcggagttttcaatgcaaacgagtaacagtgacttatcggcgaaaacctggcgtagttgccgcacaggtgccacgctgaccttcttcttggctggcgctggctgactaggctttgtttctgccgatgcttctagtgcagatttggcaaattggcgtttcattcgggtggcgactacagcagatgccgtgtacttccaaacgattttgccatcaatttcttgcccccgccggtaagcatagtcaatataatcgcctggcttcagcttgaatgagagcacatcgtagtcaccgagcaacaattgctgggtagtttcgtgctcaggcgattgaaactcaatataccagcgtttgacatcttgtctatagacagccggtaaaaattgcagccgaacaatttcggtcggcaagggatcgcgtttcagcgtggtaattttgtagcgcatcagctcgtcgtccttaatctcctcggccttaacccaatctccatttgtcggcgcatttgccattttatgtagcttactctctgataccttaatcggaccgacatgcccaccatttaaatcaaggtgaaaccggccaatgtaagcgtgacgctgatccaaccaatgttcagaaaagaatgacacttctttttcagaggttgcctcggtggaggcggctggcacctgctcacttgtaactggctcaacatcgtctttgacctcagcaaccgctattggtctttcttcagcctgtgtcctatcttgaccagttgtgagcgctgctgtctcatcttcctgtgttactgaggatgtagcaacaaattcaatcgttgctaagtcattgagaattttaagtaagctttgaatatcattagttatttttttgaatattatcagtcgttagttgtgttgttttagcagtaatttgattttttataagttcaattattgcagacttgtcgtccatataggtcccaccttcaacttaggattgattttctttattgtactgttattgatatcaattcaaaagaatttaagcttggaatcaatcaagctttgttatcacagacaagatttcaaaatttttgtgttaagtaagcaattattgaaaaatctaactattttcttgacgtcagggccattctgttaactaaggcaattcatttttagcgtacagaaaaagcccgtgtcacaactcgacacgagctttccaagaaccttttggctgattaatgcttcacaatgtcattgatataagcaatgccagccttaccatcgccgatcagatctggcttcatgtccaacatctgggcattcaggaaactgatgaccatcggcaggttcatgccagaatataggtcgaacttgccgccttcagccaagacacgggctgcgacgttattcggcgtgccgcctttaaggtcggcaaggacgacaacatcgtcttgcccctctacagcagctttaaacttggcctgaaaatcttccggaccttcatttggcaacagtgcaacggtggcaatatcgtcttggggacccatgatcatttcagcgctcttcttaagctcctcacacagttgcccgtgactaatcaaaactaatttactcatatcgaaagactcctttaaaacgtttctgataccaaattaacccttagcaatgacaccgagtgccgacagcagcaccgaaacgatcaatacgatgaaaatcgcccgggttgaggtcatatgcttacgaccaagcaaccagtaaaccgcgccaacaatcaaggctggaagcagttttggaatgatcaagtcaaagtatttctggaaatccaatggtacactgccgatcttcggcgcaaaaccaatcttaacattgatcatggttgcgaccaaggcaccaaccatgaagacacccatcaaggtagcagcgtcagtcaaagcagccaatcgatgcgccattgttgtgaccaacgaaaccccttcgttataagcaattcgcaattgcttccaacgaaataccatgacggcaatttgagcagcgatccagatgaagaccccaactgggttgccttgcgttgccatttgtgcagcaatcgccccgaaaatagctggaatcaaggcagcaaagatggaatcaccgatagcagcgaaggaccccatcaaaccggttttaatcccggcaacagtttcttcgccagcaatcccttctttttcttcgaccgccaaatcaatcccagtgatgatggtattgaagaagtttgacgtgttgaagaactgggtgtgggttttcatgactttcttgagctctggtgtgccatcaccgtagattttgcgcaattgcggcaaaatggtgtaaagataacccgaaccttgcatccgttcgtaattccaacccaactggaagccgaacaggctgcgccggttaatctgccggaaatctttatcggtcaatttgtacgtaggtttattagagttcatcatcggtgatttccccctgttcattagtcttgtttgcggctgtgcctgatgctgcatctgtattaccattgccaactgcgatatcgtgcagctttgttgtttgttgatagctgatcgcagcaaaggcaaacgcaatcaatgccatagcaagcatggacaaaccgttgaaggaagcagtgaaccctttagctaccccagcaactgcggtacccaaggtctgaacgctgccaaacagtgtcgtgaacagcacggtgaaaacaaagcccataatgaggtatgggaagtgtttcttaagtggcaggtaatgcaacagaatggcaaacccgacagcaggcaagacggcaccagctgttgccaagccatcgcctaaccatttccagctggtattcaaaacatgggcaaggtcggtaacgaagccgccgccaaatgctaaagccaagccaactggaatcatccgtgacagtgcccacggaagcgcgccagcgaggaagtaacgttcgatacctttgtagttattttgatcaaccatcttgtcaatccgatgagcaaagaaagtgttcgagaatcgagcaagaatatcagtttgaatcatgatacttgcaacaggaaccgcaatcgcagcaaccgctgcttctggcttcatgccggcgctaacggagaatgccgttgcgagaatggtaccagagttggcatcaattttagatgcaccaccgaatgtgccgaccccaagaaccatcaactatgtggatgcaccgatcaacagaccggctttcatatcgcccataaccaagccggaaattaagccggcgaaaactggtgaactcatggctgaataaatttgcagttcatcaagaatttgatagcctgcatataatgttaaaagtgctatttgccaccatgcaatcatgtttgactccccctatccttttttgagcagggacatgaagtccgctgctgtgtcgcctggaaccatttgcgctgtgagatgaaccccttttgcatcaagttctttaaatgtgtcaacgtcagcgtccaccacgttgatggacttcgtgattgaacgggtttcatcagtttgagacatattaccaacgttcaagtcggtgatcggaacacctgcattcaccaatgcgaggaatgtctccggccgctttgccacaatgaaaaccttttgtgaatcatatttgtgattcaaaatgtggtttgctgctgtggcaacatcgagaacagacaggcgaataccatctggggttgccatccgtaatccgctcttgtcgatatcactctttgatgcggcctcgtccacgaccataatccgcgttgcgccgagcttagtagtccagagattggcaacttggccatggaccaagcgaccatcaatacgtgctgcaataatagccatttttattcctcctctgtgttcagttccttaaatattgggtggtcaaccaagtttatcgcctcggcatattggccttcggtttcaaaaacaatgacctcattgtgcccggtgtgaagcaacccggctggcacatatagtgacaacgttggccccttctcccagaatctgccgatgttaacaccattgaccagcatcactcctttatcaaatccacgacaatcaagatacgtatcttgtggtttcaccacatcaaacccatattgataaaaagcgggtgtccctgcctgccaatcgccggtgaaatcaagttgcggcgccttgttcaagtcaagtgggtattgcaggtagtccttaatgaaatggaggtctaccatgacaccggtgcgaatccccttaaactgggtaatcgcttcgatttttgagccatagttgacgcggctcatgttttcgaccaacagatctagttgatggcggccttcaacttctgggagcaggatgtcatcgccgatggcctcttgatactgtgttgctagcgacttgccatcaaagaaggcttgaacgcgatcacgggcatcaatcacgcgcaacttagccggcgtgcctttgtcggtaccactgatcagcgggtttgtccgatacaacgtataaccggtgtattggccaagaaactcctgtgtctgcggataagatgcggctactggctgagctagctgatcaagtactgagaataatgacactttcgccgtcaacggattgtccgcttgcctcatcgctggcttgaccagcggtgtggtctgggcctgcgatggcaagacttcgtggatcattttctgaatggcaaagtactttggcgttggattgccttgctcattcaatggtgcatcgtaatcgtaggaagtcacttgtggcagatcatgatctttgcgagctgaggtaccgttcataaagccaaaattagttcccccgtggaacatgtagagattgacactgccgcgttggatcaccgctcgcaagtcctcggcagtttcttctgggtcgcggcgaatgatcggttcgccccagcggttgaaccagccgtcccagaattccatacacatcaacggccaatcatgtccatgagcttgattgaaggccgccaaccgatcgaaattcatgtcggcacgtgagccaaaattgccggtagtcaaaataccagcgtcggccatgctgccagcgttcaaggttgctggccacggaccatccgaggtaaacagggggacatcaacgccatgctttttcataagttcggccacagcggcaagatagtccttgtcttcgccatatgaaccgtactcattttccacttgcatcatgatgacattgccaccatgcgtgacttgatgacccacaagatgaggcattaaagctgtgtagtaacggtcaatcgcttgcagataggcaggatcgtcggttcgcaagcgcatctttttcgttaacagccatgctggaaacccgccgaactcccattctgcgcagatgtaaggggatggtcgaacgatggcatataagccaagatcctttgcggtgtttagaaagcgttcaatgtcgagaatcccgctgaaatcaaagtcaccttcgttgtactcgtgcagattccaagggacataggtttctaccgtgttaaatcccagtgccttcaagttataaaggctgtgataccaatcactgggatggactcggaagtaatgaatcgcgccagacagaatcttgaacggctgaccgtccaacataaactcatgatcgatcgaaaaggtcgtcatgcagcgctggcctcctttcattcataacagcttatgctgccatatttaagtgtcacacactgataccttatttcacaaggttttgtgtcaggaaagctttcatgcctcagcttgatagcctaatttcccatcaagataggtggcttcgagcttgagatcagcgtccaaaactaaataatcagcagctcggccaggtaaaatactgccgcattgatcgtcgatattgcaagaagcagccggtgtttgagaagccattcgaataattgcttctggtgttgcggcgttccaagcaaggagattggtcagcgcatctttcaattcaagaactgaacccgccagactgtcgccatctttcatccgcgccatcccgtctttgacataaactgggaattcgccaaggacgtaatcgccatcaggcatcatccccgcgcgcatgcaatcggtaatcaatgcgatatgttcagcgcctttcagtcgaatcaaggtggtggccacttcaggacggacatgatgaccatcacagataagctcatcatcaaccccttgcagatacatcgctgctccgaccataccaggttcgcgatggctcaacgggctcataccattgaaagtgtgtgtgaagacagttgcaccggcttcgatacaagctttagcctgctcaaaggtggcatcactatggcccaaagccaccaccgtgccgtctgcggtggcataccgagtgaagtcagcagcaccctcacgttctggggcaatcgcaattttcttcaacaagccatcagcggacgtctgccaagcatcgtattcttgctcacttggatttttgaagtacttcggattctgtgcccctttatgcttggtcgtaaagtatgggccttcaaaataaatgccttgaatcttcgcaccgctttcatcgccagcatgtgcggcaatcgttttgcaaacctcattgagttgatcaaatgaaccggtcaatgtggttggcagccaactggtgacaccagctttgagcaagtttttgctcattgtctcaatgccatcccaatcgttgtccattacgtcatgccctaacaacccgtgaatatgggtatcgactaaacccggagcaatcaatttgccggattgttcaacaatatcgccatctggcttagctgtttccggcagatactcgccaaacttgccatcatcggtgacttctagataaccaccaatttcagtcacatttttgagaaaaaactttgcagcgtgaatgtagtaactcatgaactcttttgcctcctctaaacttgctcgttgatgctgcttggtgccagttcacgctctattctttaccagcgtaatcgtgcaaggtcacgcctttaacaactcggttaacggtgccggttggtgatggtgtgtcaggcaagttgccaactttgatcgaagcaagcaatgctacagtctgggcgaacatgacatctgggagagcctgataagcttctggaagatctttaaggccattttcaaaatagaaggcatcgcctgagaagttctgatcctgcttggtgcccactgccatcacggatttagcaataccgtcacccttaacttcttcaaggacatcgatatcatattgacgggtgtaggcattgttgctaacgaggtcgaacaacaaagtcttgtcatctaggaaactctttggaccgtgacggaagcccatggaagtgtcaaacatggtggcatacttgccggctgttagttcaagcaccttcaggcgagtttcgcgagtcaagccgccaagactgccagagccaagatagacgatacgatcaaaatcaaggtcaagcactttttgaacttcggcttcacgcgccacaacttcttgtcccattgccgcaatggctttcacccacttgctcttatccgtgtcactggcggtatcaaataccagcaaggcactcaaggtcatgcaagagaaacttcctgtcatggcaaagcctttatcatttgaaccagctggctgtaacagcaacaaagtcttgtcttccgtttcagacttcttggccaattggccttccggtgcgcaggtaatgctgatttgatggaggttgtgaacaacttgttcagccagttcaacagttttcaaactttccggtgagttgccgctacgagcaaaggaaaccagaatggtcggcgtgtctgcttccagaaaatcgtaaggtgcggacacaatatcagttgacccaattgattcaaattcgaacttgctgcgatcaccatgcgcgcgtaggtatggcgtcaccgtgtcaccaacatattgtgaactaccggcacctgtgaaaataacgcgaacggttttgccattagctgcggccgtcacctgatccaaaaaggccgtgatcttttccttggcgttggtatagttatcaaatgcttcttgccatagttctggctgctgtttgatttcagcagttgtaatttgtgcacctaacttggttagttcttcagttgttttttcgaacaatattcttcatcctcctattggaaacctgcttgccagcccctaagccggactggcttatgctttattatctagtgattaacgtgatgtacgtgataaacaaattgatccgcgcgagccacactcaaggtgtattcaacaatctcgccggtatcggcaaaagttgttcgccgaatgttcaaacaggctgacgctggtgcaactcgaagttgttcagcatcttccggcgtgactaatccagcaaaaaacgcttcatcgactgaaacaatgtgaatgccataatgaccttccagccaatcgtataatggcgtttttgatagtgcttcctgattaagacctggcacagtgttagcaggtaagtaactgcgctcaatcatcatcggtaacgtgtcagcgattcgtaatcgatcaaggacgtaaacgggcgtgcctggttcgatgcgcatgcgcttggcaattttggcgggtgccgcaattttttctaaacgctggatcctagtcactggtttacggttcattgccaacatctgtttagtgaaactgtaggacccactgacatcggttcgctcatcaaatcgttctgcaacaaatgtacctttaccagtgcttcgataaatgaaaccgcgcaagaacaattcgttcaaggcagcacgaactgtgttgcgactgacctgatacaactcgctgagatcccgctcggacggcagcttatcgttgggctgaagtttttccttaatgaacgtttccagctgatctaccagctgtttcgtcaacggaaccttttccatcatctcacctccacgtggtaccaaccacttgtagtgtatgcgttcccagttcgtgaagtcaatacatgcgacttatttttatttttaacgacttacaggttctcaaaatgacaacatgtaccaattttcgttaaaaaaagaaattgaaatcatgaattaagcgataacagacatttccataattagaccaaatcaggaaaataattatttcgataagaaagcgttctcattacgttctaattttttgtttaacagccatttaatcacaccagtaacaaaaaaatccctcgatggtctaaaaacctgtcgagggataacttttgtctttatgaatatgttggccacctgatgatccgcaaccttatgcgtctacccctggagtagaagtgacgattgccaatttgccagtgaatgcccaagtcttgatctggttgggaatcaagaaactatcgcctgttttgatcgggtaatccttcccgtctgcggaaaaggtcccgtcaccgtcaagtactgttacattggtataagatgcttgttgggtgaacgtcatggtgccatcaacatcaaggcgacaaacggcaaaatgcggtgacagcggcggtttaacaaacgtggtgatttgcccgcctgtcacttgttctttggtgatatcaagcttcgggtcatggaaaggaacggtcgtcacatcaaggctttgcttaatatgcaactcacgcttgtgaccttgatcatctttccgatcgtagtcgtaaagccgataagtcgtatcggaactttgttgggtttccaatgccacgatgcctttgtttaaagcatgtatcgtgccgcttggaacatacacaaagtcgccagtcttgactggatatttccgcaacaagtgctcccaatcgccggcttcgatcatttctttgagctgttcatgcgttttggcgtgatgcccatagatcaaataagcccctggatcagccttcaggatgtaccagcattcagtcttaccgagttcgccttttgcttcgtgggccgcagcataagcatcgtcagggtgaacctgaacacttaaactagcttcagcatcgagaatcttcacgagcaacgggaactcctgactatgttgtggaccaaaataagcgggatcttcatgccacgcctcgcgaagggttttacctttcaatggaccgttttcaatggtcgccgggccatgcggatgacctgagatgatccaagcctcaccgattttaccgtctggaatgtcaaagccgtactcagtttcgagtttgcggccgccccatatcttaggattgaagtatggttttaaaaataatggttctgtcaaaatgcccactccttttttaaacaagcgcttcagatcagaaatccgcatgttaaacctctgaaccccatgatgaacaccccatcatctcattcatgtccgctaatacgccgttttctaaccaatttgcctttgcgctgctttttcgtcgttttcaagttcattatacagtacctgtctagaccgctgacctttattttgtaaacttgcggctcaattaaactaaataacaagacggaaccttactagccgattattttgcgggtgaatgctggcgaggtagttgtcaaaacagccaaaatcatctcaatgacatcacaatttcatcaaatccttgcgtgacactatgaaatggtgttggcgcacaacaccataacggcccgttgcgcaaaagatgcgtagcgggccgtattttcggttattgtcaggaattagacggccatgcgatgttgccgccaaaagaaaacaatgctaatgacacccaaaatcgtggcaagcccagctagcatcaatccccacccggaagcttctgccgtttttggtaagtaccggtctggattcacaattgtttttgttggaacttgctgctgccttggatcgggttgcggccccggcttcagaaccaacgcagcgatggcagctgtgatcttggcagccatggtatcaacttgggcttgctgggtgatgttgagattacgattaacagcagcaagcgccgcatcaacggcactaaggtcttgatagtgtgaccggtcaagtttctttgcagctgcaatggcggcatcaacctttgtgtaatcggctggccgcagttgcagtgccttgatggcgacagtaatggtctgggcatagccgtcaaccaatgcctgatcggttgcctttttaccgcggacaacagcatttaacgctgcatcaagtttagcaactgatgcttcggtgtactgattaagttgccgcggcacggcagcgatagcggcatcaactttactgtaatcggctgggcgaactaagtaaggtgcataggctgtcgaaaattgatccatcaacttcaacagcgccggcatgtctaactgtgcactcggatcatccgcccaaactgcctgcatactgccaataatcggcacggcactcgaagcgccgggtacatcagtaaattttttacttgctaaactagctagcgccgttttgtaactatagagatcgccgtccacgcgacctaaaacccaataccaaccgtcattggtattcatgattttcaaacccttatcggtcaaaaattctggctttgcgacatcatacccgccccagccagctgtccaataagagacgatcaaatccttgtcaaaagtcccgaaactggtgttattgtcataataaatcccgtcattgaaaaccatcggcttcaggccggcatttttggccatcgccgctaagtcgttgacgtatgccacaaactttttgtaggtgccactttgttgcaacttggcccatccgccagtatcgacatcatttgcatactcgtcactgccaaagttgaaggtcgtagcatgacccttgaaatacatcacatacttctgcaatagcgcttttgtgaaggcaatagcagtgtcattgttaagatcgacagtccgtttagacccattaaaggcaggattcttaatgcctagttgcgccatcgccgtcaaaatggcatccatatggccgggactattgataaccggaatgatattgatatcccgtgccgctgcatatttcaagaccgcatccatgtcggtttgcgtcaacgcattcccgtttggatcatcgtagtacgctttgttaccagcctgtatggcctgtttcacgacatcactgccatatgttttgccattgatcgtcacgctcatgtcatcaagtagcaatcgcaatgcatcgttgcccaataaaacctgcacatcggtgtaaccgtctgtatgtgcccgatcaatgatcgttttcaactgatccgcggaaaaatactttcgtcccgcatcaatcgaaaaaacgcttttcaaggtgttatcagcagcaactacctgcttgggcggctgactcagactcaacaccatacccagcagtccaacaatcgccaataaccaaaatcgaaacccgtgcttcttcaaaacttcaacctccttttgtggatggtttctgcaacaagattggcctattccaccaacaagttaagaatatgctggaatcgctttcaattcaaaatgattttcatatctcacacgttattctcatatttcgttaatattattgtgtgtttgcttttaaatggttaccccctcgctttaaaggatctagatggtcttgttggtatgtaaaaagagccatcccaaatggaatgactcttttcagcatgcgactagcagcttatttcttagttgttcgccgagtggttttgggcgccgcttttttggtcgtccgcttcgttatcttggctgctggcttcttagctgccgctggcttggtcgctgatgttttcgccgctgtcgttgttttcttggttgttttgcgcgtcgttgttcgcttcgttgccgtccggcgcgtggtctttttggctggtgttttttgcttattagctggcaccggttttgcggtttctttgggcttcgccatttcttcttgaatatggtcaagtttctcatgaacggaagcggtcatttgcttattgagcgtctcaaagcctgtgagataatccgctgccgttgcaatttcatcgattctcaaacccgacacgttcacaaatggtgatgccaccactaaatagacccgaaccggcacaatctcgtctgcctcaagaaagttcgtgactttattgacattcgcaaacggcagattgatgatgccagtttcaactgtgatgatggtcggctcaggaaaatcgatgacgaggtcggcctgaatcagttgctgcttgtcgatggccttgcggacgtctgcaaacaccttcgtcaagcccacctcgatgccgtcctttttgaacgctgcagcagtcagatgattctcggtatgctcgaagctgccatctaaaatggcttcctgaaacttgtgtacattgatttccatatcagtctccttaaaagcttagaactgctcagaccatcatagcccaccacagcaagcagacgcaaactaaaaaagaccatcaaggcaagcaacgctcgccttctagtcttttttaaataaagttatttattttcttttaaaatagtttcagtctgcttttgcaaattgttaaacgctgtttcgccgctgacattcttggtcagcgtgctgtcgacagtgctcatcaaatcgttacgataatcggtgtaaccggtaaagacagttgaggcaaaactctgtgaaactgcagagaccgctgctttatacttgtcgttcttttgtagataattcttaaatgtcgtgctgttagatgccgtttttgtcaccggcacatagccagaatccatcgcccactgtgatgcattttcagacttcagcaagaatttctggaacgcccaagcgcctgcttgttgcgctttagaggcccctttaaacaaaacattgtaatttccgttcagtggattgctgcgtttgccttcgtatgtcggaatcacagcagtaccccagtcaagatcctttggggcctgttggataagaaccggcacggttgccgaagaaccaatcccaaagaccgcttttccatttgcaaatggcacactgaagtattgatcttcgccagcagttttcaacgcaccgctcttgcgcagatccagaatttgattcacagctgccaatgtcttcggtgcattcaaattagccttcagtttcggtgtaattagttgactgccagcaccatatgccatcccctcaagcgcaacatcataactttgatctaactcaatcgcgttgacatcagttcccttgagtttctcctgatcggctgcaaaatcagcccatgttttcggtatgctgatattgtactgggacatcaacttcttgttataaaacaacaccgaagtcgagactgagaatggcaatccgtagtacttgccctcatatttacctgcagacaaaaagcttggataaatatcttttaaatcagcattgctcaacttatccgcgccatttaacatttctggatcaaatggcaataacaacttgttcttcacgtagtcgccaatgttcgtatacggtgactgcgccatggtcggcaacgtttttgatttgccggctgccataattttctgttgcaacgcgttgtatgatccctgcgaagttgcgacaattttatacttcttttggctctggttgaacttggtgatgagcttgttcaacgatttatcataagtccccgtcatccgatgccagtaggtgattttcactggcgcacttgaagacgatttcgtagccgtcccctgcttgccacaggctgtcagtaacaacaaaacagcacccattaagcctaatagccgccaaaaactagtctttttcatttctatgtccctcattcagtgtcgcggcttaccgatcgacagtgtttgcaagccgccgtatttgtcatgtcttgacacccttattatgcctcttatatttataaaagcaaagaaacacccggtatttttacttttcaaaagttacgctaaaattgccgtgccaaactccgcaatctccggccggatgaggcttgcgacgcggagctagagcgtgacggcgcatgaccctgactcaccagtcttccccatagagaatgtatgttctatactaataactaaccatgacaagcaagggggcgcagtgatggcaaacaatcgcattggtattcgtgagttcgttgagttaaccgttcgcaccggcgacctcaatccaatcaccagcaattcaaataacaccgccatcattggtagccaaattcatcgtaaacttcaagctgctcaccgtgagtccgattacgaaaaggaagtttacctcaaaaccgccgtcaccgtgaacgatgaagactatcagctcgaaggccgagcggatggtgtctggacagatgacaccggactcacagttgaggaaatcaaaaccagtgcgcgcccatgggaagaggccacacaaaatacaaaagaccgctattgggcgcaagcacgtatttatggccatctactttgtgaacaacggcatttggatcaagcaacaatcacgctggtttatgtccagaccagcaccgacacagtcagccgtttcagtgaaatcaaaagtgccgccgagttggctgatgatttcactgatttacttgaagaatttcgtgactggctcaaactacgtagtgatatcatcaaacgacgcaacacctccatcgaccagcttaattttccatttccgcaattccgagctggccaacatgagctagccgccgctgtttataaggcgatctacagccaagcacgtttgtttgtacaagctcccaccggcactggtaaaaccatctctgcacttttcccaaccttaaaagcgatgggcacgggcttgatccaacgagccttttacctaactgccaagcaaagcactcgacgcgtggctgaacaggcgatggccttgatggcgcaagcaggtttaaccgctaaaagtatcactttaacggctaaagacaccatcacatttgctgacgaacctgatgaccccagcaagaatccttacatgttaggttactatgatcgcctaaaaccggccttacacgatctactggaacacgaggatcaactgacgcgtcccgtcatcgagacttatgctcgcaaacataggctcgatccatttgaattttcactggatgccagcctattttgcgacgtcatcatctgtgattacaattatctctttgatccgctggtttttttgcaacgcttttttagcgaaaaagatgacagcaatttcttcctgatcgatgaagcgcacaacttagtcagtcgcgcgcgggacatgtacagcgctgccatcacagatcaagatttcgtccagttaaaaaaagcgctaaccccttataaaggtgccccgttgacaaaagttcgccgcgccatgacacgtattttgaatacccttgatgcaacgacttcaaccttgttgacctcacaaccgaccatctttcaagatgatccgcttgatgacctcaccgcagttctttttcgcttcactgaagtcgttcacgattggctcagcgaaccgccaacccccgcgttgcaacctgctgtcgatctcgttttgccggtattttttctagccaatcaatatctgcgaattggcgacttctatgacgcgacattcaaaaccgaagtcactaaagaaaacggccagattatggttaaagaactgtgtctcgatccatcgcaatttgtggacgaagccttgaaaaaagggcgtggtgccgtcttattttcggcgaccttatcaccgatggcatattttcaaaagttgcttggcgggatcgacaacagtctcgcctatacgctgccctccccatttgatcccgccaaacaagcagttattgttgacgctagtgtcaatacgacttatcgacgacgcacgcaggatttgccgcagttgattgcgagcctgacaacattagttcgcaccaaaagcggcaactatctcttcttttttccatcctatgcctacttgaaaacggcctatgaagccttcactgcggcgaatcccgatctaagggtttgcgcccaagaaaatgccatgactgaagcggatcggcaaacatttctagattattttcaaactggcagtgagccgattatcgggtttgccgtgcttggcgggatctttgctgaaggcattgatctcaagggaagtcgactgattggcgttgcaattatctccgtggggttgccaggtatcaatgctgaaaccgatcaactgcgggcctattttgatcgggcaaacggtcaaggattcgcatatgcctatcagctgccgggtttcaataacgtgttacaagcaggtggccgcgtcatccgcggtaccaaggacgtcggagtcattctgctgattgacgaacggtttattaccccacgttatgcccgcctttttccagatcactggacccacgcccaagtcagctacaacccaacgcaattagctcaactcttgacgcatttctgggaggcccatcatgaaaacacagctcacgcttgatttagaaaaaacgctttatgcctactggcaagaacaaggggccaccgtggttgaagaagtgacgatgccagacgatcgcggaattgtcgataccctggttcgccaaaagcagcaagacgcgaccatttggcgttgttttgagctcaaagtcaccaaagccgacttccatagtagcgccaaactcagctttatcggtcattacaactactttgtcttgccacaacgactgtacacggcggtggctagtgaaattccacatgggattggtgtttttacctaccatcccttctctaaagccgcaatcgccgccagcgctgttcctgtggtaacacccggtactttgacgatcgccaaaccagctcgccgtcaagaactgcaagtccctgaagccactttgaccgaccatttcatcgccagcctcaatcgcgaagtagtcaaggccaaacaagttgccaagggccttggccaattctcagcagccgatctatttactgaactgaaaaaacgctcagccgattacgatatttatcaccctgacaagaatctttatgatcaatttgtttcggagctcgacaataccacgatcaatgccttacaagaagagattgacgcgttgaatgctgaactcgctaccgtcaaaatggacatctcaaaatgaactattttccgattattcgtggcaaattatacgacttggccgcagtgacgcagctggttgccgaccaccaattgcccaacactgtaacgcctatcatcgaaccggttaaagatatcgcgggcgtcacgaaagcaacgagcgcaatggcccatgcagcacatcccggctatgtgattcaaaatccgcaagttggcaactatcagttgttagcggcaccgcgccatcttgctgttttgagtcataccgtgcaacccgctcggatttttgatgcacagccagctgccttggtgatcgcaacaacagctgcccaagcgaaactcctgccaaagcgccaattagccctagtgccggacgaggcacgagttcgccaattggccttaccacatgccgtctatctcaatgaccatttcaccgtttatccacacacggatgattatggcatcttgcaagacgaattctatcaatacgcgccaccatcgctgcctggtattggcttcgccgactacccgctcgcgactagcgcttatttcgagcatggttatccgcaacgtgccgtcgcgatccatcttgtttaccccgccgaagatggcacgttacgattacatcattttgtgtcggtcaataatgatgattttgctaatccgcaagctaagtttttcgaagtcttggcccaactcgcagcttggctgccgtttcatctcgatgcccaaacaactgggactgccgccttcatggatgcggccaatcgccatcattttcctggccttggtgtagttcgtaaatatcagcttatgcatcatctcgaacttatcgggcgctggttacaaacatcaactcaacgttaacgaaaaatcgattgtcgcaaagctggcaatcgattttttgctagcgtttttacaatatttttgaaagcgtttcttaataaatatttcacaattttagccgtggacaatctagtcatagacaaccaattatgttacactttctttgtgaaaaggttatcaatttgtgaaggagtgtttaactaatgaaaattcttgttattggtgcgacccatgccggtacattcgcgacacagcaaatcctgacagagcatcctgattatgacgtcaccgtgtacgaacgtaatcataatctgtcatttctatcatgcggcatcgctttgtgggttggtgatcatgtcagtgaccccgaaaaaatgttttattccagtcctgaagcattggctgcgctgggtgctaacatgcaaatggagcatgacgttttggcgattgatcctgtagcgaaaacggttgaagtcaaggatctcaaaaccggcaacgtgaccactgatacatatgacaaattggtttacacaactggttcgacgccgatcgtcccaaacattccgggcattcacgacacggatgttcatctttgcaaaaattggcatgatgccaaggctttaaaggcgcttgctccgaccattaaaagtgcgatcgtaatcggtgccggctatattggcgccgagcttgccgaacagtatgcactaactgacaaacaagttaccttgattgatggcttaccacgtgtgttggcgaaaaactttgacgctaccattacagatagagtagaaaaactttatacggatcatggcgtcaatttagcactgggtgagatggtcaccggtttcacccaaggcactgatggtgagatgaccgtcacaactgacaaaggcagctatacagcagatgtcgctgttttgtgtaccggtttccgaccaaacacggaactgctgaaagaccatttggagaccttgccaaatggtgccgtgatcaccgacgcctatatgcaaactagcgatcctgctatttttgcagccggcgacactgctaccgtgcattacaacccgactggcaaaaatgactacattccgttagcaaccaatgccgtccgtcaaggtattttagtcggcaaaaatattgaaaaaccaaccgaaaagtatctcggtacccaatcaagctcagcggttgaacttttcgaacacgccattgctgcttctggcatgaccactgaaggagccaaagcccgtggcattgaggttgccagcgtgaccattgagcaggattaccgacctgattttatgctgaccaccacgccggttctttgcagcttgacttgggatcctaaaacgcacgaagtcaaaggcggggccttcttttccaagcatgacatcagccaaagtgccaatgtcatctccttagcgattcaaacgcacatgacgatcgaaacattggccatggtcgacatgctcttccagccaaactttgaccagccgatcaactgggtcaacgccgtcgccatggcagccgttgccaaagctcaagagatggaaaaaacaccggtagcttaatccattcgaattgcaaacgattatctaagagcaacaatttcttcttggaatttatgatttgttaggttccgaataacccgggaaaaagcgcaagggcaaaaaagttctttgtcgtggcccactcataaatcccggtcattacccgataaaaaccaaaaagcgaatgatttcccctgtataaggagaggaggtcattcgtttttgcttgacgtctgaaaatttttccctgacttttccaatgcacgggttacccagtcactttcgcgtctgatcaagcgcatgaaactatttgcccacgaaaattgagcttgaagcagccaaacaaaatagccttgaaactgccggccaacaagtgctatctgagccgcgatcacgattcagaaattggtgatttttttcgactttaatcactgaatgtggctaaagttgtttttaatcttgagtattttttaatcctaccgttaatgtctattttcaaacttattaatcaacagcaaaaaataaacgttgcaaaatcgtcttttttcgtcgcattttgaaacttatggctaaataagccacgaaaagcccgaataacgcaacgttaatttctctgctgcctataaatcgcctaatacttgtatattatgtacagggtcgctagcacctagatagttttgtctcagatctacggcaattaacgggaaggagaggaaagagaaatcatttttgaccccttcaaccgtgacatactaagcacactttttcatatgtgttcttgtactatcccaaacgaaggggtgacactacatggcaattgccgatgctacctcagcaatggtttccgcactgctgggcattatggacaatcgccgtggttgtagtaagccgaaacattcaaaaaatactaggagctgaaacttatgttggaaaataacttagtgcttaaaaacttttcgtgcatcgatgattcagaattagcagaaagtcaaggcggcatcggtgttgtcgctaccggcgtcatcattggaagcctcactgtatttctgtccggtgtcttctctggctttacggatggcatgacgcaagaaaagaaacctgcaactgtataaataagtggtgaacgtgccaaagcaattcgtacttcgcgttctcgcaaagaagctccctttggccattattgcccgtcttttgatcttgatgctttggcagtttggcacgggggtcttgcaaacttaatttcatgtgggttatcaaaaaggtagctctatagctagttgtttgaaatagacacgataaatggaggaagccacaatgaatcaaaaagctttgaatcaatttcctgaacttacctacacagaacaagtgtcggttgttggcgacgatttgtcagtcgaggtcatcatgaaaggtatcttcaccggtatctttgatgctgggtaccaagtgggtcagtcaatcgcaaaatgggttaagtaatcattgagctaaagttacaaaagcttgcatgatgctcaccagaccaaaacgcagtgcacacttattgagtgcactgtttgtgcttttcagctttctatttgtcctcagttatcccccactccaaaaaagctgacacatctaaaggtatctcacttgcttagagagatgtcgttcaataccgtttaaaaataaacgtagcaaaatccgcttttttcgtcgttatttggctttttggacactgctagcgacgaaaaagcagcaattatcaacgttaaaatttaaagcaacaaaaaagcggccgcccatcgtatattgtctataggatagctaccaagcctgcaagtctatctagggaccaaatattcaaacagcagatcaatctaaggaagtgccgaaaaagctcggcaacaatttatagctttacataccaacagcttggacaaaatcgctagtggaccggacattttctgtcattgatctcgactcaaccacatgatgttgcgttactggagatctcacaaaattggggacagaccttagccaagaacatttcgccatccattgcaaaatacatctttaaatcccctacaaagactgctccatctgaactgatcaaaagtccggactatgatgattaggatagctatcaatcgttgaatcgtactggatatcccgtgaatgcaggatattttttgccccagaatgaaaaaaagcaaaaaaaggaacaccctctcgcgagaatgttccaatttaattttagccattagttatccttatagtgaaggacgaacagcaaaatcaggcatgaagtaagctaatgccgtatacttcacattttcacctggttgtggtgcctgaatcattgtaccgccaccaatgtagagcgctacgtggtaagagctaccatgtccgccccagaagagcaaatcaccaggctgaagtgcactcagtgagacttgctgaccagaagattcttgtggcactgtccaaccaccgatgttaacaccggcgccgttcaaaaaggcataatacatcaagcctgagcagtcaaagctgttaggacccttgccaccccatacataaggtttcccaatttgctgttcagcaattgagataaccgcctgaatttttgcctgacgtgacggcgtaacaggagctggagctggggttggtgcaggcgtcggcgttggtgcaggcgtcgcgttatttgtcgtttcctcggcattgaccgtaatgcttggttctgcctgctgttgctgttcctgagttgcatcaacctgtgtcgttgcaggcgcagcactggactcaggcgtcgtagtctgcacagctgcagcgctagaatcagcagcagccttagatgcagcagcactggattctgcagcagcactggattctgcagcagtactggattctgcggcagcactcgctacagcagcagacgatgcagcagcgctagaggcatttgcaaccgaagcagcagcttctgaagcgacagccaatgaagctgcagcactggacgctgcggcactggaggcagcagcatccgaagcagctgcgttcgaagccgttgcatcagacacaggcacagtcggtgccgcaacactcgttgcagcagatgactgcggtgctggtgcaggtgttgtgctagcaaaacgttctggcacgtaaccgccatttgctaaccgataccatgtttcgccattggcttgcaactgggcaaccgccgtcaacgtctggttgccttccagatactggccagttgcctgactgtacgctggtgttgcccaaactgtgactgcagaaccaatgtttttaacatataactgaatgtttgctgtctgggtatcaggctgtgcggctgcttgactcgcaggtgcctgacttgcaggtgcttggctagcgggcgcttggctaaccggtgcctgactggcagtttgttctggtgcttgaacggtgacagtcttgccgtcaaaattcaaataaatgccagggatccactgattgtcgccgactttataccaagtagcaccgtttcggtcaactttttgacctagaacttgtactttgtcaccaaaagtcacatagcgttttacttgatgccatgatggactattccatacggtggtcgcacccgatttgtaattgactgtccccgttgaagcggaaacagtattagcgccggtagctaaagttgccaaaccggcagcaccaacgaatcctgccgtaactgacaatactttctttgcatctaccatgtatgtactcctccaatccaaaactgaattttttcaaaaattgcgttttacttgcgtttaccatttcttaagaaaccatatacagaataacacgtttcctactggtacgcacattaaaaaaatatttcaactgtaaaattcacggcgccaaagccttggtataactagattttatgcgttatctaacgatcaggaactgttttggcaacaccgagtgccagaccgatcatgtcattaaagctggtctgacgctcttgggctgaggtttcttcacctgtaaccaagtgatttgaaaccgtgaggatcgataacgcgtgcacatggtacttagccgcaagtagataaagtgccggcgtttccatctcagtcgccagcacttcataatcaatgagtttttgacgatccatctcatcgttataaaagcgatcctcgccaagcacgttaccaacatgatagcgaattgcactagtatctgccaagtttgccgcctcacgaagaaggttgaagtcggctagtggggcaaaataaagcccggcgccaaacgtattcaagataatgctgctatcagtcgaagatccttgggccagcacaacatcgcgaactttgacattttcgcccatgccgccagctgtgccaacgcgaatgagcgttttaaccccatagtcttgaatcaattcattaacataaattgagatcgaaggaatgcccatcccggtcgcttgaaccgacacgcgccggccttcaaacgtgccggtgaatccaaatgcattccgcaccgtgttgtaacgttgggcattgtccagaaagttttccgcgatgtactgtgctcgcaatggatcacctggcaataagacgacgtcggcaatggctccttttggggcatcaatatgtgtgctcatgacaatgattctccttcaaaatgtgggtttatttaagtagctttaagaacgactggccaacttgattacctgtgacaccaaaattatctaaaatcgtggcaccaagatctgaaaatggcgaacgaatacctaaatcgccattacccggcaattgcttgctgtaggctagcaacggaacatactcgcgggtgtggtctgttccgcggaaggttgggtcatttccgtggtccgccgtgatcatcaatagatcctgatgccgtagcactgtcattaagtcgcccaattgtcgatcgaaagtcatcaaagcatccccgtcgccttgcgcgttacggcgatggccatacatcgcatcaaaatccactaaattggtgaaaacaaatccgcggcggtccgatttgactgcttcaattgttttttccatgccatcaacattactagtggtatgaacaccgtcatctagcccttggccagagaaaatatcgttaatttttccaatgccataagtcgcaatgccagcaccttgaaggcgatcaagatctgtcggcttatctggcttaagtgtgtaatcatgacggtcactggtccgcgtgaacgtagtggggtctgtcccgacatatggccgtgcaatcacccggccaatgcgatatggtgcgtcaattgtgatgctgcgaacgtaacggcaaatgcgataaagttcttcaagtggaatgacatccgtttgcgccgcaatttgaagtaccgaatcacctgaggtatacacgatcagatcgccagttttcagctgttgctcaccatagtccttgatcgcttctgtgccggaataaggtttgttcaaaacaactttacggccggaaaactcctcaatttgtttaatcaactcagccggaaaacctttgggaaaatagcctaaaggttccgtcacaggcaaacccatcatttcccaatgaccatccatactatctttacctgcagaaatttcggccattttgccaaaatagccgctgggactacctaacgccgtcacgccagcaattggtgttggtcgagcaatgttacccaacccaatggcctgcaaatttggcaaagccagtttaccatcaaaataggcaccaatatgaccaagtgtgtcagcgccggtgtcatcatacttagcggcgtcaggtgcttcaccaataccgattgaatccaacacaatcgtgataatgcgatcaaatgccatcttatgcttcgcctgcttccttcaaaatttgaatccctgcactggcaccaagacgatcagcgccagcatcaatcaatgccttagcttcagcataagtgtgaatgccgcccgctgccttaacccctagtttatcgccaactgttttgcgcatcaaagcgacatcgtgcaccgtcgcgccgcctgctgcaaatccagtagatgttttcacataatcggcgcccgccgcagctgctaacttgcaagccgtgactttttcatcatccgtgagcaaaaccgcttcgatgatcacttttagcaaaccacctttagcatgggtcatatcagcaactgcctgaatgtcagcacgaacatgatcgtcatgccctgccttcaattcgccaatattcaggaccatatcgatttcctgagcaccttcgtcaattgcctgtccagtctcgaaaaccttcgtctgggtggtgtttgccccgagaggaaagccgataaccgtgcagacgttcacatccgtgtcgcgcaaactagccgccgcccgaacaacccaatagggattaatacaaactgatgcaaaaccgtactgttttgcttgtgccaatacttcatcaatctgatcctgtgttgcatccggtttcaataaagtatgatcgatgtactttgccaatggttttgccatttttacgcctccgtcataaatagccttctgatcgcagccaaaaagcttatcttatctgcagaagatgaatgcggttaccaaatgacgcattcatcagattgccttaagaataccatggtatggttaatcgtgcatagaaagggttgaatagatcatgagtacgcgtaccgtcaagccaagttgtggcttgcaaatgcgttttggcaaggcagttgattaaagcaaactcgaaggcttcgggacacccgacctatggcgaaacagtcataaaggtgtccttctcgccttcacctaatctcatccattataataaagttaatcaaattgtttcttgaaagtgaggtacttccatgacgaacctgcccccgaatttaacttctaagctccgcactgatattgttcaagcaccttcagcgattaaagcggccagtggcattacgctttttggtaaaaaaattcgcagtatcatctataccatggacgtcgctgtgatcgcgaattgcgatgctgatgcgattctggctgtctatccgtggacacctaatacgcgcattctccaagctgtagcaacggtggctaacgtgccgattctggctggcatcggcggcgggctaaccaagggcttgcgagccgcaaccattggcgcttttgcagaagaaagcggtgcccaggccgttgtgttaaatgcgccaactccgattgaaacgctcatcaatgtcaatcgtgtggtggacgttccaacgatctataccattgtccgtcatatggatgatcttaacgcccgaattgatgccggtgtcgcggcttttaacattgctggtggcaaagaaaccgccaatcttgtggccgaagttcgtgaggccattgacagcaagcacccgaattttccgattattgcttctggcggtaaaaccgatcagcagatcactgccacgatcgaagctggcgctaatgcggtaacttttgcggcctatggcgtgacggaagcaactttccacgccaagatggaggcctatcgaaagcagaaatcgtaaaactcgacctttcataaggcgtctcatcattgttttaactttcttttcaatacgaaaactactcggcgatattaatatttgttagaatagcattgataatgcgccattaaaaaaattgaaaagggagatggcagccatgagcaatctgatgcagagattgctgcccgtgctcgttaacaatagcgttcggttgcgacacacccgcatttatcgcgcgctccaacaaacccttgccgtcattttcccgtttattctggtcggtgcttgggctcaaatgttgacgcagagtgtgttttcacgaaatggcttttttgcagtcatttatcatcttgacaccgtcattccttactataaccagatccgcaccattttgatgtcgatccaaacagtgacactcgatctgatggcggttatggcggcgtttttcgttgccaaatttattgcccgatcttatggcaaagatgattctttggcagccttaacgagtgtcggggcatttatgattcttaatttggattcacgacgcaatggccaatcacctttccaaatgaataattttggttatcgtggtttgtttattgctatctttttcggcttgcttatcggttggctcttccgcttcacacgtgcggacctcgaagaaccaacgcatcggtatacaatcgctgccttggttgaccgtgggctgcgtggcacctggcttactgtcgtgatccttgtgatcagtgtggcgatcaattacagcctcagccgcatctcgacagaaggtttcatcggtcttttctacattccatttcagatacctgcctccagcctcagtcacgtgtcgattcgattggccttggtcaccaccattaatgccctcatgtggtgggctggtattgaaggtccgatcaatccgttaacagtgcaagccggtagcacgaccagcactgccaatctgaattatgcgcttgagcacaacaatttgttcaacgtgcccaacccgatcaccattggcaccatttaccatcccttcgcgagtttcggtggcgttgggatgaccttagccctcatcattgcgacactttgggttgccaaaacccggccattacgccgaatagctggcatgtcgcttttgccgagcttggtcaatatcagctcaccgatcatgattggctggccagtcatgttaaaccctattttacttgtgccgttcttgattgcaccgctagtcaatatgacgattgcatgggcagctatccgcttgcgtcttatgccaccgtcagtttatacgattccaacgacaacgcccggaccgttggcagccttcctaggcaccaatggtaattgggtatcgcttatcgtggctatcctctgcttagcaatctcggttcttatctatatcccatttgtgcgactagcagaaacaatcaatcttgaatcagcaaaggtcggtggtcatcatgattaaacactggcgaaaatggctgttattactggtcagtgtcttggcggtaacggctatcatgctccccgctaccagctggatggaacaaaacgttaaatctgctcgcgttgttcacaactcccgtatgcaaccgattattttgattcctgggagttcagcaacagaagatcggttcaacaccttgatcacccagctaaacgcccaaacaacgggccatagtttgctgaaaattacggtcaaaacgaatggtacactaacttacagtggcaaaatcgcagcacgtgataccgagccgtacatcgttgtcgcattcgaaaacaataaagatggttataacaacatcaagaaacaggcggcgtggttcaacattgcctttaagcaattggcgaaaacctataatttcaatcgttttcgtggtattggtcacagtaatggcggcttgatcttcaccctttttctcgaaaagtattacagcgattctgatgtgcggatgacacgactcatgaccattggaacgccgtacaaccttgaagaaagcaatcctgacaatcgaacacaaatgctgaacgatctcattactagccgcaacaagttgcctagcagcttgactgtctactcaattgctggtaccgaaaatctggacggcgatggcaccgtcccaatcgaaagtgtggaagctggtaaatatattttccaaaaccaggtcgcgcactacacccagatcaccgtttccggcgacgaagcgggtcacagctcactaccgcaaaatcgacagattgtgaacttgatcagtcaatacatggtcgctacaccgaaccaacagggcattcggccagggcaaggcggtagtggtcgaggcgtcggacaagcaccaggcgataccggacagaatccttaaacgatcgtaagacaaaagggccgtccaacctcacttaactgatacagacaaaaaataaacagacactgacgcatctgtcagtgcctgtttatttgtctttgtaccgatcctttgtcaccaataacaacaaaaagccaagccctaaatattgtggcttggctttttgacgcttgttaactgttcacttatctaaggcacttgcatccccagataagttgcctgcacagccggatcggcaagcagctcttcgcctgtcccggtcagcttgaccgtgccgctggccaaaacgtaaccgcgatcggcgatggccaacgcttggcgtgcattttgctcaatcagcaacactgttgttccctgcgcgttgattttcgtgataatgtcaaaaatctcttgaatgaaaatcggcgccaagcccatcgaaggctcatcgagtaacagcaatttgggctttgccatcaaagctcgccccatggctaacatctgctgttcaccaccggaaagtgttgcggcatcttgatgttgccgctccttcaacaccggaaaacgatcatagaccatcgttatttgttcgccagcagcttgcttatccttcagtccaaacgcacccatttgcaggttttcggctaccgtcaaaccagcaaaaatatgtcgaccttccggcacttgcgagatgccttgcttcacaattttggctgccgccatgccattgattttctgcccttcatagtcaatgataccggaacgtggtcgcaacaaaccggagattgttttcagaatcgtacttttaccagcaccatttgcgccaatcaaggcaacaatctcacctgtttgaacgctaaaactgacgtctttgacagcttgaatgccaccatagttcacaacgagatgtttaacctcaagcatggttttcacctcccagataagcactaatgacctgcgcgttagtttgaatctcattaggggttccagaagcaatcatggcgccatggtcgagtacataaattgactcagccaatttcatcaccagcgacatgtcatgttcaatcaaaaccaccgtgatgccaaaatgctcacgaatccgagtaatcaaacgccccagatctgccgtttcttctggattcatcccggcagctggttcatccagaaacagcagttgcggcttcgtggccactgcccgcactatctccacccgccgttgcgtaccatatggcaaactagcagtcggttcatcggccacatcagcaagctcaaaaaaatctaacaattcgtcggctgcagttgctacggctgcctcctgttgataaaactgcggcaaccgcagcatcgtgccaatgaaactttcacgataaagatgtgtccgggccactaaaacattttctttgaccgtcatggcgccaaacaagcgaatattttgaaaagttcgagcaacaccgagcttcgccacctgataggctttctttttcgtaatatcaactggtccatcagccgtatacaaggtaatcgtgccagacgacggcccagattcgccagtcaacatattgaacaatgttgttttcccagcgccatttggcccgatcaaggcaatcagtgtcccttgttcgatcgtcatcgtgacatccgcgacggcttttaaaccgccaaaaactttactgacgtgatcaattaccaattgttgcgtcatgatgctgctcctttccgaatctggcgcttgcgcttgaacgacaactcataatggcctaataagccagctggtttgaaaaccattagcaaaatgagtgccagcgcatagataaccattcgcaaagtgccaaagttctgcagcactgtatcgatgatgcccaacacaaccgccgcgacaaaagtgccagtgatactaccgaccccgcctaaaacgacgataatcagcaaagcaatcgaattcatgatgccaaaatctccgggagcaatcgtttgcaagtaactcgcatggagtgacccgccaatggctgccgtggcagcgccaagcacgaaagctgccagtttccatttggtcggattgatgccaatcgactcagcggcaatgtcatcatcacgaatggccatcaccgcgcggcccgcccgactgtgaatgaagttcacaacgatcacagtagtgacacacattaagatatagatcgttggccacgaagccaaaggcggaatattaaacataccagcagggccattggtgattttcaaattattaataatgactcggataatttcggcggcgcccatcgtggcaatcgctaaatagtcacctcgcagccgcaacgtggggattccgacaatcaaagcggcaatgatcgcaacgatcatgccgaccagcatagcaaggtaaaacccaagcggcgttgagatgttttgtgtgatgatcgccgtggcataagcgccaatcgccatgaagccagcatgaccaagcgaaaactgaccggaaaatccgataataagattcaaaccgactgccaaaataatgttaatgccgattgtgaccagcgcattttcgataaacccgttaatgacgccggttaattcaccaatgtcgatcaagacaaagccagcaatcatcgtcgcgagccaaatgagcttactgcgcatatttttaaacataggctcacaccttctcccgttgacgtttgccgaataatccagcaggtaacacgaccagcatgatgatcaaaacaaggtaaaccgccgcatctttgtaggccgataagcccacagcctgaacaccagtttctagcaagccaatcaagaagccccctacagccgctcctgggaccgatccgatcccaccgacaaccgcggcgacaaacgctttgattcccggcaccattcccattaatggatcaatcgaattgtaatacaagccgatcatgacacccgctgcaccagccagtgctgatcctaatgcgaaggtgaaggaaatgacgtgatcgggattgatccccaccagttgcgcggcttctggatcaactgccaccgcccgcatcgccttgcccatcgttgtttgcttgataatgaactgcagcatcaccatcagtaccaaggatgtgaacaaaataagcagttgcacatttgaaacatcgacccctagtatctggtaggttttagtggtgatgacctgtggaaagttccgggcattagcaccgaatagaaacgacatgccattttctaggaaaaaggaaacgccaatggcagtgattaacgccgcaattcgcggtgaattccgcaacggacgatacgccaagtattcaatcaagacgcctgagagtgcagccatcaccatcgccgacaacaatgctggaacaaaactgaagtgcaggtaattaatcgcataatcgccccaaaacgcgccgagcatatagatatcaccatgggcaaagttaatcagcttgatgatcccataaaccatggtataacctagcgcgagtaaagcgtaaatactgccaagtgagagtccattaatgatttgttgcatcaaggtttgcaaaatatgatctcctcataaaaagcttccgcagtcatttacttaacggtatagactttggcaattttgccttgtgtcagttgctcaaccgccagcggcttctcaggattatggtgactatcaatggtcgtggtgcctgtcacagcaggcatttgtttgatcttggccaaacccttggcaatgctggctgaatcggcagccttctgatcttcaatcgcttgcttgatcatgtaaaccgaatcataggcaagtgctgagaacgttggtgcttctgtttgatactgcttcttaaagctggtcataaagttcttcaccagcttgctgctgttagcactcagcgtcgaaaatggcgtggtgtaataaatatcagttgcattcgcagcgccggcgatttgcgccaacttaggatcggccatgccatctgcaccaataaacggcaccttgatgcctgactgtcgcgcttgcttgatgacgaggcctaattctgaataatagcccggtgcatagatggcatcaattttcttgcttttgatcgctgtcagcatagcattgaaatctttatcacctgattgataatactgagtcgtcacgatattacctttaaacttcttcttgaatgccttagccaacccggttccgtaatcagtcgagttgtcagcaataatcgccacgtttttggccttcaaggtatcgttggcaaatatcgccgcatggtctccttgaaaatcgttattgaagcaagcacggaaaacgtaaggctgcacgctgccatttttctgaagtgtaaagtttggatccgtagcactgggactcaccattggtacggccgccttggtcacgtttggaatagaggctgttccgtcattggttgtcgccggtccaacgatcgcaaccactttgtcagtattcgccagctgtgcagctactgaagccgcgccgctcgttgacgatttgttgtcacgatagatggccgttatttttttcttagtatttccgaccttaataccacctgcagcgttaatctgtttcacggccaattcaatgccttgtttctgctgttcgccgtaaccagcaaccgcgccagacaactccatgttcacgccgattttaatcgtgttacctgccgtatttcctttgctcgtggcactctttgtcgcacagcctgccaatgccagcatcgaagcggcgatgacgccagcgctcataattgctttgacaatttgcttcttcatcttggttccccctcattatattgcttatgactatatctcattgattcttaacagaaaaaagcacccattcagacgaatgggtgctaatcgtacgccccatcgccaatgcgaaaacggggctcaacacgttgatcttaaacgatcaattcggtcgggtccctggcatcaacaacaaggctaaaagagcgtaatgacagttacgatttgtttttctttgcatacacatcaatgacatcaatacgccctcctagttaagattaatggttggttaaaatcttaatatgattaccaaggaaagtcaacttattttctcagaaatttttattggtaatttgctgaatgtttattttgatgacaatctaacgcctggcaataactttcttagaggaaatgcatgtctaagtcaaccctctattctaataaagttattagagcaaaaagagtttgtctttgtagtcagtctagttaaatcgcaaataaaaaaggacgtccttacccttaaaggcaaaaacgtcctttttctgcagtacccaagttaacttgaataggatctcgctggctccacaaccttgagatcgctgaccccacaaatccggcgggtggcttttaaccagtcagctgcagctttcagcacaagttgcgtgcttactcgactcatcgcataacatgattatatcactttttcggttttaaaacagctcgtttatacaacacttctgataacagctgggccaacataaagccgacagcaatggcaccagcgatcatgaccacccgactgacatactgcaaggccccgtccaggtcgcctaagacagttgctcgtactgcttggtaagcaacagcgcctggcaccaagggtacaaatcccgggatgttgaagatgatgaccggcattttcttatagcgcgcaaaaaagattccacacaagccaatgacaaaagcgccgactaaattggccatcatccggccactaccgacttccatcaacaaccagtaggccaaccagcccatcatcccggcccaaccagccaaatttaacgccttgcgcggcacgttgataatgatagcaaaagcgaccgttgccaaataactgaacaaaagttgaactaataaagcaaaccaccactgcaagatgccgcctcctttatgtttttagaagaaccggaagatcatagcaataccaacaccgatggcacaagcgctcaaaatggcttccatcccgcgggccataccggacagcaaatgtcccgccagcatatcgcgaatcgaattggtaatcgctacccccggtacaagcggcataatcgctccaataataataaagtccaggttgtgtcctaggcctaacctgaccccaagccacgcagttaagccaacgaccaatgcgcccagtaattcactaataaaccgaatgttggtcactgcattcactttgatatcaactagaaagcccaatgcaccgaccgcagctgccaaaggcatatcaagccagtcatactgttgagcaaataacaccatgagtgtcatgctgacaactgccgcgctcaccacctgcaaccaaatcgggaaaaaaggggtgttctgatccagtttgatcaatgccgcgtgcaattcatctagatcaatctgatcagccgcaaacgaacgagagagttgattcacgcgcgtcactttttccatatcaatcgatcgtttgctaatcggccgctcctgaatatacggctgattttcgatgctagcaaatataccggttggcgtcgtaaacaccaacgtttgtggctcaccggcattcacagcaattcgtcgcatcgtatcttcaacacgatacatttccgaaccgccttcaatcataatgcgtccagcaagcaagcatgttgccaatacttgattttggattgctgtatcctgacgctcaactgaatgtgtcatacctacgcctcaagtttctgttcaaaataccgtttaagtttgtctttagggtaaacacctgtcactttttcgcgcgcctctccttgctgataaatgactaaggtgggtactgacataatgcccatagtgctcggcaacgtatgatctttttcaacattataacgaaccactttaagcgctggcagttcttgctctagggccgttaacatcggatcaagcactttacaagggccgcaccacggtgcccaaaaatcgacgacaaccgtgccttcagctgtcaatgccttcaagttatctttcgttgcctcaattgccatgatgtgatccccttccatgcttgctcttgcaatttagcacgactgccacttacttatcaaggtataaaaaaagatccggtcaatgaccagatcctaacttagcgtggcagcttcctaccctcgcaggcagtttcccaccaactactctcggcgtgaagaagcttaacttctgtgttcggcatgggaacaggtgtatccttcttgctatcgccaccacacttatgagaactttgcgctctcaaaactggctatcattgtttaattgctgccttgaacttaa

SEQ ID NO: 8 - DNA, 68952 bp, Lactobacillus paracasei
cgcacaagtttggaccattgtcgacaaaaagaccggccgacttgccggtgctgtcgtcttagccagcttggctgaggacttgatcaataccttcgcagcggccattgatgctggtgaaaagccgagtgatttaaacaagatctatgcttatccaagtgcgcagagtgatttgcagtatctgctgtaaaaccaatgataagtcacagatgtaaccttgcattgacatcactagcgaatttagctaacctaaacccatattcacacaaacgatgagtagcttatctaagtggtctccagagagtcggcaatgctgtgacgtcgatgaccatggtaggcaaagttgggtcgtttgcgttatgttcggtgggtgcgccttaagccaagagaggtccgcaaggcggacaagttaggtggtaccgcgcgcttgcgtcctatgttgttatgacatagggcgctttttttacgataacgcacttacagtcgcagaaacctgcgcataaggaccttggtcgcaatggtcaaagtgcgaccatcacgcccaaggccgcttacactccggtttcacccacgctggctcgcgctcacatataaggaggaaacaagtatggcaaagaaaatcattttaacaggtgatcgaccaacaggacggttacatattggtcactatattggttcactgaaaaatcgtgtggaactgcagaactctggagaatacgaaccgtttgttatgattgccgatacgcaggcattgacggacaacgccaacgatccagagaaaattcgccactctttgctggaagtggccttggattatttggcggttgggattgacccagacaagacgacgattctggtacaaagccagattccggctttgtttgaattaacggcttactacttggatctggtgacggtgaaccggctggaacgtaatccaaccgtgaaagctgaaattaaacaaaaagcctttggtgatagcgttccagcaggtttcttcatttatcccgttagtcaggcggctgacattacggcgtttaaggcgacaacggtgcccgtgggtgacgatcaggagccaatgctggagcagactcgtgagattgtgcgcacgttcaatcggacttatcacaaagatgtgttggttgaacccgaaggctattttccaccaaagggtcttggccggctgccagggattgatggcaatgccaaaatgagcaagagcttaaataacgggatctatttggcggacgacgctgataccgttaagcagaagattatgtcaatgtataccgatccgggccatattcacgttgaagaccccggtaaggtggaaggtaatgttgtctttacctatcttgatattttcgatcctgataagcagcaagttgctgagttgaaagcccaataccaacatggcggcttaggggacgtgaagatcaagcgctacctgattgatgtcatggaggcagtgcttgaacctatccgcactcggcgggagcactatgccaaggatatgggggcggttgctgatatgctcaagcaaggttcggctaaagccaatgtggtggctaatcaaacgcttcaggaagttcgggatgcgatcggattcaactactttaaatagtcaagttccgtcttaagccggatgtcgaaaaccgtcgtcatgatagaatgatggtataagcaggaaattgatgataagcgtgagcagttgtagcctgccttttcacggaaataccgttgttttctgacggctttttccgtgaaaaggtagctaattgtgaacgcattagaggggaattcatatcaatgaaaacgaaacgattaagtccagttgcggtcacaagtattgtccttggtgtgattgttgctatctgcctgatcttcggaatcggcacctacaactcattagctaagcagaatcaagccgttgaagcgcaatggggccaggttgaaaacgtcatgcagcgacgggctgacttggtgcctaacttagttaatgcggttaagggcaacatgggccaagagcagaaggtttttggtgacattgctgaagcccgcaagtcgtatgctaatgcaagttcgacaactgacaaagctaaggctgatgatcagttgaacaagagtgtgggtactttgatcaacgtgattaaagagaattacccgacactgcaaagcagcaatcaggtgaacaccttgatgacgcagcttgaaggtagtgaaaatcgaatctcggttgaacgtaagcgatacattgatcaggttcgtgattataaccagagtgttgtgaccttcccgaagaatatttttgctagcatgatgggcttagggaagaaggacaccttcaaagcaacaccggctgcccaaacggttccaagcgttaatttttcaacgaacagctctagttccgggaagtaggtggcaccatgcgcaggcatttagcgtggtttgttgccgcgctgacgggtttgttgttgttcactggcgccgcgcagccagtggcggcagccgaagatctgccggcacggcccaccgagcattactatctagatcaagacagtgtgcttgatgaaagtaccaagcaactgatcgacagtaagaatcagtattaccaaggcactaaacaacagccgcaaattgccgtagcagctttaaagtcgacccatggcgaccccttgtcagactatgcaccggatcttttccagaaatggggaattggcaagaaaggtaccgataacggggtgcttttgctttatgcgaataacggcggcaagcagaacatgcgcattgaagttggttatggtttggaaggcgatttgcctgatgcgctggctgggcgaatcttgaatgacaatctgaaggacatcaagtcacatgatcctaaagaactgaatcaggccattcgcaaggttttcaatgcggttgcgacagtcatcgataagaaatacaagttccctaaagatcaaaacacggtttctgatgagacgatgaatcaatatcgcaactcaagtcaagacagcggcggcaactttttgacgaaaattgttttcatctttatcgctgtcgtcgttgtggccatcatctttggtagtcgcggcggcggtggccgtggtggtcgccgtggtcgaggtgacagcagcttttggctctgggttattctggacgcgctgctatcttctggccgccgtggcggcggaggcggcttcggcggtggtttcggaggcggctccggtggcggttccagctggggcggcggcagttccggcggcggtggtgccgatgtttgattgcaaatatatttcaattaccagacagcgagtcgctgcctggttttttgtgctatggttgttgaattagtcttttgtgaacgggaacgagcgcatgtcatatcgcttatcagtgatatccgatgacggacaggtagtttacgtgtgcaatcccgttgttgaaaagtgcgatcctgattgggtgagcacacgatcatttttggaggatttgttaatgcggaatttgaccatcggtaagccattgaaattaatcgtgctgttcacgattccattactgattggcaatctttttcaacagctttatagttttatggatgccttgattgttgggcggacgatcggtaaggatgcgttggcggcagttggggcaacatccagcattgtttttttgattattggatttgcgcaagggaccacggctggactttctattttgacagcacaggcctatggtgctcatgattatcgccgtgtgcgacgcagtttcggtacgagcatttggatcacggttgggatttcactgattctcaccgtagcagccgtcacgatgacacgaccattattgaccgtgatgcagacaccaccggatatcatggatggttcgatcgcctttgtgcgggttatctatttcggcattattgcatcaatgagttttaacttgttaagcaatatgttgcgcgcactgggcgattcaagaacaccgctgctcttcttgatcattgcgaccattattaatatcgtactggacttttggttcattctcgggtttcattcgggggtggctggtgccggttatgcaacggttagcgcgcaagtgatcgcggcgttgctctgttggatttacattcgcatgcggataccgcttctaatgattcggcgtcgtgatttgcgctttgattggcacgatattgttcagcatttaaaagttgggcttccgatggggtttcagatgtcgattatcgcaattggcgctgtcattttgcaggtgatgttgaatacattaggcaccaatgcggttgctgcgtatacggcggctggacgaattgaccagttagcgaccttgccgtcagcctcttttggggtggcaatggcgacgtttgctgcgcagaatctgggtgcgaaggaatatgggcgaatccgtcgcggagtttatcaaaccttgatggtgaacgtcggcttatcggcagtgctgggtgtggttattattcttttcagcaaaccattagtgaatttgtttctcgggccgaatcaaccagctgtgacggccttagcccagacttatttccacttcaatgccagcatgtactggttgttggcgattcttttcacgattcgtaatttgttgcaaggtcttggccagacgttggtgccaacggttgcgggattcttcgaattggggatgcgggcgtttgctgcgattttcctcgttgtgccattcggctttgctggtgcatcggcggccaacccgctggcgtggttcggcagtgtgctggtactagtcagctcgtatgttcggacgatgcggcgtattagacagcaggaagatgaattagctgggcaccaagattaaaaaagcgtttgattgatcgccaacgggcccgcccgttagcatcagtcaaacgctttttacgcgttcacgctcttttaaacgcgttcactggcgcagaaacctgcacataaggaccacaagcacactggcaaaacccggtcaatgcacttgcggccacttatgctccggtttctaagcgcgccagttcacgctctgcttttaaagtgtttgccatagacttctaaatccgcttctccttctggcaggatagcgatggctggcaaatggccccagtggtcataaccgaatttggtgaacaagttgcgactggcttggttatgcccaaaaattcgggcgagaacggtggttaagtcgtgcttgggtgcttcgcggtcaacaaaggccaatgccgcgctgccaacgtggtgaccgcgggcggccacatcaaggtataaactgatttcggcagtttggtcataagctgagcggtcactataagccgacagtgtcagccagccaacgattttgtggtcaacttgaatcatccaagcgggaaagtggttattgtgagccgcaaaccaagtttgtttctcagcgactgtttgcggctgcaagtcagcggttgcttgatgggtcgggatagtttcattgtaaatggcgacaatttttggtaaatcactggctgtggcaggggtaaattcaatcaacgtctgatgacctccattttggttaaaatgtgatgcggcccgtaaaagttgctaaacttgccgtaccgttatggctcatagcctcgagcaatggtttcacacgatcacgcaaatcggtgctgagcttgagttcggtcaaaagcgcattggttgttgcaatctcccagtgggcatcatctaaagtagggtcttcgacgatggtgccagcggtgtaggtccatgtgttatcatgtgcgatttgtgccaaagtgtccggcgtgatcaacgtgcgaatgttggcgacatcacttggagcaatggcatacagcaagccttgaatcatagccgcctgcagatgcccaatttgatccagcgcagttggctgcattgaccactcggcgacatcaacgtgatcacagacagctgccatgtttttgaataataaggcgagggcgttggcggaagcaaagtaccaaagactatgtgctaggacaacccggtcaaaatgctgatcggcgatgggcccaagatcatccgaaagattagtgttgaaatgaaccgttaagcgatcaccaagcggtcccgcaagcaagtggttccatgcttggccaagcgtcagcggggcgccgtagtcaggtgaggcgatgtcaatgccagtcacatgcccggctgagccgacttgatcagccaaaacggcgctcaggtcgccttgcccacagccgatttctagaattttttcgccgggttttacttgccatgcctcagcaattgcgagtcgatgggcagtttggcgacgctgaatggtccttgcattggcggttggaccaagtgccatgagatctgtaatgtagtcgagtcgtttttccataggattttccttttaaaaatgtgttggttcatgctttgtctaaacgcgtttgcagtcgcagaaacccgcgtgtaaggacctcgggcaacaatggtcaaaggccgaccatcgcacccgaggccacttacacttcggtttctaagcgcgactcctcacgctctgtctaaacgcgtttgcagtcgcagaaacctgcgtgtaaggacctcaagcagactgaccaaagcccggtcaatgcacttgaggccgcttatgcgtcggtttctaaccgcgccattgaacgctctgtctgattatggcaggtcgtttccggcggcgaagtagaggtcataccatttttgccgagtcaaagcaatgtcgccggcttcggcgatggcgcgaatgcgagcgggtttggtggttccggcgatgacttgcacatcagctggtacacgcaagagccaggcagcagcaattgcgttgggattggtggtatattgatcggccagcttttgaagtaaggcatttaattcaggaaatttatcgttgtcgatgaaaacaccttcaaagaagccatattggaaaggactccacgcctgaattgccatatgatgctgctgactgtatgggagaagaccgccatcatgatcaatggaacgggcatctgccatgtttgtatgcatgccggcatcaatcatgcctgtgtgcatcagggaaaactgcaattgattgatgatcaatcgttgcggcaccgcctgttggagcagttcaatctgagcaggattgaagttggaaaccccgaactgccgaactttaccttcattttgcaattgcagaaaggcttcagcaacatcttctggttccatgagcgggtcaggtcgatgcaatagcaagctgtcaacatgatcggtaccaaggcgtttaagactgccattgacagcatccacgatatgctctttggagaaatcatagcgatgggtcgcttttcgatcattgacgataccgaccttagtctgaatcaggacttgatcacgtgtaaagctggccttcttcaacgcatcgtcaaaaagctgttcagctttaccattgctgtaaacatcagcattgtcaaaaaagttaatgccgacgtcataagcagcatcaagtagttcggttgctcgcggccgatcgagattcggcaaacgcataacacctaacgcaatggcagaagcgtgcagaccagaacggcctagatcaatcattttcataatgagcatcctttcagaattgttccatgatgctttaagattatcacaaaagcagtgatgattgcgtgagaaagcaccctcaaggacgagctaatttgaggctatcgcatgcttttgtgatggttattaagtctgtggtattggccaatgactgactagccagcagtcgagtctgccattggtcggaccaaatgttgaagaaagcgctacttatagcacattcagtaaagattgatgccgatttttggtaaactaaaggtagatagaccgattgtcagtaataaggcttgtctaaaaagccatgcaggcggtgtttaccgtgctatcatggcattagagcatgatgacagtcaggtagcaaacgaaaagaaatgggtggaacgagaatggcaaataatatacaagggtttgtgatgatcggtgcacaagcaatcgtttttagcatcacaaatctgcggacgctgaaaacaattgaacgcggtagatatccagttgccattggggatgatttttatgcagaacatgaaatcttgcccgatactgttgatgcgatcgtacaagcgtttgatgccatcaatcaaatttttaaagactatggcgtaccgactgttaatgtatttgcaagtaccagttgggccgaagctgataatgccgagtttgtgcgtgatcagctttatacgcgaactggctggctcattaaaactacctcactatcagaagaagccttttttcgtacccaagcgatcatggtgaagtttccgcagtttaaatcgattacgcaaaaaggcacggtgctgattgatatcagttcagggtcagttgagttgactaccttcagcaatggcgtgtttggcttctcgcgtaatctgtcacttggccctttgcgagtgtatgaaatcatgagtgatgtccaacgctcggtgacaaattatgttgaagtgatgcgcgactatatcgacagtcgcttactcgactttatgcggctgttgccacaaggtgttgagtacaccaatatgattttaatgggtagtaatctgtctatttttcaaaatatcattccggaaggcaagcatcaggtagaaactgatcggccagggtttgatttattatacgatgaagtgacaaaggcttctgaccagtaccttgcagatacctatgatttgacttctgaccaaacatcgctggttttgccgacagttttgttggtgtatcggttggttgaaacgctcaacagtcaatctatttggatctcagatcttaaagccattgatggtattgaagtcaatgcagcacatgaaggcggctttaaaaagctgggctttgatccaaatgaagaaattgtcatcagtgcgaataatttggcagaacgctaccaagttgatgaagcccatatgcaagccacacggacggttgccttacagctgtttgatcgattgaaaaagttgcacggcatgggcaaacgcgagcgtcttttgcttgaagtcgccgcaacggttagtgatattggtagttacattgaaacacacaaacattacgcacattctaattacatcatcaaagcatctgaaattatggggctcaatgatcttgaagtaaccatggtggcaacgattacacggtttcacagctccattacaccgcaatcggacctaaagaactttccaacaatgtcgaccgaaaatcgcttagttgtggctaagttatccgccttgctacgcgttgcagatagtctagacgcatctcgccaacagaagattcagcaattacgggtttctgtcaaaccaaatgaagtgctgttaacagccagagccgatgatgatattgaacttgaacgctggacattagcacgcaaaggaaagtttttctctgaggtattcgggctagggcttgagctgaaaggaagaaacattttatgaagaaactagatttttcaaagccgcgttattttaataaccgtgaactcagttggctggcattcaacgatcgggtactggaagaagcccgggataagaataacccgttgcttgaacgggtacgtttcctgggtattacgcaaagcaatcttgatgagtttttcaatattcgcgttgcgtcgctgaaaaaaatggtcacagttaattatgatcagccggatgcagcaggattgaaaccgcaagagcagttagacgcaatttccgaaaccgcccacgcaatggtggagaaacaatacacaacattggttcgttcgctgttgccaaaaatgagtgctgtcgatattcaactgctacatgcatcagaattgacggagaaacagcacgattttgtctcagattatttccattatgaactgtatcccgttttaaccccgatgggagttgatccgacgcggccgttcccatttcttggcaataatagtctgaatttggccattcggctggttcggcctgatgataaaggcgataagtcacggtcgtttgcgatggtacaggtgcctgatgtttttccgcgggttttgcggctgccaggcggcgacaatgtctttattttgcttgaagaagtcgtgcggatgtttgtcagtgagctgtttgttggtgctgacatcaaagaaacggctacatttcgggttacccgtgacatggacatggatgtggccgaagaggatgcatctgatttgatgaaggagattcaatcccagttgaaaaagcgtcaacgcgggaaagtgatgcggcttgagattgaagctggtatgagcaagcatttgcgcaaacgtctcatcaaggctatgaatgtgaaggatgaagacgtttatgaaattcatggtccgattgatctcaattttctcagcaaattggtcaaacaagtgcacgatcataaagatttgctattcaagccattcacaccgtacatggatccggatttcaagaaagagtcgatttttgatgtcattaaggatcgcgatgtcttcatgcagcacccatatgacagctttcagccagttgttgactttattcgcgaagcggcattagatccacaagtgcttgcggtaaaaatgacgctgtatcgggtttcaagcaaatcgccgatcatccgttacctgaaaaaagctgcagaaaatggcaagcaggtcacggtattggtggagttgaaggcgcggtttgatgaagagaataatgttcattgggcgcaagaattggaacatgccggttgccacgtgatttatggtttggtcggtttgaagacacattgtaagttggcgttggttgttcgtcgcgaagaggaaggcatcaagcgctatatgcacatggcgaccggaaattacaacgatgtgacggcgcggctttataccgacatgggcttgttcacttgcaacaacgaaattggtgaagatgcgtctaatattttcaacatgctttctggcttttcggaaccaccgtattttcacaagctggtcattgcaccactgggcatcagagactatctgatggatcgaattgatgaagaaattactgctgctaaggcggggcgcaaggccttgatccagatgaagatgaactcgctatctgatacggccatgatcgagaagctctatgaagcttccaatgccggtgtcgagatacatctccttattcgtgggatctgcaacttgaaggttggtattcccggagtttcagacaatatcacagtacattcgattgtcggacagttgctggaacacagccgaatttactacttttatgcggatgggcaggaaaatgtttacctttcatctgctgacttgatgaaccgcaatctgagccgccgagttgagctgctgttcccgattttgcaggacgatattcgcgaacgcatcatcaaaattttcagtatcatgtgggcagataacgttaaaacgcgaattttacaaccggacagtacgtgggttcgtgctcaattacgcggggttacaaaactcaatgcacaggcatacttcattgaacatgctgaagccatgggtgaagcattgcgacgtgaggaagttgatgatgctcctgaagacttgcatgcaacgcatacttttattccgataaccgcacccaaggaggacgatgacgcatgacgcatcattttgcagtaattgatcttggcagtaactcagctcggatgacgatctgggaaatcgagcaagaggttgtcaagccgatcaaacggctcaaagaaatggtgcgattgtctgaggacatggggccagatcgcgttttgcagcccgcagcaatggatcgcaccctgaaagccttgcaggggtttaagacggagctgaataagtatgctgatattgatttaaaggcggttgcaacagctgctgtccgccaagccaagaatcaaaaagaattcctcaaacgggtgaagaacgaggcggggttgatcatcaatgtgattccgggaacgcgtgaagccgagtatgactttttaggcgtcatcaacaccttgccgattcaaaacgccttaattatggacacaggcggtgcctcaaccgagttgattctggttcaaaatcggaagttgcaacatctggtatcgattccttttggctcggtcaacctgtccgaacggtttttgaatccggatgtgatttcggcgccggagtattttgccttaagtacgtttattcatgagacttttaacagcatttggtggctgcggcgagcacagaatttgccgattatcgcgcttggcggaagcaatcggacgttggcgaaaatcgaacgacgtaaggaaaaaatggctgattttgaggcgattcacggctatcggatgccgacaaagcaggccaatgcgatttttaaggaaattcttggtgcagatttggccacgcgggagtcaattccggggctgtcaaagtttcgcgctgatattatcgtgggcggtttgatgccggttatctcgatgattcgttatctagactcggatcgtctcaccttctcacagtttggcttgcgagaaggcgcgctgtacgatcatttgaacacgcgtgcagtgacacagcgtgagcattagttaatcattgcttaaaagtctggtaaacatgctgacggagtgcgctgaagcagcgataatgaaggtaccaatctaaaggagagcgtgagccagcccggttagaagccggagcataagtgcgctcaagtgcgatgactgggtcatggtcattgtgcttgaggtccctatgcggaggtttctgggctggagaacgcatttaaaaggatggattttactcatgaaaaaatttatgaaatggctaggtctggccgttgcaggcttggccttgctaaccgcagcaccgcatgtggtgcgagccgatacttggtcacaaccagtggcaacaattggttcctcactgactgctgatcaaaaaagcggcaccttgagcactttacaaaatgctgccggggtcaacaatgccagtcaactgaccgtgaatggggccacactggtgaagtacctcaatccttcaggtagtacttttactgaaagctcaggcgtctggtctagcgcgttggttcaaaagactgataatgggggcattaatgtcaaaatcgtcccttataatggcaccaataacatcacaaccatcaccgctgatcaatatcgtaatgcggcattaaccgctggggttagcaatgccaacctctacattaccagcgcggttagaattgatggttcaggtgccttggcaggggtttatgcggcttttgctcaaaatggcgaaaatttgaataaccagcaaatcaatgctgctcagcaggaagtcaacaccttgagttcgatcacccaagcgaataaggacaaagatggttattctgacaagcagctcaataatgccgtggcgggtgcgaaacagcaaatggccagtcaaagtaacaacggtcagcagactttgtcccaaaatcagatcggtaacatcgtagacagtcagcttaaacagaataatttaacaacgattattaacaacaatcagcggcaattgatcattaacttactagtgaacgttcaaaaagccggttcactaaagaacaatgactttaaagcacaggcagggaagctggccgattccattcagaattctgctaaaggcttgtttgataagctcaataagagcctgaacactgaagaaaatcggaatttcctgcaaaaaatctgggatggcatcgtgagtttctttaatggtatcgctcaatggattcagagcctgatcaaataattttagcggtttaagcaaggggtgacagtttgtgatgattccggcgattttaacaacgacagagggtagtggcaatggtcataccttaactggcgcaattttgattggtgcagtggtggcggtgatcatcattttgtttttggtgattaagttactgggggcgatcctccgtcatccctttatcagtctgatactgtttgcacttggcggctttgccatttttaagtttgcgttagtcggtattattggtgtcggcgttttagctgcagccggcgctggtgccttatggctgaatacaggcgatggtagctgacagtttaagaagctggtgtcaaaatgaaaaaaaccctgctgaccagcgtcagcaggggtttttcatctttgtcggttaaacgcgcgaaggcagatcaatttctgcttgtgctaatatgtgacccttcatcgcgtgccgagcttcatttagccaaaagccagcttgcagtggcaatttcgtatccaatgcaaagacgattaaggtataatcgtgatctttatctggtggctgcgggccgacataaccagcctgtgtgaatgggtcggtgttgccgacgaggcggccagcggtggcgttcttgccttcgaccattggcaccttattggtatgactggcgcctgctgggaatgttgtgctgtcggcgggaatattggctgcattccaatgaatccatggtaggccgccaaccggtacagcatcgtagtcaaggaaccaaagtgcaaaactgacagtttcggcaggggcatcctcaatcgtaaaaggaaaactcgtaatgggatagccatttttaacgtcactgccgcttgcatgcttgccatagcgatcggcaagttgaccattgataagtggtacggatagtttcatttgaatttcctcccttttatcgctaccttaatgatagaggataaaaataattaaagccaatttatcacagagcgtgagctggcccggtttctgggtcagcaaccgtgtttaagacagagcgtgagcggccgcggttagaaaccggagcataagcggcctcaggcgtaaacggctgggtttgggtcatttacgcctgaggaccttatgtgcaggtttctgcggctgtgatcgcgtttaaggagtgcaatacgatgcaggaagacgttgaaacattactaaatgaaatcaaggaacactatgatcatcccctagaagtcgacattagtggggaggcgagcggcgtcttaacgcacgatcaaagccatcagcaattgaaaaaagatggtacgctagtggtagcagtgacggacacgaccaatgtcgattacaccttaagtcatgagttactacacctgttgttccagatgaaaggttatccgcaacttcaattccatttattgagcggtgatccgcaggtagacgatcaactttatgccacgagcacctcgctatacaatgctgcggtgcatatgcttgttgtcgcctggcaacgcgatcacaaccttttgacagacgcagcggtggcgcaagtgctcgccggcttcaaacaaaatgtgccagcagaagccgatgaccagttggttatttatcgagtgctatcgttgcttgatttgttggggtttttaaatggtgagttgccagcagaattagcaaatgcctatccacaagctttgccgcttgcacgcgaactttacgacttgctggatgcgcagaagcttgattccccatttggattacgacgcgccattgttcacctgctggcgcgatttgataccgtgattgaacggctaggctatcaaccgaccaacgatgctgaatttgcaacggtaacgcctgtcctatcgcatcggcaattacgccttaccttggatcaggtttacatgatcaagcacagtggctaccgtgatcgcgagaccaaggaacccgcatatgttgccatgggacgcagcgatgagcaaaatgcgtttgtactgcccttgccagaaaaagaaacaacgccagaagcctttcagcagttgtatcaacaatcgctgaatgacattctgacgcagtatcggctcgactacacaattcgttaatgccgaccaaagttgatgaagaaactattggaaacggaatgaacaccgagcatgatgacctgataaaggacgaaggcaaagaaaacaaggacgatgaccatgatcagataactaataacgtgtgaccaccgaaatgacttcatgatcaagactcctttctgaaagtatttctactgttatgttacaccttttttgatttaaattaatagcgcatgtgaaccatttaaacgcaacttgaaatattaaagatgcgtcatgctaaggattggcggtttgattgcgtattttcatcattgaaaaatatctgctaaaagatgagcgcgtgaacgaacgcgtttagaaaccggagcataagcggccttttaggcttgaggtctttatgtgcaggtttctgagccggtgatcgcgtttaaggagggaccatatatgtttgatctgcaaactgcaattcagcaggcgaagcatgtgacattcatgactggggcaggggtctcaacagcatcagggattccggattatcgttccaagggcggactatacgccgatcaagtcgatccggaatatgcactgtctattgataatttacaagcacatcatgaagattttcataagtttgttgtcaataatatgtactttccagcggctaaaccgaacgttattcacgagaaaatggcaaccatcaccaatcaaaaaggtacgattgttacgcagaatgttgacggcctcgatcgtaaggccggtgcagagcatgttgttgaatttcatggcaatctttatcgcatttattgccaaacttgtcacaagcattttgactacgagacctatctgaaaagtgatgttcatgcagctgacggtggtattttgcgaccagatattgtgttgtatggtgaaccaatcaatcccgataccgtcagtgcggcgatcgaagccatttcaactgcagatttgctgatcgtggtgggaacaagcttcgtggtttatccatttgcggggttgattggctatgcgcaaccagaggcgaccattgtcgctgtgaaccgtgaaaagatcgctttgccggaaggcgcgcatatggtgcagggggatgcggtgaacgtatttgcgaagctggtagtctgaagcaatcacaacttagcttttgctcatcatctgggaaattctgtaagtgaaggcgaagcttccaaaaataactttgtgaggggatattgccatgaataaagggcggcttgaggcgtttacagatgcggttatcgccattatcctgacgattctggtgttagaattgcaaccgccgcacagcggatcattggcttcgttatggcaactacgtggtgtttttgccatttatctagtgtcgtttttgacactcattgtttactggaataatcatcatcacttgtttcaactggtcgaacgaattgattggcgggtgatgtgggcgaactctttcttcatgctggttgtgtcaatgtttccattcgccactagctgggtaggcgaaggacacgtagggacatttggccctgaattggcctatggctttgtgatcttgatggccaatatcagctatgtgctattagtacaaaccctgattcgcgtcaatggaccaacatcggcattagcagacttatatcggcagcggcacaactggaaagcagcggcctcagtcgcgattgcacttgttgcgatgttattggctttgctttggccgccgttgacgatcatactagacttattgatgttgctgctatgggcgattccggatcagcgcattgaacgtcacttgatggctgattcaaaaaagaaatcacgccaatgaacgcattttgaaaaggagattttttatatggcaagaacaattggtattattggtattggacacgtaggtgtgaccacggcttttaatcttgtcagcaaaggggttgctgacaagttagtcttgattgacaaaaaggctgaacttgctgaaggcgaaagctttgacttgaaggatgcgcttggcggcttgcccacttatactgacattgttgtcaacgattatgatgctttgaaagatgctgatgtggttatttccgcggtcggcaatattggcgccatttcaaatggtgatcgaattggagaaaccaagacttcaaaagtagcactagatgacgtcgctccaaaactgaaggcgtctggcttccatggcgttttgctagatatcaccaatccatgtgatgctgtcacgagttactggcaatatctcctagatttaccgaagtctcaaattattgggactgggacttcgctggatacttatcggatgcgacgggcggttgccgataccttgcatgtgaatgttgctgacgtgcgtggttacaatatgggcgaacatggcgaatcgcaatttaccgcttggtcaacagtacgggtcaataatgaaccgattgctgaatatgcgaaggtggattacgaccagcttgccgatgatgcgcgggcaggcggttggaagatttatcaggctaagcattatacgagctacggtatcgccaccatcgcgactgaaatgacacaggcgatcatcagcgatgcacatcgcatcttcccatgcgctaattacgatccagaattcggtattgctatcggtcatccagccatgatcggtaaacaaggtgttatcaagacgccaacgttgaagttgacagatgaagagcgtgctaagtatgttcactctgccggtatcattaaggatacctttgaaaaaatgaagtaggtccttttacgagcgctttttcacggtcagctaatctgggcggtttgacgcatcctcgcaaaaaaggcctgtcatcaaagattcaaaagagacgccatttcggcgcttttttgctagtgatgatcccaaagcaaaggagcaaacatggtcaaaaaatataccttagtcactgtcgaaaccccaagtggctggttgctaattaatcggacgaatccaccatatcgtggcatgtggaatacattgggtgggaaattcctgcctaatgaaaccccagctacttgcgcctcacgtgaattgcaggaagaaagtcacattattattcccccgcatgatctgatcaatggcgggcgtgtgttctggcatgttgatggtgagttgcgggccgaactttttgccttctttggccacacggaagacgagctggtgatgccgcgagccactcgggagggcattttagcgactttttcaaaagattggttgttagcggataatcccggcttggtaccagatttacagccactgttgcactatgcgctgaatggcgaacgccatgattatgcatcttattttaccggcgatcggttagaagattttcgcatcgcggatggtgaaattgatgattaatgttggtttgacgagtgtagccgatcatccagaattagcgacgcgcggcaatcggagtacgttttcggattacgctcagcattttcctgtactggagttggacacgacgttttatggattgaagcctgtggaacaggttcgccactggcaggcccaagtgccatctgggtttcagttcataattaaagcgacgcgaaccatgacgaaacacgaagaaagtgcagacacagtcgctgacttttccaaatttaatgatatggtggcaccgctggttgcaagccatcagttgcaggcggtgctgtgccaatttccgccatattttggcgtgaccgcagaaaatgtacgctacttgcagcaactaaatcgtttactgccggatttacctgttgccattgaatttcgccatcctagctggtatttgccggcttatcgtgccaacacgatggcgctgttgcaagcagccggcgacattcacgtgatcgttgatgaagcgcagacgaccagcggctcagtgccgcttgtgccaattgcaacgaatgccgatttaaccatgatgcgcttgcatggccgaaatccggcatggggtcgaaccggcgccaaaacgactgaaagaaccaattatcgttacagccaagaagaactgcagcagtttggtatcatcgcgcagcatttgaaaagtaaaaatgttaccgtcatcttcaacaataatggtggtcacgatgctgcagccaatgcgcaaagtttgatcgatttgttgggtctggactttccgggtcttgccccacgacagttagatctgttttgatgctgattaagttgggatcaaagaggccggctcggataacagcacagcgctaagttagcattgagagcaaacatatcatcttcgaagcgcgaccaccgatccagaaaccgggttggcgatcgcgcttcgattctttctgacaccatgatcaatgcgtagtacaatcgcggtaaggatcatcatttttaagaaggagactggtgcatctatgaaaatccaagaaggctacatgccgtttcatgaatataaaacttattaccgaatcgttggcgaacctagtgctgataaggcgccgttgttactgattcacggcggaccggggtcgtcgcataattattttgaactcatggacgactatgccgaaaccggccggcaactgattatgtacgaccaagtcggctgcgggaagtcgtcactgccagaagatccggcggtttatgttaaagaaacttgggcagaagagttgatcgccttacgaaagtacctgcacctcgatgagcttcacatgcttggtcaatcatggggcggtatgctggaaatgtattatctaaccagcttcgatcctcaaggtatcaagagtgtgatgattgacggctcgccgtcatctattaagttgtggattcaggaacaacatcgcctgatcaaatacctgagttatgaagatcgcgaagccatcgcagaagcagaacgaaccggcgactttacgaatgtgaaatatctggcggccaatgatcgctacatggaaaagtactgctgggatgatccagacgaaaactcacctgaaccgctacgccggccaactaacggcaaacgcgccagtttaattgctgaaggccccaatgaatttactgaaaatgggacgattagcgatttcgatgtaaccgatcagctcaaaaacattcacgttccggttttggtaaccaatgggactgatgacctctgcacgccgcttattgcgaaaacggttgtcgatcatattcctaacgccaaatggcatctcttcgccaacagtcggcatttggcgctgcttgatcaacatgatgaatttatcagtgttttggatcactggttagcagcaaatgattagctgtgggcaactatacagccccgctgtttcctatgctatactagactcattctgaactaatgtacgggaggcccttgcatggcaagcaaaccaactttttacgtaacaacaccaatttattacccatctggcaaactacatatcggcaacgcctacaccaccattgcggcagacgtgctcgcacggtataagcggctcatgggctacgacgttttcttcctaactgggaccgacgaacatggcctgaaaatcgagcaaaaggctgataagttaggggtgacgccacaagcttatgttgatggcatggcgacccaaatcaagcaactttggaaaatgcttgaaatcaccaatgacaagtttatccggaccactgacaaggaacatgtcgaagccgttcaaacgattgtggaacgtctcatcaaacaaggggacgtctatttaggcgaatacactggctggtactccgttgaagacgaggaatacttcacggaatctcaactgtcggaagtttatcgcgatcaagacggcaacgtgaccggcgggaaagcgccgtctggtcatgaagtgcagctggttcacgaaccaagctacttcttcaagatgagcaagtacaccgatcgcttgttgaagtattatgacgagcatccggattttgttcaaccggcttcacgcaaaactgaaatgatcaataactttatcaaaccgggtctggaagatctggcgatgagccggacgagcttcaattggggtgtccagattccatccgatccgaagcacgttgtttacgtgtgggttgatgcgctgctgaactatatcacggctctaggctatggcagtaatgatcacgctttgtttgacaaatactggccagccaacgtccaattgattggtaaggagattgttcgtttccacattatctattggccaattattttaatggcactcggtttgccgttgccaaagaaaatttatgcccatggctggctagtcatgaaagatggcaaaatgagtaagtcgaaaggcaatgccatttatccggacatggttgttgaacggtatggcttggatgccttgcggtattacttgatgcgcgccataccgtttggtaatgatggtattttcacaccagaagactttattgaccgaatcaattacgacttggccaatgacctcggcaatctgttgaatcggactatcgccatgattaacaagtatgaagacggtattttgccagcctttaaaccggatgtaacgccgtttgatcaagatcttggcgatgtggcgcaggcggctttagcgcaatatcacaaattgatggacgagttgcgtttctccgatgctttggatcaagtctggaaaattgtttcccgggcgaacaagtatatcgacgaaacggaaccgtggaatctggccaaagatcctgccaaaaaagatcagcttgatgctgtgatggctcacttggccgaaagcctgcgtctgattgctctactgattcaaccagtgatgacccatgcaccgctgcaaatcttcggccaacttggcttggatcatgaaaatgacgatcacaagcttgtccaatggggcgctttgccagctggtgtcaaagtagttgaacaaggcacgccaatcttcccgcgtcttgatacggaagaagaagtggcatatatcaagagcaagatgacccccggcaccgcaaaagcaaccgtcgacgaaaaaactcggaagtcagaaatcgagttcaaacaattcgataagagcgaaattcgggtcgcagaaattttgaatgtcgaaccggttaaaggcgctgataagttgttgaagttcacgctcgatgcaggcgatgaaggcacacggcaaattctttccggtattcgtgaattttacccagaatatgagaagctgaaaggcaaaaaggttatggccgtggtcaacttgaagccgcgcaagctaaaaggcgaaatgtctgaaggcatgttgttgtcggctgaaagtttagacggcaagaaaatcactttgctggaagtctctgagaacttagagaatggcagcttggttggttaattgaagggcaatgaaaaacactcgactagttgtggtcgagtgttttttgatggtcagagataatgtcgcaacagttggtaaagtttattcgtggtaagtcaacccaaaacgtttttgttaattcgccacaggtgcaacggatgtggccacttttttacgtgcagcttttattctgtcctctgtatagtattgcgcttgcgcattgaataaatcgcgataaatgccggatttagccatgagactggcatgcgtaccatcttggacgagttgcccatggtcaagcaccacaatccgttgggaaaaacgggttgagctcatgcgatgtgacacatagatggcagttttcccttcaatgagctcgtcaaaccgttgataaatttcatactcggagatgggatcaagtgcggcggttggttcatccagaatcatgatcggcgcgtttttgtaccacgcgcgggcgatggcgattttttgggcttcgccgccagagacatccacaccatcgtcacttaacgcagtcgtaattggggtatcgattgtttcaggcattcgcttaacccgatcggccacatccgcaacagttagtgcttgccaaacgcggtcacgatcaggctgggttgttgccgcaacattttccgcgatgctataagcgaaaagccgaaaatcctgaaaaacaacccccagtaggctgcgatattcgtcttcatcgtatttttgaatgtcgatatcgttaagggtgatcatgccttcagttggtttgaacaggcgcacaagaagtttgatgagggtcgttttaccactgccgtttcggccgaccaaggcaaggcgttcgccaatattcagcgtgagattgacgtgccgcagcgcccactcatcgctgcctgggtatttaaagctcacatcatgaaactggatggcaaattcgttgtcgttgcgcttctcgacaggcagcgagccggacttttcgtgatcaggcagggccagaaaatcgacatagaattggaggtagtcaaccatattcacatacatgccaacttgctgaagaaattggtaggccgcggtcataagttgttgaaaatacccaaccgcgatcatgacgctgccgattgcaaggctaccgaggagggctttggcaccgactaagatatagagaccgatgacagcaacggcgatagcgagatttggccagtgaccgtatttggccatttgccagtcgccatcccaaatttgttgaagtgatgccatggtgctgtttgtttctcgatgcataatgaggtcacttgcacggtaaaggcggacaacctgatgattgtccatattttcagtgaaattgaagaaataggtaaatcgtcgattacttggaaggatcttttggataatctcctgttgaatgagattgctgtgtttaatgctccagctaccaacgataatcggtaagatcaacaatactaggatcatcaatgggtaacgaacatcattaagccatgtataggaagcggccatcggtttcattaagttaacaagtgttgcagtaccaaaagcaatagcaatgactagtgaaaagaaatccagcaggccttgcttcataagacttgataatccgccgctgaaggattgcccagcctgagctccagcatatgccttgcgcatgtctggatcttggagcgtgctgtagctaacagttaatagcttttcggtcacagcgcgatcgagtcgccgtttaacagcagtttcatgatcctcggcgcgcttgctaaaccagccgccgcacaattgtagcaaaaaacgaacggctaaaaagagaccgattaatagcatgacttgttgtaatgatgcccgttgctgtagctgattcaacacgagcccaagaaaggcaatgttgagataagggattcccacggttgtgagggcacgcataaattcaactggcagagcggctgagtcgagttcataaatgacccgaaccacacgtaaagttcggactaccgtattacttgccggcttctttttttcggcgtctttaaaggttgtcattggctggaacctcctttgcttcaggttgatagtatttactttgaatatgatacatttgcgcataacaaccattgtttgcgatcaattggtcatgcgtccctgattcaagcacttgaccgtgatccatgaagagaatggtgtcacagaaacgggttgaggcgagtcgatgcgagatgaacagagaagttttccccgaggctaattgagcatactcttggtaaacctcgttttcggcgatggcatctaaagccgctgttggttcgtctaacaccaagacaggagcatctttatacagtgcgcgtgctaacataagtttctgggactgaccgcctgaaagttcgatgccatcatcgcgagtgtatcgggtcataggtgtatgagctttttgtggtaacgtcgcaacaaaatcagctagacccgcgtcttttaatgctgactcgactcgttgaggttgcggcggattcgtcaatgccacgttgtcagcgaggctcaatgctagaacgatggtttcctgaaagacgggggcgaaaaatgaaaaacgagttgctagtggtaatagatcggcgtttaagccgttgatcagaatggtgccgcttgttgggtgtaacaagcccatcatcaaacgagccagggttgatttacctgcgccgttgacgccgacgatggcgagcttttggccggctcctaacgtaaagctaacatccttgagacttgcggttttcgcttcgggatagcggaaggtcacatggtcaaaatgaatggtgaccggtcgctgtgccagttgcgtttgttcaaaggtggtgagtgggcgtgctggtgtttgcggcttaagcgtcatgaattcgcgaagttcttgcagatcgagactagcggtttgcaaaccgctgaaatctttcagtaattggtcaagtaaggtgatgaagccatttgtcatgccaaacatcaaagtaaattgagcaatggatagactgccttggatgacggcaataaccaaactcccgtagaccaaggcatcgcggcataatccggcaagttcgccaacctgtgcccctaagaaatgccgcaatgagttgcggcgttgccaagcatcttgaagtgaaaggagtcgatcaagatgggtgtgataccaactagccatcccaaacatccgaatatccttaccattttccagtgcataggcattgcgggagatataagcttgctggcggctgagcttattccaattgacgttgtttgtttgataccacttgcggtaccagctcagcccggcataactgatggcagcgctgagaagaaccaatgcaaacacccacggaatgacggtcgacaaagttgcaaggaatactaacaaggtcgcgatatcaatcaaagtgccacgaccataaatatagattgcctctgccccagcatatgtccaactcaaccctttgctaaaagctgtatgagcaagatcttgtattttgccgctactgatttgatcataatcaagatcccattgctgttgatggaaatccatttcgatttgggtgcgtagtgaggtgcctttaatatcgaaggtcatcagaagatactcaacttcactggtaatggctaatcccaagccggttaaaccagccaaccaagcaaattcccccaatgttgcatgctgcacgatggcaccgaccaacaatgccggggtgaaaactcccagcaaggctgcagccgctttatcaatggcgagaccggttgcggtccaagcaagtgacggttcatcttttcgcaagtaagttaagtaccaccttaagttgttgaacaacccgtattttttcatgtcgatcacctcgttgatcttaatctagcaaaaaatcggccactcgcggcagattatgcgtgagtggtcgatttaacggcgtgaatgggaatcgcaatctcggtgacaaagacggaagcttcatattggcgattgatcatgccattatacttggccacgagtttgttgacgcgccggataccgaggccgcgtttgtcgcttttggttgaggcgtactgatagtcgatttcttgttcggcaggccgggtattggtgacagagaggtaaaactgttgcttgacgatgccgatatacagccgcagttggcgcggctcaccggccggttgctcactgattgcttcaatggcgttgtctaacaggtttcccaagatgacaaccagatcaacatctttaattaacggtgtgctgccgacaatcactttttcattgacggggatgtgcaaccgttcggccaatgtcagcttagcattgacgatagcgtccaacatggcattgccagagtgaacgagcggatcaacttcgtccaacttgtcttctagttcgtcgagataggctcgggctgcctgcgtatcctgattatctaagtaagctttgagcgcctgcaaatgatcatggtaatcatggcgccatccgcgcatattggcataaagttcctgcacttcttgcgaatattgggccatcattttatcgaggctgcgggcgaatacggcgtcctgatcgttgaggaattgacgcattaagacaaactccaaggtgccggtcaaaacggtgctgcagaaaagcacaaaccgcacacttggcagcggccaaagccaccaaccacctaaggccagcaatgtgacagccagattcaaaccgcgcacaggccaattttgttgtcggcggaaggtccaccatagaagcaggcaacagccaactgtcaacaggccgaatgcggctaaccaccaccattcattcactgtcatgagccaacccccgaaaatgtttaaagaaggcttgtttgacgagcggtgcttgttgccgagaaaccgggtaactggtgccatcagccatgacgacggtgtttttctcaagctgcgacaaaaagttgaggttgatcacaattgatcgatagatttgaataaaattttcatcgagctgaggcaggaagtcttttaactgaccggcgactgtgtacgtcattttctgggtgtgcacctgcaagcgatgatcggttacttcgatggcactgatatcatacatggcgacacgctgaatgccgttggcggtggtgaaggccaacagctttggttgcgtttgcgcggcgactttggtgatgagatgctgcagcttgtcacttgtgagcggtttgatgacataatcaatcgcgttgacatcatagccgtcaaaaacgaattcatcatagttactgacaaacgcaatcgccgtcgccgcatcgtgctcccgaatctgctttgcaagcgtcatcccatccatgcccgagcctaacttgatatcgagcaacaacagatcggcaggctcgtcagcaaaaagaaaggcctctgcggttggataagctgtcacttgtaaaggctgcgtgggcgtggtcagttggctaagcaactgagttgttgcttgtcgcgtggctgcctgatcgtcaatgatggcaatgtgcatggatagaggcctccttttctgaatttagttcattgtactgcaactgtaccaatcatttggtcgcttttccagaaagctagctagggtgagtcagctttttttgactgctgacacttcggttgctaccgagctgccccgcgctcacaaaaaaatcgcccgaattgtgtcggacgattgggtggtaaacttcgattagtgaagctcaaccttcaaggccaattgcttgttggcaccagcagatagcgtggtgttgccgagcttggtgtaccagtcggttggttcgccagcttgatctggcagaccatcgaatggctcaacggcgatgaaaggtgcctttttatgttctgggctccagatggtgagatatgggaagtcgctgatatcgagggtgatgctgtggtcatggtgcggtgatgcgagggttgccttggcaatttcgctgttagcgagaatcacgagaccaccatcaagaagatcatgtgtcaggggcaaacgattgccttctgcgccggggatgtcctcaacatcgccattgcggaatggcacagggccgatgccgaatcgttgtagtgggctgtttaatggttcaacagtgaggtcgtaatcgtcgaaactgcgatcagctttcaagccgacattaaaggcagggtggaaccctaaagcaaatggcattgatttagtatcgtcatttgtgaccgtgtaatgtacgctgaggccgccgtccgtcaacatgtaagtgacagccaaggtatactcaaacgggaacttcttcaatgtctcagcattttgatgttgcgtgaaagtgaccgctgagtcgctcttatcgctgacatcaaagtcatagtcacgagcaaatccatgctgactcattggataggtttttgcgcctaaacgatattggtcctgatttgattttccgatagatgggaacagaataggcgcatgccgattccaaaaagtcttgtcacctgtccagacatactcatagttgtcggctttgtttaccaacgactgcaattcagcaccgcgctcggcaatgcctgctttaaatttgctgttttcaattgtgatcaagttgaattacctcctaatagacgaaaacgcattcaataccagtctaccactggatcactaacctgtaatgattgttatcaagttttttgaacttcattttgatgtttgcagtggtcacaaaaacatgtccgcagtcataaaaaaagaaccgatcatcataatcggtcctttcttgcaactatggttaaagattaaccttcaactttgtcggtccaaggggttgcagtttctgcaagcaccttgttcaaacgatcaatgttagccttgccttcggtctgcagccacttcttaccagcagcttcgccttcagcagcatatggcttaacacccggcttccaagttgcacggccacagagaacaccattaaaggctgaacctgcttgcttagcaaacttgagttcttcaaggaacaattcgttggtgacaccagcggacaggaagatgaatgggagatccgttgcatctgactgttccttgtaatacttagcggcttcttccttgctgtaaacaggggtaacgccgtcatcggtgtagccttcaacaaacttttgatcaactggaacttcaagcttcaaaacagaaacattgtattgcggcttgctgaattccttggtgatcttgatgaccttttcaggcttagctttagcccatgcagctgtaccagtttcgttggtcttaccatcgtaagaaaccaattcaaggaacagtggcaggtcattagcctttgcttcagcaccaacacgttcaacgaaagcatacttgcgatcattgatagcgtctggttcatccggatcgatgtagagcaagaacttaacagcgtcgccgccttcgttcttaatgcgcaaagcactttggttgtcgatcagatctgggaaacggccaggttcggtagcatcgtaaccagtcttttcatatgaaaggagtaggccagacttaggatcgcgaaccttagcagccggcaagccatattctgggtcaagcagaatagcgctggcgtatttggttaattcttcagagactgccttcttgaaatcaacaatcgtggtttcatcagccggcttgttagctgcagctgcaagcatcttcttcagggaaccgcgttggtcaatggccaaagctgagatcacattgtcatcgtttgacaattgcttcaagtgcttcaactgaccagcagtaagtttaacagacatgtaaaaatacctcctaggtaatccttaaatgttcagtacctccatagtatagaacaaaaaagaagtaatagacatttttcgcggagcattttcatgaaaatcaaagaaaaagcgcggataataaatggtttcttgaaatgatcacccgacgatgagcctaggcaaactgcgtgctatactctaaacatattgagaatttgtaaagataggtgaaatgcatgactgatttgatcacgccagagctggtctattttctgaatacacccacgcaagcagctttttttaaaacgattagcacaacacttgttgaccagcaaattatggcgccggctgggaaagaagcgttgatcacacgtgagcagacatttccttctggcatgcaactaaatgaagtggcagatggcttgccgaatattgccattccgcatttggaaggcgaattagtgaaacaaacgcggttggtggttgttcattttgctattccggtcgccttcaaagatttagccgatgctagtcggattttaccagtgaactgggtgttcatgctcatgaatgctgagccgcagaaacaaccggaacgcatggcacagttgattcgcgctttaacgcaatcgccagctgcgcaactgaagcgactatttgctgccaaaaaagccgctcaagttgcacggttgctgacaccgcttatgacagaagcataaaagaaagttgagatcgcatggatatttttgattcacacacccatttgaatgacacgccctatcaaggcaaagaagccgagtatatcgaaaacgctcggcaacttggtgtcaagaagatggcgattgtcggctctgacacagctttgaatgccggcgcattggcgttggcccaccagtatgacaatttatatgccattgttggttggcatcccgagtctagcaaggattatgacgcggccaaagaggcgttgttaatcaagcaactggcggattctaaagttgtagccttaggcgaaatcggcttagattatcactgggatacctcaccacgggaaattcagcgacgggtttttcgtcggcaacttgagattgcacgttcgttgaaaataccggtgtcaattcacagtcgcgatgcctttgacgatacctatgacatcttaaaaaaggctcatgttgaagacttcggcgcgatcatgcatagcttcaccggcgatgcaacttggggccaacgttttctggatctgggcttatacatttcatactctggcattgtcagctttaaaaatgcaccggaagaacatgccagtgccaaaattgtgcccaatgatcgactgttagtggaaacggatgcgccttatctcacgccgacaccctatcgtggccggcagaatcaaccgggctacacgcggtatgtggtggaggccttggcgaaattacgtgaaacaacgccggaagtgattgccaagcaaacatgggacaatgcccatcgcatctttggattaaaggaaaaagcatgacaactatcaaacaagtcgtggtcgttgaaggccgcgatgatacgaaaagattgaaagaaacctttggtgccattaacaccattgaaacccgcggcagtgcaattgacgaggcaacgctcgaacgcattcggcaagcacaggctaaacgcggtgtgattgtgctgaccgaccctgatttcccaggtgagaaaatccgcaaaactatttcccgcgcggttccaggggtgacgcatgctttcttgccgcgtcgtgaaggtgtgccggatcataaaggctcgttgggcatcgaacatgccaagcctgccgcgttgcgcgcagctttgcagcatctttttacagaaatgccagatgcaccgcaagtgattagtcagcaagatttgctcgctgctgatttagtcggtggtgtcggtgcccgccaacgtcgggaacagttaggcgagttgttgcatattggctacacaaatggcaaacagttgcttcgacgactcgcagagtttcaaattagccgcgcagcttttttggctgccatggcccaagtagatggaggacagcatgacaaaacctgaaaaagttgcgcagccagcggtcaccaacgctattttaaagcgccatggtttccatatgcgcaaaggcttaggtcagaactttttgaccgactccaagattttgcaaaaaattgtgacagccgccgatttgacccctgaggatgatgtgatcgaaatcggcccagggattggtgctttgacccaattcttagcggacagcgcgcatcaggtggtggcacttgaaattgatgatcggttgctgccgattctggatgaaacattggccgattatcctaatgcgatggtcgtgaatgaggatgttttaaaaaccgacctaggcgcattggttgccgagcattttgatggcaagcacaccttaaaggttgttgccaatctgccgtattacatcaccacacccattttgctccatcttttacgcgcacagctaccacttcatagcatgacggttatgatgcaaaaagaagtggcagaacgattaagcgcaacgtcggggtcaaaagaatatggtagcctgagtattgcagttcaactcgttgcgagcgtggcaactgctttcacggtaagccgccatgccttcgtaccggcacccaatgtcgattcagccattgtcaccttgacgcagcgcaccgaaccgcttgcagctttaaccgatccagccagttttgatcggctagttcgcggcgcttttgcttcacggcgaaaaacactctggaataatcttgtggtcttatttggcaaaactaacaaggctgccattcgatctgctttaacaaccgccgccattgaccctggtacccgcgcagagcggctttcaattgctgattttgctcggttagatcgtgctttgcgagcggcggatttaatcagtcaggctcacgcttaagcacgataaatttttactaaaaacaccagcataaatcgcttgccgaaataagaaacgcgtggtataattgcaaatttcttgctttcgtgctatgatagactgcaagaggtgaagtgcatgccaatcacactagcaagcatcaaacggaagctcgatggaaaaatcggtgagaacttaacggtcgttgcacaagctggacgcaagaaagtgacgcggcgacgggggactttgaaagaaacctatccggctatttttgtggtcgatctcgaccaagatgaaaatgcgttcgagcgcgtctcctacagttacgcggatctcttgactaagtcaattcagatcaccttcgaaggcgaagaaaaagcctcataacattgaattgttttaacaattaaatctgttataagaagacctcgatgtgagttgcatcgaggtcttttgctgttttgcatttcggatacggaaacagcaagtcacgcatcgttacgcgatttttaccgtgtatcggtgaaaatcagcgcataaaacagtatactaaaaataactatacggtcgatgcatacaacggggcttgcggtgatagtgattgaccggcaagcgtatgggtcgccagagactggtggttggatggaactgatcgaaaaagcaccggccaagattaatctcagcttggatgccttgtatcgccatgacgacggcgaacatgagtggcagatggtcatgacatcggtcgatttagctgactatgtgatgattagcccgcatcgcagcattcaggtttcgacagatagcggcttcctacctgaagatccgcgcaatctggcctacaaagcagcgttggcgctgcagcgtcacgccaatatccgtcaaggtgcgcggattcatattgaaaaacatattccggtcgccgcggggcttggcggcggctcaagtgatgcagctgccgttttgcgagggttgaattcgctttggcaactcggctatagtcggtcgcaattagcacggatcggcttaagtgttgatagtgatgtcccttactgtgtttattcagagacggcgctcgtaactggtcgtggtgatgtggtcaccccacttggcagcttgccgaatttttgggtcgtgttggcaaagcctcgcgtttcagtatcgacgccgaccattttgaatgccattgattatgacgccggtttgcgccatcctgatacgcaaacggtggtggcaggcattcaaaatcatgactttgcacaaatgacgagtggcatggcgaatagccttgaagccatcactgctagtcggtatccggaaatgaccgccctcaagcagcggctacaaaagtatggtgccgaattcgcgcaaatgtcaggcagcggcccaactgtttttggtctgtgccaaaagcactccagagccatgcgggtttataacagcatgaagggcttttgccgcgaagtttacctattacggccattttgcttatccgccacgggtccacggtttaggggttgatttttaggtaacgctaaaccatgatggggataggaaaatggaggggcggttgtcatggaacaagttcaaccaaacaaggcattcttctggggcattttactgaatacaatttatattattgctgaagtggcctttggcatcggcattggatcggtggccttggtagcagatgcggttcacaacttaggcgatgtgttgggactcggattagcgtggttcgcagattggctgtcaggacggcatcccactgtcgaacggacttatggttataagagttcttcgattttggcagctttggctaatgccgcgttcttattagtggctatgggtgccatcattgttgaggcggtcacccgactctcacaaaatgcacctgttgaaggcggctggatgatgctggtggcgggcgttgggattatcgtcaacggcgccaccgccttgctattccatggcggttcgcaacatgacttgaatattcgcggcgctttcatgcatatggccgccgatgctggcgtttcgcttggcgttgttcttgccggcggactgattttgctgactggctgggaatggcttgatcccgtgatgtcgatcttagttgccattgtcgttttggttggcacctggaatttgctgcgcgatgcggtcaaccttgccatggcagcagtgccaaaagatattgacccagtggcggttaaaaagctcgtgaatgcttacccaaccgttgcttcttgccacgacctgcatatttgggcattgagcacgaccgatgtggcactgaccgtccatgtcgtgcgcacgaccacagttggcaatgacgacttcctcgatgcgctcagcctatctttgcgcgaaagttttgatattgcgcacacgacgattcaggttgagtatggtccatacgagccgcaaaataaaatggagaacccttattaatcaagtaatttaaaaaacgttgtgtccgcatggccaatgcgagcacaacgttttttatgtggttgtcaaatgattcgttggacgattttttagcgcagttgtttacgggcattataaaagcgtggatagctgcggtaaacggcaataaagctaccgatactggtggcgcccagtaacataaaggtgaccatgatctgatacatgatggctttggtgggatcaatacccgcgaaaatcaaccccgacatcatccccggcaagctgaccaaccctaccgtttttgctgaatcaatcgtcggcgccatcccagttttaattgcattgacaatgagcgattgactggcttgcttgagatcagcgccgagtgccaaacgttcaaggacctgttgccgtaaatcattgaattctgtattcaaactgcgataagccaagccaattgccaccataacgttgctggcgatcatgccgcaaattgggacgatttgtgacgggacaaaacggatggctttgaccgcgaccagcatcaccagcgttaacccagtcgcggtggtgatcgccaacaaactcgtcacgagcgcatttggaattgtcccggcgcgttttttagcgttccaagcggcgttaaaaatgatgaccgcaatcatggccaacgtcagccagacagtatcggctttgatgatgtaggtcaggacgaaaccaacaacagtcaactggatgacagcccgcacaacgccgataatcaaatctttggtcatgccgagatcttcttttaggttgatcgctagtgcaatcaagaccaagataagtgctagcaataaggtgatgggtgacacaatgagctgattactcatgagcggcctcctcgaattgtccggcaactagccgcagcaattgtttcgcggcttgaatctcgccttcatcatgggtgacgcggatcaaggtgataccttggtcattttgtttttgtaataaggcatgaatgaccgttttggtgtcaggatctaacccagcagtcacttcgtcaagtaacagcacttttggcggaaagaaaagatgctgcaacaacgccactcgctgacgttcgccgccggaaaggtttttgaccggatcgtcgagcatggttttggctaaatcaacgctttctaaagcacgctcggcttcttcacggggcattttttgatgacgaatggtgaatggaaactgcagatcatcagcaacggtaccatgaaacaacgcgggctgctgcgcacaataagaaacttcgcgacgataactggtcggatcataatcgtcctgcggtttgccattatagcgaatggttccgctcgttggtgttagcagcgtcgccagcagacgaagcaaggtgctttttcctgaacccgaatgaccggcaatggtaagatctgcaccccacggaatcatcagattgatgtcatgcaggatcgcatttttttccggcgcaaacgtcacatgactcagttcaaaacaattcatggtttgccctcctcatttttcctctttataatcattctaatatagaatggcgtaagaagccaatcagacgtagcaatttttccgttaaaaagaaacacaagatgagcaaatgcgaacgttcgttgaaaaaacaacgcaaaagggtcgaaattttcggttaaaacgtttatacttgttgagattatcacgcaatgttagtgtagtgctaaatattcggtgttaggagcgaaatgatgaaagtaagacgaagtgaccggttaattgatatgacccggtatttattagaacgaccgcataccttgattccactgacttttttctcaaaacggtatgagagtgcgaagtcttctatcagtgaagatctggctattgtccggcgaacatttgcccagcgacagacgggcattcttgaaacggtgccaggcgcagcaggcggtgtgcgctatattccgatcatgggagaagatgaggcggaaaactttattgccgcaatgtccaaacgtttatccgagacagatcgcttattgccaggcggctacgtttatctttccgatctgttaggaacacccagtgtgctacggcaaattgggcgattaattgccacccaatatcgcgaggcccatgtcgatgctgtcatgacggttgcaaccaaaggtattccaattgcgcaaagtgttagtcagtatctgaatgtgccgtttgtgattgtgcgccgcgactccaagattacggaaggttccacagtgtccgtgaactatgtgtccggttcatctgcgcgaattgaaaagatggaactgagtaaacgcagcttaccagctaactcaagagttctgattgtggacgacttcatgaaaggcggcggcaccgtcaatggcatgaaggctctgattgatgaattcaatgccaaaatggtcggtattacggttttcgctgaaggtaagttcgacggtgatcggatggtcagtgaatatacatcattgattcgggttgacaaggtggacactaaagccaatacgcttcatgccacagctggcaattttctagatcagaatcgtcaactactcgaggtggctggtcaatgagtgcttatctcggaccggtcagaactgcgatcatcacgtttccgtttttagcgctggtgttggcattaccatttctggtcgtcgtttatcgacggtacggtgcctttagctggtggcgtgcagtcgtgatctactcgttcgtcttttatctgctatcagcctactttttgattattttgccgttgccttcgcgagcagcagttgcgcagttcaccgggcctaaatataatctggaacccttcatggcgttgcgttatttcgtgcatacaaccgtgttcgtgccaaccaatccgcatacttggttggcagcgttaaagcaatccgctttcattcagccgttctttaacgtcgttttgacgattccgtttggcttttacttgcgctattacttcaaacgcagcgtgccgcagattatcttgatgagttttggcctaagtttattcttcgaactgacgcaattgtcaggactctacggttattatccgcgtccgtatcgactctttgacgttgatgacctgattttgaatacgacaggcggctttttgggcggtgtgtttgcaccaattctgatgcgcgcgttgccgtcacgggacatcattgatgcgaaaagtcaggcgcgcggtgctcgggtgactttggctcgccgatttgccgcgtttatcattgatttctttctcttcagtgggattattggcgtgttaattcaaatcttgctgcatttgctgggactggatcagctaccaggttttctcggcaattatgtcctgccgctattctttgtctttgttctttggccagcatttaatcaagggcagacactgggaaaaagtcttgtacgaatcaaaatagttcggacaaatggccagccgattgggttctggcgtctctttttacgtgagagtctgctttacgagctggctttgccgagctttatgggattgaattacttttttggcgagtatttcggcgccttccatcaaaccgaaatcaatttagcggcactgggattctttggcctcttgtcgctactctttctcatcaattttgcatgggaaatcatttcgcgtcatcaccgtttcttttacgatgcatggaccgataccacccaaattagcaccttccagtcacaaccaaaagatcctgttgctaggcaggattcaggcaatgacgatgacatacaaaagtcataagccaatcatagtcaacaacagacccgtggcaacatgggtctgttgttgtggacagccacagacacaagccacccacttgttgtcagcttcccgtggctgggctatcatgaagacagaatattaggattggagcataaacatgtcaaagaaattcaccattattcttgcggccggtaaggggacgcggatgaaatcaaagtattacaaggttttacagccggtctgtggcaaaagtatggtcgagcatgtggtgagtcaggtggaagccatccatcccgatgccattgtaacaattgttggccatggcgcagaagcagttgaagaaacgctaggcaagcgcacgaagtttgttttgcaatctgaacagttgggaactggacatgccgttttacaagctgaaccgttacttggtcaaaaagaaggcgcaaccctcattatcagtggtgatacgccattgtttaccgccaaaacgttgaatgatttatttgcttatcacgaagccaaaggcgcaaaggcgactattttgactgccagtgctcctgatccaaccggttacggccgcattattcgcgactcagacggcaatgtcgtgaagaatgtagaacaaaaagatgcaacgccggaagaagcattgatttctgaaatcaataccggcgtctatgtctttgacaaccaggctctgttcaaggcgttgcatcaagtgaataataataatgcccaaggcgagtattatttgccagatgtactaggtattttgcgcgacgctggcgaaaaagtggctgcctatcagatgccagattataccgaatcattgggtgtcaatgatcgggtcgcattggcgcgggcaacccgcctgatgcagcagcgcattaatgaacagcatatgcgcaatggtgtgaccttaattgacccagcaacgacttatatcgataccgaggtcaaaatcggtgccgataccgtgattgaacccggtgtttacttgaaggggaaaacagtcattggcgaagattgccatattggtacccactctgaactagtcgatgccacactggaaaatgatgtcacagtaactagttcaaccatcgagcatgccgtgatgcacgctcatagtgacattggtccaaattcgcatctgcggcctgatgctgacatcggcgaatacgtccatctaggcaattttgtcgaaattaaaaaagccaagatcggtgcccgcaccaaagttggtcatttaacgtatgttggcaatgcgaccttgggaacggatattaatgttggttgcggcgttgttttcgtcaactatgatggcgttcagaagtgggaaagcaaggttggcgatcatgcctttatcggttcaaattccaatattgtggcgccagtggatgttgctgaccatagctttattgctgctggttcaacgatcacaaaagatgtcccgtttcacgcgatggccatcgcccgcgcacgacaaaccaacaaagatgatttttggaaacgcctgccgctggcaaaagatccagattggaattaggttataattctattcatgtgcttgctttttttcgtcagtccgctaagatttctgtggaacaatttttcgcagcccataacaattcgtggaggaacatatgtctgagcaatacggtgacccgagattaaagatttttgctttgaattcgaacaagccgttggcagagaaaatcgctgccgaggtcggtgtgaaactaggaaagtcgtcggttaagcggttcagcgatggtgaaattcaaatcaacatcgaagaaagtattcgtggggatgatgtttatctcatccaatccacttccagcccggttaacgacaacttgatggaactgttgattatgatcgatgctttgcgccgcgcttctgcgcatacgatcaacgtggttatgccttattacggttatgcccgtcaggatcggaaagcccgttcacgggaaccgatcacagccaagcttgttgccaacatgttagaacgtgccggcgccacacgtgttttggcgctggacctgcatgccgcgcagattcaaggatttttcgatattccggttgaccatcttgtcggcgccccattgttggcagattacttcttacggaatcactacgatggtgccgacaccgttgtcgtgtcacctgaccatggcggtgttacccgtgcccgaaaactagcagaattcttgaaggcaccgattgcgatcattgacaagcgccgtccgcgtccgaatgttgcggaagtgatgaatattgttggtaatgttactggcaaacaatgtatcatcattgatgacatgatcgacactgcaggcaccattacgctcgctgctcaagcattgaaggatgccggtgcgaccgaagtgctcgtggccgcgacccatgccatcttctctggtccggctgttgaacgcttgacccactcagctattgaaaaggttgttgtgactgactccattaatcttccagctgacaagcatatggataaactggatgtggtttcagttggtccgctgatgggtcgcgccatcatgcggattcaggaaaatcgttccgtgacaccgttgtttgaaaatcggtttacgaaatagtactaaaaaagctgcacctatattcaggtacggcttttttatttacctgcatcattggtgttgaagcaaataaacgacatatagtcgcaaggaagtcatataatgtgaaaagtagcatagcgactatcgtgtaaatgcttgattggtgatgttggtgacctttttctattccgttctactgctggatccaccgttagttttgtttgccgagacagtaaccaactacttgcatcaaacaaagcgtcattagattaacagccactgagattagctgaaaagggggcacaaccggcagatgcgaatgggattagctcacgatcagtttttgttagtcaaacaaggcagcaaaacgattgagatcagactcaatgatgaaaaacggcaacaattaaaagttggcgatacgattgtgtttgaagacaccacaacggcacaaacacagcgcaggacagtaagtgcactggaaaaattcaccagttttgctgagttgtatcacaaatatagtggtccgcaggtaggcagtgcaccaacggattccgaaacgaaaatggttgcagatacgtaccagctatacacagtatggcaggaagcaagctttggtgttttggccattcatttacaaccagcattttaatgacaacgacaaaagcgacagtcatcatctgaaatagattagatgactgtcgctttttatgtgcgttgatgatcaataaaccagacttttgaatgctttcttagaagtcaccaatgactgtcattttttcaagctaccggtgtaaatactgtgccaatttatcagagcaattttaagaagatggtggcgatgatgactgaggcgacggaaactgtggcaaatccgccaaccagcatcttcggcatcatttgttgggttaagtattcctcttcatcttcggttgttgccatcgctcgcgccacttccgaagtcaggatgtagtggatgtagtccgctgggaagccaaaaagagctgtcagtgagcaagaaaatgccatttgccaagacataccgaatggtttagcaagtagccgcgatgctaagaacatgcccagaacgcccaaggcaattaggacaatgatttggaggacaataccaccaagcacagctggcgtggtggcactcagttgaccaaagacataggcgagcaagccgtacatcaaccagttaaagacgccagccttgttcaaagcattgtcctcaagaaaaccgatttgatgcgcgataaccccgaagatcaaacaaaccacgttagaattgatgacattgtttgtcaatgtcccaaaccccatttgttgaatttaaattaatgtacagctatgaaaccccaagcttttggtaaagaaccaagttgtcaaacaagcgttaatattcaattattcatataaaaagtggccccgcgcaaatactgcaacgaggccactttttatatttatgggataaagcgttgtacaagatgattattttaggttattagacctgttgatcttgctttaacagatcgcgaatttctgttagcaattcttcttgtgtcggaccagctggtttggccggttttgacggtaaaatgcggttaatacctttgactagcagaaagactacaaaagcaataatcaagaagttgagcacgtcattgataaaattcccatatgtaaacttggcgcccaatatcgtgaaataaagcccgctgaggtcagctttgcccgcaaacatggataaaatcgggttgataaggtttttagttaaagaggtgactaaaccagtgaaggcactgccgatgatgaccccaacggctaagtctagcacgttacctcgcatgataaatttctgaaattcttttaacataaacagtaactcccttcaaaattagtatactgaaatcaacacttatgctgcatctctgcggcttatcccagatgccaaacccgtaagaattcagcaatcgcaatcaagacaatgaggccaaatgcgacagcatgccgtcgcttatatagaaccactaaggcgaggtattcgcgaatcaccgcattgggtaggaagtagaacgaagtcgcgccgccgacaccattggcgacaatgccagccatgcgggcaaagatgcctgcacgaaacaaatggtaattatttgtgaaaaagctagccttataaggtgattcaccaatttcttgagtaatgagacgtttggaaaattgcatattttccaatgtggtggttgactgatcctcaagaagcgtgtcaccttcagggatgcctttccctaaagcgtatcgttgcatggccatcgcttctgagatggcctcatcgctccccttaccgccagaaaaaataattcgcggcgctggtcggccctttttgatttgtttgcgatagaacttgatcgcagcatcgattcggctcgctagcaacggtgaaacttggtcgccatgtaacaaaccggcgcccagcacaatgagaaatgtacgattgtgcggttgcggacgaaagttatacagaatcaaaactgtaagaaaattatacaacgttaagagcacataaaagccgccgagaccaaaaaagattgcaagagagaagtacaacggatcaggaatgaaccggcgaccaaaagaagcagcaatttcgatcagcaacaaaccaattgcaatatataaagtcagcatattgctcaatgaatgaccttcacgccgccaaaccagaatggcattccacaacaaccagaataaatgcaacgcaaagagcaaggcaacgatcaaaataatgatcaggaacaatacgccggtgaccgatattagcaacaaattgcctgaccttaaaatggcaatcgctaacgccacaagaaacgtgaccgcgaaaaaattaaacaagacaccattaatcaaccgtcgcggctccacggtgaaactaaaagcgaagatgacacctaatacgatcggtatcgcaaaaataataaaaagttcctgagctgacattggaaagtctccttgtgtagaggttaaaaaatgattagggtataatgtgattaaaagcggaggtaatcaacatgatcgatcctgtgtttggccgaaaagatccaaagttagattatcatacccggattggcgcatatggcgtcataccggatcatagtggcgctcggttgctgattctgcaggcgcccaaccacgccttattcttgccgggcggcggcgtcgaggaaggcgaaacgccagaagtcacgttggcacgcgaactgttagaagaatttggcgcaaccgttcatgtcacccaaaagttgggcaagtcatctgaatatttttactctcatcaccgtcaaacagcttactatcatccggcaactttttttgcttgtgatcaattggcgtttgtacaagatccgctggaaacttttaataccttgatgttaatgccgattgacctagccctcgctgagctgaaacgaccgacccaccgttgggcagttgccaaatggctagccaatcaacctaagcgataaggcagtcatcaatcgttaaagtgtggatcaatgagaccgccattcagcagataatgctggaacttttcataaattggcgaaaacaggttactgtcttgcgtggctagcatttcttttggaaagtagaaccgtttgtcaccggttgcccgaccgctaagtgccgcgactaacggtgatagggtggagagctcctcaagcgtcccatctttttgcatgatctcgatttgcgtttttggatttgcggaagctgggtcgtattggtcatatggtaagtcaaaactatcattttccgctgtgtagtagtgcgggtcaaagccggctgatgctaccaaatcccttaagcgtggcaagagataggctgtttggtcagtaaaggtcacagacttcagtggtcggcggttcaagaagcgatcagcaaaatcgcttaagatactgtctggataatctagccagtaagtgaagtaagtgtttaacacgccatcgtcgagtttcaaatagtcggtgaggttaaaagtttgttcaaaaaatggcacgagtagccgcggcgaaaagccagattcaaactgaccggactcatacaggaatttggcacgttttagcagatggaaaagaatgacttccatgccacgagacacagggtggaaataaacctgctggtacatctgaaaccgactgacaacataatcttcgaccgcatgcatgccgttggcttcataagcgatgccatccgagtatggtcgcatgactcgcagaattcgcgaaaggtcgaagagaccatacttcgtgccggtgtaataagcatcgtgcaacaaataatccatccgatcagcatcaatctgactggagatcatttgcacgacttgcggattcggataggtgtggttgataaccgatgcgaccatctcaggaaattccggaccgacaccacgcagaattttgttcacgttcgtatgcgaatccgtgagaattgctcgcgtaatcgcctcgtgatcagtgtcgaaaatgtgctcaaatgtatgcgaataggcaccatggccgatatcgtgcagcaaggcggcacacaacacgactggccgttcggcgtcatcccataggccatcgccaggtgtttgtgtcggatagttgttgacaaagttgtcacacatctcacgggcaatttcataaacaccaagtgaatgggcaaacctagtatgttcggcgccttgaaaaacataatcagaaacgccgagctgtttaatgcggcgtaatcgctgaaattctggggtattaatcaggtccagaatgacgcgatgttgcacatggacataattatgaactggatcgcgaaagactttttcgcgaggtaacttttcaaatagcatcatgttctcccatcttttttaggctgcgattgcgcgtgtgcaaatcggcagtcgcttctgtcagcgccttatggtaagctggatcgcgcaaaagggttggcattgaattcatatcagcggcgatgccagtgtcagccaaggcatttagcaaggcgaccgttgcttgctcaagcgttaacggtcgtcccagcaagtcgctaagagtcgtcatggtttcggatcgaatcacggggaaggtaaaatgtgagctggcagcagccttgccttcatgatagaatcgccgaagcaaggcacaacgagcgtcttgattaccgaaaatactgcaataaagcatcacaacgatgccggcgcgattacggcgttgggccatgcccgcaaacttttgtccgcgaacacttaagtcgtatttaccgggacaataagagtggacgatttcagtggtcgcaattggcagactcggaaacgcggtgcggaaaagctgggtcatcaactcgtatgcgccgttaattgaaagctcgtcttcatttggcaaaaatagcgatacattcaaaaccccacggtctgcaatgaccgctaaaccgccagaattacgaacgaagaaaccatagccatcacttgccaatacccgcaatccacgaccgagttgcggcaattttagatcttgcatgcctagaatgacggtttggtctgccgtccagaaatgcagcatcaaaggcgggtgcaattcaggatgtgccaataacgcgttagtatgggcaaaactgagcggcgcctcgtcttttgtaaaattttgctgaaaaattgctgcctgctggccggccagtgttgtcaagtccatcacgcgccttctttctatatgatagattacttatattatagctaaggtaacaagccacgtcagttggaactgcattttcattgcatatcttgcagtaagtgatttgaaacatggataattgttacgactcgaccagtttgacccgtgggcgtacaatagctgttagaaaggattgacattatggatctttcacaaggagtgccgattcaaattcaccttgagacgtttgtgacgcagggtgaggacaatgagacacatgtttttgacgaacctggaacgttggtgcagatgggaaacgctttatacattcgttaccaagaagttgacgaagatgctgggaccagtatgccggtgacgatgaagctgcgtgaagatggcgatgttcagttgtcgcgtggcagcagcaacggcgacactcagctgaaactgttctttgccaatgaaaagcgcgtgctgacgcgctatcgcacaccgtacggtatcattccggttgaaacggtcacgccacggattgacgtgcgcatgacaactgaacctgtggcaggtgaagtctatattgaatatcaactttttgctaataaccagcacttgggtgattatcgattgagattgcaattcaacgcctgagcgtgtatgatgaaagacagactgtataaactgtggaaagggcgtgtatcggttgaaactcaaagcatttgccaatgccgataaatcagaattatcaatgatcgaagtagcccatgagatcctcaaagaaaaaggggataccatggcgttcgttgatctggccaacgagatccagaattatcttggtaagcgtgacgaagaaattcgtgaacgtttaccgcaattctacacggatctgaacgtggatggcagtttcatttctttaggcgataacgtttggggcctgcgcgcttggtatccatacgattccgttgatgaagaagttaaccatccggaagatgaagaagaggcaccacgtcgtaagaagcgtaagaaggtcaatgccttcttagcagacgttgccgacgatgatgacgtgatcgactataacgatgatgatcctgaagatgaggatctcgacgcagatagcgatgacgacgatgatttcgatgacgatgactcaggcttccacgacaaggtcgggaagacgactgacacagacgatgacagtgatgacgacccagatgatgggttgccagatggtatcgaaggtcagctagccgaattcggcgatgacgacagcgacgatgatgatgataacgatgacatcaccgctgacttctctgatgacgatgatgacgacagcgattcagatgatgatgacgatagcgacaccaaaaagtaatgtttggcgagccgtgcccatgtcttgtggggacggctttttttgtgtgcgcgagcaggcgcaattagcacccgaagtactagccaatacaggtcaacatggattggttttgatgttttagttttggaggctcgtatatagcttgctgcgtctgtggatccactttctgaattgggactgaataggtttttgcgactgtgagcctgttatgaagctcatttcaggtccatcagtaggcaaatcctagaaatggcatactgaccaagatgatcgtgttttgccgctatttgtggtatcctaaaaactttaaaagtgcgagtgttacaagttgactgctcctaaatgtttttttacgctttaagaccgttgacaatttttgacaaagcacgatactttctaacaagagggggatctacgatgatttcaaaagaacttaaaacccggttagatacgttcattgacgctattcttgcgattattattaccattatggtcttggagttgcctgcgcaaagttgggaacatcatgccaacattaccaatttctttttggcagttggggtgtatgctgtcagtttctgtttcgtggcgaatatttggtaccagcaagcaactttgttcagcaccgttgatcagattccacgacgaatcgtgctttgggaattcatcttggttttcctactgtcactggtgccagcattgacgcgactgatgtcaggagatgttgaatccatctctgtgattatctatggtgcgatctactttttggtaattgtcgtatttcgacttatatcaaggacaatcgtgcatcaacaagccaatgataaagacgaaatgcggaaaatttataccagtatttatggggagcacaacttagaaaatgttatcatgatcgctgcgattatgattttagctatttttgtgcccaaggcagcgtatattttgtacattgcgattcccatccgttccttctttacgatcgataatgatgaattaaccggcatccagcaaatggaaacaactgggcaacaagattatttgcgcatgagccatgaccagcaagtgaagttccgccgtttggttggcgagttcattcgcgagtcgcgcaatgctcgaggtaatactgaaattagtcgaacagcatgggaaaacttcgcgaaagcagctgaagcagagcttaacattaatccaacaacactcggacattggtttgcggcttttcagcaggcaaaaaacacacatcaaaatggtgcaccctatcgtcagggacgaccgagaaaagtccatgattaaaggatttatagcggaagcagaaagctgactttaaggctgtctttgagacgtgatgttatttatgattatttgggatatttcatacttaagttttaggccttgacgtctttgccacaattagttaatatacagcttgggcgctttacaaaatgtaaagccaatacggttcaagctccctgttcgtatgaatagggagcttgtttttgttttttcccgattattaaaaaaggagactggctatgaccaagtatatttttgttaccggtggggtcgtatcgtcattgggtaaagggattgttgcggcatccttaggtcgtttgttaaagaatcgcggtttgaagatcaccattcaaaaattcgacccttatatcaatgtcgatcctgggacgatgaacccttatcaacatggtgaagtgttcgttaccgacgatggcgcggagaccgacctcgaccttggccattatgaacggtttattgacatcaacctgaataagtacagcaacgtcacaaccgggaaaatttattctgaagttctgcaacgtgaacgccgcggtgaatacctcggtgcgaccgttcaagtgatcccccacattaccaacatgatcaaagagaagatcatgcgggccgcaaagcatagcgactccgatgtgattatcacggaaatcggcggtacggttggcgatatcgaatcattgccattccttgaagccattcgccaaatgaagcgtgatgttggttcggaaaatgttttctatattcatgccagccttgtaccgtacttgcgcgcggccgatgaaatgaagacgaaaccaactcagcacagtgttaaggaattgcgtagtattgggattcagccgaatatgctcgttgtccggactgaaaaaccgatcacggaagatatgaagaagaaaattgcgcttttcactgatgttccggaaaatgcggtcatcgaatcacgcgatgcaaagacgctttattcaattccgctggcattacaagcgcaaggcatggatcagattgtggtcgatcatttcggctttgatgtgcctgatgccgacatgcgtgcttggacgcagcttgagcataaagttcagcatttgacccataccactaagattgccttggttggtaaatacgttgctctgaaagatgcttatatttctgttgccgaggcgttgaagcatgcgggctactattgggactctgatattgatctgcaaatgttccaagctgaagatgtcaatgacgataacgttgaaagcttgttgcaaggctttgatgggattcttgttccgggcggattcggtgaccgtggtttggaaggcaaaattgccgcgattcgctatgctcgggaaaacgatattccattccttggcatttgcttaggtatgcagatggcctcagtcgaatttgcgcgtgatgtgctgggcctgaaagatgctggtacaactgagacgcaacctgatatcaaggacccgatcattgacctgatgcgtgatcaagtgggtgtcaaaaatcttggcggtaccttgcgacttggtctttatccatgtgttctgaagccaggttccgttgcagcgaaggcttatgacaatgcccatgaaattcaaaagcgtcatcgtcatcgttacgaattcaacaccaagtatcgtcaggcaatggaagaccacggcttggtattttccggtgtcagcccagacaaccgcttgatggaaattattgaatatccgaagaacaagttcttcgttgccccgcaatatcacccagaattccaatcgcggccaaacaagccggagggattattcaaagccttcattcaggcagcaggcgattttaaagcttaatagcaggtttcattgatttataaaggccgtcctgaggtatcattactttgggacggcttttttggcagatgaagcacttggggggcaactcaggttcttaaacgcgctcgctggcgcagaaacctgcatgtaaggaccatggccgcaatggtcaaagagcgaccatcacgaccaaggccacttacattccggtttctaatcgcaccagttcgcgctcttgcttaaacgcgctcgctggcgcagaaacctgcatgtaaggaccatggccgcaatggtcaaagagcgaccatcacggccaaggccacttacattccggtttctaatcgcgccagttcgcgctctgttcttttagtccttgttttttcccatagaattcattaaacttgtatgttgagtgcatgatgagtttgttgtgcctcgcctaccagaaatcgcagtttattttgaagcatagatgcaggccagcttcagcctatttgaaatgaacgacctttaagtgaggatttaactcaatggaaaaaatgctgatccacggcgggaagaaattatccggtgaagttgtgatcggcggcgcgaagaacagtaccgttgccttgattccggcggcgattttgtcacgcaccccggtcacacttgattcagttccacatattcaggatgtctataatttgatggcgattctggatgacatgaatgtcaaatcggattttactgagaacgtcctaacgattgatccaactgaaattaacgatgtccccctgccaaatggcaaaataaaaagtttgcgcgcttcctattacttcatgggagcgttattagggcggtttggtaaagcaattgtcggcttgcccggcggtgatgatattggaccacgaccgattgatcagcacataaaagggttcgaggcactgggggcttccgtcagcaatgaacacggcgcgatggccatcaaggcaccagctgaaggcttgcacggtgcacgcatctttttggatatggtgtccgtcggtgctacgatcaatgtcattttggctgcggtaacagcaagaggccggaccgtgatcgaaaatgctgccaaggaaccagaaattatcgacttagccacgtatctgaataatatgggggctaaggttcgtggcgctggtaccgatgtgattcggattgacggcgtgccaacccttgaagcacacaactcacataccatcatccctgatcgaattgaagcggggacttatttggcgatggcggcagcgatcggcgaaggtgtgaaagtcaaaaatattatttctgaacatttagatgcctttttagctaaattagaggaaatgggtgtcgtcatggatgtcggtgaggacagtatcttcgtttacccgtctggtgatttgaaaatggttcagattaaaaccatgccttatccaggatttgcaactgatttgcagcaacccatcacgccgctaatgctgaaagctcatggcgagggcttgatcatcgataccatttatcctaaacgagttcggcatattcctgagttgttgcgaatgggcgcggatattactattgaaaatgacgtcattattttgcatcattgcgatcatttgcaaggcactgaagttgcagctgaagaaattcgcgcaggtgcttgcttaatgattgccggtttaatggcggaaggcacgacaacgattaccaaagttgataatatcttgcgtggttatgatcgtgtcgtcatgaaattacgtggcctcggcgcagatgttgagttgattgattgagattgcgtttgaaccatgaccgtgatagactattagagttgttgtaagagtatctctagatcaggcaatgatttagggcaaaaggagtaatcattatgaagcaaggcatccatccagattatcatccagttgtctttatggattcagcaactggtttcaaatttatctcaggttccaccaaaacttcaaaagaaaccgttaagtgggaagacggcaaggaatacccattagtccgggttgaaatttcatccgactcccatcccttctacaccggtaagcagaaattcactcaggccgatggtcgggttgatcgtttcaacaagaagtatggtttggacaagaaataaaccaaaaacagccaatagggctgtttttttgtagttaaaacttatgaatatataagtggatttataaaatgaacagaattgttgttgaaaatggaaccacctaagagttagtgaattgctatacttaggtcaataaggcagatgtatttcagccttaagcttacacattaacttacactcccaaaaaagttcccccaaacttttccaccctcgtggtggtttttttgttgagtaagaaaaggtatctttagttgcgttgtgccttttctcacgtttcagaggctatcagcgctttgtcattatctgcacgatcatcagtttgacgcatcacaagcgaccaaaaaggcagccgcaatccggctgccttttgacatcaaaaaattatttcgcttttggcatcacattatcaatcaaatcttctacctctgggccggacagaatttgttgttcaagcttgaggttttggaccactttaccatcacgaatgataatgaggtaggaatccttgtaaccatcatttaaataaacgaaggtaatccctgactcaacgatgacctgtgctgatgcagcaccacccataatcgggtcagcgctggcatcactgtaaaagctgatggtccgttctggatcaggatcattcaacaaggtgagctcaaattctaacttggttgctgtgtgctcagtgtcaaaatttgcgtcatgtgtgagatcattgacataatagggaaagtcaaaagctttagcgacatctttcacgacaaattgactcatagtgacgagttgatcttcaggtaatgttttgatcggcatagataacacctcctatctttgagtctacaccaagcgcttacaaagaggtagtaaatgacttgccgcgtcatgttacattaaagaaaaggggcaaaaacaatgacaaaacgatctaactttttatactggctgaatgtcggtggcgacctgctttacttattgattgttggtggcctttatatcagcggccgctcgttatttcacggtcagatgatgttattggcgcaggttgcgtccggtatattgattgtcagcttaccgcgattgatggagcggtggtggcattttagatttccaccggttttaatttacttattcgagatctttattcttttaagcgttttactggggacaggattgcaatgctacagtgtgccttattgggataagtttgaacatttattcagtgccgcgatgctcgccggtttaggatttgctatttttgcggcattgaccccgcaaaaacggttgacatcaacaagcccgttgctgatggccttgtttgcactagcttttggcaccaccatcggcgtgctctgggaattttatgagttcacctttgatgggttgttaggattgaatatgcagcggtacatggcgactggcggcgagctactgcgtggccgggcggcattaatggatacgatgggtgatttgtttatggacttctttggttcgttgggacttgctttgtttggttattttggaatcaaacgggatctacgttggttggacaccttcgcattccaacctgaccataagtcggttaaccattagccgaatacatgctgcagtgtcagcgtgtcgttgggtgtgaggaagttgggctggtaacgggtgagaaaatgaaattcttccatcccgacttgccgcttagcttcctcttttgattgggcgagccatcgcagccatgggccaattgcttggccggccatgaattcgcgcgcgtaatcaaacagcgctggccattcagccgctgtcgcgatgacggccatatgtccaaaaatctgcggatcgactgaaatttctggcaactttgcttcatgaggctgcaattgcttcatgaaagctggcaaatccatcgccactgtcagccactggtcgacttcggtatcaatatagcgaatctggcgtggctcctgctggagatcgaagccaaaatattggtgcccggttttggcaaatggcaaaaaatgtgctggcaaatcgcttgaagtcatggctgggccaacagttgcaaaggcgtggatacccacgccgtcaatggcatcactcgtcggctccttagtcggaagccaccaattcatcggtaaaatacctgtttgaatgagcttaaaataagcaggcggaatggctgctgtttttggaatcgttggcaaatcaggacgagggataagattaggccatggttgtaacatcataggtcaccctttcttagatagaatgaggagagctagcgcagaaaccgggttgacttacgctctgattgaaacgcgttcgctggcgcagaaacctgcgtgtaaggaccttggtcgcaatggctaaagcccggccatcacgaccaaggccacttgcactccggtttctaaccgcgccaactcacgctctgattgaaacgcgttcgccaacccagaaacctgcacataaggaccttgaacgcaatggccaaggcccagccatcacgttcaaggccgcttatgctccggtttctaagcgggttggctcacgctcttaatcttaacgcatgccatgccgtgaaagtcgtataattaagtcgggagtattgaaggggttttaaacgtgcgaaatgcgatgatttatgttcgccatgaaccgttggcgcatttgtttttgacatatggcatttcagcaagtgatttgctgagcgaccatctaaaagtaccgaagcatctgttattgctgccccctgtggatgagcaggaacagatagatccgcatacttggttcaatattatcgacggcgcggatcaggttcaggactttttgcggagtaaagcgggtcagacgcgttgctggctagattattcaagcccgcgatttttgcaggaactcacgcctaacgagattgcggaactgctatacttaggacatgccaaaacgcatttaagttcgccattttactacaaattgaaaaacgagttggtttacctgccattgcgaaacggtatggtgaatatgtatctgcgtaacgaatctttatttgcgaccttcttagcaaacgccattaacaagtatatgcggcgaattgctaatgaggaaccattctggttacgcttacggcaacagcacttttctcgcgtgtcacatgccgtctatacacagtttttaccattattggaagatggcgtggtatttgatttccggaacgtccggttttctcgtgaaaaaatcagtgtgccacttttggcaccgaaagctcggttcgttcctgatggtatcttgacggatacagatgtccggcgattgggaatgcttgttttgatgcggcaaaagaatcagtggatgatgattgatgatgctgcatctgccgatcatcgccaataatggactgttttaacctgttcttaaacaggatgaagttgaagaattggagtcgaattaattatgaagatgacattggcagagattgcgcgagttgtgaaagctcaactgctctctgaagcagacgggtcgcatgtggtgaccggactggtttttgattcacgcaaattgaagccgggtatgctgtttgtgccgttacgcggtgaacgtgatggtcacgaatttattccggcggctgctacggctggcgcagtggcgacatttgttgcagctgatcatttacctgtcaccaccaagctgattacgctggtggtgccggatccgttgaaagcgatgcaacaattggcacaatattatctgttgatgaaagtgaatcccaaagtggtggcgatcaccggcagcaatggcaaaacgacaacgaaggacatgaccgctgcgatcttggccacacaatatcacgtcgttaaaacccctgataactataataatgaaatcggcgtgccaatgactattctcagcatggaacccaataccgaagtcttggttcttgagatggggatggatcggccagggcaattacatgcactgtcaaccttagctgaaccggatgtggccgtgattacgatgatcggggaagcacatattgaatttttcaagacccgggataaaattgccgatgccaaaatggaaatcactgatggcctaaaggatgatggtacgtttatttttaatggtgacgaaccattgttgcaggaacgggcgaagaagatcacgcaggagcgcgaaacttttggcttgcatcctgaaaatacgatatttgcccattcaatcagcgggcatcgtaaccacactgagttcacagttgaagcttggcctgatctgacgttctcgattccgattatgggtgaatataatgttgtcaatgcgttagcagccttgttagttggccgcaaattccatgtcaaacccgaaatcatgcaaaaggcattggctcattttcaggtgacggctaaccggacacagtggttgatcggggatgtgggtgaacagattctaagcgatgtttataacgccaacccgaccgcgatgaaagccgtcattcatgattttagcgaatttacggcaactggccgtcacattgcagtgctaggggacatgctggagcttggtgaacaaagtcccgcgttgcatgcaggtctggcagaggcactcgatcctaaggaagtgcaggttgtttatctatacggtagcgatatgaaagcacttgccgatgcattggcagcaaaatatccagccgatcagttgcactattatccgcttgatgacaaggaacagatgacgcgcgacttacaaaacgatgttaaccatgacgatatggttttgttgaaagcgagtcacggattgcatctggaaaccgttttgtcagctttggtcgctggtggtcgtgcttaatactagcgttgtaagcataaaggccgttccatgaaaatgaaacggcttttagcatgttttgacggtttttattcttttaaaaatgtcagtttaggcttaaataagtatgtgttgactgaagcttttggtgattatgcaagacttggccgaatctcggcacttgtttttttatagtgagcatgatactattgttcggatatgtttttttgtcatttactgaaaatgcacgtgatgcccgcggattcctttgaaaacacgcttgggtaaacgcgtgcaggaattctcaaggaggaactcatttgaagtttaaagaactaggtttggatcatgatctcttaaaggcaatcgcccagtcaggttttgaggaagcgacgccgattcaagcggagacgatcccactggttctggcaggcaaagatgtgatcggtcaagcacagaccggtaccgggaaaacggcagcgtttggcttgccgatcctgcaaaacatcgataaggctgaccggagtatccaagcattggtcatttccccaactcgggaattggcgattcagacccaagaagaactttatcgtttaggccaagataagaaaatcaaggtccaggcagtttacggcggtgccgacattcgccggcaaattcgccaattatcagaacacccgcaaattgtggtggggacaccaggtcgaatccttgaccatattggccgtcacaccctgaagttgcaaaatcttaaagtcttggtattagacgaagcagatgaaatgctcgacatgggcttcatcgatgacattgaaaagattgttgaacaaatgccaaccgcacgtcagactttgctgttttctgcaacgattcctgcttccatcatgcgtttgaccaataagttcatgcatgaaccggtcaccgttaagattaaggcaaaggaactcacagccgataccgttgaacagtattatgtccgtgcaaaagactacgaaaagttcgatgtcatgactcgtctgttcgatgttcaagacccagacttggctttgatctttggtcggaccaagcgtcgtgttgatgaactaacccgtggtctaaaggcgcgtggttatcgggcagaaggcattcatggtgacttgacacagcaaaaacggatgagcgttttgcgccagttcaagagtggccaattggacttcctagtggctactgatgtcgccgctcgtggtctggatatttccggtgtcacccatgtttacaactatgacattccgcaagatcctgattcctatgttcatcgtatcggccggaccggtcgtgcaggtcacaagggtgtttccgtcaccttcgtcaccccaaacgaaatcgaatatttgcacacgatcgaagacttgaccaagaagcggatgctgccgatgaaaccaccaacagcagaagaagcattgatgggccagatctccagcggtttagaaacgatcaaggcacaagtcgaagctaacgatactgaaaagtacgaagctatggctgaatccttgttggaaaactataccccgttacagttggtttccgcttatcttaaagcagtcagcccggatgatgccagtgccgttccggttaaaatcacgccagaacgtccgctgccacatcgcggtcgcagcaatcacggtcacggcaataatcgtggtggttataaaggcggttacaagggtaagcgtcgcgaaggcggctatcaaggcaatcgtgataataagcgcagttacgacaaaaaacgcaacttcagcgataaacgcaagaatgttaagcgtagtttcaaaatccgtaatggcgaatgatttttaattaaagcgttcaaaaggcctcaggttaaacgtcctggggtcttttttgcttcaaccaaacacccgttttctgtaaaagcatgctagaataactttatgacaaagcgtgagcaggaacagtggttagttccggcgatgtcaacgcggttaaggaggcaacccatgatttacggtattggggtggacgtcacagatttggcgcgaattcaggcggcacaagaaaaaaacagcggcttcgcggttaaaattttgacgccgactgaattagcaaattatcaacaacttgatggccgccgcgccgttgaatatctttccggccgtttctctgccaaagaatcgtactcaaaggcatttggtactgggttaggaaaagtcgccttacaggatgtcgaaattctcaataatgagttgggcaaacctattctgacgaagcatcctttttccggtcaggcttttgtctccatttcgcacagtgaaaccttggtcttcaccgaggtaattttagaaaaagaaggtcctgaacgtgacgatcggtaactttcgaccagcaaaggtattaatagatgaaacagccattttgcataatatccagcatgaggtcgcacgattaaaaaagcagacgcagcttttcgctgtggtcaaggctgatgcttatggtcacggtatgttgcgggtggcgcgggttgctaaagcagctggtgcaaccggtttttgtgtggcgatcttggatgaagcattgggattgcgcaaggccgattatagtgaaccagtattggtgttaggcatcgtaccgagtcagtatgcggccattgctgctgcccaaacaatatcattgcctgtcagcagcaccgaatggcttgaacaggctttgccagtgttagaagcacagccagagctgccgccgttgcgtattcatctggctttagataccggcatgggtcgtatcgggtttaccgaagatcaagcactcaagacggcagttgcgtttgttgaagcgcattccaagcaatttgtcattgaggggatcttcactcactttgcaacggcagatgctcctgatgatacttatttcaaacagcaagttgacaagttcaatcatctagtcgatcttttaccaagtcggccgcgttatgtgcatgtttctaattcggctaccagcttgtggcatgcggcttgcaatggcaatatgattcggtatggggtggctatttacggcttaaatccgtctggggacgcgattccaaccacaccgtttccactggaaccagcgttgtcattggaaagtgagttgacctattgcaagcaggtgcatgctggtgacggtatttcgtacggtgtgacctatcgtgccaaaggagatgaattcatcgggactgtcccgattggctatgcagacggctggctgcggcgcctacagggctttcatgtccttgttgatggtcagtattgtgaaattgttggccgtatctgcatggatcagtttatgattcgtttgcccaaagcatatccagctggcacaaaggtagttttggttgggcaaagtggcgatcaggagattacgttgttggacgttgctaaatatagcaagacaattcattacgaaatcgcctgcaatttaacgccgcgcctgaagcgacagagcgtgaatccggtcgattgatggtggctcgtatgcgcattttgtgctaaagtaacaacatgaacttgggaagttggaggaagttgtcatgaaaaagcaaacgtcagtagcggtaacgtttgatgatgccattaaggcgcggttggatgcctattgtgaattgaatgacattgacgctcaggctgtgattacggaggcagtggcgacatttttgaagtcacaggctcccgaaatcaaccaattgatttctggctatgtagcaatgggccagatcaatacagagatcagtcatgctttctctgcctgcgagagcgaggcatacgcccatattcgatgagcgataagggggcaaaagcatggatgtgtccgtaaaacgcggcgatgtttttttcgccgatctgtctccggttgtcggctccgaacaaggcggcaaccggccagtacttattattcaaaacaacgttggcaaccattacagtcccacagtgattgtggcagccattacctccaagattcaaaaacccaagatgccgacgcatgtcgggttacgggccaagcaagatggcgttgaacgcaactcggtcattttacttgagcaaattcgcacgattgacaagcaacggctacaagcccgcgtgacagctctgtcaagcaccaaaatggcagcagtcgaccgcgcgttggcgatttcagtgggcttggtcagtttgcccaagcccaaaacatataataagaattaacagcaacgcgcttaacagcgcgttttttgttgaacgttcgccagagcggttagaaactggagacaagcggcctcaaacgtgatgacggggcttgggttactgcattcgctgtctttttacgtaggtttctgctccggcaaacgcgctatgacgaaataatgtgacttttaatggaggactttcatgacaaatctaaaaacacgcggttgggtacttaatgctttggtcgctgctatctatattgtgctatcaattggtcccgcgagccttaatttggccagtggcgcgattcaattccgcttgtctgaaagtttgaatcacttggtcgtgtttgatcgtaaatatattgtgggtgttgtgacaggagtcgtgattttcaatgctatcttctcaccgcttggttggcttgacgtggtctttggcggcggtcaaagtttgcttggcttgctgttggtcgggtgggtggcgccgaaattgcgtcagctctgggcccggtttgccttaaatatcgctgtcatgacgatcacgatggccttgattgccgttgagattgtgtggacggggcatttaagtttcgccacaatgtttttaccaacctatgtttcgttgatgctttccgagttcattatcatgacgatttctgcgccgatcatgtacggacttgataaaatcgtccactttcacgccgccatcgtgagaaaatgatggcagttatcttaaacaactaaaaataaaaaaagatcttgcaaccgaccatgactaacagtgcaccagtctgatttcctattaaatcagtctgatgcactgtttttgattgtgaccagatggcggattctgcaagctttgatagacttcggagccaaatgtgaaacggcagacaaagaaaaaagcattgtaatctcgtcattattagaatactatgagaccaatatctttaggctcaagacattgatgttaactaataaggtggggatttcatggatcacttagcacatgacaaaaaattaatgtacctgccggaatttgagcatgcggcctgtggtatgggatttattgcgcaagtggatggtcacgctagccacgaaattgtggaaaaagcgttgaccatgctacaacgcatgaatcatcgcggcggcaccggtgctgaacctgatacaggtgatggcgccggtatcttaatggcaatgccggatgcttttttccgtgacgaaatgcaccgctatgaattaacgttaccggcgcaaggtgactatgcagtggctcagctttttttgccgcatgatgcagaagaaaaggccgccatgttaaaggcggtcgtgagtcaaatcgatgaagccggctttccggttctttggacgcgcaatgttccgtttgtttacgaaaactgtggtcccgcggcccaacaagctatgccgggctttgttcaggttgtggtccaacggccgacagacacacaggcagggcaggactttgaggatcatctttatgcattgcgacggcagttagagaaaacctttgatcggcaagccatgtatatctgttctttctcaagccgcaccatcgtttataaaggcatgcttcatgcttaccaagtaagtcttttttacccggatttacataacccgcaaatgaaaagtgccatttgcttgattcactcccgtttttccacgaatacgtttccgagttgggatcgggctcaaccattccggtttttagcgcataacggggaaatcaacacgttaaaaggcgccgaaaattggatgaccagtcatggtattgaaatttatgatgaaactgactctgattccgccaagttagagaactgtatggaatatctctatcggcatgaccgatccattccgcaagcgttgatgatgatggtgccggaagcttggggcgaaggtaccgaaatgtctgatgaacaacgggcgtttgatgaatacaatgctactttcatggcaccttgggatggcccagctgccttgtgttttacagacggcattcaagttggtgcctttttggatcgtaatgggttgcgcccatcgcgctacacattaatgaaaaataatcagttggttgttgcctcagaatcaggggtggtagatgtcgaccccggcgatattgtcgagaaaggcattttggcgcctgctgagatgttactagttgacaccagtaccggccgcatttcgaagactcgtgatttgaaacgggcttgtgctgaagcgcatccttatcagcaatggctcaatgccaaccgattaacgttgggggaattacctgacgctaaatcagatgaaagtatgccgatcgacagtttgaaaaaactttggctgcgcaacggctatacccacgaagtcattcaaacagcgttgttgccaatggcgcaaaatggtggcgaaccggtcattgccatgggctttgattcgcctttagcagttttgagtaaaaaatcgcaatctttgttcacgtattttaagcagtcgtttgcccaagtgacgaatccgccaattgatccattacgggaaaaagtagtcattgggacttttggctttttaggtcgcgatggcgattgtacgcgcgatactgctgaaaattgtcacaagcttaaaattgacagcccgattttaagcgatcaagaatatgctaaaattctcaacttggatttgccgatgttacaagtcgctaaattgtcgttggcttatgatttgacggatacgcccgatcgtttggcgcatgtgcttaaggaccttttcacgcaggcggaaaacgcgattgatggaggtgcaacgattttagtgttgagtgatcgaccagttgctgacaatcagatgacgattccggttttgttggccgtatcaggcttgcataattatttggtacggcaaagtaaaggcactgctgcgtctatcgtcgttgacacggcagaggcatgcgaaattcatcattttgcctgtctgatcggttacggtgccgctgccattcatccgtatggcgctttcttgacgctaaaggaacgtggccttgaagcgcaattgccagattactgccaagcggcgaccaaagggatcatcaaaatcatgagccgtatggggatttcgacaaccgccggctaccaaggggcgcaattgtttgaagcagttggtttggctgatagtttgattgaccaatacttcaccggaacgccaactcggattggtggcatcaatcttaaccagcttgaagacgagtattaccaaaagtatcagcgagccttcagcaatcacgcgattgacgatttgccttctggcgggagttttcaatataaggccgatggtgaagagcatctgtacaatcccaagagcatttatcaattccaaaaagcagtcaggaacggcgactatcaggcctatcaacagtacacggcagagctggatgccgaagaacaggaaaatccagtgaccttaagatcgatgtggacgattgatcaaaatggccgtaaaccggtgccgttgagtgaagttgagccggtgagttccattgtgaaacggttcaaatccggcgcgatgagttttggggcactctctgaagaagcgcatgaaaccattgccattgccatgaacaagttgggtgcacgtagtaattccggggaaggcggagaaaacagaaatcgatttcatatcggtgcagatggtctgaaccgcaacagcaaaatcaagcaggtgtcaacggcgcgctttggcgtgaacacagagtatctgatgagtgctgaagaaatccaaattaaaatggcacaaggagccaaaccgggtgaaggtgggcagttgccagcagggaaagcttacccttgggtggctagcattcgcggctcgattgccggtgtgcagctaatctcgccgccaccgcatcatgatatttattccatcgaggatctcgcgcaattgatttatgatttaaaacaggtcaatccgtatgccaaaatcaatgtaaaattagtttcttcaaccggggttggtacgattgcggccggtgtggtgaaagcgggtgctaatacggtcgtgatctccggctatgacggcggcactggagcggcaccaagaaactccacccgagattgtgggttgccatgggaaatggggctagcagatgcccatcaaacgcttgcgctcaacaagttgcgccaacgcacgacattggaagttgacggcaagttattaacagggcgcgacattgctgttgcgattatgttaggcgcagaggaattcagttttggtaccttaaccatggttgctattgggtgtgtcatgatgcgcaaatgtaacctcaacacatgcccggtcggtatcgctacccaaaatccagagctgcgcaagttatatgcaggacgccccgaaaatgtgattcacatgatgcaatttttggccgaagatttgcgtgaacagatggcggcattaggttatcgcacagtcgatcaaatggtgggtcacggcgagcatctgaagccgcggtatgtaccttttgggaaagccaaaacccttaactatgatcggatgctgggcaaaacgattccaattgaacgtaaaaaggccaatccttttaagccaaagtatgactggccggatttagaccgatttgctgaaactagtctcaaaaatcaaaataccacaaccattgacctaccaatcaataacgtggaccgcgcggttggcacgcgtttaggcggctggattgcggcgcattttggtaatgacggattaaaaccaggacaactggctttcaactatcacggtacggcgggtcaaagttttggagcgtttatcacccaaggactatccattaagttggtcggtgaagccaatgactatgttggcaagggcctgtcaggcggtcgcttgatcgttgctgcac

SEQ ID NO: 9 - DNA, 82811 bp, Lactobacillus paracasei
tattttccaagtatggatggggtagctatttggcagtacacgagcgcatttgggctgtcgcaaggcctcgacggtaatattgatttgcttggtgtcaccgataatggctactcgaagcaaccagtaacacctatcaccccagcaccaagcaaaccagcgcaatcaaccgcagccactgataccgactatgcgcaaactggcgttttcaagccttccgcgactgttaacatccgcactggtgccggcaccggctatgcatccgttggtagctatgctccgggtgaaagtgtgatttatgatcacgtgtatatccgtggcacatatgtttgggcacgttatctcagctactcaggcaggtatcattatgttgccttgggcgtgaatggtggggagagctatggctcgcgttcgtctggatatacttcgccggtaagccacacgtactacactgtccgctctggtgacagcttctggagtattgccagcaagtatggcatcagcatgtacacgttagccgctaacaacggcaagtcaatttacagcgtcattcatccaggcgaaagcctgtatatccgataacaaaaagtcctctgctcgctaacgcgggtggaggacttttttacttatgcaataatataaatataagtaattcgtggtgaagttgtggtgaagtgaatccgaaattatgaaacctaagaaattgatatagagctatttttgcttttacaccggcgatttgaaaccctatgaaatcagtgctcaagcaaatcacaacaagaagaacatgttcgcattgctcggccgtccgggttatgaggatatgaccaaggaattgaacgcacggctttaatggcgtgggtttgagattggttgaataggaaaaaatgagagcctcaaaattgtgttgtaaatgttcgtgactgaattttgactgaatagccaaaagggtcaaaacatttatgtaccaattttgaggctctttttgtgtccgcgggattgccagtactggctttcttttggtgtatagactaaaaacacggtgtgatttcagcgggtgataaacgccatcgcgaaatcaagcctatatccatatattgacccaatatctagttggcatattaatatcagcggttgagaacgcttgttgcgaactagttcgtgtccgttagtgctattaggtcttagaaaagtgtttcggcaacgctacttcaagccagcctcaactgaccaatccaactggctttttgagaccatggcaacagcgtgatattgtaaccctctgctgccgactgaaagcttggcgaaatattacgttccagatcgtttgcgagcaagtagaacttaatttcatcattaaatgaacgtacatctgtaattgaaaagattggttctttgtaggcatttccagttggattattcactagttttaatgccttagcggaggttgttttcgttcgaccaatcagaatttcaaagttgatgttattgccactttgacctgtgtatttaacatttgtattgaccgaaatatcgctgttaattaagaagttgacaacgtcttctagaaataagtctttggttctatctcttgaagttgcgagcatatcgccaacctgcgtgatgcattgaataagctgcaattctgcctgtgcatatttggagagggaaggtattttgatggttagctcaccagttggggcatattgaacgccgaaggaaaggagagtgtcattgaaatacttctttcttttaactgatgtgttcgtgtcaaatcctaaggttccaagttcgtccatggtataaccatcatcactcagcatcaaattgccatcagcgtctttgtataaaaccagagaaatattatcatgaaacatgtctggaaacggcgtgcgaatctcaatgaagtggttcttgtgatacatctaaccacttaatgcgagccctttttaaggcttcaattgttggcatgtccatgatttgcctctttcttgctctgtacgaagacagcctttgcacggttaaggatttaacgatgacattgtccaaacaatcgtttatggtgtttgattgaaaaattaagcatggtcattcatgcgcaatatttctaaaggctcagtcaggaattcattgattccagccaaaaacttttgaaaatgcgccgtcccattatgactttcaaccgcttcagcatctcgccaatgttcgatgatttcatattcattcggagcggtgagactttgatagtgatcgtagctaaggttcccttgttccgcacgcgaaccttggaccaaagcggcgatgaattgccgatatgctgcatcacgatctggtttgacaacaagtttgacattaatgattttcattttaaatcctccattttttgtgtatgtcatatgataatggaagctgggtcgccaagaaacgttttcgatccatggctagcttctttttgcatcagtacttggtgcctattatacggagtgattcagattgtatcaattttaaaaagcagcatacatgggtggtgtcaatgatgtgtttaggtctaaaaaatcaccatcagcacaaatgctgcctccatgattaacaagccaaatagggccgtgatcctaccgataaaactgcggtgaccttgttcaagtgagaaggggaggatgtcttctttgctcgacggtgatatttcgaaatacttctccatcatgtgacgtgagattgtgtatgactgacagcttagataaatcaaagtgatggtgacaattaccgttagccaagcgcttacacggcaaacggttgggtcagcgtagatattaagttggtagataccagcaatcaggaaaccgatgcaggcactcagactgaataagttaaggcgaagcagcaaagcgactttttgggcccgtttcatttcttcaggaaatgttttcaacatttttgccgataacatgacaacttgataagaattggcaccttttgtcggacgtcttgcttttatgactttaacgacaccagttatttctgtgatggcaccgattgttaaaagaagcaggataccgtcaaaaaagatttgatttgtcatcagggacctccaaaaactgaatcaaaaaagccgtttcgactgttatgacgtctaacggctttaagtgacgctgatagattttaattcttagtgcttgtcccatcagcatagttgattgtataaccaggttcaatattaaaaatgtaaacattaaaatagacttgattgtcaccaatactttgcgcacgcatctgaacaccacgagccactaattcattgccacggaaaattggtttgacttcgtagcggacataatggctggtactttgtttgaggtaataagcgatatccatctcatgagccagcatgagtggtgtattaagggtttgcgtgccggtcatgaggttcttggggttgttgttttcgccggttaattgataaccaataagatggctgcgattgtacagccaaccatgcgcggttttcttgttgtgccagccagttgggttccatgtgagtggttcacgcttagctgttggcatgagtgatttatttaaaagcgcatttgcatctgtcacgcgattttgaccatcgagatcagaataagttgcccaagcacccttggcagtagatagatcagcatcactaaatgcaggattatttttgttgacaatgatttcttgttggccagtgtagtcaagattggcgagatcggacgctgtcgtggtagcagcacttgttgatgattcacttgcagcaggttgtgttttcgctaacttggctttgagatcggtgatctctttgcgtttttccgtcagttctgaatcaaggctgctgatagctgactgcgtctttttgttagccttggtttggctggcaactggatcgccagctgactttactgaacgactattagttgtactgcaaccgccgagaagaagaccaacaacggccagcggcatgaaaagttgaagtaatttattttttctcatcgtaaggcctttcgataaccagctgcttgtgcatcagcttcggaattgaagtaaaccgcgttggctgaattcatgtgatagccagcttgaccaggcacatggtaaattttgctacggctgtttccgatgatggtgccttggttacctgtatacaaatctccgcttttagcgggggcctgttgttgtggctgagtggcttgttggttagcggctgacttttgtgcctcctcggcttgtttggctgcttgtgttgcggcagctgcttgcgatgatgctgcggcggcttgttcagacgcggcaacttggctcgccgatgcctccttggaagccgcctcagaagctgctctggatgatgatgcggcagcaacactggaagccgctgcctgtgaacttgcttcagattctaagctagcttcttccttctgaagtgcctttagttcggctactttcttggctttcactgctagcagaattttgccatgcgccttttccgcgtcgaggcggctttgttgtttggcagtcagcgccttcgttttgctgactgacgacgattgatgcggtgatccggatgcagccttggtgtttgccatcggactgccgacaatcactaaaatgatgccgccaatcagcatgatcaaattcaagcgtttggtcaggggatgtttgcgctgtcgaagtagccgaatgatgccccatacggaaccaactaatccgagcaacacaaaaatatttcccagtgttgacataatgttccctccaaagtttttaataccaacattaactattctgagtagaaaaaaataatgttgatcattaccaaggtttattttcccagaaaaaaagcccggcgacaagcaccgagctagcttcacagtcagtttttttaggatttgaccacatcgacattagcatacaagtttgcaatgatcgccagcatgtctttttcagttcgatcccagccgatcgttttaagaaaggcttgaccattttggacctggttgctgatcgtgtcagggttggcacaagcatttgcaagcgttttggccagatctcgttcatcaaggtgactggcaaaataggtcccgtctttcaagaagtagcttcctgtgccttccttaaaatcaatgagtggcaggccagtgctcatcatttcataagggacaagcgaaaaattggtcatagatggcgcgatcccgaaatcagcactttggtaaagtcgatttaattccgggggagtcagcttaccaaggttttcaccattgatgaatcgtttgctgcggccggtaccgaagtattgaattttgagatcgattcctttggcgcgcagtaactggcggcaattttcgaggacaatctgaatgttgatgggtgcgcgccgcgggctgctccacttggtatagacagcaagcttgatttgcttcttttgttgataaggtcccatgtcgcgttccttgaatggataccgtgcgacatcgacaggaaagttaatcacatcaataggactgtgaaccttgcaatgcatggtgatcatgtgggcacaccatggaccaagcgataccatgtgcagacctagactgtaagttcgtcgcgccatctgatagcgatcgccatatggatagaaatacggttcgtaatcttgaacaaaatacattttgtaccccggtttgttcttgatcacataaacggattcccataacgtggcgacccaaatatcggaacgatgggactcaagttcgcccattggcagacaggttcctttgtaaccgggataattaaattcagcattctgaatcatttcgtcttggctttgtgggacatagcttaaatagtagacatcgtaaccggcgttggccagcagcgtacctagatgcagcatcgttgtttgaccgccatcaaaaccgataatgccggttgtgacaaatgtgatccgattaccacgcggtttcgtttgatcggctggttgatcattaaaatatttcaaaatctgatcatattgatgaatactgccatcaggggcatcactaaacttagtttttgcaggtttcacaacgagtcctccttgtatgattaatggtactttgtgtcgctttaggcgttgcttaaatttgagtagaaaaaagaagagcggactaattgtcatctcgcgtttggtgtgacgatccgtgtaggctcaagcagcgtacaaaagcggctactttattttagcttacataataaccgtaaacttctttttgaaagttttcaagttgtcgctgaatggtcgttaagaacggagaggcgtaaaatagaaggacaggaccagtggtatactgtgttaataatagtggcatttgactaggcaggcggatcattacgaatgcttatctttaccctgacaggggcctgtgctagtgtgaaagtaaattattttgtcatgaaagaacaggtgaaacgatgttaacgattggtgtcatgggacttggtacgattgcgcagaaagcatatctgccagtttacacacaaatgcagaatcaagtgcactgggtactgagcacccgcaacgacgataaattgcaacaattggcaacacaagacggactcgcgattgcgggcacgactttagaggatttggatgcgcaaccgctcgatgccgtcatgatccacacgccaacggaaacccattatcagtatgtgaaacattttctggaaaaaggcgtcaacgtttttgttgataaaccacttgccacagatatgggtcaaatcaatgaattatatgatttagccgatacccagcacgtgctgctaacggttggattcaatcgacgatttgcgcctatgattcaggacttggctgaagtcgatgataaaaccggcgttcgcgttgacaaaaatcggattgatgcccctgacgatccagaacatgcactgtgggatctctttattcatccggtagatacggccttaatgttggcaggctatccagaaaaaccaaatacccgatattcattgcataccggcgatgatggtaaactgcagcaagctagtgtgattttcaccgcaccgggcatccgcggtgaagccgggattgacttacaagcaggtaccaatcttgaagaagctcaggttgcggctccaagtggcgttcagcgtgtgcagaatcttgatcaactcgtcgtttacggacgtggcggggcaacgcagacattcgcgcctgattggcagccgatgttaacaacgcgcggttttcagccaatggttcaggcctttgttcaggctgtggcggatccagaagggaaaaacccggtgtcaccagctactagtcaattgacgcacgcagttgttgcggatttggttaatcagatcaaggcttaaattgtcgtggattttgggatataaggcatctaatcattcggatgccatcaagaaaatgctcgctagtgaatttttggcgtggtgagtactgtctttttggagggaatcgcttatgtatcgaaaagaatttatggcaatggccaatgaagaagccaaggcaaacgtcaatggtagcgatggcggtccgtttggttgtgtgatcatcaaagatggtaaagttgtcagccgtgcgcataatcaagtgctggtcgatcacgacccaaccgcccatggcgagatcacggcgattcgaaaagctggccaggcacttggcacacatgacttaaccggctgtgaactctacacatctgccatgccatgtcccatgtgtctcagcgccattatctgggccaacattaagcaggtatactatggcaacacagcagacgatgctgcggcaattggctttcgcgatgccgctatctatgatttcatcaatgccggcttgaaaggcgacatgcttgctctgacccaacatgatcgcgagttgacgatcggggcattcaaagactatcaatcggctcaaaagaaactttattagcaacacgagtggcatcatctatcattagccaaaatgactgacaggaaaaagcgaaaacccgcatcagttgtcaccaagtgctgtcaaaatgtatttgacattttcgcactttcctgtagaataatttaggtacgatattaagcgccactcattgcccgttggtcaaggggttaagacgccgcgttctcagcgcggaaacacgggttcgaatcccgtacgggtgagaaatagaacaaataagaacaaatgaaatcctcgaaatgcctttagaatggtgtttcgggggtttttgttttggggagaaaagactaaaaaagagacttcacggtgaaccaatggtgaacctaaattgtagtcttgcctgcttaaaagagcaggttcaccatctaacgcgctaagccttggcacacaagaggttcagcgatcggtaaatcctgattgctttttcgaggttcaccgtcgaagcctgtatccttttaggcacaaggggtacagcaattggaaagtcctgatcactttgggtctatcttgacaatcttgtgggaggctttgccaagatagtcttgaccaatcgatgcgcgaagttttgtatcagcttctgcctgcatttgttcgaagacatgtccataagtacggtgtaattctttcaaactgttgtgaccaagacgcttcgcaatgtaccagtcggagtatcccgcgtaaatgagccgtgtagcgtgcgtgtgacgcataccatgcatgccgatgcgtttgatacccagttggtagtgcagctcgtctaagcgtcggttcacggaatcgttttgcggcactttaaatgtgaaactcaaaaacatcatgtcttcttcgtgataggttgttgttttccattcccagtcgtggcgtctttggtgttctgtattcttcaagtacaactgttggacccgtttcatctctttcaattggggcaggtattgatcggggattgagacaatgcgatcagactttccgtgattcttggttagcatgaacttgtgtagtcgaggattccactgtttattgatgttgatcgttgcagttttgaaattgatgtcgtcccacgtcataccagcaacttcaccgtatcgtgaacctgtcatcagggcaaacagcatcatttcttctgtcatttgattgaaagtggcattgtctcgcaaatagttgagcaacgtaatgtattcgtcatactctaggaacttgtaatcggcagcctgtggtttactacctgaatagatcaatcctttagaaatatcgcgggaaataatgccctcatcaagagcagcaccaataatgacatgcaattgccgatagagcttttcgcctgtggtgattgcgtggcttttaccaaagtcgttaagccatttctgaagttcatctcgagtgatggaagtcagcagacgatcgttaaactggtctttaatttttttgacagtgttttggtacaaggcataagttcggggggatcctttcgacctgtacaaatcaatgtagtttttggcaaagtttgaaaacgaaactcgtgacgctgcctgcgctggatgttgcaatttatatcgctcgtcagtttcccatgtttccgcttcgctcttcgtagtaaaggtttgttggcggcggacttctctgccctcgatggtaagcttaaagcgagattgccacttgccttttcctagtttcttgactgttatgatgcaagcctccttgtttttgatataattgtgtatacgaagagcgcactcaatggattaccgctccgagcgtttgtttgtgcgtctactctgaccggtcaaaatttgtggggtaggcgattttttcaatagtattgagtagagatatggtctccttcaacaagtaaaatgtgtgctaacattggctcagatagaatgtaagtttgctggtatttgttggagccactatcatacttgagattctgtggaagcaaccccaatttttcaaagcttctgatagtctcgtcaacaagctgacggagtaatgctagatgaatattttttatatctttcggcatattatttcgaaaaatattggcagagtacattccgcgtagcaggtcatcgtattctttgacaagtgtgcgatccacatgtgctccaccgtcttgattagcaacgtatctgacgatatctttgcgagttatgatatgatcttcgaatacaagtaaccttccgttccaccatttctcaaacggtatagagtgcaaaatgtttgccgaaggattatagcaaagcggtaaatattcggcctgtggcaattccgtcggcttttccttgccccatccagctattactggaccaccgtaaagcaccactccttctcccagagccacagaagacataaacttcgttttttctggatcaattttcagttgttcaatcagtggttcccccatgttctgctttagaaaaagtgtccttagaggggcagtggccatttttatgagagaatgatcttgagtgtcatatccatccgctgcaaagcttaaataagacaattgctcatcaaacctttgcttaatttctcctcgtggccgtttaactcgtctttgcttttttttcatgaaattagttaacctttcgtggcgaaagaaaagagtaatattaaaattatcagtaattctaaagatgtgtgggaactttctgaagccattttttctattcagagttttcagatacaccgaatattggagccgatgagctagcaactttactctatagcaaggcttttgtcgatatttcggacggtgaatatattcactggttacaactgacctcagatgcacttgaatcagtgaaaaaaggatttagaaaaaatgaatgggaaaagactagctgcttgattaatcaaacgtttaagagccggtttttattgttacccttgtgacgtctactcaaatcattttggccggtggggtaggcgctttttatcatttattaagctcatagccaacagattgatcttcatcaacgtgattcgtcaaaaatgttgttgcctttgtgatatgcgaagcaaatgcatcttcatcatgaggtagatacgcattgtaattaaccgaatattttaggccatccgtgagaatcgaaacttcatctttgaagcgtttttgcttatggtacattgtgcttaatttagtggaaacaagactgcccgtccttgtaactatcatcagtcattctttttctgcttttctccactcgcctagtttgtaataaagattgtcaaggattacgccaagttctttaagctgaagagcaaccccaagcgcggtcgccaagtcacgccgaaggatgaggctattaagcaagccaagcagttctgtgggtactgggtgctgctcacaaacgagaagatgacagcttcgcatgccctgcatatttaccgatccgaagacatcattgagaagggttttgggaacatcaaagatccgttgaacggccggtgtctattagtttcaggtgtctattagtttcatcagagaaaagcctgaacgggaaaatctttgtccagttcgtcggcctcattttggtagctggcgtgaatcaggtgatgcacatcaaacaattataccggcagtactctctacggcaattactggattggttggacgattactgcccctggccgagagcagaagtgcgagaagtacaaggctgatcaagccgccatttacgatggctttgatggcatcaatctgttcttgttatgagtgacccggaacctcggttaccgtttgtgcggttgattgttaatgccgggatgggggggtcggggtcaagcgctttgttatttgttttcgtaccagttacgtaatgcttttattcgttcatgcgtgttcggaggaaatccaagtgtatcgttatataccagtttgttaacataagtgatagccatatctttactgggatcaattaagttttgaagatcagctagcgcactaagaaggcttggatgcccaattgtgtgactggccaaaataagtaaaagcgagaaaatatcgttttttccaaagcccaaagcataatcgttaactgagatgattgttgggttgtttatcaagcgtacgatagagcggggtaactcagttcgacttgttgggtatgacaatcgagtttttaatatacttgtaccgtgtgcaatcgtatttcgataatcctgtgcaattttgagagaaaggcggagcaggttcaaacgttcctgttcagacacgtttgtacttggatttaaatcgttgagcacttgacgtttgatacctttgttgcttatcgcataccaacgtgatgcgatgccgaaactgatgtcattgaccaaaatccagggtggcacatggttgtgctcacgacggtacatatcaagagatgcagaaaccttatagtgtgatggctcttcgtaagtttctcaatttttgttctgttttacatgcattcccgttgcatactctctcaattttcttaatgttggtgccggatccatattgatacgtggataacgaatagaatcaagatatccaggaacaccattatgggacacatgatatacgccaaaattttccgcaatgtgataacttaaagaggtttcaaaagtattttcaaaatgaatgactagcggaagtaagattcccgaaaggatttcgtcaattcgcttgatatgaacgagcaagttgaacggaattggcggatcaaatttttcagctttggtatgaggtagccggtcttgatacgcgttaacaaggttataatatccatattgtttaaggtctgaaatgacctcttcctctgattctgatactagtttaatatcatgatcagcaagtctagccacttgttctaaataagttttaaatggtttatctggacgcaaaaataatcaccccacgaaaaaagacgcgacctcgcggtcacgccttttcatgagtaccttttgccagttgggctaggtactattgcgtaaccacattatatgacgatgctagtgagccgtcaagaatttcattctacatggataaccctaacttcgtcacccttatggattgctaaatctgcgggagccttcactttcaatggttcaatctcctctgaagagatcttgagtttagcaggttcctcaacttcgtgggaagttccatagatagttgaaattgattttgacatttgttccagtagatttgagtaaggactattaccggcatgtctttttcgaattttggaaataaccgaaaaatgccgatttacgtgagtcacctctagatcatctttgacaaatgtatacaatccaagagatttaccgtccgtgtcaaatatttcgtccccaaatataactacttcagcagaatccccctttttaattctgtcaacgtatccaagattaatgataagatctgatggactgatgattctgataacctgaccatcgatttcttctgtcaaactaattcctcctaaagccaaggccttcttagtgtccttctactccaataagatataaaaatccgtttatggatcaagattgtgattagaacacacagccctgtcgtagcacgatgattcaattttcattaatgatcgaacaaagttgctagattatcgatattaagggctaaatgataattccatgcgttaatcttaaaccttgcgagaaagtggctactactacatgatgtggatgtacctgggtaaatgtctgataaaattcgttcagcacggactaaatcagttgaataaactcgggactgggatcgttgcgccggggacacacaaatacttttaaacgattctccatctgttagtgaggcaggtgtgttaaaaagccgctcgaaagcgactgacaaactgtttaccttttttcaaccattattgacttggatgttggaggtaagcggtcatcgatactaatagtgacgtgatgaccaccagatatctttgcaccgcgtggtccaacctcatgatgattatcagtcctcagctcaatcggttctgccataagcgatctcttttccgaagatttagtgaaaagggaaaatctctagagcaaatctcacgtaccgtttaccagaagcaatcataccaaaaaagtaagtacgtgacaataaaaaacgctatatgttgtgggggaacaaatgagcgcaacacaacatgccaaaagttactaactaaaaaactgagattttcaagaacgaaatggacgtactagcaggggttctaacaaaaattgtagattttctgaaaatagattgattcataccttgaagtatggttgatttaaacaatcaaatatgagaattatagatatgcttgaagtaggcttcaattagtagcagacgaacggttagtatagtacgcgcggcgacagatttcctgttcgaacggccttcttttgtgattgctaaacaactaattcaatactgccactcctaacgtcaaataggttgcaaataaaatccaaacaaagtatggcacaaacaggtaggctgccagtttgttcacattgcgaaaggcaagtatgcaggcaaggacaaccaaatcaagcactataatgatgatcagtccgagccaatagctattgccgccgaaaaacacgatgctccaaatgaagttgagaagcagttgactgccaaaaagactgagattgatggtttttggggtacgcgatgtcgtgtctttgatgactaagtaaccagcaacgccaattaataagtagaggatgatccatactggtccaaagacagcggctggtggtgaaagtggcggcagctttaaggatgtatagatgcccttgatattacctgcgagtagaccggaaagggacccaataagttcaacgacgacgatgctcaaaatgagatgaaaccagttgatatttctttttgtttgcataagcaattacctccttttttgagtttagcatgctcattattaattgtgttaatatcacgcatttgataaggtgcgtcaatcattgattgtcaaaggctgttactgatccagaaactgccttgacataagttctatgataaaggtagagcctgcttgaaggctttggcaggccagaagtttgattaagcgaggcgatcatcatgatgcaatatcgattacaattagacactaaaaaccagttgtttgtagcaattgacgcacatgatcagaaccattttggaactggtcggacggttgaagaggctattaagaacttgaaggattcaacagacaacaaagctgcataaaatcaggtcgtggactttcgcacttgcgagaacccacgacctgattttttagtggcgcttattttcctaaaaggttcgtggtaaggcatcttctagtgcattcccaattcaattcgtcagacaacgccgtagcttttcgataaatggatttaagcctgcgtttccaagtagttcgattcggattactgatatcgcaccaatcgccgccgagttcggatccaaacaacgataagcacagcgactagcgcaaacacaccgactgcggcaatgatgaacaaactgcgatagctgagccagtcgatgactagaccgccgaataatggcccgagtgcgcgaccaacggaaccccaagaattgacgaaaccttggtagcggcctttgatttcacgcggagtcagatcgttaacgagtgcaggaatagcaggggatgcggtcgcttcgccagttgtcaaagcaatcattgcgatcatgaaaagcgcatatgtgtgcgcggtgatcagaatgagaaatgagatggcaaccatcacgagaccaaaaagaatttgatagataatctgaatgccgttgacgtgttcgttgaaccagtttaaaaagagttgaataacgacgattaaagcggcattcaaggtccacaggaaactgtaattgcgtaacggaatgcctagtccagtcatgtagacggacaaattggatgaccattgttgatacatgagccaaaagatgagcaaagcaaaaaagaaagtggtcaacatcagcttgtttgcaccaggcaaactcggctttggtgtttcggtcgtcgtttcttttcgtgtcggttgcgctgtttttgccgccggtcggaatttgattagcacgatcccaaagaaaatgccatataacacaacggcaatcagaaaaagtagggtaatgctgatatcataaacaaacccaaccaacgcagtgccaaccacaacaccgacattttgcgcaaagtagagcatcgtgaagacatagcggccgtcttttgatcggatgcttgtgccgagtgaattcaccatcgtaatgttccacccggagccaatgcccagtaaggtcagccaaatgctgtaggctggccagccgtgccacaaggtcaaaccgatcaagaccaagccggtgagtcccacaccaaacaaagcaaggcggtaagggtcgccttggtcgtacagacgtccgccaatgatactgccgacaacgctcccaagcgaatttagcagtaaaacgacaccgatgacagttagcgaaatgtctaggcgattatgcaaataaatgctggttaaaggccagatgaaactcatgccaatgctactaagtaaggcacctgtcagtaaccagcgtaactgaatttcgcgcaccaagggtaacgccccctttttaaaataattgcaaggcacggagccgcttgctgcctgtgtttaagacaataatgccatgttacgtcaagtgtgatcgggcggtcaaacctatttttggggatgctttcatgattgaaaataaacgcagacacattttgtgagtcagaaaaggaaaagaatagggacttggcaacatgtcccaaaaccttaatgcatagcaggcaggcgcatgcgtaaataagcgatgaaatggaagacgataccaagtagtagcaagacgccagcgatccaaacgttcagccaactgaccaaaatggaactaccataaattaagccactgattaacggatcgatatgttgtgtaggactggtgatgccatgatcggtgagttgtggatgggtgcttagataatgataaatcaaccaataagaaagcgaaattaagagagcgacaatgtcgtagacaataaacgctacctgcatgtcagcatgattcaaggttcgtaacgccattgcaaccagtgacatgctgtagttgattaacgttgcggtgaataacaggatgagattcaaaatattcagcgccgtggtggttctcttaacatgagtaaagtagtcgtggtggaaaagccacaaggtaccgacgtaaaaataagaggtgaggtaagtgattaataatggcatttgtccggttacttggtgcaacagcgtccctggtcggccagcaacgggatgaaattcaagcaccaaaatagtgattaaaatggcaaacacgccatcgctaaacgcttcgatacgagattttgacatagcgatcattgcctccttttgattgccatttgggtgaggtatgccggatcggttgtaagaagttgtcagcaaaaaagcggccgcaagattcggaccgcttgatgtcattcactgataacttaaagatttttatccatattaaacgttaacttcgacagttttaaactttccatgacatagttgttaatcaaagctttagtagcttgcttggtgtgatcaactaacttgtaattggcttcagttaaatactgcgtcaactctttatccccaagatccttagcaccgtcgtcggtggcttggatcatttcacgatagtcgcgattcagggcagttaaataatcgcgatctgcttgaataaactgggtgtaatgcgcttcgactaacacatccaagaggcgatgcagccagtaagctgaatcggcatcgatatcgaatgttttcggcgttttagagtagcttggatcggtatcgttggcgttgcaataaaacggtacatacgggctgaaagtcggcatgccaatcgctagccacataatggcagcaagtccttcattgacatcacggcgtagctgcaaaatgtgtgaattttgcgtacggttcaagccgattggccggtaacggaaacgatcggcatcactaccatgaccataaggatcaaatggtgtctcgttgtaatggctaccgaggatttgggcaatgtcttcacggttgatcaggtgatcggtatgcatgatgaatggcaattcggccgattcgggatcagcttcgatttctggattcagaattttgtgaccataccacacacgcggcgtgttgtagtgacgatccttttcattcatcgtgccgaaaatgtggcggaagttccaaccttctttgtcggtgttcaggtgatgcgcatcgacgaattcttgaataccttcactccagacaaaattgtcggtatcatcaaagtcaacctgctggatagcaacctgattagcagcaatcgcgtaggcatcatcaggaatgcgctgtgcaacccaatgatggccagtcacgatttccatataccagacattgtctttgtcggaaaacaacaccgagttgccagcaggagagccgtattgcttgatgagttgacccagatactcaaccccatgacgagcagattcgatgaatggcaacaccatgttgacgatcaagtcttcatcaagcccatctttaaccaacggatcaaaccccaacgcccgttcattgccgtaagtactttcggtggctgacatcgcgacattgcgttcgttgatcccgctttcctcataatcaccgagtttatcgttctcaacatttgggacagcattatagcgatagccgttctccggcaagtctgcttcgaaaccgttcaaaggtgatttaacgtgcagcgatttctcgcctttccagcccgcgtgcatatagaaacgttgtggtgttaggggactgaaggtgtcgtcgttacgtgcgatcatcgttgaaccatcgatgctggccttcttaccgaccagaatcgaggtgcatgcagattcaattttcattcttgcgcctcacttcttaagtattggtaatagtttacgccagaatcaggtattttgcaccttcataaaaaaagacgttgacaagtgcgcaaaaattttttaagatattactcgttgttaagttattgggtagtagcgaagtggtaacgcagtggactctgaatccataatcataggttcgatccctatctacccaagcgcgatattaaaagatgctgtgaacagacatacttgtttgttcacagcatctttttttcgtctaaatcattttaatcccggttatgagcgctgggtccaagctaaaaaggcagcgtagccaaaacaaagacagccataaagcagaaaagcgccgatgatgaaggacagccatggccaagttaaaaaagcgcgtgcgatgaaaaggaagaaagccatcagcaccgcgcgcaggccacgggtgaagacggttttgacagcattattcaaatgacacctcaatgagcaggcgccgtgccttggtcaggtggctcgtggttaaccacatattattagttgaagcctgctcagcgtcttcactcaattcaggcagcaggcttaataaccatgcacctaactcaggattattgaatgcaaaatgttctggcaaacggataacccgtaaccgatttggtgggaaaaagagtgattgttcaggaaacaacacacggtcgtctaaaagaatactggcgacattttgataaggtaccgtgcgaacctgataactttgcggatgggcatgggcatatgccagtatcatgatggctgcgttgatcacaaaaaaggcctccattcagaaatgcttacgggtttcatgataccatggaaaggagaagtgtgtgcgttaagcgagaatgcgcactggacagtcacgatgcgacaatgatgatgagatggcataggtacacggactgaaggagtgatagacatgacgataaggctatatttggttagacatggcgaaacgcctatgaatgcggctcgacaattgcaaggcatcacagatgcggcgttgacggctaagggacgcgccgctgccgaccgattaggcgagttgctgcggccagtgccttttgcaaaagtctttaccagtgatcgcggcaggacaattgaaaccgctcatcggattattgctggtcatcagccgcaaccgccattgattcaattgtccgccttacgtgaatattattttggcggcttagaaggtgattctggtaacgccgtcatcacccgcacgattcgtcaatttggggtggctgccgcttttcgggcttggcgcgggtcggagcgttttgctggactcgtgcggtcaattcgagaagcagatccgacccatcaggcagaggacttaccggatttgattgctcgtgcccaccaggcttttacccaagtgatcgcccaaagcccggatagcagtgacattctagttgtttcgcacggtatgttactgagtgcgttgatttatcagctggcgccagaggacttgccgtttatgctgttgaagaataccagtgtgacgcgggttgacatcacagagaagcagtggcatgtgcgcggcgttaatttaactcgtgaacgcgacattttggcacttcgcggctccgcaacgtcgacggcacacgatgctgcctcggatcagtcgcaaaaatgatttcttggactgaatggttatttaacagcaaccagtcatgttccaataataagaattttgttaaaacgacaacctcagaccttcgactgaatttgtcgttttttgattgcattttaaaacaaccgcgactataatgacagcttgtcacatgacaaattgtcatatccgtgaaaggaggccgtcatgccgaaaccaacgttttttcggttaccggaagcaaagcaaaaacgtttaatggatgccgctaataaagagtttgcccgcgcaccatttaatgatgctagtattagtcatattataaaggatgcagggattccgcgcggtagttattatcaatattttgatgacaaagccgatctatatttttatttattggaacaagtgcggcatcgcgcagttgctgctttgcaacaggtgatggccaaacatcacggggatctttttgccgctatgtcagaattttttgggctgacgattgatgcgctggttcaaggtccgcatgcagcactttatcgcaatgtctttttgcatatggatttccacagtgcctcaaaaatggccggatcacctttagctgagcggccccgtgggcatcatgagatacatcagtatttgctggcaaatattgatcgtcgtcagttacgaatcaaaagcgacgatgatgtcagtttgctcattcgtcagattgtcgggatgttcatgcagacaatcggctatttttattcacgccagactaaaggtaaagaggtgaccgttgctgagttgaagcaacgcaccaatcaaattctggactggttgcagtacggcgttgccagtaaaggggaacgtcattaaattgtgcaagacggtcgaccgcaattgcgatctaatgcacgtgttaggaggaaattatgcttaagcttgcaaaaaaacgcatgtctggctgggccgtcatcggcgccgtcctgttcatgatcgttcaggtgatgagcaacctgtacttaccaaacttgacagccgatattgttaacaatggggttgccaaaggcgatattgattacatttgggcaaccgggatgaaaatgatcctgtttgccttgctcagtattcttgcgagcgtgggaaatgtttttcttgcgtcgcagacatcgcaaaaactgggacaaaaattacgttccgacgtctatcgcaaggtcattaactattctcatgatgagatggacaaggtcggcacaagctcgttgatcacccggacaacgaacgacgtcacccaaattcaaaacgtttggatgatgatcttgcgaatgatgatcatggcaccaatcatgctcatcggggcaagctttttggcttatcaaaagagtcataccctgaccatggttttcttgattagtctgccattattagcctttttcctattgattattatgtattttgctgtgccgttgtttaaggctatgcagaagaagaccgataacattaacttagttttccgggaaggtttgactggcgttcgggtcattcgtgcctttcgtcaagatgattttgaacaaaatcggtttgaaacggttaaccaagattacacgcacaatgccgtgaaagtcttttcaattatcgctgcggttttcccagtgatgacgttgattatgagtggcacgaacattggcattacttggtggggcggccatttgatcgcgcaacaagcacttgaaactgggaatctgattgcgttcatgacgtatgcaatgcagattttaatgagtttcatgatgctttctatgatctttgtgttcattccgcgggcgcaggcttctgcggttcgtttgaatgaagttttggatcaacatagtcggattacgacgccaacctcaccaaagtcgttagacactacccatcctgcactgcagtttgatcacgtccaattccgttatcaccatgcggaagagccagccttgagtgatattgatgtgcaggtcactggtggtgagacgctggcgattattggcggaaccgggagtgggaaaacgacgatggtcaatctgattcctcggttctacgatgcggaaaaagggcatgttcgagttgacggcgaggacgtgaaagccgttgatttgaagaagctgcatgaagctgtggctttcgtaccgcagaaagccaatcttttcaccggaacggtgcgcgataacatgaaatatgggaatgatgaggcaaccgatgatcaaatctggcatgcccttgaaattgcccaagctaaagatttcatcgcggccaatccagaaggcctggactatcaagttgaacaaggcggcggtaatttctctggcgggcaacgtcaacggttagccattgcgcgtgctttggtcaaggatgcatctgtttatgtttttgatgattcattctctgcgctagactttaaaaccgatgctaatttgcgcgccgctttaaaggccgatgctaaaatccagacaaaagtcgttgtcattgttggtcagcgagtatcaaccgtcgccgatgcggacacgattgtcgtgttggatgaaggtaagatggtcggcaaggggacacatgctgagttgaaggccaccaacacgacttatcaggagattatcaagtcacagattcgggaaggagacgagcaataatggcagatcaaaaaaagtctgaaaccacgaagcagccgtccggccctcggatgggtccaggcggccgtgccggtctcgttgaaaagccgaagaatttctggggcacgacggcgcgtttgtttggttacatgcgcaatcggctgattgggatcattgccgtactggttttggcgattgcctcaaccgtctttcagattcgcacgccgaaaattttaggggaagccacaactgaaatttttaaaggcgtcatgaaggggcaagctgaacaaaaagctggcatgtcagttggcacttatccagttgattttgacaagatcaaacagattatcttaatcgtcctagtcttgtatttgggcagtgcactgttcagtttcctgcagcagttcattatgacccgaatttcgcagaacacggtttatcaactgcgaaaagatttgaagtacaagatgaaaactgtgccgattaagtattacgacacgcacagcaacggtgatatcatgtcgcgggcgattaatgatatggacaatatcgcctcaactttgcagcaaagtctgacacaaatggtgacaagtgctgtgatgtttgtcgggacgatctggatgatgttgacgatctcttggaaactcacgctgattgctttggtgacgattccgcttggcctgattgtggtcgggatcgttgcgcctaagtcacaaaggttcttcgctgctcagcagaaagccttagggttgctgaataaccaagttgaagagacttatggcggccaagtcatcatcaagagtttcaaccgtgaagacgatgaagtccgcgattttgaaggtcagaaccaagcattttataatgctgcttggaaggcccagtttgtttctgggatcatcatgccgctcatgatcttcctgaacaacatcggttatgtttttgtagcaatcatgggtggtatcgaagttgccaacggtgcgattacactggggaatgtgcaagctttcctgcaatacatgcaacagttctctcagccgatttcacaattggccaacttggctaacacgattcagtcaacgattgccagtgccgaacgaatctttgctgttctggacgaacaggacatgcaagacgagccgtctggtgtgccagcagtcgcaaatgatccgaacaaattagtgatggatcacgtacagtttgggtatacaccggatatgctgctgttgaaggattacaatttgcaagtgaaaccagggcaaatggtggccattgttggaccaactggggccggcaaaaccacaatcatcaacttgctggaacgtttctacgacatcagtggcggttcgattcgcttgaacgggacagacacgcgtgatatgaagcgagaggcagttcgctcgcattttgctatggtgcttcaggatacgtggctgtttaccggtaccatttgggataatttgaagtatggtcgagaagatgcgacagacgatgaagtgcttgcggctgccaaggcggcgcacgttgataactttgtccggcagttgccagatggctataacacgattctgaatgaagaggcgtcaaatatttctcaagggcaacggcaattgctgacgattgcgcgtgcgtttgtcgccgatcctgagattctgattcttgatgaagcaaccagttcagttgatacccgaactgaaattcatattcagcatgccatgaaccgactgttgacgaatcgaaccagttttgttgttgcacatcgactttccacgattcgcgacgctgacaacatcatcgtgatggatcatggttcgattgttgaaaccggcaaccatgatgaactcatggccaaaaacggcttctacgctgatctgtataacagtcaatttagcggtaatgttgctatttagggctgatttttagggacgagcgtgagccataatttccttgtaggacttgtgattcgttaaattccgaataatcgtaggcgggtgctaggctaaaagttccttgccgtgccaaacgccgcaatctccggccagacggggtggcgacgcgtagctagagcagtgacggcgctttgagctcgcaaaaagcgcgatctcaaagtcgcctaacaacatcagctccaaggaccgtcgctgtgttgtttccacggctgagccccatctggcctacgattgcttcgccttggcactaggatttttaaatttttcctgactatctatgaaaaacaaagacgactgattttccgcaattgaaaatcagtcgtcttttgtttggcaatggtgaacgttgaaacatcttaacttttcagcgccgcttgtggcgcatgaaggtggcgtagtgcagtaggcaggctaacagaacaaagaagattaccacgaagctgacatagcgccaccagaagttggtggcgatgccaggtaaaagtaactgaatgcccatcgtcgccagcgccatcacagcaatcatgccgaataataagaagtatcgtttcacggtttcatcatcctttttcttaaatgtacctaatttttcaccgagttggtgggcttgattgacctttgccagtggcagtgaggtcatcccccaagtatgcggtaaaaccagttcggttattttatggacacctgctgctgtcatggctttatcaatcgcaaccaaggtcgcatcggtttggtgcgtgaacgtattgtccaagccggtggcaaaacaactggtgacactgacataatgcttgtccttgaattgcccaggcaaggtgtcacctttatgagtcattcgcgtcatgcgatggcgcatacagtccagcagttgcttaaattgaccagcgacagtgccaaaataggttggtgtacctaatacccaaacatcagcagcttttaatttggcttcgagtttatccagcgttggatttgtggtctcaggtttgtcaggatgaatttgatattgattcaaatcgacaaactcagttgtggcaggcgctgcaacgccggccagcacttctttgactaagctggcggtgaggccattagcatcctgaccaccgtatatccccaaaattttcatcaaatacttgcgcctttctatgccatgtttttacatgacgtcacacttaactctaaaaaacatttgtgaatttcgcaacttagttttgttgaagaagccgactttcgcgatggccagcactttttgagttgatttgcgaattgaatcaccaaatcaagcgttttgttggcaaaaattgaaccgaatcattatgctgttctcagttatgtaaacagcgggagatgaacgctgtttgcgtgttcaagaaggagcagattaaaatgacaggaatcatattgccagaagagactcgagtggattttgtcgcgcttaaagtggcgaatttgacgttggtgagtcaatggtatcagcaggttgcgcggttagatctgctacggcaaaatgggtcaacgatttatttaggcacccggcttaatcaacaggttttagtggtattgcatcaaattacagggctgcaggcacaacaaccggtgactggcttggatcattttgccattttgttaccgaatccaggtgccttaggtgcggcttatcgcattgtggctaaggatcaaactgtaacgactgcctttcagacaggttatcgggaaggcttcattgcccatgatcctgaaggcaacggggtcgctttcaccattgatcgcgcgattgaacagtatcaagaagaacgacaatataactgggaagacgaaacgcttcagtcgattgacccggcaaccattggcaaacatgccgctcgggaatatgatcgattgccatctggtacgacgattggttatgtccaatttcgggtgtccgatttaccagcgacaagtcattatcttgaacagggattgggttttcgcgaaaagactggccatgatccaaatgaggtttttttagcggcaggggattatcggcatcacattggcattaacttaagactggatgctaagttggcgttgccgacgccggatatgtatggtttggattatgtgagttttatcttgccagatcagcacgctatggaaaacattttgatgaaccttgatgcggcaggtttaacggattacgattataataaagacaatcaatttttgatgattgctggtcctaatcgcctaacgctgtggtttcgggtggcgtgattcgtgataatggtcagtacatcagagagaaggccagcatggattttcaagcagtgacggatgaactgaagacatggacaaaagcccgggtaatgccgggttttagtgtggcattattgacgggtaaaacggtgcagacggcggtcagtggcgaggcacagtggttcccgcaacctgcgcctttgcagccgcatatgctgtacgacgtggcatctttgacgaaggtggtaggaactaccacggtgttcttgcaagcatgggaccaaggcttggtttcgccggatatgccgctacaccgattcttgccagatttcccgcacacaaccacttttcgacaggcactcacgcatacttcaggactggaaggctatattccgcaccgtaatgctttgtcagccccggcgctgaaacaggcgttgatgacgcaactgactgttaccgaagaagtggatcgtcaagtggtttatcgcgacgtgaatttgttgctggttggctgggctttggaacaggtatatcatcaaccaattcaaacactcatcacgcggcaagtgatacagccgctagccttaccgcaagctacttttcaacctgattcacaacaatgcgttccaacaacgtatagtccggcagtcgggttgcggcaaggtgttgtccatgatcccaagagcgccattcttggtaagcatagcggtgcagctggcttatttgcttcgttggccgacccagtaactttcaccgaatacttttttggcaaccgccaatcagcaagctggcccgcgcatgcggctgatctcacacaggattggacaaagcatcacttaggacgcagtctcggatgggacttgcggcgcgatggtcaaggccgactatggctttatcatactggctatacgggcactttttggctgattcaacctgatgatcaattggcattggttgtcttgaccaatcgggttcacccccaaccaaatccggcttttttggcaaagcgggatgctttgatagcccgatttttaagtgatttcaaaacaatgcctgctgtataactgataaagttttgggacatgatttatagttgcaaaaaaagacgagcgattgtccgtagtatttggagtacggaaaaccgttcgtctttcattttgttatagacaatctgctgttgaatttaaagatcccagtgccaaggcggagcaatcgtaggccagatggggcccagctgtgcaaacaacacagcgactgatctagttaggcgacttcgaaaccggtttttgggctcgaagcgccgtcactgctttagctatgcgtcgccaccccatctggccggagattgcggcgtttagcacggcaaaggattctttgcctagcattccttcccacactgtcgtacaaagcatacgcggcctaaaagcctgctttgatgtatccgccatcgcttaatttcttgcgtagttgcaacattgctgtataggtggccagaacgtaaagttgatcttgcggggagcgttttaaggtgctgatgacatcatcaagagctggcttgctgacaagtgctttttcgggcacacctgcgactgtaaggcgtaaaccgatgtccttgtagcgttcgccgccgaccaaatagctggcggccttttgactggcaacgagttcttcaaaattgccgtcccaaatccaactagtatcaatgccatctgcataattggcattaagcagcattgcaaaaccaaacggctgcttggcggtttcgatcatgctgaggacctggttgaggccgactgggtttttaaccaaaatcaaggttaattttttcttgccaagttgaatgacttcttgacgaccgaagaccttctcgtcataagcaaaagcttggctgatttcagtcggggtaacaccgaacgcccggccaacagcaaaggcggcgagcgcgttgtagatgttatacatgccaccgatgtcgatgtggcatggttgatcatcaatcatgaagtcgctgctttgtggggtcatttgggtgacctcggtgatttgatgggttaaagcggggcgtttgaagccgcaatgcggacaaaaataattgcccaaattggcgtaagtttgtgcatggtagtgcagaatgtgctgacataccggacacaagacaccgtccgtattcggcggggctttatgatcgccatttgccgtgagttcaaagccatagtaggtgactggattaggcagctttcgggagctgaaaatcggagcgtcgccattagcaatgaccatcgcttcaggatcgcgtgtcacaccgtctaaaattttctgataggtggtataaaattctccataacggtccatctggtcgcggaaaatattggtgagaacaaaggccttgggttttaactgagcggcaactggtgcaacattggcctcatcaacttcgagcacagcgataccgcggccatgaccgcgcttcggctgggccaaaaaagccgttgtgataccttgcaacatgttggagccagtggggttcgttaaaacttctttatatttctttttaagcaccttaacaatcaggctggtggtcaacgtcttgccatttgttccagtcaccacaataacatcgtagttttgaccgagcgtccgcaagacttggggatcaattcggttggcgatctggcctggtaggctcgacccgccttttagaaatgtgtgtaagaaccagtaactgctgcgaccaatggcagttgccaggctagcttttgcagaaaatgccacggcgttcttcctctcaacttaatgggactattttagcataagttgcaagcaaaccggcgggcgtggtgttctttgcacaaaaaatccgttatactgtgagctgtgatatttgagatggaggcggcatatggcccagcttttctttcgttacggtgcgatgaactccgggaaaagtattgaaatcctgaaggttgcgcataactatgaagaacaaaataaacgcgtcattttgatgacaagtgccgtggatgatcgtgccggcgtcggtatgattgccagtcgaatcggcttagaacgcacggcaattccgattacacacgaaaccaacctttacgacatcatcaaggcaaatgaccctaaggctgcctgtgtgttgattgatgaggcgcagttcctacagaaacatcacatttttgaagcagcacgtgtggttgatgaattacatattccagtcatggcgtttggtttgaaaaatgatttccgcaatgagctgtttgaaggttcaaaatatttattactctatgcggacaaaattgaagaaatgaaaacgatctgctggttttgtgccaaaaaagcgatcatgaatatacggattcatgatggccagccagtctacgaaggcaagcaagtactgattggtgggaatgagtcgtattatccagtttgccgacatcattattttcatccgccattgaagcagattgaccccgccgattaaattttaaatggcgcttgacgataagtgcccgcactggcgcgtttagcgactaggcgtgtcgattgtgacgccggtaaatgcatttttaggaggaaacatggataagatttttgaacagttggatggtctgctggaccgttatgaagaacttcaagagctgatgtcagaccctgaagtgattagcgatacaaagcgttatcttgccttgtccaaagaagaaggcggcatgcgggatgttgtcgccgcttacaagaaatataagcaagtgctttcagatattaaagaaagtgaagaagttctgcgggaaagcaaagacgatgacatggaagctttggccaaagaagacctcgaagacttgcagaagcaaaaggctgaccttgaagatcaaatcaaggtactgatgctgcccaaggatcctaacgacgataaaaatatcattatggaaattcgtggtgcagcaggtggtgacgaggccagtctttttgctggcgatttgttgaatatgtatatgcattacgctgagcgccaaggctggaagaccgagatcattgacgcaactcctactgaagtcggcgggtacaaagaggttgtggtcatgattactggggacaacgtctactccaagcttaagtatgaaaatggggcgcatcgtgtgcagcgcgttccagtgactgaaagtgccggccgcgtgcataccagcactgcaacggttggcgtgatgccagagtacgatgaggttgatctaaaaattgatccaaaagatattcggacagatgtttatcggtcatcaggcgccggtggtcagcacgtcaacaaaaccagttcggccgtgcggatgacccatattccgagtggcattgtggtctcaatgcaagatgaacgtagtcagcaggaaaaccgggcccgcgcaatgcagattctgcgttcgcgtgtttacgattattatgaaacccagaatcaggaaaaatatgatcagaatcggaagaatgcgattgggactggtgatcggtcggaacgaatcagaacttacaactacccgcaaaaccgggttactgatcatcgaattgggttaacactcaacaagttggatcgtatcatgaatggcgaactggacgaaattatcgatgcgttgatcgttcacgatcaggcacaaaagatggaatcgctcaatgtctaaaacgtatgccgaggcgctcaagtgggcgtctttgttgttgaccaaggacgggattgatcctgacggtgcgcggtatgtcttgatgacacgcgcggacttcaccccaagtcaattgattttgcatcgtcaagatctgatgcctgaaacacgttggcagcaatttcaacaggatgtcgaacgcttgcgtcagtttgagccggcccaatacattgtcggggtagcccctttttttggtgagttgtttaaggtcacaccagcagttttaattccgcgatttgaaactgaggagcttgtggcttgggtcgctgaagagcaacggacagcacaaactggcttggatcttggtactggcagcggggcgattggcttaaccttagcccgcaagttgccgcaaacaacgatgaccttgagcgatgtttcaccagaagcacttgcggtcgctaagcaaaatgctaagaaacagcaggtggcagttcagtttacggtgagtgacttgtttgcagccctaccagcacggtatgactttgttgtgacaaatttgccttatatcgccccagaagagacgcctgtgatggatcaaagcacgctgcgttatgaacctaagttagcattatttgcaggccatcatggcctcgccgtttttgagcagtttgttgcagcgttgcctcagcacttaacagctggcggggtggcatacttagaattcggttatcgccaagagccggcattgcgcgaactttttgctaagcaactgccacaggcgcaggtgacttttcgacgcgatatggcagatcatcctcgtatggccaagctgcaattctgaaggttaaaacacatggtgtgacctttgaactgatctgctacaatttttctactaagtttgagctatttaaaaagaacatgatttggaggcaacatcttgtcaaaacgttatcacgaatctgatattccggaagctgcggctgcgctgaagcgtggtgagttggtggcctttcccaccgagactgtttatggtctcggggcggatgcgaccaatgtgacggccgttggaaaagtttatgctgctaaagggcgaccgtctgataatcccttaatcgtaacggttgccgacgctgatatggtcggacaatatgccacgattaccccgcttgcagcaaagctgatgcaggctttttggccggggccactgacaattattctgaatattttgccaggtcggctgtccatgaaggtgactggtggcttgcagacagctgccttccgaaatcccgataacgcgttaacacgcaaattgattgcgacagccggcgtacccattgtcggtccatcagccaatacttcgggcaagccgagtccaacaactgctgaccatgtgttgcatgatcttgacggcaaaattgccggtgtactcgatgatgggccaactcaagtcggtgttgaatcagcaatcattgatctcacggtcacgccaccagctattttgcggccgggagccattggacccgatgaacttgaaccgttaatcggacacgttgatacggcagcacatcatgttggccaaaacgaagcacctaaggctccaggaatgaaatacaagcattatgcaccagctgcgcaggtagttgttgtcgatgatccagcgcaattttcggcagcggtcgcttgggctaaacaaactggtcaagtgtttggcctgttggcaactgatgcaattttggctcagtatccgacgataccaagctattcacttgggaaggatgttcaaagcgctgcccacgctttatttgccgggttacggtggtttgatttacatcccgatgtcacgctggtcttagcacaagccttttcaaaaactgaattaagtgctgcttacatgaatcggctgttgaagtcggctggcgatatgcattttcaaggatagtcgcagcgaatcatagcgctaaccgtttatgagtgctggattatcgaggactcaagtttagccgtcgtgctgaatcgttatcttggatgatggcagctgtttaaacgaaacagaacgccaacattcagctacaaataagtagattttctagcagacccacgatgatttgctataatgagaccaactgacagagcctttgtgagttggtttttttaataaaagcaaatgcaacgggtgttttggtggcgcattttaaaggaggaacttgcatggatttcatggcacaagatccagaagtttttggtgcaattcataacgaagaggaacgacaagaacataatattgaacttatcgcttcagaaaacattgtttccccagcggttcgggcggcacaagggtcagtgctgacgaataagtattctgaaggttatcctggccatcgttattatggtggtaatcaatacattgatgtggttgagaatctcgccattgatcgcgctaaaaaattgtttggggccgaatttgcaaatgtacagccgcattccggttcacaggcaaatatggccacgtatcgcgcctttttagaagatggcgataaagtgctggcaatggatctaaccgatggcggccatctgactcacggcagtccagttagttttagtggtcaggaatatcatttctaccattatggtttggatccgaagacagaacggctaaattacgccaagattcgtgagcaggctgaacaggtgcaaccgcgaatgattgtggcgggggcttcggcttatagtcgcgagattgatttcaaaaaattccgcgaaattgccgatcatgttggggcctttttgatggtcgacatggcgcatattgccgggttggttgccgcaggtttgcatatgaatccggtaccttacgccgatgtggtcacaacaacgacgcataaaacgctgcgcggcccccgtggcggcttgatccttgctaaggcgcaatacggcaaggccattaattcagcacttttccccggtattcaaggcgggccgcttgatcacgtggttgcagcaaaagcagttgcattaggcgaagcgttgcagccatcttttaaaacatatgctcagcatattctggataacatgcaggcgatggtgagtggttttgaagaagatccgcatttgcggttgatttctggtggttctgataaccacatggtcttgattgatgtaacgggttatggcgtaaatggtcgccaagttcaagatttactggatgaagttggtatcacgactaacaaaaatcaaattccaggagagcagaatggcccgtttaaaaccagcggtatccgagtaggtacggctgccattaccactcgcggctttacagcagatgagagcaaacgagttggcgaattgatcagtgctgcgattgcccagcgtgatgatcagccagctttggaccagattcatcaagaagtgcttgcactgacagcccgtcatcctttatcatagttagggtttgcaaacaaatgattatcaaagaaaacgtgattgacttcttttgaaaccggtctatcagaggacttaggacgtgatgttcacggtagcacatggcgactaagacctttatatagcggtttctaggatgaagaatgcgtttaggaggcgccaaatgggcaaatttacagttttgaatcacccgttgattcagcataagctgaccctgattcgggacaagcatgctggaaccaaggagttccgcgaaatcgccaatgaaatcgcggaattaatggtgtatgaaatcacacgggatctgccacttgaaagtatcgaaattgagacaccgatgggtaaaactatccaaaaacagcttgctggcaagaagcttgcggttgttccaattttgcgcgcgggtttagggatggttgatggtgttttgcgcctgattccagccgcaaaagtcggtcacattggcatgtatcgcgatgagaagacccttaaaccgcatgaatactttgttaaaatgccgccggatattgaacaacgggatttgatcattgtcgatccaatgctggcaactggcggatcagctaacatggccattgaggcactcaagaagcgcggtgccacatcaatgcggctagttgtcttggtggcagcgccggagggtgttaaagccgtccaggcggccaatccagatgtcgatatctatgcggcagcgttagatgatcatttgaacgaaaatggctatattgtgccgggtcttggagatgcaggcgacagactttttgggacaaaatgacattctttggcatgtgtaaaagcacgtgcctttttcatatttcttcaaaagaattttcatagccgcaaaaataggtggtcaaaagtcgcccaaagccatgaaaacactgatgaaaaagccgctatggcggcaaaagtttctgctttcagtgctttgtcttttaggtgaaatggtgttagagtaatgattgtgtttcaggggtctgccctagtaaacaacgattatcgaagtctccgcaatcgtgcatcatcattttgatgatacaaatgatatgacgtcacttcagtaaggaggtgaattctgtgaacgaacaatatccctcgatcaagctttttggcttaagctttaacctgacgaatgacatcggcgttttggtttcggcagttctggtattcttactggtattctggctgtctcgcaaccttaagatgcggccaggcggcaagcagaatgtgctggaatggatcatggattttacgaacggtatcgtcaaaggtaccatgcctggttcggagcgttatacttttaatttatttgcgtttacgctcttcttatttattttcattagtaaccaaattgggttattcattgaagtcgatatcggcaaagacacttggttccgttctgcgaccgcgtcgcctgtcatcacgatgacgttggccatgatggtactggtcctctcgcattacttcggggttgtcttcaagggtttcaaaggatatctcaaggggtatgcgtcaccggtcgcaatcctgcttccgatcaacctgcttgaagagtttacaaatttcattacactctccatgcggctgtatgggaatattttcgccggcgaagtcttagtcctgctcatcaggcagtttgctttctcaggcggggccgtcagcttcgtctccggattcttgcttgaggttctgtggcaagggttctcagtcttcattggtagtattcaagcgtacgtttttgtcacgcttgggatggtttacacatcacacaaaattgtgtccgagtaactaaattaggaggaaatttcttatgcaattcatcgctgcatcaatcgccgccggcatcgctgccttcggtgcttcaatcggtaacgggatggttatcagcaaaaccctcgaaggtatggctcgtcagccggaaatggctgggacacttcgtgggactatgttcatcggtgttggcttgattgaagccgttccgatcttgtctgtcgttgttgccttcatgttgatgagtcgttaatctggttcatcaataaagaagggagtggcaaaaaatgactttaggtgacacactcttcacactagtcacatttctggttctgatgctagccgtcgggaaagtggcctggaagccagtttcgaaaatgatggcggatcgtcagcagaaaatttccggagatctggattatgctgaaaagtcacgcaaagacgcagatgctttagcagctaaacgtcaagaagaactgcaacactcccaagccgatgccgttaagatcgtgaatcaagccaaggaaaatggcgagaaacagcggcaatcattggtcgacgctgccaacgcagaagtcaccacgatgaagaagaatgcgcaaaccgacattgatcaagcacgtaaagatgctttggccagtgccaaaaatgatgtggcagacctaagtttgaccatcgcgcaaaaactgatcggtaaggaactcaatgcagacgatcaaaaaggtttgatcgatgactatattaaacggttaggtgatgcaaatggcagtcactaatcagatggtcgcaccccgctatgccaaagctttattggaagcggcacaagatcaaaatcaggtggagacggtccatgaagagttacaagcgctacagtctgtctttaacgacaacccaacgatcttgactatttttgataacgctcgaatcacggcagctgataaagatgccttgatgacaaccttaaccaaggatgctagcccgctggtcgctaacttgttgaagttaacccagcaatatgggcgattcggagcattaccagccatcatcagcgcgtttaaccaagcgtacgatgaggaagccgggattattgcggcgactgtgacgactgcagttgctttgtcagcagatcaagctgatgctttgcgcagtaccattgctgcgcgttttggcatgaaatcgacccaactggatcaagtcgttgatccaagcgtcatcggcggtgtgcgaattcaagcacgcggttcggttatcgatggtacggtcaagcaccgtttcgataagatgaaagctgcactgctggcagactaatgagtaagtaaaagaggtgaaccggatgagcatcaagactgaggaaatcagttctctgatcaaaaaacaacttgaaggatatcaggacgatttggcggctgaagaagtcggcactgtgacttacatcggtgatgggatcgcacgtgcgactgggctggaaaatgccatggccaacgaattgctccaatttagcaacggctcatacgggatggcgttaaaccttgaaacgaacgatgtcgggatcattatcttaggtgacttcgatgagattcgcgaaggcgaccaagtgaagcgcactggccgaatcatggaagttcctgtcggggatgccatgatcgggcgagttgtcaattctttgggtcagccggtcgacggtttaggcgcgattaagacggataaaacccgtccgatcgagtttaaggcgccaggtgttatgcaacgcaaatccgtatcagaaccgttacaaaccggtttgaaagcgattgacgcgctggtaccgattggccgtggtcagcgtgagttgatcattggtgaccggaaaaccgggaaaacatcaattgcgattgataccattttgaaccaaaaagatcaaaacatgatctgtgtgtacgttgcgattgggcaaaaggacagtacggttcgagctcaagttgaaacgttgaaaaaatatggtgcgatggattataccatcgtgctgactgctggcccatctgaacctgcaccaatgctgtatatcgcgccttatgccggtgcagcgatgggtgaagagttcatgtataacggcaagcacgtcttgatcgtgtacgatgatttgagcaaacaggcaacctcatatcgtgagctgtccttgctgctccgtcgtccgcctggtcgtgaagcctatcctggggatattttctatacccacagtcgcttgttggaacgtgctgctaaattgagcgataaactcggcggcggttctatgacggcgttgccggttattgaaactcaggcaggcgatatttccgcgtacatcccgactaacgttatttctatcacggatggtcagatcttcttacaaagcgatctgttctatgcgggtacacgtccagccattgatgctggtgcttctgtttcccgtgttggtggtgatgcgcaggtcaaggcgatgaagaaagttgccgggacattgcggttggatctggcatccttccgtgaactggaagccttcacgcaatttggttctgatttggatgcagcaacgcaagctaagttgaatcgtggtcgccgaacggttgaagtgctgaagcagcctgttcacaaaccgttaccggttgaaaagcaggttatcattctttacgcattaacccatggcttccttgatccaattccgattgaagacattactcgcttccaagatgaactgtttgatttcttcgatagcaatgcagctgatttgctcaagcagattcgtgacaccggtaatttaccggataccgataaacttgatgcacaaatcaaggcttttgccggcggattccaaacgagtaaacaacttgctgcagcgaaagactaaggaggtgccgcatggctgaatcattaatggacattaagcgcaagatcgcatcgaccaagaaaaccggtcagatcacgcaagccatgcagatggtttctggggccaagttaagtcagatcgaaaagcgggctaaaaagtatcagatttattctgataaggttcgccagattgtgacccatttggctgctgggcagcttcttgagttagccaacgctgcagaaagtgataccgattcgggcgacaagagtcaggtcatctccgttgctagcctgcttcagaagcggccggtgaagaaaaccggctatctcgtgatcacaagtgatcgcgggctggttggcagttacaacagcacggttttaaaagccatgatgcagatgatcaaagatgaccatgaaagtcctgacgattacgtcatgatggccatcggtggtgtcggtgctgatttcttcaaagcacgcggcctgaatctggcttatgaatatcgcggtgtttctgacattccgacttttaatgaagttcgggaaatcgtaaaaacagctgtgacgatgtttgacaatggtgtgtttgatgaactttacgtttgttacaaccatcacgtcaacactttgacctctgctttccgtgcagagaaaatgttgccgatcagtgatttggatgtcagtgaagtggccgataccaatgttgagtatctgattgaaccagatcttgactcggttttggaatcagttttgccgcaatatgcggaaagtctgattttcggcgcgattatggatgccaaaacggctgaacatgccgcttcgaccactgctatgcgtagcgcaactgataatgccaatgacctgatttcacatctgtcgacccaatataaccgggcccgacaagctgcgatcaccactgagatcactgagatcgtcggtggtgcggcagcactagaataatcacgcgcccgctggtgttggttcctaaacacaccagctcggtgctcatcataacgcgctcgctggtgcagaaacctacgtgtaaggaccctgaacgcaatgaccaaagtgcggtcatcacgttcaggcccacttacactccggtttctaaacgcaccagctcgcgctcaatttacaacaggaggacgaaaatgccaaattcaactggtaaaatcgcgcaagtgatcggtcctgttgtcgacgtagccttcccaatcaatggcgatctgccagaaatcaataacgccttgaccgttgccaagaaggatggctcccagcttgtgctggaagttgccttggaacttggtgatggcgtgatgcggactattgcgatggattccaccgatggtctgcaacgcaacatggcggttcaagatactggcggtccgatctcagtccctgtcggaaaagacacactgggtcgggtgttcaatgtgttgggcgaccccatcgatggcggtgaagcctttggaccggatcatcggcgcgacagcatccatcgtgatgcgccaaaattcgaagatttgaataccagttcagaaatcttggaaactggcatcaaagtcatcgatttgctcgaaccttacctgcgtggtgggaaggtcggactcttcggcggtgctggtgtcggcaaaaccgttttgattcaggaactgattcataatattgccgaggaacacggcggcatctccgttttcactggggtcggcgaacgaacccgtgaagggaacgacctttacttcgaaatgaaggaaagtggcgttctggagaatacagccatggtctttggtcagatgaacgagccgcctggtgcccggatgcgggttgccttgaccggattgacgatcgcggaatacttccgtgatgttgaaggtcaggatgtcctgctgtttatcgacaacattttccggttcactcaggccggttccgaagtttctgctttacttggccggattccatcagctgttggttatcagccaacgctggcaacagaaatgggtcagttgcaggaacggattacatcgactaaaaaaggttcagttacatcgattcaggcaatttatgtgcctgctgatgactacactgaccctgcgccggcaacgacttttgcgcatttggatgcaacgaccaacttggaacggcgtctgactgagcaagggatttatcctgccgttgatccgctggaatcatcttctagtgcattgacgccggaaattgtcggtgatgaacattataaagtcgctaccgaagtgcaacaagttttgcagcggtatcgtgagttacaagatatcatctctattttggggatggatgaattgtctgacgaagaaaaggtcgttgtggcccgtgctcgccggattcagttcttcttgtcacaaaactttaacgttgcggaacggttcactggccagccaggttcatatgtgccggttgaagaaacggttaaaggctttaaagctatcttggatggcaaatacgacgattaccctgaagatgccttccgttcggtcggtcgcatcgaagaagttgtcgaaaaggctaagaagatgggctttgctcctgacgatcagaatacggatgctgacgaaaagccggctgcacaagctgcagctaactaaggaggcgacgcgttttggctgaaacgagcaacgttcttcgggtcaacatcgtgacgcctgatgggttagtatacgatcatcacgccaggatgctagttgttcattctgtcgcaggcgaattgggtattatggctaatcacgaaccaatcgtgacaccacttgagatcggtgaggttgacgtgcaacgagttgacgccagtgatcacaacgattcaattgcggttaacggcggttttatggaagtatcagaaaatgttgcttccatcgtcgccgattctgccgagcgtgagcgtgatattgatctcagtcgtgcgcaagctgcgcgcgatcgtgctcaaaagcgcattgctcaagcaaagaatgatcataatcaagacgatcttcggcgggcacaagtcgcactgcgacgggccatcaaccgaattaacgtcaagaccagtcattaaacatgaaaagcagttctctcccaacttggagaggactgctttttgcttgctgcttgatgaaagttagcaaaacctgcaatcaagaccgcttatgttccggtttctaatcggggtggttcacgcttttgctgaaacgcgttcacaggcgcagaaacctgcacataaggaccttgaacctaaatggccaaagccctgccatttaggttcaaggccacttatgctccggtttctaaccgcgcctgttcacgctctgcttgcgtcttatcgtgttctgcgggaagatacctcatgaggtgatcatatgtttcagacaatcggtttaaacggcgcgattacaatcgtgtcgcattttgttttcatcatgctcgcgttccgtgcactcaatgccttgcgctttgaacagttcatcaaagccaaccatgttcgtgaggcacaggtcttgttactcttcattgcggttgcgctaggattcttagtcagttcgttctttctatcactcttacaagcagctttaaacttacctaaacttttcctgtaaaaacctcgtcttaactatggtataatgcgatagttagtcaatttacgaggagagatatatacccatggcaaaagatattgggatcgacttagggacggccaatgtgctgatcaatgtaaaaggcaaaggcatcgtcttaaatgagccctccgttgtcgccattgatacccataccggcaaagtgctggcggtggggacagaagcctataaaatggttggacggacaccgggtaatattcggtcgatccggccgttaaaggatggcgtcatcgctgactttgacattaccgaagcaatgcttgaatattttatcaataaactaaatgtaaaaggtgttttttcaaagcctaatattctgatttgtgcaccaaccaatattacggatattgaacagaaagcgattattcaggcagctgaaaagtctggcggccgccatgtttacttggagttcgagccaaaagtagcggctgttggagcgggattggatattttccaaccacaaggcaatatggttattgatattggcggtgggacgagtgatattgctgtcttatcattaggcgaaatcgtcacgagtcgttcactgcgcttggcaggtgacaaaatggatgcttccattgctgcctacgtgaagaacaagcataagttaattattggtgagcataccgcggaacagatcaaaatcaagattggtgccgtttacgaagccgatgagaaagaaacgattgaagtccgtggccgtgatattgcgactggtttgccacgcgaagtttcggtgacatctgttgaagttgctgaagctttacatgagacgatgatggcgatcattgaaggcgcaaaaggtgtgcttgaaaagaccccaccggaattgtctgcggatatcattgatcgtgggattatgctgacaggcggcggcgccttgcttaaaggtatttcacaactttttgctgcagagttgaaagtgccagtgttgttggcggacgatcctttagatgcagttgcacttgggaccggtgttttactcgataatattgaacaccatcgccagtactaggagcgagctatggactcacaatatcctaaacgcatcttccacatcattaaaatttggctgatgatagccttaatcgcactgatattgggcttattgattggctttgctcttggggaaggtaatccgcttaagttgttcctaccatcaacatgggtgcacttctttaagtttctgcgttaggagtgtttcatgaaacaggttctgacatggttagtgcggggctaccagcgcttcatttccccgttgctgccgccgagctgccgatattatccgacatgctcaacctacatgattcaggcgttgcagaaacatggcgccatcaaaggttccttaatggggattgcccggattttacggtgcaacccctttgttaaaggcgggcttgatccagtgccagcttttttcactttgcggcgtaatccgcatcccgaaaatgacttggatcttagtgacattcaaaatctcaatcataagctaggaggccgtcatggctaaggaaagaaatatcaaggtcacacaggcagatgaaactcgaaatggtcatacagtttcggttttaaaaatcggtgaccgggagattggctttattgaaccggacggcacgcgattttcagcatttgtagccggctcgactaagcctaaccggttcaaaacactggatgccgcagttaatgcgttgattgccgaataccatttacatcaaggctgaaacaactctggcagcgcgcatcgcaacatccagtgctccgtgattttagaggtaaatcggtatttgaacggttttatcatcaacattcagctagtaaagaatatgcttttgcgaaaatcgaaggcattttaagaacgaaacgtgaaccaacgcgtttaggcaagagcgtgaactggcacgttcagaaaccgggacataggcgaccttgagacgacctgttgggttttgaccctttagtttcaaggctgttatgtgcacgtttctgcgtcagtgaatgtgtttaaaggagggcagcccgtggagtcacacgaaatcaaatcaaactcagagggtgatcggattgattatggcatcatcctgtcagtcatgttactggctttgatcgggcttgtgtccatctatctggccaccgctcatgatacttctacgctacagaatcctgttcgtgccacggttatgcaggcggcgtggtatgtgattggcggcatcggcattttcttcgttatgcgatttgatgcggagcagctttggcgcattgccccttatttatacgggattggcatttttctgatgattgcggtattgattttttatgaccgcaacacagaagccagtacaggtgcgaaaagttggtttgcccttggcccgatcagttttcagccgtcagaagtgatgaaacctgcctatattttgatgttgagtcgcgttgtgacccaacacaatgctgctttttcacataccattcaacacgattggcagttaattggccggatggttttgtggacattaccgatagcagtcctcatgaaatttcaaaatgactttgggacgacacttgtttttctggcgattttcgctggtgtcaccttggttgccgggattaattggcgcattctcgtgccgattgcacttgtggctggcattatcgggacagttggcattctgttagtgacgcagacatggggtcgatctattcttggtagtatcggctttaaaacatatcaatttgcccgaattgattcgtggttaaacccttctggtagtacaactggcgacagttaccagctgtggcaatcaatgaaggctatcggttctggtcaattgactgggaaagggccaatgcacattgcagtgcctgtcccagtccgagaatcggatatgatcttttccgtgattggcgaggctttcggttttgtaggtgctgcggttttgattctgttatactttatgttgatctaccaaatgattagggtcacgtttgacacaaaaaatgagttttatgcttacatctcgactggtgtcatcatgatgatcctattccatgtatttgaaaacatcggcatgaacatcgggttactaccattgacggggattccgctaccatttatttcacaaggtggttcattcttgttggctaatatgttatcagtcgggatggtcttgtcgatgcgctaccatcatacgagctacatgtttagtcgcgacacagaagattttgaataggggagagcaaaatggcaacaacttatttttggcaagatgaactggctgccgggcaaattcgtctcggcttgacccaagaggctcaagaaacgttaggcaaaatcaagtatgttgatttgccaacaattggcgcgagccttaccaccggcaaaccttttttaagtgttgaagccgaaaaagccgtgttagatcttgaggcaccgttagcaggaacaattgtggacgtgcatcaggaattgagtgataaaccagctttgttagacgaaaccgatcataaccaaaactgggttgtgacagtttcaaccaaatagctaatcaaaaagccgacccgcatttttaaaatgacggtcggctttttgcatggcacattgtgagttagcgcggcttattcgaagaagcgcttggcaatttcttgataaattttgatcgccgtcgtgtaactgttcaggtcgatgtgttcattcacttgatgactgaagtggttatcaccggggccatagacaatcacatcaaaatggttagttgatttgatgaactcggaagcatcggttcctccaaacgcaacggctaattcagctggtttaccagttaccgccgcgatggcagtatttgccgaagttaccaagtggcctgttttatcggagtgaaccggcagaaaacggtgcaatactttcaacgtgagtttcgcatcggtcgtggcgttgacatgtgccactaagtcttcaagcattttcacaaccagctcaatattggccgatggggtcgggcgaagattgccacgaaggaaagcgtgggctggaatggtgttgacttggtcgccgccattgatgaccgtgattgaatgtcgaaatgggccgagatccgggtcagcaggcgcattgtcaaaggcgtggtgttccagtgcggcaaaagttgttagaccatcgatggcattgacgcctttttcaggcctagaactatggacagagacgccttcactgtcaatctcgtaattcacggtgccagcatgtgcgtattttaagattttagtggtgggttcaccaacaactaagccagcgagatcatcggcatagccttgctctgtcagcaaacgtgcgcccatcgcaccgtattcttcgcctaccgttgcaatcaagcgaatcggatgagtgaacccggattgtttgagggcgatcagggccagcaccatggcggctaaaccgcttttcatatcatcggtgccacgaccatacatcacattgtcgacgactttgccggaaaaaggtgggtatgtccaggctgactcgtctccaggactcacaacatcttcgtggccagtgaaaccgagaacgcgatcaccatggtttaattcggcaattaaattcacgcggtcttctgtgtaggggatcagcttggtaggaatatcggcagcctcaagttcggcttgcagcaatttggcgacggcgagctcgttgccatttacagaattgatttgaatcagcttttggagcagggcaattggttctgtcatgattgcaccatcctttgtcgcgacagtcagctgttgcagactttgtgcgcgagttttgttgagcacagcttacactctttttgatttaaaattcaatgattgacaagttaaaaaattgtgataagctcacttgtacaaacttgaaattgattgtaaacggactgagtgagtagttaccgcgaggcagtacagaaaacctgatgagctgagagcagggtcgctagcggaaatgaagatggcttggcacacacggcacaccgagcaaattgcgaggctgtgatggttggcacccattatcctgcacccggatgaattcgtccgctgagtggatcacgttttgtgtggtcaattagaatggtaccgtgggccagagctcacttctaacaaagattgataatttgttagaagtgagttttttttcggtcttcttgtatcaatggcaagtttatgcgcctcggactgcaggccgacgcacttattttagagagcgcgagtcagcttggtaagaaaccgaagcatcaataggcggggacgtgatagccgtattttggccactaggaaacttatgcgtagattgatgggttggcgaacgtatttaggaggagaagacatgaaacggttttggaaaattttgacaaccatttttgttttaggattagtcttggttgggtgcggtaaaagtagcagcagttcgtccagtagtcaaaagcaaacgacggtgaagatcggggtcgttggcgcggataatcgcgtcttgcaagcagttgctaaaaaggttaaaaaagagggcattacgatcaagatcgtacagttctcggattacaatcagcctaacaccgccttgcgcgatcatgatattgatttgaacctgtttcagcatcagtatttcctgaataactggaacaaaacccacaaggctgatctagtcagcatcgggcagaccatcattgcaccactagcgatctattccaaaaaaatcactaaaattagccagatcaagaaaggtgacaccatcgcacttcctaacgatccgactaacgaaggccgcgcattacagttacttgaaactgctggtttaatcaaactgaacaaaaaggttgccttgccaaccacgcgagacgtgaccgaaaacaaattggatcttcagttgaaggccgttgatgctgcccagacagcaagttccttacctgacgtggctgcttccgtcgtcaactctggcgttgcacacgatgccaaactggatcccaagaaggctgtttatactgaaaaagtcgacaagcaaagccaaccatggattaacgttttcgtcgcaaacaagaaagataaaaataatgctacttacaagaagatcgtcaaagcataccgaacaaaagacatcgctgacttgattgagaaactttatcatggcagtgaagtcccagcttggacgcagaaattttaatggtgagttgagaaagttggtatataagtaagcaatgttgagggtaatccgagttgaattctaggatagaaagcagagagttggcggagcggcgagggggctcagccgtgaaatgtgactagttcataattcttagccagaaaataaaaacgagcaattttccgcgtattggaaaaatcgtttgcttctgcccgcttataaattatttgttgcgattttaaagactgtagtgccaaggcggagcaatcgtaggccagatggggctcagccgtggaaacaacacagcgacgggctctggagctgatgttgttaggcgacttcgagaccgcgggctttgcgggctcgaagcgccgtcacagcgttccagccccagctggccggagattgcggagtttggcacggcagaaacgcgttcgcagccgcagaaacctgcacataaggacctcaagcctaaatggccaaggcccagccatttaggcttgaggccacttatgctccggtttctaagcgcggctgctcacgctctgagtactttatcttgacattttacctaatcatcgtctaaaatcgatttaattcatttcgggaaacgaatgacgtgagtgagtagatctaataagactgtacagaaaacctgggtagctgagagcagggtagttaattggatcgaagatggctcattgatcggcatcgctgagcagtggttaagcgatgatggctggcggcctttaatccgcacacaggtgattgcctgttattgaggacgcgatggcgtcgaattagaatggtaccgcgagctaggctcgcttctaaaacttgtttttagaggcgagcctttttgaatgctttcatcgcttgcacacatcatttgtttacctgaacgaggaggagaaagttcatgaaattttggaaaaaggcaattttgacgtttgcactgattttaccagtatttgttttagcagcttgtggcaagtcggctagttcaacgaagaataccacggttaaagttggcatcatgagcacggataaagaaatttggactgatattcaatcacgtttgaagaagcagggtgtgacgatcaaacttgttcagttcaccgactataatcagcctaaccaagcactggaagatggcgatattcaactcaacgccttccagcatcacaatttcttggataactggaacaagaaacacaacaccaagattgttgatatcggcgcaacctacatcggcccgatgcgcgcgtactccaacaagatcaagtcgttgaaggacgttaagaacggcgatcagatctcggtaccaaacgatccttccaacgaaggccgtgctttacagttgttggcacaaaatggtttgctgacgttgaaaaagggtgtagcttcaccgactattcgcgatatcactgaaaataagctgaatctgaagtttactgaattggatgccgctcaaacagcccgttctttgaatgatgtcgcagttgctgttgtcaacaatgatattgctgctgccgctaatctgaagccagctaacgcaatcgcagttgaaaagattactaaggcgtccaagccttgggtgaacttcattgctgccaagtcagccaaggacaaggacaatgcgacctataagaagatcgtgaaagcctatcagacacagcggacagctgatcttttgaagaaagtttacaaaggttcaaccttgccggcttggaactataagttttagttagaaacggggacaatcatgtcagatcaagcagttgtgactttaaaagatgtggacgttgagttccacggcaaaacccgctcggtgcatgccgttgatcatgtggacttaacggtcaatcgcggtgatatttacggcattgtcggatactctggtgccggcaaatccacacttgttcggaccatcaacttgctgcagcgcccaactggcggcagcgtcaacgtcctaggccaggatatgttggccttgtcgccggcgcagctgcgcaaggaacgcaaacgtatcggcatgatttttcagcattttaatctgatgaacagtcgaactattgctgacaatgttgcttttccattaaaaggaatcaaatcgaagcaagcgatccaaaagaaagttgcggagttgctcgatctggttggactcactgaccgcgctaattcctatcctgctcaattatcaggtggacaaaagcaacgcgtcgggattgcccgcgcgctggcgtcagatcctgaaattctcatttcggatgaagcaacgagtgcacttgatccaaagacgaccagttctattctggagttgctccagtcgctgaatcaacgactgggcctgaccattgtactgattacccaccagatggaagctgtgaagcagatctgtaatcgtgtggcggtcatggatgatggggcaatcattgaacgcggtgacttgttgcaggtcttttccaatcctcagcaacagttaaccaaagacttcattgatactactttgcaactggatcaggcgattgatgctgtcatgcagcagccgaccgtgaaaaatctggggccggatgatcgtcttttacgattaacctacgtcggtgattcagccgatcaaccgctggtggctaagctgtttagtagctatcatgtcacggcgaacattctgtttggtgacattcagattttacaggatacgccgtttggcaacttaattgtggttctttccggtgaccatgatgaagttgaagccggaatcgcgtatttgaaacagcaggatgtcaagattgaagacattcttaagaaggaggcctagacagatgggacagttctttacaaaatattttcctaacgtggtgcctatctggtcgggtgacggcggggtgactcaggcaatcaacgaaacgttgtatatgaccgtgttgacagcagttgttgccggcattctcgggattgtcattgggattctgctggttctaaccgatgaaggtggtttactagccaaccaaccgttttattttatcctcgataaactggttaacatttttcgggcggtgccattcatcatcttgctggcaatcatgacccctgtgacgcgagccattgtcgggacagggatcggaccaactgcagccttggttcctttaattgcagggaccacaccgttttatgcacggcaggttcaaaatgccttattgacagttgatcctggcgtcatcgaggcagctgaagcaatgggtgtttcgccgcttggcattgtgttgcgggtttacctacgcgaaggtttgtcagaactcatccgagtttcagtcctgacgatcatctctgtcatcggcttaaccgctatggcaggtgcagttgggggcggcggccttgggaatctggcgatcgcggtcggttaccaacgttaccaatacgacgtcatcattgtctccttgatctttattctagcgatcgtcttcttggtacaatttatcggtgacttcttcgcacgaaaaacccatcattaaatttaaaactcgttttgtaagcagaactcgtgatagcgttctgcttttttttgaacgcgtttgccgctgttctttttatgacgtagaatggcgatataactaaaagtcaaattccagtcgggggtatcattgtgcacacacttgagattaaggatttacatgtcaaaattaaagcagaacctgagcatccggagattttgaccggcgttaatttaaagttagcgactggtgagattcatgccattatgggtccgaacgggacaggaaaatcaacattagccgagacgatcatgggcaatcccgcttatgaagtgactcaaggcgatgtcttaattgatggtcagtctattttagacatggcagttgatgaacgcgcgcgagccgggctttttctagggatgcagtacccgcaagaaattgctggtgttaccaatgccgagtttattcgggcggcgatcaattcacgccggccagaagatgatcagattcgcatcactgactttttaaagcaattggacgacacaatggcgaccctcgaaatgccggaatccatggcggatcgttatttgaaccaaggcttttccggtggtgaaaagaaacgcaatgaaattctacagttgatgatgattcacccgcactttggtttgttggatgaaattgattccggcttggatattgatgcactgcggattgttgccaaaggggtcaacttattacgtggaccagattttggcagcatgattattacgcattatcaacggctattggattacatcattcccgatgttgtgcatgtgatgaaaggtggccgaattattgaaagtggcggcccagaacttgctaaagaattggagaagactggctacgaacaccttaaagtaggtgatcaaaatggctgaagcagtgactttaccggcacctaacttgcccaagtttcctttagctcggtatttaaaacttcagcctgatgccgtcctagatcgtgtgattctacacgcaccgcaatcggttgcctatgcagcaggctccagtgaggttcaacggttcaccccagtcacgtcattggatgcttggttacttgcacacccccaaggcgcgaccacgattgatattccggcccattttgtaagcggtgatgagccgattgtcttgactggtcctaaacaagcgggtggactgctgtatgttcatgtcggcaaaggcgctaaagtcacgattcaagaaaaatgggcgagcggcggcaatgttttaggcgtttggcttgtgttggttattgatgccgatgccgaagtcagctggctgagttatgacagttttacagctgagaccgtgattgcaaaccgtaccgccacgcttggtgccaatgctaaattgaattggaccttggcagggttttcgcgaaactccggcctcaaccgggtggatgtccgcttattgggccaaaacgccgaggcaaccgtcaacgtgggtgtgcttgcggcaggaagtcaacatgtcagttacacaacctcggtaaccaatgaagcgcaacacacagtagggcatattaaccaacgtggcgtcattactggcagtgcccatttattattcaatgggattggtcacatcatcaaaggtgcacgtggcagtgatgcccaacaagaaaatcgggtcttgatgttgtcgccgcacgcggaaggtgatgccaatccgattctgttaattgacgaaaatgacgtcaccgcaggacatgcggcttcagtgacgcgtgtgaatgctgagcagctatactatctcatgagccgtggtttatctgcgacattagcgaaacggttggtcattcgcggtttccttgaaggcggcttggctgaaattgatgatgtccgactgaagaaagaactcttcgcaacgattgatcgaacgctggtggctgaagatgcgtgaacaatttccattttttagagctcatcccgaactggtctatctagatacggcggcgacttctcagaaaccgcaagctttactagatgctattcaaaattactatgtcaatgataatgccaatgttcatcgtggcttgtataaattggcttatgacaccaccgaggcttatgaaaacgtacgccaacaagtggccggctttttaggtgcggcgagtgctgatgagattatttttactcgcggaaccactgatagcttgaacttggttgctagtgcttatgggccgcaagtcgtcacggctgggtcacaaattgttgtgacgggtgcagagcatcacagtaatttcattccttggcagcaattagccaagcgccagcaggctacgttcacagtgacgccggtaaagccggatggcacggtggatattgctgccttattagcggccatcacgcctcagacgaaggtggttgcggtggcgcaagtgacgaatgttgcaggtgatacgttaccgattgccaaaattgcggccaaagcccatgcagttggtgctgttgtcgttgttgatggcgcgcaggcggtagcacatctggcagttgatgttcaagctatgggggcggatttctatgcattttctgggcataaaatttatggaccaactggcattggcgtcctctatggccgcgctgatttattgcagcacatgccgccgattcagtttggcggtgaaatgatttcagaagtccgcgatgatgtcagtacttgggcagacggcccaattaagtacgaggctggcacgccgcacattgctggcgtgatcggattaggcgctgctttaacgtggtttgatcagtctgtgaatgcagcagcatttgacaacgaacatcaattggcagatcagttacgcgctggcctggcagcgattccagatgtgaccgtgtatggtaatcaagcaagtttggcgactgtgtcgtttaacttaactgggattcacccgcatgatcttgcgactttcttagatgagcagcaaattgccgttcgtgcggggcatcattgtgcacaaccgctgatggcgcgactaggggtcccagctacggttcgtgctagtttcggcatttacaacaatgctgacgatgttgaacgattgattcaggcagttcaggcggcaaggaggtatttccatggcattgactaagctggaccagatgtatcgggcggtcattttggatgaagcacaacacccgcgacatcacggggttttgccagcttttgaccatgaaattacggttcgcaatccaagttgcggtgatgtcttgcatcttcaaatcaaagaggatgccggccgggtaacggacgtggccttctctggcagtggctgtacgatttctcaagccagtgctagcctgatgacggaacagatcattggcaaaacgccagcagacattgaacaaatggtcgaaacgttttctgatttgatcattaacggggatgtgccaaacgctgatattttaggcgatgcagcggttttaaaaggcgtccaccaatttcctgcacggatcaaatgtgccactttggcatggaaagcagcggcgcaagttttgacgcagaaaggtgaagaccatgactgagacaaaaaacactaaaaacaatgaaactgtcgcggcagatatcgactttttgccagaagacaatccagcagattttaaggatgatatcaagccggtgtattctacaggtcggggcttaaccgaggaaacggttcgcgctatttctgcggagaagcatgagcctgactggatgctcgattatcggctgcgtgcttatgcaacgtacaaaaggctggcaatgccgaattttggtccagatctttccgatcttgacttggacaacatgctttattttcaaaaggcgacggatcgaacctatcgcgactgggatgacgtgcctgacgccattaaaaatacgtttgatcggttaggcgttccgcaggctgaacgtaaatatttggccggcgccagcgctcaatacgagtctgaagtggtttaccataacatgcgggatgaattcgaaaaactcggcattattttcatggacatggactcagccttgaaagagtatccggaactcgtgcatgattattttggcaagctggttaaacctagcgacaataaatttgctgctttgaacggtgctgtgtggtctggcggcagttttatctatgtgcctaaaggcgtgcagacagatgtgccaattcaaagttacttccgaattaatgccgagaacactggtcaattcgagcggacgttgatcattgttgagcctggcgcgcatgttaactacgtggaaggatgtacggctcctaactattccagcgacagtttgcacgcggcggttgttgaagttttcgtcaaaaatgacgcttactgtcgctatacgacgattcagaactggagcaagaatgtcttctcacttgaaaccaaacgcgcacaggcactcgacaacgccactatggagtgggttgacggcaaccttggcagtaaaactacgatgaagtatcctagcgtgtatcttgacggtaaaggcgcgcacggtacgatgttaagtatcgcggtcgcaggtgaaggcgttgatcaggataatggcgcacgaatgattcataatgcgccaaataccagcagttcgattgtctccaagtcgattgccaaagatggcggcgcggttgattatcgcggcacagttcgcttcactaaaaaggcagacaatgccttttgccacgtagaatgtgacacgatcttgatggatgaaaaaagttcaagtgatacaattccttataatgaaatccataatgccacagtgtcaatggaacatgaagcgaaggtatcaaaggtttccgaagaacagttgtactacttgatgagccgcggtatttctgaagccaaggccactgaaatgattatcatgggctttgttgagccatttactaaagaactgccgatggaatatgcggttgaattgaatcgtctgattggtatggaaatggatgggtctgtaggctgaaatcgacttcttattctaatgtcgatttttgaagaaaagctggctaaattgttatctgcaatctggaggttgcggatagacgtttagccagctttttttattcgacataaaaatattaggcaagcctaactttttgctttatgatagaagcggcaacaaaaccacactaatttaggaggccgcaaatggataactatgataaagcaagaaaggttttgcaatcaacggcattgtcaaaaatagctcagcagaccggtatcagtatcgggcagatttggcattatcgtgatcgtcacgaaggcattgaaaaggcaccagaggcctatgtaaagaagattgccagtttgtatcgaaataagcggtattgaaatcgctagaataaggggcttgttaatttggccaaattgcaagaggcgtcaagataaaagctatgaacccacaaaacaagtcgtgagcctgatagcgatcacacgtcatgggtgctacaattaaattactgatttgcaaactgaatctcaattttttgcatgctattgcgtgtgccatgatcgcgaggaggtgtaccatggctgaggatcttgaacattttatcaagacaatggcgctggggattccaacgattaaaccagacgaaaagcgagcttttctcggtaattttcgtgagcgagttgcgatggccattacgattaagcagttacgcgatgcacgaatcaccaccatgcttgatgcggtgttgactcgttatcctggttatcgaatttttcttaatggccgaatgggcgaaagtctggtcaatcaatacatgatgcaggccctagctcacaactatcctttcaccattatgaatcaaccggggatgcgcgtgactaagcgcgttttgcaaaccgattttggctgggtattggcacacccgactcagaaaatagcccgacccatccttttataagctggcgacgcacgccgtttgtgaagccgtttgccagttgaacattgcaaaaagtgcggttagtttctgacgacaatcacgtatttacaggaggtccattttgacgcaacttgatacgattcagcgaacggtacaacaactccgcgatttgctgaataaaggcgaaatttttacagcattaccgaatatgttgggcaaagtgattgagagcgtggcagttgaacctgctaccccgattaaaatacctagagacgacaagacggccattgtcaaaatcagagctatccagaagcggatcaagcaaacaagtgatcccagcgtgactgatgatgagattgactttttggtagcacatttggcaagtaccaaccctgcagttcgggataaaggcgttttcttcctgttcaatgatttgtttcaggcggaagccttcaccaatgagcaaattaaaacgcttttcaagcggctgcaagcaccggatattttgttcaatcatatttttgaaccgcaaaacaatggtatctttttgcgcagtttttcgctgatgattctaagcggcatgatctatgctgatcagaatcgttaccacgtgttgactaaagccgattatttggcgactgttcagaatatcgccgtttatattctgttagaaaaagatggccgtggttatgttgagaagaagggctgggcacatgcctatacacatattggcaacatgctggaagaattgagtcaagttggggtcttaccgcgagctgagaaagttttgctcatggccgcagttgtggaagcttggcggcgcgttgaaacaccgcttgtttttggggaagatcatcgcatggctttgtatctgagcagcctgaccaacgtcaataagttttacagtgaaactttattgatgtgtctcaagaattggcagcacgccttggtgaatgttcgtccgcaagaatcctacagtttttgggttcggtggtacaaccgcaatcgattgttgcaagcattggccctgcgagctgatttgccacagccaattgccgattatattcagcaaattgtggatcttttttagttcagatggtcaatagaagggagcacggctttgattaaggctattatttttgatatggatggcgtgattgtcgactcagagccgtgtgccttagaaaatcgactggcctatttacgtcaggtggggattgaagccgatgatcgcaagttggccgggttattagggcgcaatatggccgatgtttggcgcatcattgcgccttcgaaagatgctctgcaacttcaagcaggttatgtggcctacaaacaggcccatccgattccgtatgtaaagattgtaatgccgggtgcacggccaactttacaatggttgaaacagcatgatatcaaaactgccattgcatcagcctcagatctgacctttatcgaaaagatgtgtacagagacaggcttgcgtcagtattttgatcaattgcttagcggcgccgacttcacacgcactaaaccggcacctgatgtctacttggcagcgctgcaggtgctggacgtggctgctgaggaagcgatcgcggtggaagattcaacgcttggtattgccgccgcaaaagctgctggtctatataccttagcagtcccgctacgtgatccccggttcactcaaaatcagcaagcagcagatcaacggattaagaaactaaccgatattatgggaatagttgatgataaaaatgcttataatcaataagcatttttgttttgcatttatattataaaatttatatctcgtggcttttagatacaaaagatcaaaatctaaaaagatattttttaaaaattgaataaatatcagttgttattattagcttttaaaaccacttatccgtataattgactctaggttaagggttaagccttgccaaaattctatgttgatgcacttaactgaaacactggggagtgataagtatgcgaaaggagcagcaaacactgcggatcttgggggataaggtccgttattatcgcaagttgaagggtctatcgcaggccgagctggcggcaaatatttgcacgcaagctacaattagcttgattgagaagcgtaataaagtgccaagcatgaatattttgatgcgattaattggtcgtttaggaattcagctggatgacattgttgtcgagcatcatgatcgggttcagcaactgttgaccggtattgattttcagattcagcaccaccaatatgcacttgctgcggagaatttgagtaagattcggttggataagatcaagaatgatgatgaccaaaagcgctactattattatcaaggaattatcgaactattcaaaaacaatgcaccggatgaggcgatttatttctttggccgagtcctgagcccgttagttaactccgaacgtgacctttttggtattctagcaacgctggggttaggattggcctatgctgccaagcatacgtttgaccgatctcgagtttatattgatcaagcgttacgcatgttgaaacacgtgccactgtctgacagtaaatatctggatgttgagttgacaatttattggcacattgcccgaatttattatgaactcagtgactttaaggccgtcctcaaatacactgatctgggtgttcgagaggcagtcaagcacgataaacttttccttctagatgaattgtttgcattacaagcaagggcgctcaagcttttgggtgaccccgatgcctctaaaagttatcaaattgcgatcgcatttgcccgagtgacaggctcaacgcctttggaaacgagcttagtcgcagaaatggtctcgcaaaaaccaaatattgagacagcttgaaaaatcctcatagatgctgccgtctatgacgaaaaaaatacctgaaaacatcggctgatttatgagccagatgtctcaggtatttttttattttttaagcaggttttaatgacctatctaacttgaatattaaaattataatgattatttatcactgttgtcagttggctttttagtgcttgccagtgccggtttgttggccaaatcggtccggacaaccaagacatcgcaaagtgcgtttcgtgtcacatattcagtgacggacccaatcagtaagcgttcaacagcgttcaaaccggtggcgccgatcataataaggtcgatattcttagccttagggatatcacgggcgatgatcgtcttcggagcgccatactcaatactgaaactgaccttgtccaatcctgccttcttggcttgatccacatagccttccatggtactcttcgcgttttctgtgacttgttcaaccatcgctgagtcaaaactggaaacgttctggaacgcgcgggtgtcgacaatatgaatgagaatcaattctgcgtcattccgttttgcaacggcaaccgctttcttgaatgccaactcagcttcgtatgagccatcgatcgcaaccaaaatatgttgatattgttgtaacattcctcatcacctctaccttcattgtacttgatttaatcatggaattaaatgaaaagcgtttcacaacttcatttgggtcagactaattagcacgaaaatcatggctaagaaggcaccaacgaccaaaatcacgagatttgcccagagcggaaagaaaagaccaccaatgatagcagcaatgccaacaaggacaaacaggcaagcaaatagtttaagaaaacgggttaaacccggcgttggtttcttaataatcaaaaagttttgttcacgatgcaaccatgtataggctgctaaggcaaacgttactacggcgtaaatgcccattaacaagagagtcacgagagtcctcctatctgttttctttattatgccatagctggcagggaatggcggggggatttttctgaaaattgagtgacttttagacgctcgtgttcccactttacattaacgcgttcggtctacctagaccttggacgcgctggccaaagaacagccatcacgcctagggccacttatatgccaacttctaaacgctctggctcacgcttggggctgctttttgcggaaggctataactgacgctgggctagctttctataacgcgttcgccagcccagaaacctgcacataaggacctcagccataaatggcaaaacccagccatttatggctgaggccacttatgctccggtttctaaccgggctagctcacgcttccacaaaaaaagccggcactgggccggccaaaaacaggtttggtttttgtgaaaggctaattggtgccgttttcttcccggatcgttgaaacccgctactagctatgtgggcccagacgccagagacattagccgctaagtgaaatagcagcaccgtccaagactcttccggtcccaaggtctcgatactgttcggtcaactgatagttaaggaagcgcgaacaccttagaactttcatagttatagtagcacgggaaggcaagtagttgcaagcgtaaacgcttacgttaccttttcttagacttttgcgcatcacgctgccagtctttaagttgttgtagtcgctgagccagtgccgcttcgtatctgccggtggccttaggctgatagtagtgtttatttttaaggttgtcaggcagatattgctgtgcaacccagccattgggatagttatgcggcagtttgtagtcgataccatggcctagttgtttggcaccgcgataatgggcatcgcgtaaatcatctgggatttggccggcattgccgttttcaacatcggcgagagcttcgtcaatagccttgataccggagttgcttttaggtgcgaggcaaagatcaatgacagcatcagccagtggaatgcgaccttccggcaatccgagacgttcagcactttgaatggcggtcaaggtgcgactagcagtggctggattggcaaggccaatgtcttcataggcaatgaccagcagtcggcgggtgatgctgttgaggtcaccaatggcgattagccgagcgaggtaatgtaaagctgcatcagcatcggagccgcgaatggatttttgaaaggccgaaataatgtcgtaatgcgcgtcgccgtttgtatcgccagccaaagcgggcttttgcagactttgctgaatggtagttagatcaattgtgatcgtgccgtcatcgcttgctggggttgataataccgctaattcaagcccgttcaacgctgatcgtaaatcgccattggttgcatgggtgagataatcaagtgcgtcaggctgtaagtcaacctgatagtcaccaagtccgcgtttgtgatcggctaaagcccgtttgatggcgcttgcaatatcatctggcgtcagtggcttaacctgaaagatttgagttcgactgcgaatggctggctgaatgttcatataagggttttcggtggttgccccaattaaaacgatgcggccactttccaacaatggcagtaaaaagtcttgcttggttttatccagccgatgaatttcgtctagcagcaagataacggttccgctcattttggcctcttcagccacgatttgaagatcctttttagtatcggtagcggcatttaaaatacggaaggcatacttggtgctgccagcaatggcactggcaatactggttttaccggtaccgggcgggccatagaggatcatcgagcttaatcgatgggcgctgaccatgcgacgaatgatgcgatctgggccaacaaggtcttgttgaccgacaacttcatctaaattttgtggacgcatgcggtaggcaagcggttgttgcaaggcgaaccctccttgtgtgtggcagttttaaaatagacattaactataggaagtacttttaagatgattgacttagtttagcatagaggtgtgacttgaaaataggcggttgttgttgcacggggatgcttacgctccggtttctgctcgcgccagctcgcgctcttgttgtctgcgtgttaatctaattctagatcatcaaataaaggaatgacacatgttgaatcattattggcaactgatccagaaaaataacttgtttggcttacgggacgacactcggattggggtgattcggacggtgaagccggtgttggcggaaggcgagcagctgccagtgtgggcgaatgcgagtcggcatgcgttggtgcagcaggtgtcggctacaatgttacagttgacgacaccgcttttagacgatcccagcgaagttgtggcgtatttgcgtgcgggactcagccgcgtctgggcagcgctaccagaaaatggcaagctgccggttttcaccgccggattggaaaataatcagcgcattcgcattgttttgccggaagtgttgtttgagcggctttatacggcggaaaattttcaagggaatggccctgattatgtaacgtaccggaatcaaatttatgatttggtcgctgatgggttgatcacacaattgccgttactgacttatctctttgccgcttcaccggccaaaaacggccgggcattttggcctgcgccggatcaggaacggcaactggttcaaaaggtcagtgaccctgatcacttagcgcgaacattggctttggatgttgcagtggaacttgatccttatgcggcgagcggtgttacggaacaaatgttgaactttttaatcgacagttgctggtttgctttgagtcaaccagcgattccattgcccgcggcggctgaggtgcgccggcatagtttggcagaagcacagaagattgctgctggcgatcccacggcaccggtcgcgagtttgacagcaccgattgatgccatggcggtctggctgaatcaggtcggcctcacaccgcaacgcaaacaagcttttgagttgatgcaaagtcgagtcctgaagccagaaacgacgattgcgggtcaggtggcggcggcttatcatgatatttcagcagctcaaacaccgttagcaacgcaagcccacgcagatttgtcaatggaagaagatttgccgggcttcagtaacttgtcaggcaacagtcaagccttgcttcaggcagtgattgatggggggtatcagtggaccttgctggatcgggaacagaatattctgcagattgccagtgatactcagcgccatgtgttgattgacggtgcgttgactagtcgcacacctgctagtgccatggtggtagcagaacatcgccatgccgccaaaaaggtgttagcggcggctgggttacctgttgccagaggggccaagttcacacgttggcctgaagctaaagctgcttttgagcaaagctttgcccgtaaaagtatcgtcgtgaaacctgaacagcgtagtcatgggcttgctgttgagcaatttgcggtgccgccgactgccaaacaattcgcccaagcctttcacgctgctaaccaagatcacggcgtattggtcgagatgatggggcggggaacaacgtatcattttactgttataggtcgccgtgtggtaagtgtgttggaaaatgccgctgccaatgtggttggcgatggtcgtaaatcaatcaaagaattgattgcgttgaaaaatggtaagcggccgaatgcgcggcagctcaaacttgacgaaacagcaaatcggcagttgaagttacaatcggttacgatgaatactgtcttgcggcgcggtcagcagattttccttgcttctgcggcgcatccgcaaacaggtggcgatatttatgatgttacaaccgaaatcgatccaagctacaaccaacttgcggttgccgctgctgatgcgcttgaattgccgattgccgccgttgatatcgtgattgataatctttatgacgcctatgctgctgagcatgaaggccaagctatcatcatcagtgtcgatccgattcccgacttaacgttgccacaacaaccagatatgggcgcggcgcattcaattgcacctgctttactcacgtatctgtttagcgaaaaataaaacatctgccgtcatgttcggcagatgttggttataactttttaaaaaaatcaaagccacgttttttcggcttttcagaatcttgctcaagtggtggcagatcaacattcgattgattaatcgccgtgtcggcaacaatcagcaatccagcggctttgtcggctgtttgcgcggtttcattagccaccagcgtgaatggcacattcgcatccgtgagcattttcatataggggcctgtgatggcattatcgagtttcccgtttagcaacgctttataaccatgagcgtgaaagtctttgagtaaaggctgcacttgcgcttgtcgtttggggtcggccaatgcctgattggtgacctgtagagcaacacgttctcgcaaagagcccatataggctcgacgttcatcgggtttggtctgcgggggaccgtaaatcgcactgttcagatgttcctgcatattatcgtctgacattaatggtgcctccttttaaacgcattcatatgcactcattgtaacatgttcttatcttggaaaagaggttgtggttctgtttacacttgaagatttcgccgtttttaaggcgacaacgctggcgacacgaatgcatttgattcgcgaacaattggatcccaagtttgctgaggccgccacggtgattgtgccgctgctgcaaacagatcagcaggcgatctattcgcacattgcgaagcatcaacgtcgctatcgcaatccgccgccgaatacctgggtcgcgttttcaaccagttcacgcggttacaaaatggtgccgcatctggcgctgggcttttgggatgatcggctcttcttgtggctgtcagttttacgtgaaagtaagccggcgtcgcgggtattgacggggatcaccgcgatggcaacaaccttaccgggaaaatggcaagtggcaggggagcatacagataaggcgatgttaccactgacttcagccaatttagcgacagttagggctcgatttcagacgattaaaaaggcggagttccttctaggaaaagtttatttggcagatgatccgatttgggcagatcccgtgcggctttggcaggacatacaacggcgggttgtcgcccttaaaccaatgtttgatcagttggttcaaaacatctaatgtcggggtgatcgcctgcaaatggatcattttgaatgttttgtatgagaatgccgcgagaattcagcgaaacctgtccgccgccatgtttagggtggtagaatcacactgtggtgttgctcgcctgcgcgtgttggtaaagttttggcgaacgcctattttgcctagttcaccacttggattagctagcaaactgcatcatgttaaaggagaaaagccatgccagatgtacgatttcatagtgtgtttgatattatcggtccagtgatggtcggcccaagtagttcccatacagcaggtgccgcccgaattggaaaagtggttcgcgatatttttggtgaagcaccagaaacgatcacgatttacttgtatgaatcgtttgccaagacttaccgcggccacgggacagatgtggctttggtcgcaggattattaggcatggcgccggatgatccgcatctacctgaatcaatgaagcttgcctatgatcaaggcattaaggttagctttgtaccgaaaagcgacaaagttgatcatccaaacacagcgcatatcgtgctgcaaaaaggcgaccaccggctagccgtgactggggtatcgattggcggcggtaatattcagattactgaaatcaatggctttaaaatttctctgagtatggggcagccaacttatattacaattcatgaagacgttcccgggatgatcgcgcaggtgacgaaaatcttttccgatgctggtattaacatcggtaccatgactgtgactcgcgaatcaaaaggcgagcaggcgatcatgattattgaaacagacgactatcaagatgatattttggctaagttgaaacaattgccgcatatggtgaatgtcacttacttcgaatgacagtcgtttttaattgttgtccctgatgttttgataaaggagtcgcctatgttttataccgtcaaagaattgattgagcaaagtcacgcgtttccatctgttgctgcgttaatggtgcataccgaggttgaaaactcgacacggacagaggcacaagttcgccatcttatgagccgcaatctggaagtgatggaacgatccgtcaaagaaggcatcgccggcgtcaaaagtgttaccggtttgactggcggcgaggcgaagaaattagacgcttatgtcaccagtggtcagttcatgagcggcaagccgatcatggaggctgttcgcaatgcggttgctgttaacgaggttaatgccaaaatgggcttgatttgtgccacacccactgcaggatcagctggcgttttagctggtgttctgcttgctatgcgtgatcggttgcatctaagtcatgatcaacagttggattttctttttaccgctggtgcgtttggcctagtgattgccaataatgcgggaattgcaggtgcagaaggcggctgccaagaggaagtcggttctgcgagtgcaatggcggcagctgcgttggtaacggctaatggcggtacggtggagcaagcagcgactgcagttgccattaccttacagaacatgctcgggttagtctgtgatccagtcgctgggttagttgaggtgccgtgtgtaaaacgcaacgcgctgggcgccagtcaggcgatgatttctgctgacatggcgttggctggttgcatcagtgttattccggctgatgaagtgattgaggctgtgaatcgcgttgggatgcaattaccagcgaccttacgggaaacaggcgaaggcggcttagcaacgacaccaaccggattgcgtttgaaagaggaaattttcggtaaataatcattgtcagtcttggctatttcagggcgtgatatttgtggagatgctccaagctgggtgttagcgtcagttgcagtttaaacggaaacacaggaggagctcgtgattcatttctatattgttcgtcatggggaaacagccggtaatgtcagccagttaattcaaggtatcaccaattcgcaactcaatgcgcgtggccgtaaacaggcattggctttgggccgcgggttgcgggcaagcggtttgatgatcgaccgagtcgttgccagtgatctgcttcgagcacaggaaactgcgcaacaaattttactgggcatgcaggtaaagctggcaattgaaaccgacaaaggactgcgtgaagaaaatgatggcgtttttgaaggacgatcgttaaaggatgtttcacaggaggtttttggtgttccggattatcacattcttgtgcgcagcggtaaaatgccgctggaagcgattcctgatgggatacacgcagctgatgcaactaatcaagctgagaatacgcaacaagtggtttctcggtatgattttgccatgcgccgaattgtgacaggcgcagaagctgcgaatgagaccaatgtgttggtcgtcagccatggcacggccagtctcctgtggttacgagcgcatggtggcgatttgccaaatcggaccgaactcacgaatgccagtgttagcaaggttacctatgacaacgggcgatttaaagttgactggatggacaacactgagtttcgtgatcagggattaaaagaagaattatcgtaaaaatattgggaaagcatctgtaggcaagacggctatggatgcttttttaggtgcacagttgtctatatgttaggtggctcggttaagttcatcagagtaaaaagattgtgcgctatcgaaattcaccattcgcgcgtatacttgtccttaagatatgggccatcacagtttttgtgaccgtgataacttagtaaaaataggcaagcttattcatcgtcgttaagttgataagcacattcaaaaggagctggtgacatggagcaagacgtatttttagctaaggtgactaacttgatgcttgcaccgggaacgcgtgcatttgagcgcgaacaattgcgccaggccaaacatttggtagaggccgggcgaccagtggcggaaggctgggcgcaacttgaatcatctttgcggccattggcgatgcgtgataacctgaccccggatgtggctgacttttatcgagcagagaccggtgatccagcaggggctgtgcagacagatttgagtgcccattttgatcgcgacatgccgtttcaggagcgggccatttttgctggcggttgtttctggtgtatggttgaaccattcgtcgatttgcctggtatcaccgcagtcacttcggggtacactggcgggcatagcgcacatcccacttatgaacaagtgatcggcggctataccgggcatgttgaagccgttgaaattatttttgatacccgcaaaatgagctacgcagcattagtggcgctttattttcagttaactgatccgactgatgcactggggcaatttcaagatcgcggcagtcaatatcgtcctgtgatttttgtcaaagacgatacgcaacgccagatagcggaagcggctaaggctgaattggctgcttctgggcgttatttgcgtccaatcatcactgcaattgaacctgttgcgactttttggccagccgagaactatcatcaagacttttataaaaagaatccgaagcgctaccagatggttgaacggacgcgccgccagtttcttcaatttcagcgtgcacaaggcaacctgcgggtgatgttgaaacggcgtaaaaaggcataaattcttgcagtcaaatggcagttgttgttgaaacggaggtagtggcctatgcgggaaccgatacgacattggacgcaaaagaatatgcctgatcttcacggcagctatgcggtcgtaacaggtggtaccagcggagttgggtttgcaatgagtgctgctttgttgcggcacggggcaacggtgatcattgttggcaaacaggcatcaaaaggcgtcactgctgaagccaagttaagggcgcaaaccggtcaacaaaatgtcacgtttatgggcgctgatctggcggatcaagcagccactaaacacttagccaaccgcctgctgaggatgcttcctaagctggatattttaatcaataatgccggtgtgatgatgcccgctaaacataccttgacccgtgacggtctcgagctgatgtgggcagtgaattattttgccggatttatcttaacaatcgaactgatgccgctactattgcgatcggatcatgcccgtgtggttaacgttgcctcaatcgccatgggtcgaccacatttgacctttaatcagtttgatggccatgactatcgcccttggacgatttatacgactaccaagctggcgcaagcgatgatggtggttaagctcaatcagctattgacagaggcaggacagtcggtgatcgtgactggctcaagtccgggattagccgcaacgagtttgaaaacaatcagctcaaggaaaactgcgtggttgatgcgaatgggtgcgttgagttttcgcctgctgccgtttctccggcagtcgccagatcaggcggcattgccagcactgtatgcggcaaccgaccccaatgcgcaaggcggcgtgatttatgcaccacatgcatggcgtggtttgcgaggttacccggcattatgggcttggaatcagcggcccgaattacacgatcagaagttgcttgatcgtttatatcgggcttcacgcaatgtaactggtgtatgactgccattttgggcacgttagattttctaagaagcgactttgctaatgccccaaaagcatcatttctgctgatcccatgctatttttgctgtgattagcgttgtgtaagcggttcacctaaaatggcacatgtagtggtgagcacactcgctaacaccaatatattgtatattcaagacttacatttaaaaaaatttgttgcataatagagcatagtcgttgtcagtgcaacgaaaacgaaagcttaagggagtcttgtttgtgcaaacatctgggaattattttagttggttgatgcatcagttgaaggggtgcccgcagcagaactattatttgttctggtttgcttttgggtgtcagttgatgacccttgtagatgctaagataacgcccgtgactatcattacttttattgggacaactttgggtgtgctttgcgtcttggccattaatgccactaaagcagtcaatgggtggttaggtcttttgagtgccgcatgttttatctatgtcggctttatcgcccgcaattatctatcaatgtttgaacagctagcctatgtggtgacacttgatttgccagttttgattagcgttcggacttggaatgatgatactaagaacaacttgaagacattcaatgcccagaaatggatgctgtcaattggctttacgttgattgtgtgggcggtgagcgcctatttgatcggccagtttaccaatgatccgcggccaatttttgatggtatggcttttgcgatttcattgactggtgggattgtttgcttcctgcgatacaacaatcaatacttctggtggttgttcagtggcgtggctcagctcgttttatgggccattacttttgcgcaaggggatgccagtttagcgatggcgattaatgccagcatttacgtcattaatgatattttggccttcacggttagtccatggttcaatcggggccgcaagcagctgggtctaaaaacgatctaagtggtgctttagctgtgtttgtggtaatgtttgttgttggcgcaacataataaacataattgaggagcgagatctgtgatctacattttaggcagtattggtgcaggaaaaacgtcgctgacaaaagttttgtcagaagatatgcaggcaccggcatattatgaagatgttgaaggtaatggcatgatcgccaatatgttgcaaaaattttatggtgcaggcgttgagagtcgtaagcgaaccggcgcgatgttgcagattgcatttctcacgttccgttaccagcaattgaagaaggctgtgacccaagaaaacgcgattatggattcttcgcttgaatcagacttcgtgatggcctcgcagttgcataaacacggtgaaattgatgatgttgatttcaacgtttatgtgacactgtctcaagagatgcaaagtaatgtcaatggcagtccttggaacggttttcctgatctagcagtttatctgaaaattgatccagatcacgaaattgacgaaattcaaagtcgtggtcgcgatatggaagatattcgcgaaaagccggagttggtcgattactatcggcgtgtcaacacagcttatcgtgattgggcaaagggttatacgcgctcgtctatgattacaattgatcgtgatcgttatgactttatgcactcagcagctgaccgtgccagtgtgttggatcaaattgaaaccaagcttgttgatctcggcaaattatctccgcaagcatttgatgcgttgcaagcgcaacatgcagatgggccgatttctaagtttgcatgatttccagttaaattgttagaaacaacgacctgtgtcatcctcatttttaggggataacacaggtcgtttttgatttgtttcataaaacatgttcacaaacacagcaactcggtcgattcacgcgatgccatctgttttcgattgcaagttcagtctatgatatgcttatggtataagaagtcatggttcgaaaccctaactagcattggttgtcagtagggtaaaggacactgaccccactagaaggaggaactcattcgtgacaatttatgatcagcacatgcataccttgtattcatttgattccgaagcccaactccgtgattacttaacgcagacaaaggcgcctgtcgtgacaacagaacatttagagtttgataatcctgatgatggcggccgggataatctgcctgattatgctaggatgaaggcaacgcaggcggctctggccgaaaaatttccgaacgaattcttgcttgggatcgaagctggctattttgctcctgccgatgctcgattccgacagtacttggacaaccatgactttgatttgacacttttgagttttcatcatgatggtcattacgattatctggatgagcaattgatcaccatgccagctaaacagcagcttgaagattactttgaacggatgctcgctggcctcaaacgatttcatgatgccgacgtcttggcacactttgactatgccttgcgccgatttgacatcacaccggaccagctagaagcttggggcaagccgttgttggatcaaatcttcaccattgccgtcgaaaatgacttggcgttggagttgaatacgaagtcaatgtatcgctggggcaatgcaccactgtatgatcaggcgattgcttggtatcaagcagcgggtggtcacttgtttactattggcagtgatgcgcatgaaggaccgcaatacgaggcaaactttgctgatgcgctagcgatgcttaaacgtcacggggtaaaagaaatcgccacgtatcgtcaacatcagcggacaatggtaccgattgagccgccagtgattgatgctgataatgcttattaatggcaacagggtgaggacatcattcacagcttcgaaaaataaagacgcctgatttttccatttgcagggaaaatcgggcgtctttcgttttctcatagataactgtcgggatttaagatctcagtgccaaggcggagcaatcgtaggccagctggggctcagccgtgcaaacaacacagcgtcgcaagccccagctggccggagattgcggagtttggcacggcaaaggattttttagcctagattgtttcttcaaaacgccgtgaagcgcttatttcagataggcgtaaacaaagttgaaactgttgcccgggctcgtcttcagatcatggatcttcggattaaccatgcgtgctgcaacgagttgatacagcgggatggcaccggcttgattgaccagcaactgttcagcttcagtcatgtccttgaagcgggcagtcgggttgttagcatccgcaccgttactcttagccatgagcttgtcatagtcagcattttgccactggccatggttgtattcactgctactcgtgaacaaatcgagataggtgttgggatcgggataatccgccccccaagtactgagcaccatgtcaaaatcgtgggtggcagcgcgctgctgacggttcttagctggcacactggcgatactgattttgaggcctggcaaattctcttgcaaagcaccttgaagatattcttgagttgccttgactgcatcaacatcatcacctagcagctcaacatcaactgttttggtgccgacttctttcaggccttctgcccacaatgcttgagctttcttcttattgtaagttgtgatggccttcgtgttcttggcaaccgctgtcgcataatcggtgctgctgtccggcaactgactgagatcagccggggtaatcccgcgggcgacaatagaaccgtcagctaacacatttttaacaaaagagtcgcgattgatcgccatggagatggcctggcgaatcttggtattcttgaatgccgggaccttattttcatttaattcaaggaagtaagtccgggcccgtttagtggcaacatagccagtcttgcccttttgttgggcagcgagctggccggttaaattggcatcgtcaagcttaccagtgcgatataggtcaagtgccgtattggtatccttaactacctgaacgtcaatttgcgtcaaatgaacattctttttgttccaataggtggtatttttaacttctgtccatttatcgccagtgccggtccagcccttggatttaaaagcgccgttcgacaaagtatattgcgacttggtaccgtacttggcgccccatgccttaaccttcttagcaggttgcgggaaaaacgcaacgttatttaacaagctattgaagtaaggaatcgggtgttcaagcgtgacttctaaagttttatcattaatagccttgatgcccagatctgttgccggctttttgcctgcacgaatgtcgtccgcattcttgatgccagagtacatgttggcctgagtggacttggtagctggatcaacggttcgctgccaagcaaaaacgaaatcttgggctgtaaccggggtgccgtcactccacttggcattgcgtaacgtaaaggtgtaggtgaggccattatttgtcggcttcacgattttggtcgccatggctggttgcaggtcgtgaccgtagtatttatataacccgttcatggtatcaatgatagcctgtccagagacaccttcagatgctttacttggatcaagcgtttgcaacacatcggcttccattcggtgccagacctgttgcttgctggaactagaactgtccttgctcgattgggtaccgcatgcagtcagtacaaaagtgagtgctgcagcagcaaccacaagccatttttgttgtgttttcaaatcatgcccctccaatttgtaagctgttactagaatatcaatctccttacaaaaagcaagtgctttgtatgaactgatgctttttgaatgacagcttaaaaacccagttcacgaatggactaggcaaaggcgtgatcttagacgttgtggtcgcgaaaggtgagcgtgacagcaaattgttgcttgtctgattgcagcgtcattttcccgccaagcgtggtggtgagtgattgcacaatgctcagacccaagccgacgctttgggttgtccgagctgaatcggttgtgtagaacctgtcaacgagctggtcagcattcgcaagcggtttgtcggtgttgttggtgaaggtgatggtcaagcgctgctcatcttggcgaacgagcgtgacactagcctgattcttggcatattttagccagttaccaataagattttggaaaactcggcgcatcatcgtctcatcggttgttaaaacaagattgggtgcgatttttggggttaccttcataccactggccgtcaattggtcaaaataatcaaataattcggtttccagtaattttgataagttgatgggttttagctttaacgccgtggatttctcctgaatgagattgaagtccatcaggtaatgtaagtagtaattaacagatcgcaaattgtgtgccacgcgggccagcgattgtttggcgtcggcgtgcggatcgcgatttagaagttgaacgtagccagttgcgacggtcagcggggttttaatatcatgcgtcaaattcagcaacatctgatgaatctttttttcttgcgcaatttgctcaagccgcaactggcgggtggcattcagattgtcattaatcccagctgcgagtttacgaaccaaaggaaaattggtattggttgtcaccccagcgttagtctcgacgtgattaatatagataagttcgcgattgatacggcggatatcgatgatgatcaacaaaagagtgatcgccaatacaagacaaatgacgctgagtccgatgatgataccaagcatagccttctcctttgaaaaacatttttcaattgctagcagttatccttaaaaatgatccgtagctaactagctatatcaaccgaacgccgatgccccagattgatacaatatacttcggatcttttgccagatcattgattttggtgcgtaaattgctaatgtgcacgttcagcgtattatctgcgttcatgaacggctcgccccacacctgctcatataattgttgtttgtcgaaaacttgatggggatcgcgcatcatcaacgccagcatcgcatactcttttttcggcagggtcagcggttgattgttgacagtaaccgcatgacgtttgagattcagcgtgatttcaccaacctgtaagtgatcttgtgctttagccgatggtgcaggcaacgtttgacgcaactgcacctgaacccgagccaataactcgtcaatgtcaaacggtttggttaaataatcattggcgccttgttgcagaagcgcgacagttttttgcttgtcttgaatggcggtaagaaccaaaactggcacgctagatgttttgcgaatggtcgtcaaaacactttcaccggtgacgtttggcagcattaagtcaagaataatcaagtcaggtgcttcctgatgaaattgtgctaaggcactgataccgtcataagcttggatcacagcgtagtagggtgataatacatctcttaacaaggcttgaatatcttgatgatcttcgacaattaagattttgcccatgctgtcacacctcctaaacgcgttcgcagccgcagaaacctgcacataaggacctcaagtacaatggtcaaagtgcgaccatcgcacttgaggccgcttatgctccggtttctaaccgcggctgctcacgctctctactaaacgcgttcaccagcctagaaacctgcgtgtaaggaccttggctgcaatggtcaaaacccgaccatcacaaccaaggccacttacactccggtttctaaccgcggctgctcacgctctctcctaatagtgtaagctataagagcagtttttcacaatttaggtttaattaaggattcattatatagccagttaagaaaggcccgttaagctgattttgtaagcaaaaagcggtgacaaaatggtggagggagattgctatgacacaatcagtgttaacgattgaacatgttagcaaacagtttgggcgttttcaggcattagatcaggtcagtttcacagttgaaaaaggggatatttatggcttaattggcgaaaacggggcgggtaagactactttaatgcggttgattaccggcttgtcaccgatgcagcacggaaccgtcacattactaggtgagcaagctggtcactatcaacatgcacttagtcgaattggagctgtgattgaaagcccagcagcgtttgagaagttgaccgtttaccaaaatttgcggttgtgcgcaattcaacatggcattcaagataaacaggccatcacggaagccattgattttgtgggactcaaagcgaagcaaaccaccaaagtcaaacatctttctttaggacagaaacaacgactaggtttggcgttagcgattttaccgcgtccggattttctgattcttgatgaaccgattaacggccttgatccttcgggtattatggaatttcgccaattattgaaacgcttgaacgaggagcagcagacaaccattctaatctccagccatattttaagtgagttgtatcaagtgtccacccgatttggcattattcatcatggacggatgatcaaacaactgaccaaggctgagctggataaagccaatcaatcaggcttggcggtgacggtcgatgacactgcactagcagcacaggttctggatcaaaacggctatcaaacttttgatgttattgacgatcatcatctcttgttgcgacaaccggaagttaatgcagcggcggtgaaccaattgcttgtgaccagtggcgtgggtgttcaggatatcagtcatcaagctgggtcactggaacaattttacatgcagttactggggcaaacagagaagcaggaggggcaagcatgattaatcaaattcgggccgacttctatcgtcaaatccatacaacgggcatgtacatcatgcttgtgctgacgattatctatgcggccacgacaaccttgggacagagtgttggcggcgtgacagtgcgtggcgacagtggtcaatttgcccaagttgggggtaaatcgtggtcagttttaactggcattaaagtggcgaatatgggtgaaacgatgctactttacgtttttatcggcgtttttgtcattgttttcgggtatgagttcagtcaaaaggtttacaaaaacaccttaatctcgggtatctcgcggttagcgtttgtcctagccaagtatttggtgatgttactggacttactgctactattcgctgtcaatttcctaaccgtactgatggccggacttgttgctggacgcccattaggcgggagcttgggaacattgtttggaacctttagtctgagtttcgtggctgcgaccttctttgtgagtgtgatcttcagcattggcgtgttcctgctggtattaactgggtcgattatgataccggcgattgtggtggtggtctttcccctcattgttagtgtgctccatgtactcggtgagtgggactggattaaatatatcgacttcttcggcgtcgcccaaaatatcggcgtcggtggcatgaaggttagtgcattgccaccgtacatcgctgtcagtttggcgctattagttgtgatgattggctcgtcagcattaatgttgcgaaacaaggaactgtaactgaccttttaagatttaaaaacgatccgcattttggctagttgaccttgtgcggatcgcttttttggttgcctgctaaacagtttcgattaattggttgaaaatttccaaaaatttctgagcagcgccagacattgggacgtttttcgtccagattaaggccatcttggtggttagtgtcggagaaaaggggacgaattttagttgcatttcatcatggccgattaaatggctgagaccgacaatatacccggaaccgagttgagcaagcagaccagcattgtaaatcaagttgtagcgagccacgacttgattagggttaaaggcgtggccggcccaatcagtgagcattttgacaactggttcgcgttccgaaacgatcaacgcctgaccccgaatcgtttctggtgaaatagcggtttgcgccgctagcggatcggaaatggggatgagaaggccccagcgattttcacctgagatacggcgataggcatatttatacgtgtcggccggatcaatcacgacgccaaaatcgagtaaaccatggtctaaccgctccttaatatcatcggcattgccactgtatagccgcagtgtcacatcaggaaaagcatcgatcaattgttgcgctgcctttaacacaatctgattaagccgtgactcgccaagaccaattgccagcgtaccactgacggcatggtcatcgacaatgtctgcaaccgcagcgtctgtcaacgtgagaatttgtctggcgcgattcaccaaatacgtcccattcgcggttaaactgatcgcccgactttttcggttaaacagctttgtaccgagttctgtttctaattcctgcatttgtcgcgacaaagcaggttgtgaaatatggatggcattggcagccgccgtaatcgtgccagcatcggcaatcgccacgagatagcgcaatgttcgtaattccatgaaaaggcctccgatacataaaaaaatatcataatactatatgctatataagcattatacattttaagccatcggaccgataataaacttaaacattgaaa

SEQ ID NO: 10 - DNA, 5457 bp, Lactobacillus paracasei
ggtattccaaggacggacagtgtaggatcgtattgggacatttactcataacctcgcttgcttttggtttcgacgctaacaagcatagcatggacactgagtaggtgtctttttgcgttatccaaaaagggcctacacgttcagtgttgattatttctcaacaccagaaagtgtagaccctttattttcggaaagttaattgacctgtcagtgaattattaagagtagtggcatataatataagtagataagtagggaggcaataaagatgaagaagacactattattaatacctgccgtattgcttctttttacagctgggtgtggccagaacagtcaaagcagcagtaaaagtggatcggtgagaacaactcaatcgagcaaaaagaccgcgaaagcctcaacaagtcagaagcaaaaaaagacagcctccaagagcagcagttcgactagctcaagcacaactgagagtgcagatgcggcttcttcctctaccaccaatacaagtggcactgcaaacgttgaccagcgctatgccgctttgaaacaggcgacttttaggcaacttggcaatcctaagtggccaagcgcttatcaagttgatcaaacccaatacttaaatatttttaccactggcgacagtcaaaattactcgattttcttcagtcctggaagtcatgcattagcttataatgatgcaaccctgcaaaatgtgaatgcagaattagcgattcaaaagaagacttatggtaataatgcgcaagctcaggcacagattggcgctgctcaatcaactcaagggttgccgcaagtcgcgatcggtgatggcatttacgcggcaagtcagggagcagcgggttcttcctatttaacttggaatgaaggacgatggactgtgacagttaaggcctcagcggttaacggtgaagatcctttgcctcttgccaaagaagcggttacctggtttgcaaataatgcgttgccggcaccagaaacgcacggaacagttgacttagctgtgaccgccgcgaatacccgtcagaatcagatcacttggactgaaggcaatgcagtctatcagatctctgggcttgacccaatgaaaacgattcaagaaggcacggcgacacgttagcataggttggtttatctcaataactgcttctcattaatctgattaaagtgattctcttggagattaactctgagaggattatttttttgcttgacgtagtgggcaggaactgaatgaaatgataaagtgatcgccagtggtttaacgagtaatttagattcccactcgataatctgctatacttttttcgtaagttcaaaagggtttgagccttttgctcaacaatgattctataataattgaaaagaatgaggtgccaaattggcaaaaattaaagtgatgacggtctttggaacccgccctgaagcgattaaaatggctccagtcgttttaagtctaaagaaccgcagtgacgaatttgaagaagtgaccgttgtaaccggtcagcatcgggaaatgctggatcaagtattatcgatttttcatattgaacccagctatgatttgaatatcatgaaatcacgacaaacgttagccgacatcacaagcaatgtgattttgaaactgggtcagatcattgctaaagaaaagccggacattgtattagtgcatggagacacgacaaccacttttgcggcaagcatttcggctttttaccaacagacaaagcttgggcacgttgaagcggggttacggacttggaacaaatacagcccatatcctgaagaaatgaatcgtcaactgaccgatgttttgagtgatctttattttgcaccaacaaatcaaagtcaggcaaatcttttgaaggagaatcatccagaaagccaaatctttgtaacaggcaatacagcaattgatgcccttgatcaaacagttcgcgatgactatcaccacgaagtgttagatatgatcgatcccaataagaaaatgattctagtgactatgcatcgtcgcgagaatcaaggggacccgatgcgtcgagttttcaaagtgatgcgtgaagttgttgaaagccatccggatattgagattatttatccagtccatctcaaccccgttgttcaagaggcggcagacgccattcttggtcaccacaagcgaattcatctgattgatcctttggatgtcgttgattttcataatctggcggcaaggagttacttcatcatgacagattctggtggtgttcaggaagaggcaccatctttaggaaagccagtgttggttcttagggacaccactgagcggcctgaaggggttgaagcgggcacgcttaaactagttgggactgatccgacgatggttaaaacagctatgttgcaattactggatgatccaaccgaatatcggcgaatggcagaagctaagaacccatatggcgacggtcatgcatctcgtcgaattttggatgctatcttgtatgactttggtaagattcaaaatcgtccggcgccatttaagtagaaaaatcatcagtcatcctcgccactacagaaccttgtagtggcgatagtagttaaggaggaagtttgagtatggcactgcccacattgtggattgtaattccttgttacaacgaagaaaaagtcctgcccatcacggcaccgaagtttttagccaaactcaatgactttattcgtgacaaaaaaattaaggagaatagtcgggttcttttcgtagatgatggatcaaaagatcacacatgggaattgattcaacaatttgcacaaaaagatgctcactatctaggcatccaacaaagtcgcaatcgcggccatcaaaatgctgtcttagctggcttgatgacagctaaggatcattgtgatatcacgatttccattgattcggatggtcaagatgatattaacgctatggatgccatgatcgcggcgtatacagatggttgcgagattgtttatggcgtgcgatccgatcggcagactgattcttggtttaaacgcgtgaccgcgcaaggcttttacaaattcttgcgattgatgggcgtggatgttgtttataatcatgcggattatcgactcgccagcagtaaagtattgcaacatcttgctgattttaaagaagttaatctatttcttcgaggaatgtttccgctggtgggctttaaaagcacttcagtttattatgaacgacatgaacgactggcaggcaagagtcattacccgctgtcaaatatggtgtcattagcgattaatggcgtgacaagtttatctatcaagccaattgtctttattgccgaactaggagctgtagtgagtatattgggctttattggtactatctgggctgctgtgatggcattcaagggggccacggttgctggctgggcatccattgtttgcattgtgtcatttttaggcggtatccaattacttagtcttggggtcattggagaatatgttggcaaaacgtatatggagacgaaacatcgaccacgtttcattatcagtgaccagacatgggaggagactcaagagaaagagcaagaaaagaaaaaccattctcaataataactgagtcagggcttaagactcattggattttggttgttagtattaaaatgactctctagtaagtcaagctttccagagagtcaacgtaaagcgacaactattaaatcccttcatcaatttgacgttaggattttacgggaattgtttcttttggtcgaatagtttttactttcctttggatgaaggcaatgacgcctgcaacaaggtaacttagtatgatcacgagtaggccatagatgacactgtgtgcagcaattgcagcattaccgtgtaggagactggcaatgaagggatggtataggtataggttcagggaccatgcgctgctgatcaaaaacagtttgttgtcacattcaactttatagctgatgatcatgagggcgagtgcgaagaaaatctcactgagcattctgtatcgcattaaactgtgaacttcgtcaagtgtaaaacatatggcgaataaagttgatgtgctgagcatgatcggtgaatagtaacgttgaataaagggaataaaatgatcttcgtagtaggcaaataagacacctgtgggaaagacaaaagcagcattgattaaccattcacccatgccttttttccaaatgtaacccgtgtaaatggctgtcaacaacagcaaaatagcaaacagaggtagcgcatgtccttttgacaatttcattgccagccaaaatgctaagtaaaagaaaatgatggctaatataaaccagctatcattgacaaatggcgcgccatttgtcatcgaaatagcagcttgtttcaatgtcaagcccattagaaaatgtttgatagggaaaattaaaaccatggctaatatgtatagcgttacaatcggcagaagccggtgtggaaggaagttcttcaaataagaagggcctttgatctgatattgtcgcatgatgccataaccagagacgaagaaaaagattgcaaccccaagccgtcccgccaatgatagccgagaagcgaagaaagtacccgcaactggtccaagttcctgattaatatggtgaagaatgatgaaaataatgctgatgccctttaagttgtttgtggtattttttcctaagtggccctttttgagattctgactctgctgcatgctcgcaaggatcagtccgatgaatggtaacaaaataatgtccatacaggtactcctccatttatgttgctttcttcacattaatgctcgcaaaatagtataacatgcaaaaaaagatcagagggtttttattgtgtcatgctagtatgagggttgaagttactgagggtccaccgaatgagctatcgccgttcggctgcttgtttgatagacggttgcggcgtcccgctgatgcaagtgggcactaatgaagtattaacgattttggcaccgctctgaaaggaagaagtgaagaatggaaaatcgaatgaatagggttatgcaagaactcagccagataattgataaatttggcagatatctgctggtaattgctttttcattttgcctgttgtgtttatttaagctccagattattcaaggcgctgcatgggatacatctgcctttgttctgggcggcatgggcattatttgtggggttttcctactttttaaattgagtttgattcaattatcagatcgccaggcactcgtcattttagccgcgatttctctgatattattgggaatttggaactatatctatcgtccagttccggtcagtgactataaggtcttgctagaaggcgcgcaagatatcgtgaatggtacgtttggcaagcatgctgctcagcctagtgactattttaggtattataattttcaaattggctatgcttattatttatcgt

SEQ ID NO: 11 - DNA, 74282 bp, Lactobacillus paracasei
gtatactgttagaaacctgccccctcggcgggtcttccagataaaagcaattccttgccaactccgccccgtcctatatggatggggttttgcgttcattttgttgatgtgcacacaatgtgtacaaaatgttattcaagcctattaaatagggatctagtttcgcccttactctccgttgtcttgcattcggatgtagctacataagaagcctcaaaacgctgttaattcggtgttttgaggtttttttgaacatcaaataaaatttaattgtgtctgatatgattagtagcatgagtggggatttaaaggatgtttaagacatctgaccatcacaaaatcgttaaccgactttagtgactattttgtacgaaaagcttgtaatttttaatagcttccgctagtataaataaagcaatagacaccacacatggaggattagctcagttgggagagcgtctgccttacaagcagagggtcacaggttcgagccctgtatcctccataacgaaaacacctaccactgcggcaggtgtttttcttttacctttttgaagttggacgggggcgtccaacgcatgagatttgacttagtttaaacagctattagagggggctgattctgacaataaaaacgccaccactgattgtggcgacggttgattagccgtgcatgcgcgctagatagagtaacagcgtcgcaatgactgggctaaattggtaaaggtagctgggtactttaaatggtcgacggctgttgatgagcgtgacaaggatgatgataccgccgatagctattaagttgagtcgttgtaaccagtaaccgataacgacggtgattgccaacaagaccatatctgtccacttggcaaaatggctggcccataacccgattagtgctggcacatatagtaatgccaagtcgagcaacatatcctgactgagaaaatgcaaacccgcgtaaataagtaagatttggaataaaattgcttggccaaaagcaatggtaccagcccattgcttggtaactttttgtgtgcgcaacaaaaatgtcaacaggagctgaacagcaactaatggtaacaagatccattgattgatggcaccaatgataccggtaatagcggcaatgattagaactaatgggtaacgtttaacgaccattgcagccgctaagcaaatgcccatgagtaaaagcgcgatgatttgaaaatgccatgtgatttgcaaacttagcgcgatcagaaacggataggcgagtatttgtccgataaaggccactgcaccagcaccttgattgatatttttcaaattgattatcctttctatgatgcttccattttacaaaaccctgagacggtaaacaaagattttcggaaattttacatcttttatgttatgctactagagttgcaaaacattcccgatggggttcgtcaaagctatgacgaacatgccttgtaacctaaaataataagggggaaacaaaacatgcaggaacgccatttatttacgtcggagtctgtttcggaggggcatccggataaaattgctgatcagatcagtgatgctatcttggatgccatgcttgaacaggatcccgattcacgagttgcttgcgaaacgacggtgacaaccggtttagtgctggttgtcggtgagatatcaacaaaggcttacgttgatattcaatcagtggttcgcgggacgattaaaaagatcggttataccaaggaatcaggttttgatcctgatagtgtcggagtgctggtcgctttggatgaacagagtccagatatcgctcaaggggttgacgaaagtcttgaagcccgtgagtctgatactgatccgcttgacaagatcggtgctggcgatcaaggcatgatgttcggttttgccattgacgaaaccgaaaactatatgccgttaccgatttcattggcccacgcgttaatgcgcaaaactgattcattacggcacaagggtgaaattagttatctgcgtccagatgctaaggcgcaggtcacggtggaatatgatgatgatgacaatccaattcgggttgattccgttgttgtctccgtgcaacatgatccggatgtcacgcttgaagaaattcgccgcgatgtcgaggccaagattattcgcactgtgattcctgaagctttaatggatgatgacacgaaaatttatgtcaatccgactggccgctttgtactgggcggtccgcaagccgattctggtttgaccggacgcaaaattatcgttgacacatatggcggttttgcccgacatggtggtggtgccttttctggtaaggacgcgacgaaggttgatcgttcggccagttatgcagcgcgttatattgccaaaaatgtggtagcagcgggtttggcgaaacgggttgaagtacaattggcatacgcaatcggtgttgccaaaccggtttccgtgtcggtgaatacatttggcacaagcgcagtatcagaagatgtgattgaacaggcaatccgtgagaactttgacttgcggcctgctggcattattaaaatgttagacctgaagcggccgatttatgaacagacggcagcatatggtcattttggacgtacagatgttgatcttccttgggagcacttggataaggtgcaggctttgctcaagtaccgagattagcgagaaaagaggcggccttagtcgagaattattctcggctgggtcgttttttcgtgcttatgaggggcttctcaagactaacaacatcgcctggcaactcagaagggatatttatgaagcaaaggaaaaccaatgtcgcactcgtaacggcggcaatttttattggcacatttatgacggcgattgaaggcacgattgtgtcaacggctatgccaaccattatcggcagtttacatggggttcatttaatgaactgggtcttttccatttttctgttgactaatgcgatggcgacgccgatttacggcaaactgagtgacaaaattggtcgcaaaccagtttttctcattggactaacgatatttgtcattggttcgttgctatccggtttgtcacaatccatggaaatgctaattattttccgcgcaattcaagggattggtgctggggctattatgccagtgacatttacgattatcgccgatatttatccattcgaaaaacgagcaaaaatgctcggttttaatggctcgatgtggggaatcgcttcggtaattgcaccgttattgggcggttttatcgttgatcagttaagttggcactggattttctttattaacgtaccgttgggtattttcacgtttggccttgtgtggttctttttgcaggaagatcggcgcagtgtccggcagccgcttgacatgcgcgggacggtttggctgctggtggccttgttggcgatgatgtatggctttcagacattagctgagcccaacggcatctggcagttagttgccatggcaattgtggctacgctgggcttctggcgtttttggcaggcagaacggcgtgcagtcgatccgatcattgacttgaaactatttgaaaatcgtacttttgtgattcataatttgatcgccgctttgatttcggggttcgtgattggatttgaagtctacatgcctatgtggattcaaggaattcgcggcatggatgcttcccttggcggctttgccgtgactcctagttctttgatgtgggtcgttggctcttttgttgctggcaagttattgggccggttccaacctaagccgattctgacaggggccatgatttggctgcttggcggtagtcttgtgctggcattagtgccgcaatcgacaccgtattttgtctttctgctagttgccggcgccttaggattcggctttggtttggtgattacgattactacggtaacagcccaggccgttgtggcgcctgatcaggttggcgtggcgacgagtttcaataccttgtctcgaacgttggggcaaacactgatggtctcggtttatgggattgttttgaatctgcgtctgactcaaggtatcgcggcagatagccggctcaatagcaatatgctcaacgaactgattaatccgcataccgccaaaaatttacccgcagcagtgttgccaactcttcggcaaattttgtatgaaggtctgcacaacatttactttttctcgattatcatcgtggcgttggcgattctagccaatcattttgaagcaaaaagggtgctgacaaaagaaacaattcaggagtcgaatgaagaaagctgaatcaactgaaatatcatacaaaaaaccggattctatttaagaatccggttttttgtacgctgatatcgctctcgtttgccaataaatagctgaagttaaaacggactgaccactcgatcggtatgatcttcggtggcggtttttcagacaggttgtttgtacaatttcgctgttttatcggtgacttgcgcaatgacatcgtagtctgggtcattttctaacgggccaaaattgaacactgtctgcgttgcttcgcgcttgatatcttgcaatctagtgctgataaggacatgtagcatatctgctttttgatgtgatcgttcgatttcttcactggctttggctaaggtatacccttcatcaagcattgtcttgatcatgacgattaaggtgatgtttgccaaggagtatcgtttattgccattagcgtcatgcctgcgagaatgaatgagctgcttcttttcccagtatcgaatttgcgttggggtggctccggtgacgcggctggtttcgcctatgccgagtgaaatatcgagtgaacgtaaacgtgcattaaacggtcccatgacatagcatcctctcttgaaaatgcgctcactggcgcaaaaaccgatgcataaggactgtggtcgtcatgaccaatatccggccatcacagccaagcccacttatgatccggtttctcaacgcgcctgttcacgctattaccttgacatttattaagtttaaatgtaatattttctattgtcaatattacattgtgtgatatagaaaacatgaaatcttataaagaaactaggcgaagttatggacgttaaagatatcaacgggaaacacgtcaatgtaccaatgatggtcacgaccttgatcgttgggacgtttattacgattttgaatcagaccattctatctaccgcgtttccaacgctgatgaaggccttcaacatttcaactgcgacagtgcagtggttgtcgacaggcttcatgctggtaaacgggattatgattccagtgtccgcatatctgagtgcgaaggtgccatcaaaatggttatacatgagtgcgatgagtactttttttgtcggcacattggttgccttcattgcaaatagttttggcgttttgctaattggtcgattgattcaggcgcttggcgttgggatcacgatgccgttgttgcagaacatcatgatgtcgatttttcccccgaaccggcgcggcgctgctatggggatggctggaattgcgattggggtggcacctgccatcgggccaacgctttccggttatgtcatcgacaatttcggctggcgtttcttattcgggatgattctgccaattgccggtctcgttattttggcaacattgtttttcttcaaaaatgtcttaccgttgtctgatcctaagttagatattccttccttgattgaatcatcaattgggtttggctccttgctgtatggcttttctgaagtgggcaatgatggttggggcgatccgatcgttttaggcacgatcgcactcggcgttgtgtttatcttcatctttggttaccgtcaattgcacttaaaagaaccatttgttgaattgcgagtgttcaagagcaaaatctttgccttatccacagtcttaggtaccatcgccaacatggcgatggtcggggtggagatgattttgccaatgtatttgcaaatcattcacggcaagagtgcgttggagtcaggtttgacattgttgcctggggcgattttgattgctttaatgagcccggtcactggtcaagtgtttgatcgcatcggggccaagcggcttgcacagttaggcttgttcttgctgacgattgcaacattgccatactttttcctgacagaaagcacgccttccatttttattacggtgatttatgctgtgcgaatgtttgggatttcaatggtcatgatgcctttgacgacgaatgggatgaacgccttatcacctgatatgattcgacatgggacagcggttaacaacactgtccgtcaggtggcaacttccatgacaactgctgtcatgatttcagttctgtcaaacgtcaccaatctggccaaaccggcggccagtttgttgaaaactaatccgctgcagtataagcaagacttttttggcgcaacacttagtggctaccacgcagcctttctgctggcagcagggttcagtttaattggctggatcttggctttcttcttgaatacccacgcgatgtcgcaagaagtgacgatcaaaaatgaaaagaaggtgaaggcatgattctatggtttttgggcctgacagtgatcggcctttatctcagctttattatgatgaaacgctccagtttgcgtagcacgttaattgcggtcttcgggattggtgtggtgggtagtctattgctgattacgttgaatgataatgcgcattttggcatggtcaaacgaacaacaactgatgagcagaccatctacaccgcctcaccgaatgcacaactgccaatgttgctaaaacaaaacattggcacggatggcaagcatgttgtctacatttataaaaccgatccgaagaaaaaagcggttcataccaaggctgatattgttgtaactaatcgggtgacaacgacagcgaatgccacagcttcgttgacgagcaaaacaactcggtggcaatatcaaaacggtttttatggtgcgttgttcaatcatgaaggggctggtcaattggttgctcagcacaatcaattggtcatcccaacaagctggtcagtgctgacaacggctcaggccaagcagcttggtaaaaagttggccgccttgcagcaaccaactgcagagcaaaaagcgtcactggcagccgcagtcaaggctaaagctgctgcgctggccaaggctgagccaaaactagcggcagatccgacagctttagcgaagcaggctaaggctgcagttgaacaagcaatgattcagcaggctgttcgtgaagtgcaagcacaaaaatagtctgatgccgcccataacgtggtactagggcaaacatttttcataacattatcttgacgaatggcttttgtcagccttctaaattaaaaaaagcagaccgctattttttaacggtctgcttttttgattgtttggcaaatcggtttgtcagataaggactaaaataccaccaactcaccatcagcaaggcaaagccaagtgaaaatccagcaaagacatctgtgggatagtgaacgcgcacgaagatccgagaataaccggttaaaagaatcatgccactggcaaggcaggtgatgagccatttggcggattgacgtttgagcagtgcccaagccaaaaggatcatggtaccgtaaaagatcatcgtgccactagaatgcccgctaggaaaactaaaaccgccagcatgtaccaatgcccgaatctgaggatctgcaataaaaggtcgtggtcgccgaacccaatatttgattccgacgttaacgaggctcatcaaggcccccatgctggctgcaaaaagtgcggcgtaacgataacgcttgagcagtaacaccacggcgaacgccatggttaaaaaaactaaggatactggattgccgagactggtgattaagatgagtaagggtttaaaagtgacaggatggaactggatgacagcggcaattacctgttgatcaatggtatgaatccatccagcgttatttagaatacccgtcaataacgtgatgaaaataaataaagcaattgctgccagatacaatggttcgggtcggcgttttagcacttgttgcctcctctacaaaacgttcgcagtcgcagaaacctgcatgtaaggagtttggtcgcaatgaccaaaaaacggtcatcacggccaagttcactgacacgccggtttctaaccgcggcggcttacgctctttcataaacgcgctcgcaggcacagaaacctccacataaggaaatggccaaagtccagccatttctgtctgagtccacttatgttccggtttctaaacgtgcccgctcacgctctgaaatcgactaatgttataagaatagcacaaacaccattgaaccttggcaatgtttttgctatgattgacgcaatcatcaaacgaacaaaggagtagtaagttagcgcgggtgacagagagcaggcggtggtgcgagtctgacgaagcaaagaccgaactgacctttgaagttgctggggtgaaattagtagccacagccggccggaccgttatctcctttgagcgctgtgaaagcagaacttaggtggtaccgcggctgagccgtcctaatgtagatagggcggctttttgtttgaaattaagtgggaggtaacaaaatggcatacgatcatcatgagatcgataagaagtggcagcgttattgggccgagcataacgaatttaataccacaaccgatcctaagaagccgaattattatgcgttggacatgtttccttatccgtcaggccaaggcctgcatgttgggcatccggaagggtatacggcaactgatattgttgcacgcatgaaacggatgcaagggttcaatgttcttcatcctatgggctgggatgcattcggcttgccagctgagcaatatgccttgaacacgggtcacaatccgaagacctttaccaaacaaaatattgagacctttaagcgtcaaatcaacagccttggcttttcatatgactggaatcgtgaaatcaacacaacggatccgaattactacaagtggacccagtggatttttgaacaactttataaacatggtctggcatatgaagctgaggtaccggttaactggagtccggatctagggacggttgttgcaaacgaagaagtgattgatggcaaaacggagcgtggcgggttcccagttgttcggaagccgatgcgtcagtggatgctgaaaatcacagcctatgctgaaaagctgttgacggatctggacgatcttgactggccggaatcaattaagcagatgcaacgcaactggattggcaaatcaactggggcacagatcaccttccgggtaactgacagtcatgagccgtttgatgtctttaccactcgtccagatacgctgtttggtgcaacgtatgtcgtgatggcaccagaacatgaattagttcagaaaattaccaccccggcacaacaggccgtcgttgatgcgtacattgacgaagccgcccataagtcagatcttgatcgtaccgctttagataaggaaaagactggtgtttggaccggggcctacgcgactaatccggttaacggcgaaaaactgccgatttggatttcagactacgttttagcctcttatgggactggcgcaatcatgtccgtgcctgcgcatgatgatcgtgactacgcttttgccaaaaagtttggtattgaaatcaagcctgttattgaaggcggcaatgtcgatgaagcagcttatactggcgatggcgtgcacatcaactccgggttccttgatggtttgaatgaacacgacgcgattgatcgaatgatcaaatggcttgaagataaaggtatcggcagtgccaagatcaattacaaactgcgtgattgggtcttttcacgccagcgttattggggtgaaccgattcctgtcattcactgggaagatggcgaaaccacgttggtgccagaagacgaactgcctctcacattacccgaggaggctgatatcaagccaagcggtactggcgagagtccactggcaaatctgactgactgggttaatgtggtcgacaagaacgggcggaaaggtaagcgtgagaccaatacaatgccgcaatgggcagggtcttcatggtacttcctgcgatttgttgatcctcacaacaaggaagctcttgcggattacgacaaacttaaggcatggatgccagttgatctgtacattggaggggctgaacatgctgtgctgcacctgctgtatgcccgtttctggaatctgttcctttatgacatcggggctatcccgaacaaagaaccgttccaacggctatttaaccaagggatgattctgggcgataatcatgaaaagatgagtaagtccaagggcaatgtggttaatccagatgatgtggttgatgagtatggtgccgataccttgcggctgtacgaaatgtttatggggccgctggatgctggtattgcttggtcaacaaaagggttagctggtgcccgcaagttcttggatcgcgtctggagtgctttcattgatgatgaaggcaaactgcgtgatcggattacgacgatcaatgacggtcgacttgataaggtttacaatgagacggtcaagaaggttaccgaggactacgatgctttgcatttcaacacggcaatttcacagatgatggtcttcatcaactcagcgcgtaaagatgatgacctgccactagaatatgttgaaggattcgtgaaaatgcttgcgccgattgccccgcatctaatggaagaaatttggtcacggctaggtcacgatcatagtctgacttatgcgccatggccaagttatgatgaaagcaaaatcaaaaccgacacttacgatatgatgatccaagtcaatggcaagctgcgcggttcgattacggcggatgtcaacgaatcagatgatgagatcaaacaagcggctttggcaaatgataatgttcagaaatttacggcgggcaaagacattaagaaaattattgtcgtaccgcgaaaaatcgtgaatattgtcgcaaaataaccgcactggcttcaccaattaactgaaagaaaaaatggtcaacgaatggttcctgaaggaagcgggcgttgaccatttttttagcgattcagctgcatgaaaagttttgtatttttagcctttcgattgtgagatcacttgctacgtggcggctggtaattgtcaaagttttcttttgattcccgaaagaagcccgggaaagattgcaagtcgcgctgggattgcctaaaatataaaggattatgcaacacgacaggagtttatcatggagaattcgctgggcagcggtaatcaaccgcaacgttcagataaggaaaaaatgatccgcggctcggcgtggatgactgccggcagtgttttttcgcggattttaggggccatttatgtcattccatggcgtatttggcttggagcagcgtttctaactgccaacgctttgtttacaaaaggttatcaaatttacagtctttttctgattatttcgactgctggtgttcctggtgctgtttccaaacaggttgcccggtacaatgctatgggcgaatataaaaccgggatgcgtcttttttaccacggcacttttgccatggtgctgatggggattgtctcgtgtggtgccatgtggctgctgtcgccgcttttagcagcgggtgacgcgcgcatgataccggtttttcggtcactggcatggccgttgctgctaattccgtcgcttagtttgattcgcgggtttttccaaggttataacgagatggcgccgagtgccatcagtcagtttattgaacaagtggcgcgaattctttatatgttagtgatgacttatgcgattatggtggcgggtaaccacagctatctgagtgcggtcattcactccaccttcgccgcgttcatcggggccgttttcggacttggactgttagttgtttatttcctccggcaaaaaccacggttggatgcgttggttgcccaaagtgctaattccctgcagatcagtgtcaatgagattcttttagatgtggcacggcaggcgattccatttatcatcatggattcaacgattaatatttactacatcgttgaccagtacacatttaatccaatgatgaaggctttttatctcgttagcgaagatcagcttgaccgtttttatgcgctgtttgccggaaacgctaataaactgattatgatcgttgttagtctggcagttgctatggccattaccgtagtaccattattggcaggtgcgaaaacgcgcggtgatgttgagggattggcccggcaaatcacgaatacactgcagttgttttttatcgtcatgataccttcggcgttggggatggtggcagtcgcgcgcccactgtatgttttgttctatcgggatatggactggttgggcattcgcttgttgcagatttcatcacttttagcgattatgctgggcttgtttacggttttggcagcaattcttcagggattgttcaataaccgtcttgctattcaagagatgctgattggcctggcagttaaagtgattgtacagtggccaatgattttcttcttcaatgtttacggtccggttttgtccacaatgttaggcatgacggtctcgagtctcctaatgctctattcaacgaatcggatgtacaatattcatgtacgccaaaccattcgccgcggcgtcggtattctggccttttccctgatcatgtgcgccgtttgttacctgattgtgaatgcatcaatcttggtgatcaatccgcggagtcagttcggggcagcgttcgtcttgctgattgcagttggggtgggcgttttgatttacgtttatttgattttgaaaacgcgtttggctgatttaatcattggtgagcgaattagtcgacttcgcgatattttacacattcggtgagcttatgcgattagataaatatttgagtcatttacaatttggtagtcgaaaagaagttaaggcacttattcgcgacaagcgggtacgtgtggccggtgatttaatcactgatcctggttacaatgtgttgccggggatcgcggtcgaggtgaacgatgcccaagcggatgggccgcttgaggtcgattatttgatgaacaaaccggccggggtgattaccgcaacagaagatccaacgcaatcaacggtgctggatctgatccgaccacatgattaccgaccgggtttatatcccgtaggtcgtctggataaagacactactggtctgttgttacttacgaccgatggcaatttaggtcatgcactgctttcgcctaatcgtcatattgccaaaacctatgctgcaactttggctaagacattaactgctgacatgaagcagcgactcgaaaccggcattgatttaaaggacttcacaaccgccccggcacaagtcgttgtcttgccggataccgatggcaaacgcatccagattacaatcacagaaggtaagtttcatcaagtcaagcgcatgttgttggcagttgataatgaggtgacggccttgacgcgaattgctatgggaccattgtcattgccagccgatttagctgctggggagtatcgggctttaaccgatgacgaacggactgatttggataatatcactcgttgagcaaccgagcactttgctgtggtgattgtttggctttgcctaagcgagagattttgtttgttacaggagtttaagagagcggccttgattaggcgaaccaagatggctactttgccaaacatgattagaaagggtgcgggtcatggatcaacaacagtacgtctgccccaaatgccaaaacacggcttatgttgccgaccaatttcaagcaactggtggtaatttttcaaaaatcttcgatgttcagaataaaaaattcgtgactatttcttgtaccagatgcgggtacacagaactttatcgcagtgaaaccagttctggcatgaacattctcgacttccttttgaatggcggctgagaaggcgtaagttcaggttaggaatgatgtcaaaaaagcaggtgatccttcagccgtcgttgtggcggaaagggatcatctgctttttgtttgctgctggttcacaaattggttcgtcattctgaaagctgctttaagtaggtgggcagttcgcgaatgaccatagtcggtaaggcaacataactattcatagctacaatatcagctacgcgggaatggacaaaaacggctgcgagagcggctttgtccaatggctggaactggcccgcaaaggcagcaataatgcctgtcagcgtgtcaccagagccgcctgtggccattgcgggcccaccggctgtgttttcatagacatcttcatcaacgaaaacatgtgtatgggaacttttcgcgacgatgatacccggtatttttgcggccgctttttggctggcttcaatggtttgggcagccaggggtaagccagataaccgctgccattcaatctggtgaggtgtccaaattagttgggcttgcgggtaatctaggtgatgagaggcaacgagagtgatcgctgatccatcaatgatcatgacctgcttggcattgacggcagcaaaaactgttttcaaaatggtaagggctgtaccatcagtgcccagcccagggccaacgacaatgaccgttgcttgccgcacagccgtctcaagttccggcgcggtagcatcgaggatcattgcctcaggtaatcgggcgtgcaacgcatgacggttaaccgggtcagtcgcaacactgaccaacccagcgccagcgtaaacagcagcactggcactcatgatcgcagcaccgccaaagtgggcattaccgccaacaatcagaattttgccgaaactgcctttatacgtatcacgggcccgtggccgaaccacactttgtgcaaattgctctgttaattgtttcatgacggatttgccgcctcctttaaaacttcccaattagaaaaagttttggtcgtcaattcaggctggccggtcgttaagaatgctttcgcaaacatgacaagcggcgacgcattggcccatgtcaaagtatcgagtggcaaggcgcaggcaccgagcgaatcctgacccacaaattgggcaacgcttgtttctagtttaccgccgttaatggatagcgcatagaaaacgcagatgtgctggttgatggtccagtgttggtacttccaaggatagataaaactggttgcccctagttgttgatcaatcgtggctgtcaatccggtttcttcggtgaattcccgcaagacgtcatgttcaagcggttcagggccatcaaggctacccccgggaaggtcgaagcgatgacgataaggacccccatttttcttaatcacgacaagcttgtcgtcaatcgttgcaatcccgtaacaaccaaatgcgcgatgagttttatgtgtcatcaggccacctccattgatcaagggtagcacgctgctgcagggggaacaaattgtaaaaatagttcgtgattttgcttgcgtgccttacctgcttccgttataatcatttatgttgttgccgcgatggcggaactggcagacgcgcagtgttcaggtcgctgtgggatttatcccgtgcaggttcgattcctgttcgcggcattctcgtgatttttaacggcggttaaaaatcgaaatgcccgtgtaacaacgttttagccttcctaattgatgttaggagggctatttttgtgtgcaaaatgtgaacaagcaatgacttatgccttgatgcaagtcatcaggtctggaagctgtgttatattcgtcatgaggcgactgagcaagcggcaaggtgaatgaggagtataaacatgatgtggcctgaaatgaagcacgatcaatagttgaaagggatgatcgctggatgatttattttcttgatgaatacttacttgcaaagaactcaagtgttgaacatgctgcgttgaaacgactggctttgttcaaacaatttaagcaaccagttaagattctgacgcgtgattacgatcgtttgagtgtccaaaccttgcgcgagcttggcgttgctcagacggatgtgcgcaacatgttcgactattttcagcatgtgcccgccgaccgaccggaaaaagctgtgcataatgatgagatcaatttgccgacaatggatgaagtttcagtcgatgctaaccaaagtcaggtgacgaacggcgaccggctgcgacggcaggtcggttatattccaggaaccgtcggccatgtttattatcaaaactttttggacgatcaaggcaatcttgtggaatgcgatctttgggacgcccgagggtttaaatcggccactcagtattttggacaggatggcttgttagcctttgaacgctactatgatcttcgaggtgtaccagtgctggacatttattatgctggtgatcatgctggtcagattcagatcagccggattgttttaaaaggccaaacccttaaagaagatcatgagtttgatacattgggagagttgtttagctattttcttgatcaacttgcgactgaagattcagaaacaacgatttttatcagtgatcgtccggggattggcgttcaaccgctactagcaatgcatgcagccgcaaagaagtttgtttacatacccattaatcatgttttaacacctgacaaaccgcggcaaggcgaacttgatggttttattcaacctgtgctgcagcatccccaaaaagtagatggcttaattgtacaaacgccgcagcagcaacatgatcttcatgatcgttttccgaaagttcgggtggcggcgattccagcggtgacatttgatccggctttgacagcgcgttcggcggccgccgctgcaagcaagaaaatcctgtttgtgggtcgactgtcgcctgataagcaacttgatcagctacttcgggcagtcgctttggcgagtcggcaggtgtctggcgtgacgcttgatttgtttggttacggtgatgaacaatatcaaaccgcgatgaggcagcttgcggatcgtttagagattggcagtcaagtgacatttaagggttaccagtcatctctggctgatcagtacccgcaatatgccttgttggtcaatacgaatttgacagatggtggtccgttggcgttggttgaagcacaaacccatggactgccagtggtgagttatcgcttttcctatggacctagtgcctgtgtgattgatcaggaaaccggttatcttatcaagcaaggacgcgtcaatgaccttgctgaagcgattgtgagactgctaaagtggccagagcagtcacaacaattcggcgatcatgccagagcactggcgcaaaagcagctagcgcctgaaaaagtctacgcccgctggcaagcatttcttggactggacagttaacccgacaaaacggcaaggaggttcaggatgtattattttttaaatgatcaaatggcctatgccaagtctggtattgaaggcgcggaaattcagcggttgcagcttttcaaagcgaaccagacgccagcaaagattgttacccggcaatttgctttagatctacacgatgttttgaaagatgcaggcattgacgatactgattttatcaatctgtttgattacttttgcgacctgctgagcacaccgtggcagcaggtaacggttgcagacgtttgccagccgactgcgggcgtgacccgccggcgtgaaggacgccaggtgatcttcagccgcggttcccgagtcattcgaattgtttatttgcgcgaaaaggcggggcgtgagcaagaggttagcaatgttcaatactttgatgtgaccggccgaacgatcaaaatgagttggtgggacacgcgaggcaaccattgtttggatcagtattttgatcaaggcggcaaaattttccaagaacactatttggatcgtcatggtcgcacgcggcttgaaaaactgcattatttaaatcatagccagcaagaaaaattttcgtggaaattggttgattttcatggtgtggattatctatttgatgggcttcatgatttgacaaggttcttctatgatcaactgaatcaggtagatggcggctataatgtcttcgtgtgcgatcggacgacggaaactggctggggcttgttgcacatgacgacaccggcgctcaaagttttgcatctgcacaataaccatgttgccgggaatgaggacgtgctgcatgcgaagctgaataatttttatgctagtgccttgacccatttgaatcgctgggacgctgtgattgtgccgacaccgcagcaggcgcaggatatggccgcccggtttggcacggccacgccgattttcacgattcgagttgcttttgttaaggcggcagatgtagcggctaatcgcctcccgttttcacaacgcgaacaacatctggtggtgcatgttgcgcgattggcaccggaaaaacagcaagcaagttcaattcgggcatttgcccaagttgtgaaggccattccggatgctaaacttgaactctggggttatgccaatggtgatatggcgccgaaactacatgctctggttgaaaagctgcatctcgcgaatcacgttttctttaagggttatactcgcgacatagcggccgtctacaatcgcgcacagttaggactgttgccttccagtgccgaaggatttccgctaaccttgatcgaagcacaggcacacggattaccgatgatcgcaaatgacattcattatgggccagccgatattttggccaacggtaaaagcgggcttttgacgcaaaatggtgacattgatggtttagcaaatgcgatcattgggttattgaatgattcaactaagctggcccagtttagcgcggctgcctatgacaatgctttgcgattcactgatacgagcacatttgttcagtggcagaaactcatggcgtttgcggcaaagaaaaagacaaggctggcggcctttgagcatgttgattaggcaccggtcatggcaatgagtggcgtttttactgacaactgttcaaaaaatggtaggatgaggcgtaagcttttaccaagaaatggaggctaaccaatgtcaatttatgattatgaggtcacattagaagatggctcgcaatatgctttgagcaaatacaagggtcgaccaatgttgatcgtgaacactgccactaaatgcggcttcgcgcctcagtttgatggtttggagaaattgtatgacaagttcaaggatcaaggtttggtagtgctaggttttccttctgatcaatttaaacaggaactggctgatggtcatgcagcggccgaggcttgccggttgaaatacggtgtgagttttccaatgcatgatttgattaaggtgaacggaaaagaagcagctccgctgtttcaataccttaaagcccaagcccctggtgaactaggcaagtccatcaaatggaactttacgaagtttttggttgatcgtgatggtcaagttgtcgcccgctttgcaccaaaaacaaaaccagaagcgattgaaccagcagtggagaagcttcttggctaacttttgtcagttgcacgtggggctggttcacgctctgttttaaacgcgtttgccagcccagagacctgcgtgtaaggactttgggtgcaatgaccaaagtccggccatcacacccaaggccgcttacactccggtctctcccgggctggttcacgctctgttttaaacgcgtttgccagcccagagacctgcgtgtaaggaccttgggtgcaatgaccaaagcccggccatcacacccaaggccgcttacactccggtctctcccgggctggttcacgctctgttctaaacgcgttcgcaggcccagaaacctgcacataaggacctcggacataaatggccaaaatccagccatttatgtccgaggccacttatgctccggtttctaaccgggcctgctcacgctctggacactcatgcatgtgatgcgtacaatgacatcaaaagtaagaaagcagggatgattgatggaagaattgccagctgatgtagcggcttttgttgaaacacatttggttgttcggcgcaatagtaacgccgtgaagtgggatggtttggcaggtgaatttggccgcacggatctcctgccgatgtggattgccgataccgaatttaaagcacctcaggcggtgattgacgccttaaccgctcgcattcaagaaggaacttttggctattccattcggccacaatcctactatgatgccttcattgattgggaaaagactcgccatggcgtgacggtgcagccggaatggatgcgttttggtgtcggtgtggttaaatcgctgtatgccatggtcaattggctgaccgaacccggcgatccagttttaatcatgcagcctgtctattatcccttcatgaatgcgattaaggatcttggtcgcaaagtggtctcggttgatcttcaattaactgctgatggctggcggatagattttgatcaattggataaaacgctggcgacgcaaaacattaaagccatgattttttgctcgccacataatccggtcggtcgagtttggacccgtgaagaactggaacggctttttgcgatcacgagtcaccatgatgtcacggtggtatctgatgagattcacggcgatttggaagttagtgggccaaaattcacctctgctttgcaagtagctgagggtccggcacgcagtcggcttgtcgtcctgaatgcaccgtcgaagacctttaatcttgcggctttactgaattcgcatattattattccggatgaaaagttgcgcacggcttatgatgatttcatcaaacagttgcatccagtagataccagccttttgggacaggtcgccggtgaggcagcctatcgtcacggtggcgcgtggttagacaaggtgcttcaagttgtccgatataactaccaacagttgctaaccggtctgaagcagagcgctccgaaggctacagttgcggacttgcagggcacctatcttgcctatgtggatattggtgcctatgttgcgccagcaaaaattaaatcatttgttgaagatgtttgcggactggcagttgattacggcgcatggttctccccaaaaacagctacgtatattcgcttgaacttagccaccgaccccaaacttgttgccgaggcgattcagcgtttaactgagcacttggctcagccgcaactttaattgaaacagaaaaaaacaccctgttaacgcaaggcatgttgactcattaccaaacatacaaggtttggtgatgagacagcgacgcttgctgatggcagggtgtttttttgtgagtagtcttagttaacagtcactaagggtgattgatgattaaatgattatcattcatattatgatcctgtacgatttctttaagatatcgccgcagcattggtgagcgttccaaaacggcccaacccggatcggcttttaatcgcttgagttcagctttatcgggatgatcatcgcctgtgaaaaagcgccagttcaagacgcccatcagttttgcggcagcatccaaatcatgctgattcgtcacgccattatccatgagatccccatatgcaaggccttcgccatcttggagaaagagttgcttcagataccgttgataatgtagcagatcaggattttttcgttgcttggcggttaagtaaggtgtgggatcagtcgcatgcttttgataggtgattcggttaggcgtgaacgtcaccaccccataactggcagggctgatcgaaaatgcgccgctgacaacttcaatcgttggacattgcccatctggatcgcggctgatgtcttgcgcatggatgtgtccggaaaaaagcaacggaacatggtaagctttcagcaacgttttgagttgatcgctgttgtccaaaacaaatccttgattcaccgcttcattgtgggcatatagattgtggtgcatgaaaacaatcgacttgcgatgggccttttgaccagcagctaattgctggcgaacccatttcatggtctgcggtgtgagcttaccgccagtgttcggggggcgattggaaggttcgatcgtataaatattgctgtccagcatcagcaattgataattgcggttaaggttgacgcgatagctcaaactattcggatcctgcgcaactgcctgctcataactggtatgaaaaatattgcgccaatcgctagggcttatttgttctgtcagtagttgtcgtttgcccttgtaggctcgtgcccaaccatcgtaaatatcatgattgccagggatgatcaacaccttcgtaccattggcaacaagtggttgtaggcggcgcatgatactttcggcactggctttttcgccgttgaacgtgacatcaccggtgatgacgagggctgtcgggcgggcttttaaggcgttttgaaccaaagcattgatagcaacgggctgataatccatatcttttcctgctgcagaacgtttgatttgggtataagcagtcttttcatcatgtagacttggggcaataaagtgggtatcgctgagcacccaaatggttgcctgtgaactattggtgagtgggcgatcacgatcagggtgaatttgccccaagacaattgcaaagatcagcattaaaaataacgctgctacatatttgactgctttcattttctgcctccgtacctagtttaccattgatcaaggtaacaccagcaggtcattttgagtgggtgtcaaaaaattttttgatgattaacttgttggtgacttaaaaacgttactgaccgagagcgggattatggtaaaataaagccacatttgaccacgatagcgtttagagagaggacatatacacctatgcaagtaatcgtaacggttatcggtaccgacaaagttgggatcatcgcacaagtaaccactgctttagcagatttagatgttaatattttggatgtttcacagactatcatgcaaggtgcatttacgatgatgctgctagctaaaattccagataatggcaatttcaatacggtaaaaagtcaattggcgaccttgggtgatcaaattggcgttgagatcaaagtagcccgtcaagagatttttgatgccatgcatcggctttaatatgcgttggatcggcaatcgtacttatcagagctaaaggagccagtgatggaaactcaacaaattaaagaaaccattgaaatgatcagtgaagagaatctggatatccgaacgattaccatggggatttccttgttggattgtgtaactggtgacctgcaaaccacagccgacaaagtatatgccaaaattatggcaaaagctgccaatctggtgccggtagctgacgccattagcgacgaatacggaattccaattgtcaacaaacgtattagcgtgaccccggtcagcttgctagctggcgcggatcaaaacctcgattttcgcccgattgcccaagcgatggatcgagctgcaaaagatttaggtgtggatttaattgggggctataccgctctcgttcaaaacggtagtacgccagcagaaactgcattgatgaagagtttgccggaggtgttagacaccacggaacgcgtttgtgcgtccgtgaacatcggcagtacacgcagcggtttgaacatggacgctgttaagttgatgggcacggtcgtcaaagaggttgccatgcgcaagccgcagaatgcgatgaaactggtggtattctgcaatgctgttgaagacaatccgtttatggcaggtgctttttgggggatttcagaaggtgatgttgccatcaacacaggtgtttccggtcccggtgttgtagaacgggcgatcgcggccaaaccggcggcaagttttgaagagatctgtgaaacgattaaacaaaccgcctttaaagtgtcacggatgggccaatttgtcggtaaagttgctgcggatcgccttgatgtaccgtttaacattgttgacctcagtttggcaccaacaccggcaaagggtgactcagtggcgcaaattctggaaacaatgggactcagtcatgttggcacaccaggcacaacggcagcgttggcgttgctaaacgatgcagtcaaaaaaggcggcatcatggcggctgaacgtgtcggcggattatcaggtgccttcattccggtttctgaggatgctaatatgatcaccgcagcggccaagggtcaaatcagtctggaaaaactagaagcgatgacggcggtttgttcggttggcttggatatggttgcggtgcctggcgacactcctgacgccacgattagcggcatgattgccgacgaggctgctatcgggatgattaacaacaagacgacggcagtcagagtgattccagttcctggtaagcaggtgggggataccgttgaattcggcggtattttcggtactgcgccgatcatggcaattaacgatggcgatgcgcagcagtttattaatcgtggtggccgtatcccagccccgatccatagctttaagaactaacgcgtctcatttttaaacgattcgacttaggccttgttgttcctggtaattgccagtagcagcagggctttttggtggcggtgcgtaatgttttgatgaggtgaatcgtatgtttgtagccctagataaaaacaatcaacgtgtcacattgacaagtcatgcccaggcggccaatttaacacaccaaacctttcactgtcctatttgcaagcaggtcgttcgcatcaaaaacggaaccgtaatgcctgcccattttgctcaccgaagtcaaccaatgggtgagggtgaaccagagagtatagagcacctaactggcaaatggtggttggcgtcttggctcaaacagcatggcgaacaggcaacgttggaatactatgatgcaaccattcgccagcgcgcagatcttttggttgcaagtaaaccgccgagggtattggaatttcaagcaagcccgctaagcgtgccggatctgcaaaaacggacaatgatgtatcatgcgcgtggttggcaagtgacatgggtattgggtcatcgatactggcatcctgaaggcaagatacaagcacgaaagtttttgagcatcgaagatcatcggctaactttgtggcatttacagacaacggttggtgagttggtacggattcagtttggaaatgaaggccgttggctaacgcgctttcagcatgatgatccgccaactcaaacttggcaggcagaatcgacttatccgcaacgacaaattcggcagattgccatcagtttacaaaagcgggtgcaaccgtggatgacgctgcaagcagctgcttatcaacagggccgcaatttgaatggctccccatggttcgttcacagtcggccccatgtgttacggcattttggtattccggaactccaactgcgactcaaatggctgttgatctttgaaggacagccttttaccgcgactgccaaccgtcaattttggcaagcggccctgccgaatatctggacgcctttgttgccagctggcacgctcgggaaaatgatgggtgcccattggctgcaagtgttgctggcagaaggcttcgttgttcaggaagatggttgtcgttatcagtggcagcgtttgcctgtttggtttgccgatcttgagcgaaaattggccatgaaaaaagactttgcttaaggcaaagtctgatgaggctgattgcttatcatgattcgcaaggtgggaaaatgtgacggtttgtgcgcttatggaaacgtgtttgtagacccagaaaccggcatgtaaggacgctgaacacaatgcctgaagaccggtcatcacttcaggtcactgataggccggtttctagccgagtctgttcacgctctaaaaaattctaaagttgctccccatgttttcgggccgttcggtgaagaaaccggcgggatctgttcggatgagatcgcaaagatgtgggatgagtgctgggtcaccgatttgttcgatcaaaacagcatggccgtcatctactttgcgatcggtgtcaacaatgacaagggaaggcgtttgagtgatacccatttggttagcagttcgttgatcggagtcaaagcccattttaacttcggaacgctgacgatcttcataaaacatttcctgatccagcttacatttgtcgagcatctttgccacaaaggccgcatcatattggtattgaaccagaggtgcgtgttgttgtagccgcaacaagagcatccgtgcttttttgttgccttgatattgtgcagccttataatccaacgcaaggttgtaagctgcacggagcagctggttgcgtttagcaagattacctacgctcagttgctcacgtttcataaattgttccatgatatctaaattaagaacgggaacgaagtggacgcgcacttcctgctggaatttatccaattgtctgagtaatttctgttcagtgcccagacagacactcccgattggattgaaaaaaaggaaaatttctatcacgttaacggcctccaattcgccaacaacaaattcttacatttactttatcagaaaatgagcagggtacaattaatcagcttgtgaatcgtgcacatgcatgaatgcgcgctgaactttgttgataaccggccgtttttcaatgttgaattggtgcaacaaagtatcgtagaaaacttgagcttgtggcaggtcatggtactccatttccaactcaaaatcagaggtgttgtccatgtaaaaagtctgatcgagtgtcaacaaacctgctttaagatgcgctacacggcgggtcgtttttgcttgggtttgcggatgaaccgctgcggggtcaatttcacgggctgctagtgccgttgtgacttgaccggttttaagttgaccttggtcaatcaaggagcgggcttcaactgaagtcagcggatcggtaatttcttccaaatcacgatgttgattcttattaggaacttttaaggtttgttccgcacgatctttaaactgacgaatgcgcaagcctaggcctgcctttttgacggcgccagtcggtgtatcgtaataggtattcatttgactgaagcccggctcaaaatcaaactgattgagaatcgctagaaaatcagtctttgttaaagttgttttaaattcctgttcgcgagaaattgacatgaactgcctccaaagacaaagggcaacggtgacgagacaaaaatatgatagaatggtggtcgtgagtgacttggctggcaagaaagctacgggttgccgtacttcttaaccagtctggctggaatatagccgtcgtttgtcggccaagcctcacgcaacgtatcatcagtagtttagtatgggagggccagcaatgcaaagggactgggatagtttcttaatgccgtatgaacaagcagtcggggaattgaaaattaaatttcgcggtatgcgtaaacaatttcaacaggccaatgaacacacacccatcgaatttgtgacggggcgggttaaaccggtcagttcgattattgaaaaacaaagtcggcgttttatcagtgacgaacttttggaacaggatatgcaggacattgctggtctgcgaatcatgtgtcagtttgttgaagacatttatcaagtcgtggcactccttcgtcaacgcacagacatgaacatcgtggaagaacgcgattacgtgaccaacgtgaagccttctggttaccgcagttatcatgtggtgattgaatatccagtgcaactcatccatggtgaaaaaaagattttggcggaagtccagattcgaaccatgtccatgaacttctgggcaacgattgagcacagcctgaattacaaatataatggcgaatttccggatactttgaaggcgcggctcaagcgggcagcggaggcttcctttatgttggataaagagatgtcagatattcgtgaagaaattcaagaagcccagcatctgtttgtttatggtaaagggcaacagccacattcgaaaacaaaggatcaccatgacgataaaaaggatgagtaagatgcgtgtgacagttttccataatagcatacctgcctcaatcacggctgcgcaaaagctgacgaagcttttgaagagcggtcactttgagcttgatgagcggcatcccgaggtggtcgttaccatcggcggtgatggtacgctcctttcggcctttcatcgctatgcggatcagttaaactcaattcgcttcatcggtgtgcatacaggccatttgggtttttacacagactggcgggattttgaaattgaagatttagttatcgccttaaaagaagactctggacaaagcgttagctacccacttttggatgttcaggcgatttatgctgacgcgaccagtgctcattatctagcattgaatgagtcaaccttgaagcgtttaaacggtactatgcggacggaagtctatatcaaaggcgatttctttgagagcttccgcggggatggcttgtgtgtgtctacgccaactggatccacagcttacagtaagtctaacggcggtgctgtgattcatccgcgattggacgcgttgcaaatgaccgaaattgcgtccattaataatcgggtttttcgtaccctcagttcgccgattatcacggcaccagacgagtgggtgacattggagccgacaggtcgcgatgattatgtcatgactgtggatcagttcgtcatcaatccaccaacaatcaaacaaattcggtataaaattgcgaaagaacggattcattttgcacgctaccggcatatgcatttttgggatcgtgttgaagacgcctttatcggagccaaacactgatgcgatttgaatggcagtatgagggaccgccgctgaaattggcggcttttttaaaacaacagggtttttcccgtgcacagcttaagaaacttcgttatcaaggcggatttgtttttgtcaacaaacggcaacggcataccgcttatccggtgcgctcgggggacagaattttggtacagacagcacctgagcacgcggcagacagtgtggtgccttattcgcatgatttggccatcagttatgaggatgacgattatctgatagtgaataaaccggccggggtggcatctattccagcggttgggcgccaaaataatagcatggcgaatatggtcaaggcttatttaattaaaaccaaagctgaaagtcaggccgttcatgtggtgacacggttggatcgcgacaccagcgggttgatggtctttgccaagcatgggttggcgcacagcttgttggatcagcaattgcacagtcaagactttgtcaaacagtatgtggcaattgtgaccgcacaaacacctttagcaactcatggttggatcgtattgcccattggcgtcagtgacggcttttatatgcgtcgtgttgtaaccgatactggcaaagcttctgtcacggagtatcgaacacttgaccaaaatacggctggggccatgatgcttgtcacgttgcataccgggcggactcatcaaattcgggttcattttgccgcgattggtcatgcgttgtatggtgatggcttatacagtcctgatacgcacggctttaatcgacaagcacttcattgtgcccatttgcgtttctggcagccgttgaagcataaactgattgatttacatgcaccacttccggctgatatggcaacgttagcggcgaagttgaaattatcgcaacaagattgagccgccgcacaagcttaaacaaggtatgacaaaagccagttcccaaaaattaggaactggcttttaacatactatgattcaggaacataattagcggcttcaagcgaactagaagttgcctttgtgataacctgaatcggcatcaaacttgaattgttttttgaggccattggttaaatagatcttcttgtcattggtaatgaaaattgcttgaatatgatcgctgtttttggcattcatgtattgcagaccgccttttaatcctttatcaaaggcagcattggataaggcatcgccatcaacactatttttcgagacaatcgtgactgaggccaagttgttgtcatagggatagccagtctgaggatcgaaaagataaatgtatttatggccattggagattaggtattgctcataggtgccagctgtcacaatggattcgttgctttcaggaatcgtacccactgcagtgccacgcggcgcggtcgggtcttgaatcccaacatgccaatcgcgattggtaccaagcggtgagtgacccatgacaacgacattaccgccaagatcaataatcgctgctgtgacgccatctttggcgagcacggccttcactttgtcagcaacccagcccttggcaatcccgccaaaatcaagccgcatcccttttttggtcagataggcggtattatttttggtatcgagtttgacatcgcgccagttgaccagtggcaaggccttgtcgatctcactttgtgccgggacgcgcgcgccaggcaggccaatttgccacagattggtgacggctccaatggccatgtcgaaactgccattggagttttttgaaaagtagtaggctttttcaagtaagggcataaaatctttaggcactttgaccggcttgattccggcattatcgttgatcttatccaaaaccgaaccaccgcgggttaaggttgcctcggcgtcgacgtgatgaatcatggcaaatccgtcttttaaggcggattttttacctttatcataaattgtcaaagtacaagtggtgcccatgacaaattcattttgtgtgtatggggttttcaagtaagttggactggctgttttttgacagccggacaaagttagaaaaccaataaaagcaagtaaaccgatgacgaattttcgcatgttacataaccctcatttcatctttccctttgaatatcataccgcgcgttatggaaaaagaaagccctggttgtcgctcgtcaaacgtatggcagcaaaaaaggctagttatccaggcggttgcccgcataactagcctttccgtggcgtggttcattagaacgcgattagtttcgtaccatgtaaagctttcgcacccaatgtctcaccgattgaagcagcgttttgattggtgatcccgccgcctggcaagatgctgattttatcacctgcatagttgatgatggcttgcaggcgtggcaaagtgtcggtgatgggggtggtcaaaggaccgccgtgggtcaagatacgctcgacatcatgatcggccaaccaatcaattgcggcaaactgcttggtttctggaatggcatcgaaagccatatggaaaacaacggtcatgccagcactggcagcaatgaggctggtcatcgcgtcttcatcaattgcgccagctggtgtcaaagcaccaaagacaacgccatccacgccaagcgcctgtgcctcaaaaagatcagcttccatgatttttaattcaacatcgttataaacaaagttaccgccacgtggacgaatcatggtgatgaggctacggccatgttcatgaacatattttgtactctctgccataacgcccttagacacagttgtgccaccaaccgctaaattgtcattgagctcaatccgatcagccccggccgcgattgctttaggaatcgatgtataattttcaactgcaatttcttttaacatgacggacctccatttactagcttagataaacatgaccaataagacaatcgcacctaaagcgattcggtaccagccaaacggtttgaagtcatgcgtttgaacaaatttcaacagccacttgatggcaacgatggcgacgaggaaagaaacaatggaacctgtcatcaaaacagcccattgttcaccagagaagccgttgccttgccacaggtatttgccgattttaagaatcgacacgccaaccatggtcggtattgccagaaagaaggaaaattcggtggcaacgtagcgagaagtcccaattagtaaggcgcctaaaattgtggcgccagatcgtgatgtaccagggacgatagacaagacttggaaaagaccaatcagtaaggcggtttgataagtgatgtctgccagagtggtgatatgcgcgtttttattcttgaggtagttttctagaatgatgaacagcaccccataaatgatcagggttgttgcgactacgagtggtgtatgtaaatgttcatccatccagttgttaagcgggaggccaacaacgactgacggcagaactgcaatgataacttttgcccacagttgccaagttgcgttgcgggctttggctgtcggcttagaaaagggattcagcttattgaaataaagcaatatgacggcgagaatagcgccaaactgaatcacgtactcgaacatattaatgaaatcctgactctgcgataatttaatgacgtggtttaccagatcaatatggccggttgaactaatcggcagaaactccgttaacccttcaacgataccgatgatcacggccttgataatgtcaaacataataaccctccaattctcaatgttaacagtatacaaggttttgcaaggcttgccacgttcaactcggaatttatagtcatcttacgtaattcagcaacttttttgggaggtaaaaaaagcccaaccaccaagcaaaacaggtcttgggggctgagccaataaaaagttgtatcgatggttaaacataagacagacggtttaacttacttagccgataaaaataaaacgttaacggcttctggcgtcggaatatcacgttgaatttcggtcaagagtcccgttttggcatcgcgactatagagtgtgccattactactgttttggttgaccacgagaataaagtgttcagtgagatcgaaattgaaatcacgaggaaaatcgcctgccgtactgatttgttgcaattctgacagatttcggccatccggactgacggcaaaaacggtgatactattatgaccgcggttggatacataaaggaagcgttgatcactgctcaggcgaatcgcagcagcaccattgtgatcggtgtaatcttctggaatggtcggcaatgttgcaatgagtttgaattgaccagttgccgcatcataatttaggatgctaacctgacttgaaagctcacctagtaaataggcaatcgggttgttgtggttaaaagctaaatggcgagggccaaagccaggttcggtgtgaaaaataaccggatcgctgagtttgccggcatcgctgacagcataggttgttaaggtatcattacccagatcaacgaccgctagtcgctgaaagtcaggggtgacagcagcaaaatgaacatgggcactatcttgttccggtcgcggaccgttaccggtatgcttcacttcatccgttaaagccaaaccatgatcatttttaatgcgatagacattgattcggccttcgtggtaattgctggcataaaccagctgacgattcgcatcaatcgagatatgcgccggggatgaacctgcctgcagcaccttgttgatcaagcgcggtggatcagcatttaggtcataagccgcgacaccgccttgatcaccttctgcgtctaccgcatataaaatattgtcatcagatacggctaagtaggttggtgaacccaaatcagtaatgaatggggcaggggtcggcaaatgcgcttcgtcattatcaaatgtaccggcataaacgcctgcaccgccgtgacgcgtataaccgcctaacaagagtctttgcttcatgttcaagttgctcctttcgaatttgatttgagtatagcatgtttggctgatgcttatgctatgatataaagcgtgagtcaacgtttaatgaaaatagctggccaataaagctatcattaaaggaattttcagacctttaatcaaacgatttgccacagcccataactcagcgccatcatgggccttaacgagatcgcatttatgttggcagcgaagctcagataacaaacacttatgatattaaaaatgacaggcaaacggaggcacgaccatgcaattgacagcaacagtaacagctattggtaaggatgcattgagttccaaggatccgatgattattctctttggaccgcaagcaacagacgcactacgcgacgtcgcggtgatccagcagttcgctgacaagtcagctttggaaaaactggttatcaaggcgggcgaccaattaacaatcgatgatgagacgtttgagatgacttatgtcggtcaacttgctaacagtaacctgaaggcgattgggcacgttaccctgttgttccaagctgtaccagcagacaagccgatgcaaaacgcaatttatttaaaaccgacccatcgaccaacatttaaggttgggacgacactaacttacatcacgcaagccaattaagtgtaacaacgagttcttggatcagttatgcgccagtttctaaccgcttctgcttacggtcaacaaaaaaagaagatttcaggcgatctatcagcctgaaatcttcttttttaccatgatgccttacgaacacctggaatttgacccttatgcgctagatcacggaaattcaaacgagacattttgaatttgcgcatgtacgcatgcggccgaccatcaagttcatcgcgactatgcgcgcgaacgggtgaggcattccgcggtaaagcttgcaaggcagcgtaattatgctcagccttgtatttggcacgcaacggggcatatttagcaatcgttgcttcgatcttcttttccttggcaatctttgactttttagccatgtatgcaatcactccttatttgtggtttgtatttaacgttttttaacgacgtgtctgttcgaacagttcaacccacatagcatagcacagccttaagccgctcgcaacacttacaaaaaataagcgtttaatattgatcgccattgaaaatcgagtttttaacaatgacataatcgaccttggtcaaggactcgagatcgcggccaccggcgtaggagacagctgactgcaagtcttcttgcatttcctttaacgtgtcaccaatcttgcctttgacaggtaacaagatttttttgccttcaacgttgtggtgggtgcccttttgatactcggacgcggaaccgtaatattcctgatattctttgccgtcaatgttgacgtgcttgccaggtgtttcttcatggccagcaaaaagggaaccaatcatgcacatggtggcgccaaagcggattgacttggcgatgtcaccattattgcgaatgccgccatcagcaatgatgggtttacgggctgctttggcgcaccaacgaacagcagctaattgccagccgcccgtaccaaaaccggtttttaatttggtgatgcagaccttgccaggaccgatgccgactttggtagcatcggcaccagcgttttcaagttcccggacagcttctggggtgccgacattaccggcaatcacaaaggcatttggcaaataatgtttgatatgttgaatcatgtcaatgaccacctgagcataaccgtgcgcaatatcaatggtgatatagtcaggagtcagctcattagcagccagcgcttcgataaaatcgaactcgtcatccttgacgccgacactgattgaagcgattaagccgcgctttttcatatcgcgaacaaaatccatccggcgttccggctggaagcgatgcataatatagaagtaatcgtgctctgccaaccagatcgccaaaggttcatcgatgatggtttgcatattagcgggaacgactggaatcttgaaagtatgcgggccaaatttcacgctggtatcaacctctttacgtgattgcaccacacacttgttaggaatcatttgaatgtcttcgtaatcaaaaatctgcatgccgttgttcatcggattcatcctttcgcaaaagccgaacattgttaagcattattggtgttattcaaaacaccaagtgctaagatacgcgaaagttttgtaaaagtcaatcaaaagtacatatattcttttttaatgttcgtgttttgcaaaattaaaagaaaagccggttgcccggcttagaaaaacgacagtggtaattgatgcggcaaacgaggatgtaacacgtcacagaaggctcagaaaaacttgttgcgccaaaattgaaaggcaagtaccaccgcaatggcaacggaaatggcaatggtgataatccagctcaccttcatatcagccaaagggagatgaacattcatcccgtaaaacgagaagaccaaagtgggaatggttaacaaaattgaataagaagttaggaacttcatgacgccgttcatgttattgttaataattgacgagtaggtgtccgccgtttcgttaataatagaattgctaatttgtgccatttcgatggcttgttgattttcgatgatggtgtcttccagaaagtcttggtcgtcttcatccaaaccaagaggattgctgcgttttaattgttcgaggacgttgcggtcggtccgcaaactcatcataaaataaaccagtgaccgttgaatgcccatcaagccgtagagttcttcgttgcggaggctgcgttgcagtttattttcattggcttcacgtgccttgtttagatcacgtaggtaggttaggtaactgattgaaatctggtaaaggaactgcagcacggaccgattttgtcggcgagggtcgaagttactgactttaccttccgcaaaaagactgaggagtggaatcggctcgccgttgatggtgatcaccgcggtattagtgatgatgatcgctagcggagccgtttcgtacaccacctttttacgtgcgtcccgtgtgacgatgggcatgtcgaaaataaacagatggctatcattatcttcgtcgtattcgtaacgggcaccttcatcgggatcaaggccgtacaaaaggaaagcttctgagagcttagctttgtcctgtagttgctgacgttctgcaggagtaggatcaaccacattgatccagacccctggactgatgcgggattgctggttcagttgaccggttttgtcatcaaatcgataaattgcaagcatagcgggctccttggctttttcttttagtttacaacaagcaacagcaggatgcaggagggaaacacatgcgtaagcgtgaaacaaaaattcatttggctgcagcacaagcaccgctttttgcttgtccagtctgtggccaaccattacaggtgacagcgggatcgttggtttgtgtcaacggacatgtacgcgatttcagccacaaagggacgctgaacttcctgaatcagcaagtagccaccgaatacacgacgccgatgttagccgcacggcggcgaatgttgaacgctggtttgttcaccccatttttggcagctatggcagccaaacttccgaaacatcaacgactgttagatgtcggctgcggggaaggcacgccgactgcgtatttggccgaggcgggtcaacaaactgccgtgggttttgatatctcatcaccggcgatcaatctagcaggcggcttagcggcaccagttctgtttgcggttgcggatctggcccacctgcctttcgttaacgatgcatttgataccgtgaccgacatcttttcgccaggtaattatcgtaaattcagacgtgtgctgcgtcctgatggtcagctattgaaaattattccgcgggcgggttatcttcgagaaatccgggaaggcttatactcggggacggctaaggctgtgtataacaatgagcctgtcttaaaaaggttcttagcagctttccctgatgcgagtcaggagacaatcacctacgattttccgttagcgccaactcaatttggcgatttaatggccatgaccccgttaacgtggcaggcgcccgccgatcaacgcgaccaaatgcttgctgcaccgccgattagtatccatattgatgttgatttgctcactttgtcgcatcttgtcaagtaaaagggttgtaaacatcgatggctggtgttaatattcctttaagctatttatttttaacttttatcagggctagcttttgggtaattgataaaagtttgcgataaattacttcactaacgtatcgcttcgctgagtgcgctccgaagcaatgcgtttttttcttgcttatttttacaaattgacctgtccacaaggcctgttcgtgcaagttaaatgtgctaaacttaaaccacttgcgttgaagggaagataacatggcgaatcacattgttttatttgaaccgctgattccggcaaataccgggaacattgccagaacctgtgcagcaacgaatagctatttgcatctcatcaagccactgggatttgagacagatgataagcatctgcgtcgtgcaggtctggattattggcaacgcgtccggatcatctatcatgatagtctggatgacttcatggcaaccgttaaggaaccccaatacctttaccttattactaagtttgctgatcagacatactcagaccgagattatgccgacattaatcaggatcattatttcctttttggcaaagagacgacgggattaccggaaggcttcatgcgcgatcatgccgatcagtgcttacgtattcccatgactgacaacgtccgcgcgttgaacttgtcaaattgcgcagcattggtcatttatgaagctttacgccagcagcattttgcaggacttgaaacatcacatacgtacgagcacgacaaattaaagtaacccaacaatagaagtgtgcgagctggctcgagtaaaaactggcgtgtgaatggctttgaccgttatggaaaaggacgcttacaagaaggtttctcggttggcaagcgcgtttaggaggctgtatttatggaaacaaaacgttaccctatcgcggttgaatcttttcactatgatttggttaagcaaggaacaccggttaagaacgacttgcaagttgccatgcgccagattgaatggtcagatcccgctaaacaagatgagttgaaaaaaggcaatctttttcagatgatgattccatttgacgttgtccctgacgatgccggttttgagatttctggcaaaattacccagatcgtgcaggttttggattattttggtgaggcaaatgaattgccgcaagccgaacttggcaaactaagccggccattggttgaaaccattgaaacgttgacttaccaagtgaccgcagttgccttggatcaagggattaaccttcagtttggtgccagtgatgaacaaccgggccaaacaaaataagacaaagttgagtcatgatgaaaggcggccgttatcagccgcttttttgatgagcgcgaatgcattctgacgacaggcgttgtcttttagctcaatgatcgctgaatcatcatggctttttatttgcgagttcagctcgtgtataataggcgggtatgaaaggagcatcacgatggcacagaaacgcagcggacgcaaaagcccgcgcagaaaacgacctaccaaacaacaacagcacacccttagttgggtcggtgcgttatttgtggtgttcgccagcttggcatttttccggttaggcattgtcggaaccgtgtttgctaatgttttccgattggttgttggtgatagctttctagttgtcagcgcagggatgatcctgatggggatttggtttctcttcgcagatcgattgccgaaattggcacggcatgtgtgggttggtctggcaattatcttaatttgtgccttggtactgttaagcgcaggcaccatgaccacattgaatgtgcacagtcattatttgttggcgacctggcgcctacttcaaaatgatttcggcttaatgacgacggcctctagtgttggcgggggattgatcggggcgggtttgtatgcgttacttgcccctttactaagcagcatcggtgcaacgattcttgcatggctaggcattgttgttggcacattagcttttctaggtgtgggtgcgaatcaggtttttaattggttgcagcggtgtgggcaagcttgtaaacatggcgtgatgcaggtacaagcagccgtggcggctatgaaaaaagagcgcgcgcaaaaagcggctgcccagcagaaaaaaaccgtttctgcgaagccacagacaactacgccggtcaccgaaaacgaagcacccagtgaaacacctgatcaccaggatgatttcacgattaacgggccggcaccggttcacgaattgacgcaaccggctcccttgccacgcacagaacctaagccgcagtcagctacgactgcgccacaacctgagcctagtgaagcggcatctggacttgatgcagacgatccttccacgaattatcagttgcccgatcttgacatgctgacaacgattccgccagttgatcaaagtgctgaatacaaggcgatcaaaacaaatcgggttaaactaaaagaaacctttgaaagttttggggttcatgttgcggttaaaagtgccacacttggaccatcgattacccaatacgagattcagccagcggtcggcgttaaagtttcaaagattgtcaatctttcggacgatctggccttagctttggcagcaaaggatatccgtatcgaagcaccgattcctggtaaatcattgattgggattgaagtgccaaatcaacacattgcaacggtcggcttcaaacaagtcatggcagaaacgccgaagtcgcctgatcgcccattagtcttaccattgggccgcgatgtgaacggtaaagtcgtgacttttgatttgacaaaaatgccgcacttgctgattgccggcgccaccggttctggtaaatcagtcatgatcaacgtcattttaactagcattttaatgcgaacgaagccaagtgatgttcgcttaatgttgatagatcctaaacgggttgaattgtcggtatacaacggcgtgccgcatctattaacgccggttgtgacagaagctaaacgggcgccaagtgcgctgaacaagattttaacggccatggatgagcggtatcaacgttttgctgcggctggcgtgcggaatatgaccgaatttaatcaaaaggtggcggctgatccgacaagcggccaacaaaagatgccgtatattgtcgtgatcatagatgagttgagtgatttgatgatggtggcaggtaacgaaattgaaactgccatcgtccgcttggctcaaatggcacgagcggctggtattcacgtcatcattgcgacacaacggccgtctgtggatgtcatcactgggctaatgaaagcgaatattccctcgcggattgcttttgcaacgtctagtggcatcgattcacgaactattttagacagtaacggtgccgaaaaacttctaggtcgcggcgacatgctcttttcaccaattggggcatctaaaccgatgcgaattcaaggcgccttcataccatctgtggacgttgagcgagttgttaaggcaattactgaccaagtttcacctgcatatgtggagagcatgacgccaacggaaaatacggaggctgagaaacccggtgattcagaggatgagctatatgatgatgcgaaggcgtttgtcatttcacagcagagtgcctcgacgtcaatgctgcaaagacgcttccgaattggttacaatcgagcggcgcgcttgattgatgatcttgaagccaatcaaattgttgggccaagtgaaggcagcaaaccgcgcaaagtctttgtgacgccagaacaagtaacgaatggtacgccatcataaggagttttatgcgaaaagaaatgaaaccgggtgtttggttgattgtcttgccgacaacgcaatttaaaaccacccgcatcaatgtgcaatttttagcaccgttgcaacgggcaacagtgactaaacgaacattattaacaagcctgttagaaacgaatagcgctgtctatccgacgcaagcagctttgtcagcacatctcgagtcgctctatggcgctaatttcagtattggcgtggcccgtgaaggcaagttgcatcgaattggcgtgacgatgagtactgtggatgatcggtttaccgatgcgcctttattgcctcaagcagcggccttcttacgcaccatcttgtttgaacccaacatgcaggcggggagttttgacgaagccacttttgcgcgggaaaaggagaatttggatcattatttagccagtctagatgatgatcgccaaacccaagcggcgctgggagtgcagcaactatattttggagctgatcaggatcaggctattccgagttttgggacgcgggaagatcttgcatcgctgacggcgtccagtttggctgcttactatcaagaaatgatgcagcatgatcaggtcatcatcacggtgttaggggatgttgatcctaagcaagtggcagcattatttgctgattggccacttgatgctcggtcacaaaccgtaccagcagtggcgtttgatttaccgacgcatccagatgtgctgacccaaacaaccaaggtgaatgcgcaacaggccaagtttgacttggcttatcatgttgaaactgatttgatgggacccaaatatgcagcaacattggtggcagaggaattatttggcggctcgagcttgtcacttctattcaccaatgtccgcgagaaggctagtttggcttattatgcgagctccatgttcgatgcttttcgcggcttgatgctggttcaaaccggaattgaaggaaaagatcgtcagcaagttgctgatcttattcgtgatcagttggccgcagtggtcaatggcgatttttctgacgccctattgaaggccgtgaaggacggcattttggatcatcagcgtgccgcctatgacagcccacggtttttgacaaaccaggcgttgtatcagttgttagtaccagatgcgccacagaattttgatgagtttgctcagcggattaaggcggttgatcgccaagcggttcaacaggccgccgcagatatgaaattgcaggccacctatttcttgactggggaggatagcgaatgaagacacagtattttagtgatgtcgatgaaacggtgatcacgaccacgctatcgaacgggctgcgattgcaagttgtgcctcgcccggcgtatcacaaaagctatgcgatcatgacaaccgattatggttcgattgatacgcaatttgcaccagatggcaaacagatggtgacttatccggccggaattgcccactttcttgagcacaagctatttgaaaaggaagatcatgatgcctttgatctttttggtgaaactggggcatcagcaaatgcattcacgagtgcgaccaaaacgagttttttattctctacaacaacgcagctgacgaagaacttacagattttactggattttgtgcaaacgccatttttttctaaggcatcagttgctaaggagcaaggcattatcgggtcagaaattcaaatgtatcaggatgatccggggtggcgcggttatgccggtttgttagaaaacctttttccaaaccatccggcgcatgttgatgtggctggcacagtggcaagcattgcccaaatcacgccggaaatgttgtatacgattcatcgggttttctatcaaccaagcaacatgacgttgattgttgtgggaaatattgacgctgatgccattatggcttttgttgcggctaatcaagcagccaaacagtttccggcgccacaggcgattgtgcgtggcgttcacgcggatttgcagacggatgatatcgtgccatatcgccagttggagatgccaattagtcgcccaaagacgctggtcggcatcaaagggcaggttgcgattcctatgacggctgagggctggcggtaccaattaaccattcggctcttgctagaagttctgtttggcgattcttcccagttatatcaagattggtatgaccgaggattgattgatgactcatttgattttgattttacgaaccagcgcagctttagttatggcttggtcggtggtgataccgatgatccgcacgcattaagtgatgcgatcaaacatgtgttgctaagcgcagcgacacagccggatttgacccgcgaccgggttgctctaattaagcgggcgtcactgggtaaatactacgctggccttaacggactgaatggtgtggccaatcagctaagtgcgttgagttttggccaggcgagtttgtttgatttccccgagattttgagcagcatcacgctagcggatttacaagctatgattgatcaggtttttcaggcgaaagcattgaccgttttagatatgattccggaggcagattgatgcgagcagctttgattgttggtgcgtcgggtgacattggccgagcggtggctaaaaagttggcccacgatggctggtcattgtacctgcactattttgaacacgaacaagtggttaccagccaaattgcgacttttcaagcggcgtatccgaatcaggattttattccgttacagtatgatttaactgatgatcgtcatttggatgatttgacggcccagctttttagcttggacgcggtcatttttgcggcagggatgacgtattatcatttatttaaagatacaaccgtttctgaattaacaactttgatgcgcgtgcatctattgacgccgatggctcttttaacgaagatcgagcacaaattagcacagtccggtcatggccgcgttgtctttatcgggtctgtctatggtggcgccggttcagcgatggaagtggcctatagtactgtcaaaggcgcgcaaagtgcctttgcaaaagcctatgctcaggaagtggccagtctgggcatcacggtcaatgtggtcgcgccaggtgcagtgacaacaaaaatgaacactaaaatgtttgatcaagcgaccttgaccaaggttcgagaggaaattcctgctgcacgatttgcgaccccacaagatattagttactatgtgactatgctagttgcaaaagatgctgcttatctaacaggacaaactttatatgttacaggtggctggcgaatctaggaaacaaaggatttcttaaggcttgcagttggtttctcatgatatactgaaaatggtcaataaaaaatagcgggtgaataaaacttatggatgaaattgggcaaaaattacgggacgcccggattcaaaaaggctatacgattgatgatcttcaacagatcaccaagattcaaaaacgctacctgatcgcgatcgaagaaggtaattttgatgcgctgccaggcgacttttatgtgcgtgcctttattaaacaatatgctgacactgtcggccttgatggggatgcgttgctgacgcaattccagcaggacatcccggaacctcaaccccaagagtatgcagcacaatcagttgaaaataagactcgggcaacccgcgccgaagaagcgagtccggttaaccgtttgcggcgttatttaccgcaaattgcgattgctgcaattgttgtcgtggcagtcattgtgatctatgtcatcatgttggtttaccaatcaggacccaagcaaacgatcccgacagattcagaaagtgttgcggtctcatcgaagcgtagtacatccaagacttcgaaatcgtcgacatcttcgaaaacaagcaagacatcagcggcttctagttcttcgaagactgcggagaagtcgtccaagaagagtactaaaaagagttcgaaattggacatttctgtagcggatgccaatggtgctactcaggcagttactttaaagaatctgccgaagacgggtaacaagttaacgcttggcgcaaccggcgccactgcttggatttcagtgattgtgaacggctcaacgacgtggcaaggttcattgacatcaggtaattcgcaagaagtgacattgccagacaacgtcacgacattccaagtgcggtcaggcaatgcaactgcgaccaccatcaagctcaatggtcagagtgttgatatctcaaagggaaccagcatcgtacggaccatcaccttcacggctgatgcaacagaaagcgagggttcgcaagaatgaatcttccgaataaattaacgctcattcgaatttttctgattcctgttttcacgatcctgctggcacttgattggccggctgggtatctgacacttgcaggaactaaggtcgccttgagctggtttatcgcgctgattatttttattgtggcctctttaaccgactttgctgacggtcaaattgcccgacgcaagcatttggtcactaatttcggtaaatttgccgatccactggctgacaaactgctggttatgactgccttcatctttctgacggccaatggtcagattccagcatggggaaccgcgattatcctgtggcgtgaattagccgtaaccggattacgcttattgctttcaaacgaaggtgaagtcttagcagcggcttggccgggaaaaatcaaaacaaacgcgcaaatgtttgccattattttcttgatgctaaacaacgcatggtttaacaatatcaatgtgccgtttgcattgatcctgttctatatcgccgttttcttcacgatttactcaggtgtcgaatacttctacaaaaaccgtggtgtgttcaaggactcattcggttcaagtcatcaataataagttattcaaatacccaggcaggtgcttgggtatttttgtagagcgcgagcaggagcgattagaaaccggagtgtaagtggccttgaacgtaggtttctgcgactgcgagcgcgtttgcgagcgcagcgtgaagtcgccactaacctaagctgggtggggagccccaccagcaaatacggagatccctatgtgcaaacttttggaccagcaggcccggttgcgagcaaagcatgaatcagccaacaaaaattgcacgctaatcttagtgaagatgtatctaagcaccatacagctatttagttgcaactttttttaaaaatgtcaggtcaagtaccttaaaaaacgaattctattgttaggtgggaaaagtatgcaagcagagattattgctgtcgggacagagatcctgatgggacagattactaacacaaatggtgcctatatggctaagcaactgacagcactgggtattgatagctaccatcaacaggtggtgggagacaacggtccgcgacttgaggaggccattaagttggcggaaagtcgcagtaatttagttattttgattggcgggttaggaccgacaccagatgatctgaccaagcaaacattggcagcgcacttgaaccgcaaattggttgaagatcctgacgctatggctaaattacaggcgcgcgtcaagcaacagcagcggccaatgacgcctaataatcaattacaggccatgtatccggaaggcgccgatattttggtcaatcgggttggcttagcggttggcgcgtggatcgtcaatgggcagcacacctatgtcttattgccgggaccaccgaaggaattcgttccgatggttgatcatgaactgctgccgcggctagcaaaatggagcggccacgcggaagttatggtcagccgggtcttacgtttctttggcattggcgaatcgcaactagtgacagatctggacgacttgattgccaaccaaaccgatccgaccattgcaacttatatcaaggatcatgaggtgacggtgcgcgtcactgccagtggcgctaccgaaaaagacgctgatgcaaagttagaaccaatggtcggtgccatcatggatcgtgatggtcaatatttttacggctacggtgacgacaatagtttggcaaaagagcttgtgaagacgcttgcggcaaatgatatgcaaattactgcagctgagagtttgactgccggcgcatttcaagcagcgttaggcgatgtgccgggggtatccacttattttaagggcggttttgtcacttactcacttgcaacaaaggccgcttttttggcaattgatgctcgcgaattagcggcacacggagttgtcagcgcatttacagccaaggcgatggctgaacatgctcggcgtaaggcagcggcggatataagtgtcagctttaccggcgttgccggtccagacacgctggaaggacagcctgctggtacggtttggatcggtttagcgcggcgcggccaactgcctgaagcacatgtttaccattttcctggcggtcgcaatgatgttcggcagcgtgctgtgatgactggtatgatgcttgcattaagggcgctgcaggcctaacagaatcattctttaacacgttaatacgtcaggtttacgcaagaggaggcggcaggatggcaggagacgaacgccagaaagcattggatgttgcactgaaaaagattgaaaaaaattttggtaaaggcgcgattatgcgaatgggtgctaaggcggacacgcgcgtttccgttgtctctagcggctcacttgccgttgatgatgcacttggtgttgggggctttccgcgcggacgaattgtcgaaatttatggaccggaaagttccggcaaaacaaccgtcgcgctgcatgctgttgctgaagtgcagaagcaaggcggtactgccgcctatattgatgccgagaatgcgatggatcccaagtacgcaactgctttgggcgtcaatattgacgaattattgctctcccagccagacacaggcgaacaagggctggagattgctgatgaactagtcgcgtctggtgccattgatattgtggtgattgattcagttgctgctttggtgccgcgggctgagattgagggcgatatgggggatgcccatgttggcttgcaagcccgattaatgtcacaggcgttacgtaagttatccggttccatcaataagacaaaaacgattgctttattcattaatcagattcgtgagaaagtcgggatcatttttgggagtccggaaacgacaccaggtggtcgtgccttgaagttttatgcgactgttcggttagagatccggcggtcggaacagatcaagacaggcgcagatgtcgtcggcaatcgcactaaaatcaaagtggtcaagaataaggtggcaccgccttttcgaacagcaattgtggatatcatgtatggccaaggcatttcgcaaactggcgaacttgtcgacatggccgttgagagagatattgttgaaaaagcagggtcatggtacgcgtatcaaggtgaacgcatcggccaaggtcgcgaaaacgctaagacatatcttgataaccacgctgatcttcagcagacgattaaacaacaggttcgcgtggcttatggtatggcagccgcacctggtcgggagacggcttcggtcagtgaagatcaacccgaaatacatcaacaggctgaagtatgaatcatgagtcaacttgctgttgtcggatgtgatgagtccgatggcgcaagtttttttatctgagcggtcttaaagagatttgatatatgttttatttttctcagttcgtaaaaagcatcacccagacttaagactgctttaatgctggtttttaggcgccgctatgcgcctcccgcttcggttgacaccttgcaccctagcacgtaaactaatagaggtgtaataatttaaaaaagcatcaaagattttgatcaaaatttgattgaatcgcttagatgatgcggaggtgaaatgatgagttcagtaacactggtctcaataaccctcgcagcagtcatcgctttagcggtcggtttattgatcggatttgcacttcaaaagaagctccaccagaacaatttggatcgagcgacgcagacagcagaaggcattattgaggccgctaaaaaagaagcagcgactttaaaaaaagaaaaactgctggaagcaaaagacgagaatcatcgctatcgaacccaacttgaagatgaattgaaagatcggcggacagaagtccagaagtcggaacatcgactgaatcagcgagaggatactttggatcggcgggacgatacgctagatcgcaaggaacaaagtcttgctgaccgggaagcaaatttgaacaagcggcagcaacagctagatgaacgtgaacaagatatctcttcagaaatcagtaaacagcacacagaacttgaacggatcgccgagttgactcatgaacaggctcggcagcagattcttgaccagacacaatcagaactgacgcatgaacgcgccgtgatgatcaaagaaagcgaagatgaagctaaggaagccgcggataagaaagctaaagtgctgatcgccgatgcgattcagcgcagcgcttctgacatcgttgccgaaacgacagtgaccgtggtgaacttgccaaatgacgacatgaaaggccgaatcatcggccgtgaaggtcgaaatattcggacacttgagactttgacaggtatcgatttgattattgatgataccccacaagccgttgttttgagcggctttgacccaattcgccgggaaatcgcgcgaattgctttggaaaaactcattcaagatggtcggatccatccagcacgaattgaggaaatggttgataaggcgcgcaaagaaatggacgaccggattcgtgaaattggtgaacaagccattttcgatgtcggtatccataatatgcatcccgatctgattaagattttgggcagattgcacttccgtacgagttacggtcagaacgttctggatcattcgattcaggtcgccaaactgactggtgtgatggctgctgaattaggagaagatgtcaccttagcgaaacgcgcggggttattacatgatataggcaaggcgcttgaccatgaagttgacggatctcacgttgaaatcggggttgagctggcaacgaagtacaaggaaccaaagacggtcatcaacgccattgcatcgcatcatggtgacgttgaaccaaccagtgtcatttcggtactggttgccgcagcagatgcgatttcggctgcccgcccaggcgcgcggtcggaatcgcttgagaactatcttcatcgtttggagaaactagaagcaatcgccaacagtcatgctggcgtggatcatagtttcgctattcaagcaggtcgagaagtccgggtcatcgtccaaccggaaaagctctctgatgatcagagcgtcatcttggcccgtgatattcgcaatgaaattgaaaaagaactggagtatccaggccatatcaaagtcaccgtgattcgggagacaaggactgtggaatacgccaagtaaaaaacacagtacccaccagcacaaagttggtgggtactgtattttttatgctgttttagttcggacgttattgttagacagttagatgtcctcttagagcttaggctttcttggtaaagggacttcgcggtattgactggcgccaatggtaggcgaaaactgtccattcaagaaatcatttagggccgcgagcgtcgcctgcaaatgctcatcatctagatacagggtgatggtaacagcagtcccgtaatcagtgttcgcaattgacaaatgattggttgtcaaaaaatgctgaattggatcaaagtcggcgtaaggaatggtaaaagtcacagctttttgtttgatgcgcgccacaatgccgatggtttcgatcgccgtgttggcattgcctgcatacgcccggatgagtccgccagcaccaagtttaatgccgccaaagtaacgagtcgtgacggctaccacatcacgtaagtcatgctgcaacaaagcctccagtgttggggcaccggcagttccagaaggctcgccattatcgcttgcgcgttgaatttgattggtatcgccaagaacataagcaaaaacattgtgggtagctttggcgttttcctttgatacttgcgcaatgacggccttggcatcgtcttcgtctttgatgcgcgcaagatgggtgatgaaacgcgattttttaatggtatttgtgtagttgccggtttgttgaatggtaagatattgctctgacatgcgtaatctccttatgaggtgatcatgatgaatcttgctggggcacaattgacagaaaatgaactgatgcgcttaaccgtttctaatatagcacaggccacatcactgccagcgttgattcaagaacacgggcgctggtgttgccaacgttgcggtgatcgaaagccagttcaattgcctgatgggcggttttattgttcagcttgcgtgagtttaggccgcttaacaaatcgtgatttgctttaccgctttgaacagccgcaccggcctgttggcgacggcttattaacgtggcacgggacattgacgcctgcccagcaaaaagcgtcaacggctttacaaacgagtgttacagcagggctgatcatttgatttgggcagtgacaggtgctggcaaaaccgagatgctttttccgaccatttcacagatggtacaacaaggcaagcgcgtggctattgtttcgccgagaattgatgttattcgggagcttgcgccgcgactgcgaactgcctttgcaaccacgcccatcgccgttcgatatggcggtcattttgatcaaactgacagtgatttggtgctggccaccgtgcatcaattattacgatttcatcgggcttttgatctgattgtcgttgatgaggtcgatgcgtttccgatggcgggaacacccatgctccatcgggctgttcaaggtgcccggcgtggaccggttgtttatttaacggcaacgccggatcggccattgaaggcggcgatgcgtaaagggttgatggtcagtcgattgtttcgtcgatttcacgggcaccctttgccagttccagcgattcggttgatgaattttaaaaaattaccgtcccagttgccacctgccatcgtgaagtgggtgcgtgatgtcgtggcgacagggcggtcatgtttgctgtttgttcctaagatcagctgggcgcctcaaattgctgcgtttgttcaacgtaacgggctaagggtagctggcgttgctagcacggaccgtctacgggcagagaaaataacggcttttcgtcagcggcaaattcaggttttagtcacgacgacaattttggaacgcggcgtaacggtgcccaagtgtgcggttggggtcgtggccgcagccgatcgggcattcacggcctcggcgctagtacagatcgctggtcgatccgggcgggcagccgatagtgccgacgatccggttgtctttttcacggatcgctatacgttagcattgttagcggccaaacgtcagattgtcatgatgaatggacggtgatggtgatgcgttgttgcgggtgtgatcgccatgttgatcgtagtccgacattgaaggcgttgttagctggcagcaagttgatagcaccccgattgtgcagtagttgtttagcccgctttaagatgattactggagcgacttgttcaggctgcggccggtcgggtgatgcacgaatatgcgcggattgccgccaatgggagcagcaagggcggttattacataatcgggctttatttgtttatgacgcagctatgaaacaatggatttaccagtacaagggtcttggcgattatcgcttacacgatgcgtttcaagatctcattgctgcacaattgcaaaatgctaggacactgatcgccattcctagcgaatccaaacattatgatgtgcggggatttgatccaattcagggactttttggcggtttgcagctgcagccatggctacgtaaatcaccaacggccaaaccgcaggcgcagaaaaatcgtcgcgaacgattacaaacgccgcaaagctttaccgtacttgtgccagcagcaaagttgaatcaaaccaaacaaattacattggttgacgatttatataccacaggacggacattgtatcatgctcgcgatgcgcttgtggccgcgggatttcagggcacggtgaccgcatttactttaattcgctgaaatgtggcttttgttgtgtctggcgacaacattcgggtataatgaaattgaagattggaagggttttatcccaaccaatcgacgtgtaagtgtttattacacgtaggaaaggggagaagttttatgctcacatacaatgttcgtggcgaaaacatcgaagtcaccgaggccatcagaagttacgtggagaagcggattagcaaactgaacaagttcttcggaggttcggttactgcaacggcacacgtcaatttgaaggtttattccgataaaactgcaaaagttgaagtgaccatcccgttgtctttcttgaccctgcgtgctgaagaaaccagcccggatctttatgccagcatcgatctcgtgaccgacaagctggaacggcaggtacgcaagttcaagacaaagatcaatcgcaagtcacgtgaaaaaggctttggccaaatcgacattgatgcgactgcaccagctgaaccgaaaccagccgaagatgatgataatctgacggttgttcgtactaagcgagtgtcgttgaagccgatggattcgcaagaagccattctacagatggatatgttggggcacaacttctttatctttgaagatgctgacaccaatggcacaagcattgtttataagcggcgtgacgggcgttatggcttgatcgaaaccgacgaataagcagttcttaaaacaaaaaacaagatcgccgcaaaaggtgatcttgttttttgttgggaaagtttgccatatggacttattgctggtaagtttttattaaagtttaatgacaatatacaaattggggccaggtatatgaacttgcaggcagtgaagattgaggcgctatcgtgctggtattcagttgttattgtgaacggcatcggcgtgcgctcgtcgatgtggatgatgcaagatctttgtactgctcggttttcaatacccaatgaaaatgttaagatactatagatatactgtcagtttaacgaagtttcgacagagaggaatccattcatggccaatattcttagaaaatgggtcgaaagcgataagcgagaaatcgcgcgcctaggcaaaattgctgataaggttcagcaatatgaagatgagtatgcagcattatctgatgaacaattaaaagcaaacacaccaaaattaaaagatcgtctcgcagctggtgctacccttgatgacattctgccagaagcctttgcgactgcgcgggaaggtgccaagcgtgttttaggtctattcccgttccgagtccaaattattggcgggattgtgttgcatgaaggcaacattgcggagatgaagaccggtgaagggaaaactttaaccgcaaccatgcctgtttatttgaacgcactcactggtaaaggtgttcatgttgtcacggtcaatgagtacctgtcaacccgtgatgccacggaaatgggcgagctatacaactggcttggcttgagcgtagggttaaacctcaattccaagaacagtgatgaaaaacgagaagcttataattgcgacattacctattccacgaacagtgaactcgggtttgactatctgcgtgacaacatggttgtttacaaagagcagatggttcagcggccactgaattttgcaatcgtcgatgaagttgactctattttgattgatgaggcgcgaaccccattgatcatttctggcggcgcagaaaaaacaaccggtctctacattcgtgccgatcggtttgtcaagacgctaaaagcggagaccgattacaagatcgactggccaacgaagacaatctcgttaactgaaagcggcatccggaaggctgaaaagaatttcggactggataatctgtatgacaccgaaaatacggccttaacgcatcacattgatcaggccttgcgggctaattacatcatgctcaaggatatcgattacatggtttcagatggtgaagtcctcattgttgatcagtttactggccgagcaatggaaggtcgccgatattctgacggcttgcatcaggcgattgaagccaaagaaggcgtccaaattcaggacgaaaataagacgatggctaacatcacttatcaaaacttcttccggatgtacaccaagttggccgggatgactgggaccgcaaagaccgagcaagaagaattccgagaaatttataacatggaagtcatctctgttccgaccaacaagccagttatccgggttgactcccctgacgtgctgtacccgacgttagatgctaagttcaacgcggttgttgaagacatcaaagcgcgtcatgaaaaaggccagccgatgctgattgggacggttgcgattgaatcgagtgaacggcttagtaagcaacttgatgaagccaagattccacataccgttttgaacgcgaagaatcactttaaagaagcagaaatcattatgaatgctggccaacgcggcgctgtgacgattgcgacgaacatggctgggcgtggtacggatatcaaacttggacctggtgtcaccgaacttggcggtttggcagttatcgggacggaacgccatgaaagtcgtcgaattgataatcagttgcgaggccgttcagggcgtcaaggcgatccaggttctacacagttttacctgagccttgaagatgatctgatgaaacgctttggttctgatcgaattaaagctatgttggatcgctttaaggtggcggatgacgatcaggtgattcaaagtcggatgatttcacggcaggtggagtcagcccagaaacgggtcgaagggaataactacgacacgcggaagaatacgctgcaatatgatgatgtgatgcgtgaacaacgcgaggtcatttacaagcagcggcagcaagtcatcaatgaacaggaaacgttgaagcctgtcttgatggctatgatcaatcgaacgattacacggattgttcagactcatacccaaggagatcagaaggactggaaccttgatgccttgtacgcttgggtcactgccaacatgattgatcctgagaaattcaaacgcagccagttagatggcaagtcgcaagacgagttgatcgggttactggccgagatggcggagaccaacttccagcaaaagaataagcagctgggcgatgacgcgcagatgcttgaattcgaaaaagttgttattttgcgcgtggttgattctgcttggaccgatcatattgatgcgatggatcagttgcggcagtcgatcggattgcgcggttatggtcaaatgaatccgctagtcgaatatcaagaagaaggctaccggatgtttgaagaaatgattgcatcaattgatgatgatgtgactcggctgttcatgaaagctgaaatccgacaaaatattcgccgttaataacggcttagcgccccggcaccgcggctaaagcttgcggtactggggtgttttgaagcagtcgccgacgcacatagtcatgctacaataacgcaactatgtttaaaaaaagggagattacacgatggaactgagtgttatgcgcaacaccttggccgccatgcggaccaaaattaatcaatttagggggtcactttgacctcgatgcgctgaacgaacgcattactgaaaatgaaggccgaatggctgaacccggcttttgggatgactcggaggctgctcaaaaggttattgacaacaacaatgcgctcaaagaaaagcatgatcgattttatgcactagaaaatgagttggaagatcttgaggctggttttgagttattacaagacgagcctgataaggacttgcagcaagaagaagaagcaaagatcaaagatttacaggaaaagctggacaagtatgagatgcagcttttgctgaacggtccatacgatcacaacaatgccattttggaaattcaccctggtgcaggcggtacggaatctcaggattgggggtcaatgctgatgcgaatgtatcagcgttgggccgatcagaacggattcaaagtagaagtggcggattatcagcctggggatgaagctggcatcaagagcgtaacgctgctgatcaatggcgagaatgcttatggcttgctgaaaagtgaaaaaggcgtccatcgacttgtgcggatttcgccatttgattccgctggacggcgacacactagctttgcctcggtggacgtgatgccggaactcgacaactcaatcgaagttgatctgcggccggaagacatcaaaatggaggttttccgctcaagcggcgctggcggtcagcatatcaacaaaacctccagtgcggttcgcttgattcatctaccaaccggaatcgtcacctcaagtcaggcgcaacggtcacagtttcagaacaaagcgactgcgatggcgatgttaaaggctaaattgtatcagcgcgaagaagaagctaagcgtgctaaggccaaggccattcaaggcgaacaaaaagatgtcgcatttggttcacaaattcgctcttacgtctttcacccatacacgatggtgaaagatcatcggacgaattatgaaaccggcaatggcaatgcggttatggacggggatttgaatccattcatcaatgcgtatcttcaatgggaacttgcgcaaaagaatcctgattaaactgtaatctgcctgaaaccttgctgacttaatcgcctgttatactgatgctagcttagaaaaaggagcaatttgcatgattcaaatggagaacgtgacgaagcagtatgctaacggcgtgactgccattaaaaatctcaatcttgagattcatgatggcgagttcgtctatgtgatcggtcccagcggtgccgggaaatcgactttcgtcaaaatgctttaccatgaactaatgccaaccagcggtacgattaaaattgatgattttgattttgcaacaatgaaaccgagccgggtaccatttttgcgacgtcatattggtatcgtctttcaagattttaaacttttaccgcggttaacagtgtacgaaaacattgcttacgcgatgcaagtgatcgaagcacctgacgaaaaaatcaaggaccgagtcctcgaagtactggggctggtaggtctcgaacaaaaactgcgccgttttcctgatgaattatccggtggggaacaacaacgtgtgtcagttgctcgtgccatcgtcaacaagcctaaggtattgatcgccgacgaaccgacaggcaatttggatccacaaacatcagatgaaattgttgatattcttgagcggatcaatgccagtgggacaactgttattatggcgacgcataacaaggacatcgtaaatgagcgtcagcatcgcttacttgaaattgctggcggccgtttggttcgtgacgaagaaggaggcacttacggtaatgaagactaagatctttttccggcatgtaaaggattcgctgcgcagtctgaagcgaaatggctggatgtcagttgccgctgtcagtgccgttacagttaccttactattggtcggtattttcatggcacttattttcaacttgcatcatgtatcagagcaagttgaaaatgacgttcaagtgcgtgtttacatcgagaagaaaactacgacgaaacaacgtgatgcattaaagactcagctagaaaagcttgataatgtcaagaaagtgacttaccggtcacgtcagcaggaattgaacaccattgtcggcgggtatggttcgcaatggaaaatgttctctggcgatcagaacccattgagtgatgtcttcatggttaagacaagcaaccctaaggcgacgatcaaggtctccaaacaagctcaaaaactaaaccatgtggtggacgcaagttatggcggccggactgcgaaaaaactgttcaactcagttgattcagcacaaaagtggggacttggttttactgtccttctgctgttcgtggcggttttcctgataagtaataccattcggattacgattctgtcgcgttctgacgaaatcagaattatgcgcctagttggggcaacaaattcatacattcgttggccatttattcttgaaggtgcttggactggattgttcggggctgtgctgccaattgtgattgttgacatcggttatgccgttgtttaccgcagcttcagcttatcaagcggctctaacggttattcgctatatggcacgatgccatttctgctttggcttgatttgatgctggcgggcattggtatcatcatcggtgcattaggcgcagtcatttcaatgcggcgtttcctcaaaatttaatcgtgcaatttgtgaactcatcctcgctaatgacggggatgagttttttgctatcatactcggctatgcgtgcctactcacattttgatttttatgacgttgtgggagcctccggcgatttctgctatactggtcacagtgaatattggagggttaccgatggcagttgtagttgccttacttatcaatccggttggtttggtgttttggctagcgctaggtttaacgatttggtttgctgtcaatcgcactgatcgcgagcgccgccggtatctgcgcgcaattcatcccaaacatccagaaattggtcggttcttctggatcggacttgtcgtaggtgcgctagtctcgctggtgatggttattggacgactgcagatcagtttagctgctttgcttgcattaagcggcttgacgttagtagcattgctattttctaaatggcgatttagcccttggtggctaggtcttgccagtctggcggcagttggtcagtctggtttgctagctgaacagcatgcagctaatttagctattttggtcggcctattatggctaacacaagctggacttgcgcgattcaaccgcggcgatgagatcgagtcgccggtgattcaacaagaccgccgccagcggcaaagtgcggcgtttgagttgcggcaactgttctgggtgccgttattcttacctgttgctgttgaaaacgtcagcaacctcccactgctggcggttacagtgcagtctttgacttttgtgggcttgccattgcttttaggtgcgaccttcatgactccgcgagatcgcgctcagacggcttggcggcgaagttggccgtggtatggcggcgcaggtggcgtacttatcgtttatggcattgttgcccgcaccatgaccttgcctttgctggttagtcttgtctttccagcagtggtgagtttagtattggttggcggcttcatttggcagggacggcaggtgcatctgacggtgactttagccgatcaaggtgtggtgttgattggtgtcgtgccgcatacaccggctgcagagatgggcttacaacccggtgatcgtgtattggcctgcaatcaccattccgtgaacaattctcgtgagctttacgatgccattcaaaaagaaccaacctattgccgcttgcggcttcgacaggcagatggtgagctgcgattaactgagacggccatttttgccggtgccccacacgaacttggtatgattttatttccggaggagacagcatgaagaagatcttgattgttgatgacgaacctgcgattttgacgttgctgcaatataatttggaagctgaacactatcaggtcgaaacagcgacagatggtcaggaggctttggataaagtacgcaacgagccatttgactttatcatcctcgatttaatgctgccgagtctgagcggcttggatgttacccgcaaaattcgtgaagataaaattcagacgccgattatgatcttgactgccaaagacaatgaaaccgataaaattgttggcctagaactcggagcagatgactatgtgactaagccgttttcgccgcgggagatcattgctcggatcaaggcgattgaacgacggagtcagagtcagccgcaaaccagtcaaaaaccgggcaacagtgatcagatcacagttggccagatcgcgattgatccagaaaattataaggccagcaagggtggcaaacgtctgcagttgacgccaaaagaatttgagctactggtttactttgctcaacgtgttggcaagaccttgtctcgagatgctttattgaacggggtttggggattcgactatcccgcagagacgcgaatggtggatattcaggtcagccatttacgcgataaaattgaaacggatccgaaacatccggactatttaaagacagttcgcggtttcggataccaaatggaggcaccccatgaataaacgaatcattcggcgtgcactcatcattagtctgctatcattggcaggcttttttgtgctcgtgacaacggtgaatcaacaaattgtccatcaacaagcgcgtgatcttcggcgagtcggccggacgtatgcggcctcgagtcatgatggggtcaatcggcaagcattggcagagtcagaggcagccttcatcacggtcattcccaataatccgcggaccacgcgtcaaaaagtgatggctgatgctttgcgtggtaatcgggatgcagcgtttgtaacaaccgtcaacgtgaatggtcgaacagagcaagcgtatttattccaaaataaaggacagtgggtggcagtcagccgctttaaatcaagtgtctggacaactgcaccagagcaattctggctcctaacgcttgcctttgcggcattgctcgctgccattctcatttggctttttcgatctgaacatcgttatcaagaagcgattgaagtcatgagccataatctagatcgcatccgtcgaaagaaagacccagatccggtgattttaccgcctgattcaccttttgtaccagttgctcgccgcatcaatgcattggccgctgaacaagcccatctccgtgaaaaagtggcggtgcgtcaatcaagttttgatcggttgattgataacttgccattgggagtcatgctgattgacaccgataaagatgtcatcttgcataatcacgccatgtcgcagctgctaggtcatcaaatcccgcagccccgacacagctaccttgatgatgttaaaacttatgccttggcgcgcatgatcgaacacacttttcgccatgaaaaaacgcatcatcaggaactgacaattttgaccacgcaaaaatccgttgatgcttcggttattcctttgaatcaaggcatcagtcggttgcaggtgctggtgattctatatgatgtcacttacttgcgacaggttgaaaaaatgcaactggactttgtcgggaatgtcagccatgaattgaagaccccagtcacagctatttctggatttgcagagactttacttggcggtgcgaagaatgatccggcgaccttggacaggttcttagggattatttatgacgagagcaagcgattaacacaattaattaatgacattttgaccttgagtcgaccggattccaaccaaaatgtggctgcatcggttgctttgaaaaaattggtcgatgatgcattgcataatttggccaaagtgattcaagacaagcaaattcgcgttgaagtggcaattaccccggatctattggtcgtgactgacgagcgcaaattgacccaaatcgtgcgcaacttattgaacaacgcagtcttctacaatcgcttggctggtcatgtcacgatcagcgctcaggttgtcgatcatcagctgtcactggcagttgccgacactgggatcgggatttctgagacggaacaggcccggatcttcgaacgcttttaccgagtagataaggctcgcagtcgtcacaatggcggtaccggtctcggtttagcgattgtggccgaactggttaagagtatggatggtcatgttgcggttcacagccaagtaggggttgggtcaacgtttacggtcactttgcctgtgggtgaaggcccgcacagaggatgaaaaactgcagccatcatgcctttacacaatctttacattcaatgacatgaacatttacatgtaactgataaaataattggagcttgaaatggaggatttcgtgtgaaaaaaattgtgaccctgttgagcctgctgttcttgccactgttaatcagtgcttgcaacagcagcagtcaacagtcgggagaatcgatcaccgcagttggatcaagtgccttacagcccttggttgaagcggcgggtgaacaatatcagacggaacatttgggggtctttatcaacgtccaaggcggcgggagtggcacaggtttaagccagatccaacaaggtgctgtggacattggtaattcggatctttttgctgaagaaaaagctggtatcaaggccaaagcattggttgatcataaggtagcagttgtcgggatcgccccgattgtgaatccgaaggttggcgttaaaaacgtctcgatggcacagctgcaaaaaatctttcttggcgaaatcaccaactggcagcagttgggcggcaaaaatgtgccgattgttctagtcaatcgagcgcaaggctcaggcacacgcgcgacttttgaaaaatgggtgatgcaaggcaaacagccaatggccgctcaggagcaggattctaccgggatggttcgacaaattgtcggcagtacgcctggtgccatttcttatgtggcgttttcgtacattgataaaacagttcaggggctctcagttgatggcgtcgcacccacggatgcaaatgtcacgaccaatcaatggcgcatttggtcgtacgaacatatgtatacgaaagggcagccaaaaggactcactaagaaatttttggcttatgtgatgtcaccagctattcagaagaagcttgttttgaaaatgggttacgtcccgatgacacaaatgaaagtggttcgggacgcgaatggcaaagtgagcaagcagtaacctgtgatgttatcaagacacggtcagatccgttggctgtgtcaggtgtcggacagaagcgtgatctaatccggatagaaaccgatgttgtggtcttcgccgggaaggttttagttagaaagcgcgtttaggaggtcaagatggatccaattcgggaagcaatgctcaaaaaatcgcgttcagctaagttagagcagcgtggtaaactgatcagtttgctttgtatcagtttaattgtgattgtggtggtggcaattttcttctttgtggcatcgaaaggactagctaccttctttcaaaacaagattaatctttggtcgtttctaagcaaaagtgtttggaatccgtcaatcaaagatgcgcacggcaatcccgaagttggcgccttgccaatgatcgtcggttcgtttggtgtgacattcctgtcagcaattattgcgacgccgtttgcggttggcgcaggcatttttatgactgagatttcccgtaaatggggacagaagattttgcaaccggtgattgaattgctggttgggattccatcggttgtttatgggttcatcggtctctccgtcatcgtgccttttattcgccacatttttggtggtactgggttcgggattttagctggtacttttgttttgttcgtcatgattttacccactgtgacatccatgaccgtggacgcgttaaaagctgttccacgacattatcgtgaagcgtcattagcattaggggcaacacgctggcaaaccacgtatcgcgtggttctacgtgctgcgattccgggaattctgactgggattgtgtttgggatggcacgtgcctttggtgaagcactggcggttcagatggtgattgggaacgcagcgcttttaccgaaaaatttggtttctccagcttcgacactgacctctgtcttgacgagcggtattggcaacacagttatggggtcgctagataacaatgctttgtggtctctggcattgttgctactcctcatgtcgctagcctttaatctgctgattcgctggatcgggaagaaaggggagttgaacaaatgaatccaaaagttgctgataaaattgcaacgacggttttgtatatcgtctcaggtatcatcattatcatcttggcgagccttcttggatacattctatttcaaggcttacctcacatctcctggcattttctgacaagtccggctcaaagctttgaggctggcggcgggatcggtatccagttgtttaactccttttatctcctgctgctcgcaatgttgatttccacgccaatttcattgggtgcagggatttacttgagcgaatatgctaagaaaaactggctgaccgatgtcattcggacgtccatcgaaatcttaagctcgctaccttccgtggtggttggtttattcggcttcttgattttcgtgttgcagttcaagtttggcttttcaattttgtccggtgctttggcgctgacggttttcaacctgccgttgttaacgcgtaacgtggaagactcgttgcgtggagttgagtatgagcagcgcgaagccggtctggcgcttggcttgtcacgttgggaaactgtcctgcatgttgtcattcctgaagcattgccaggtatcatcactgggatgattctcggcgcagggcgtgttttcggtgaagctgcggccctgatttatacagctggacaaagtgcgccagcgttggattttaccgactggaatcctgctaatatcgcaagtccgcttaatcctttccgtccggccgaaacattagccgtgcatatttggaagatcaactcggaaggcattcagccagatgccgttgccgtctcggccggtgcaagtgcggtcttggttctggccgttctgctgtttaatctcggtgcgcgctactttggcaatcgcctgttcaaaaaaatgaccgcatcctaatgtgaatacgcacatgccattgcagtggagttggtgatggtggtcataaagttggcgacaaaacgcttggaggctcacgatgcaagaacttgaaaaatattcattagatgacacttatattcgtccattcgatcgcgacaagcaggaaattgcgatcgaaacagagaatctacgcgttttttatggtgagaatgaagccattcataatgtctctttaccgtttgagcggtataagattacggcattaatcggcgccagcggttcaggaaagtcgacttacttgcgctcgttgaatcgcatgaatgataatattgaaggtgcacgtgtcaccggcaagatcatgtatcgcaaccttgatatcaatagtgacgcggtggatgtctacgaaatgcgtaagcatattggtatggtctttcagcggcctaatccatttgccaaatctatttacgacaacattgcctttgccttacgtcgatttggattaaaagacaagcaaaaactcgacgagatagttgaaaccagtttgaagcaggcggcgctttgggaccaagtcaaagatgacttgaatcaaagtggcatgtcactttcaggggggcaggcgcagcgtttgtgtattgcccgcgcgattgcgatgaagcctgatattttgctgttagatgaaccagccagtgcgttggatccgatctcaacttcggcggttgaggataccttgatgtcattgaaggataagtatacgattatcatcgtcacacacaacatgcagcaggccgcccgaatcagtgattacacggcgttcttctacagcggaacggcgatcgaatatgacgaaacccgcaaaatctttacccggcctaagatcaaagcgacgaacgactatgtctccggacatttcggctaggaggaacacatggctgaagcaaaaaaaatcattaccagttcaaatgttcatcttttttatggcaaatttgaggctttaaaaggcatcgacctagacttcaatcagaatgaaattacggcgttaattggaccatctggctgtggtaagtcaacgtatttgcgaaccctgaatcggatgaatgatctcattccgggtgtcaccatcactggcaatgtcagtttgcggggcaataacatttattcgcccaatgaagatgtcgttcaattgcgaaaacaagtcggcatggtttttcaacaacctaatccatttcctttttcgatttatgaaaatgtcatctatggtttgcggctggcaggcgttaaggataaagccgttttagatgaagccgttgaaacgagtttgaagcaggcagcaatttgggacgaggttaaggatcacttgcatgaaagtgccttatcattgtcaggtggtcagcagcagcgggtctgcatcgctcgggtgttggccgttaaaccggatgtgattttgttagacgaaccaacaagcgcgcttgatccgatttcgagcacgcagatcgaaaatatgctgctggaattgcgtgatcagtatacgattattctggtaactcacagtatgcaccaggcctcgcggatttcagataaaacggctttcttcttgacgggtaatctgattgaatttgctgacacaaaacaaatgtttttaaatccaaaggaaaaggaaaccgaagattacattactggacgcttcggataggaggggtagtatgcgacgactttttgttgatgaattgaacgatcttcatgtgcgcttttcggaaatggggatgatggtcaacgaggccatctataagtccgtgaaagcattcatcaatcacgacaaggccctggcccgcgaagtgattcatgaagataagcatatcaatgaacgtgaagtagatttggaaaaacgcagcttcgaattgattgcactgcagcagccggttacgactgatttgcgggtgattgtgacggtcatgaaggccagctctgatttggaacggatgggtgatcatgcggtatcaattgctaaatctaccattcgggtcaagggtgagacccgggttcctcaaatcgaggaagatatcgctggcatggctgaagcggttaaagagatggtagaacaggttctggatgcgtatgtgaaggaagattctgctcgcgcccgcaagattgcgcttgaagaccatgggatcaatgacttttcatcacgaatctacaaggaatgtattcggcagatgcaggataatccagaaacggtgatcggatccatggattacatgctggtttcttcctatcttgaacgaattggcgattatgtcaccaatatctgtgaatggattgtttatctcaaaacagggaagattactgaattgaactcaaacgctattgaggataagttctgagaaaatgacgctcttgctggcttgcaagggtgactgaaaaagattgacattgattgttattttgaaagagggatgatttttacttttgtgaaaatcatccctcttttgatctctcatggatgacttactaatatctaaagatcccggtgccaaggcggagcaatcataggctagatggggttcagccgtgcaaacatcatcagctcagcgttgccagccccatctggctggcgactgtggatagattcctttttgatgaacgcgctgatgatgtgtttcatgtcaataaccagatgaatagatgcattactttcaagcgtccgtcttccgacccgttcaaaaatcaacctttggacctatgcgccccggcgcgaatccgtgcatactaatcatgtaatcaaatcctggagggataacccatgaatgaacgcgaaagaattttagacctagttaaaaaaggcgttatttcaagcgaagaggcgctggtacttttggaaaacctggcgaaacgtcaaggttcccagcaggccgctagcccggccgataacacagctcccgaaggaacttcggaaacgccgaatacggatgatgagcatgcaaccagtgacacggatcgcaatgaagcgctgacagaactcaacactgagattgctgaagcagcaggtgccttagatgctgctaccgcacaggttacaactattggtaaacaaatcgatgcgaacaacgaacagatcatcgtgctggacacgatggaagatctcgaagccctttccccggaaaaataccaaaagcgcggggatttgaaacaggagaatcagaaactgactgatcagttggccgaactaaaaggccaaattgagtctctgaaagcgaaccttgccggcttacgtcaccaaaagcatgatttagagcgcaagaagcttggcgacaagattttaaatgacgattggcaaaaagatgctcgcgatgctttttctgagtttggcaaaaacttaggcgatgcaaccacgcaactgggtgggttcgtgaaggatactgtcaacaatgttttggataacgttgactggaagaatgtcaccattacagtacccggtttagcaactgaaaaatttgaccatgttttcgattttccagatagtcaggcaacgattcttgatgtgaaagttgctaatggtgacgtgaagttcaagacttgggatcagccaggcattcaagttgctgctgcgatcaagttgtacggcaaaatggatgccgcatcgccgctggatgcgttcaaagaccggagccgcattgatgtcacggacgatcattttagcttccaagtaccaaacaagcgggttcaagctgatttggtcatctcattgccaaagcgcagttatgatcatgttgctgtccggttattaaatggcagtgcagatttaactggcattaccggtaaagatttctatgttaagagtacaaatggtcagatgaacttcactcatgttgatggtgtcatgatcgagagtgaaggtgtcaacggctcaatcaaggttcaaggtggtcatacccatgacttgttgctcacaacagtgaatggcgatgtcagtgttgatgccgatccggcaacggccgccttaaagacagttaacgggactgtgcgagctacctatcacacggacttcacgacgcttgaaggcacttcgatgaacggcaatgttaaagtcgccgtgccgtcctccattgcgcttaacggcgaggttcggacgcattttggcagcatcaagagccgcttgagtgaggttgccgaaccagctaaggggattaagcgtctggaactgacgcgtcccgggactggcagtagtgaaatgaaactcaatacaaccagtggtaacattcaattaaaagattcaaatgactgaggggattgcttatgccttttctattaattccattaatgttctttatcattggcttgatcatcgtggcggtttttgccatcgggatattcctgctgaaacttctcattgtaccggccttactcatcatcttagctgtgtggctcttctcgcggcatgatcggtctgaccgttatgatcgtcggcgtccgcgtcacccctatcgtgatcgcgactcatctcggccccgaaaaaatgcaacgcatgtgaccgagtcgcatgacgatgactggagcgatttctaatgaacttcgtcaaacgcaccatcataacgacggcagttttcctgatttacgcgcaactgtttccggctcagctttatgtggcaggatttggtgttgcggtagtcggtgcattggtgctcggcgtcttgaatggtctgttgcgaccaattctagtgattctgtcgataccaatcacgattctgacactaggtttgttcctgatcgtgctgaatggtttgatgctaagcatgatgacttggttcgtaccaggcattgtgttcagcggtttcggcgctacgatgttgctggcggtcattatttccgtgttgaatatgatgtttgtcggcaaaaattaaagtgacgattgaaaatggcttgcgatctgcaggccatttttgcgtgacttgagtgaactaaaggcttatcgttaccttccaacgaagcgcacaatgtgaatgaccttttgcgaatgtttcaacctgctgaccataaggggaatcgacttatggtaaaatagagcaaatatggcgaaagaaaggtggacttcatggcagacagcgtgacagtgcggcagttggttaaggcaaccaagctcgaggtatacagcggcgaggagtatcttgatcagcggcaagtcgttttgagtgatatttcgcgtcccggcttggaactgactggctattttaattactatccacatgaacggattcaattgttcggtcgaacggaaatttcatttgcgcgaaacatgtcatccgaagaacgtttattgattttaaagcgcatggcaactgaagataccccagcatttttggtatcgagggggttggaggcgccggcagaaatgatcaccgcagcgacagcggctcatattcctgttttgggatcgcgtttgccgacgacgcgtttgtcgagtctgattaccgagtatttggatagtcagctggcggagaggcgcagtatgcatggggtgctagtcgatatttatgggctcggcgtgctgattaccggcgattctggtgtcggcaaatccgaaacagcgttggaattggttcagcgtgggcatcgcttgattgccgatgatcgggttgatgtttatcaacaggatgaacaaaccattgtcggggctgcaccgccgattctttcgcatctgctggaaattcgtggcttgggcattatcgatgtcatgaatcttttcggtgctggcgctgttcgtgaagatactactatttcattaatcgtccatctcgagaattggacaccagacaaaacctttgatcggcttggttctggggaacagacacaattaatttttgacgtgccagtgccaaaaatcacagtgccagttaaggtcgggcgtaacttggccatcatcattgaagtcgcagccatgaacttccgcgccaagtcaatgggctatgacgccaccaagacatttgaaaaaaatcttaatcatctgatcgagcataatgaagaaaccgaccagaacagttcgggggacaaataacttgttattagcacttaatccgatcgcttttcaattaggcggtctggaagttcattggtacggtatcattattgccagtgccgttctaattgcggtttatctagcgatgcgcgaagcacccaaacgcgggattaaggaagaccacattttgaatcttatcttgtgggcgttgccgtttgccttgatcggcgcacggctttactatgtggcgtttgaatggccttactatgccgctcatcccggcgaaatcattgctatttggcatggcgggattgcgatttacggtgcattaatagccagtgtcatcgtttttgccatttattgtcgggtccaatggttgccagtttggcttgtcctcgatattgctgcaccaactgtgatgttggcgcaggcaattggtcgctggggcaacttcatgaatcaagaagcccatggtgctgtgaccacgttagcctatttacgcggcttgcatttgccagaatttatcattcagcagatgaacatcggtggggcatatcgtcaaccgacttttctgtatgaaagcatgtggaatctagtcggctttgctttgctcatgacggtgcgtcaccatgagcactggtttaagcaaggcgaagtggtgttgagttatgtgatgtggtacagctttggccgtttctttgttgaaggtatgcggaccgactcattgtatgtcatgcccgggctgcgtgtttcacaattgttgtcgatcatcttatttgttgcagcggctggcttagtttggtatcggcggcggcaaggaaatgtggcatggtatttagacggcaatccgcttaaagcggtggaataggagtgattttgtgccaacgaaaatagcagtgttaggtgctggttcttggggcaccgtgctagccaatttattaactgaaaatggtcatgaagttgatttgtggagtcacaatccggatcaggtagccttgatgaagcggacccatcaaaatgaacactatcttggtgctgagtttacattacagccggctttgcatgtgactgctgaccttggccaagccttggatcaagcggcggtcattttgtttgttgttccaaccaatgcgattcgcagcgtggccgagcaagttaaaccaattctgcaagctcataaagggcgtggtgaacaaccgattattgttcatgctgccaaaggacttgaacgtggcagtgagttgcgcatctcgcaagtgctcgcagaagtcttgccgaaggaattaattcaaggtattgttgtgatttccggcccgagtcacgccgaagatgtcgccacccacgatattacaacgttaaccgccgcttccgatgatttgaagttggcagaaaaagtgcagaagctgttcatgaatgattatttt

SEQ ID NO: 12 - DNA, 81259 bp, Lactobacillus paracasei
tcccgcaatcgtgatagtttcctttggtgcggtcacataagtgtatacttggctgccaaccataccaaggacggcaaccgccacaaccccgatgctgatcttccaactcactttttgcatgacatttaagagccacgaaaagacaatcgccaatagcgctgctgccaaagcacccattaaagttaacgccgcatcatttcgatcaatacccagcaaaatgaacgtgcctaagccaccggcgccgatcaaagctgccagcgtcgcggtaccaatgatcatgaccattgcagtccggacgcccgacaagataaccggcaaggcgatgggcaattcaactttgaacaacttccgcaatcgactcatgccaaacgcatcggctgcttcttcataggaaggatcaatatcgcgtaaaccgatatatgtattttgaaaaatcggcaataaagcatacaccactaaagcaataatcgctggcagcgtcccgatacccacaaacggaatcagcaaccctaacaaggccaacgaaggaatggtttgcaaaacaccagtcacttgcagcagcactgccgcggttttgtgatgcgtctggacccaaacggccaatggaatcgcaatcacaacggcgatcatcaaggcaattaaagatatttcgatatgttgccccaaggcactaagcaactcgccgtgccgttcagaaattgtccgccacaaatcagccatgttatgcctccaattgaatgtgatatgagtaagtgtaacacctagttttcacgtgcaacaagataaggtgtgttatattctggcaagttcatctttcttctgggagctggtgaaataacggtagttcgcgttagctttgcaggcgcctgccactgtcttaaacgcttcaagaagcagtgccatgggcaatctagctcgaatactaggatagaaagcagagagttggcggagcggcgatgggctcagtggtgagattggtcttagcagagtggttttctccgcttagaccaagaccgagcttcgagacagcgcgccgggcttgcgcgttggctcgaagtcgtgcccaccactctagctgcgcggtcgccaccccgaatcgccgcggagtcaactcggacaataggatcaagcttaattagagtagaaccgagaaaagcttgacacatacgggcctgctcacgctctcccaaacgcgttcgcaggcccagaaacctgcacataaggacctcggacataaatggccaaagcccagccatttatgtccgaggccacttatgctccggtttctaaccgggcctgctcacgctctttacttttccaagtgcccagcgtacaattatcgacaccattttaaacaccgaaaggagcgccgtttctatggaaaatgcaacgaaggcagaagaacaggctcgggtcacggcggtcattgagaagctcaaggcaaggctagcggccattcatgaccagatcgaagcggcgcacaaagaaaccagccggattgaacgatcttacggtgaaaataccaaggtcaacgttaccgaagtcgatgaccaaatggaaaccaacgctgcggttcaacagcagaaagtcatggttgcccgcgccgtcgaaaatgaaaccattctcaaacacgaaggtaatcgtctcaccctgctagcggacaatccttattttggccgtatcgatattgacgaagatggcgatcccgacacgctttatatcggcactgccaccttcattgaccaagatggcgaattcttggtttatgattggcgcgcgccggtaagttctatttattacaacggtacccttggcgatgtcagctacgatacaccagcaggcgaacaacacgccactttgaaaaacaagcgtcagttccaaatcgaacacggccacatcaaaaccatgttcgacaccaatgaaaccgttggcgacgaaatccttcaatccgttttaggcgatcaatcagacgaatacatgaaaaatattgtcgcgaccattcagcgcgaacaaaacgacattattcgtgataccaccagcgacttgcttgtggttcaaggggtcgccggctccgggaaaaccagtgcggtcctgcaacgcattgcttacttgctatatcacagccgtagcgatctggatgctgaccaaatggtgcttttctcgcctaaccgcttgtttgccaattacatctcacaagttttgccgagcttaggcgaaaagaatatgcggcaggcaaccttgtttgaattcttggcaaaccgtttcaccggcttacatgttgaaacattatttgaacgttatgaacatgatgcagctggattgccgccagctgctgagcatatccgtcgctttaaagaagcgccgcgctatcttgaagctatctacgactatgctaagcaaccgaagcggacaccgcattttattgacgttgagttcaacggtgagactttcttctcagccgcaaccatcgcaaaaatttatcaagcccagccagcattgatgcagccagttgataagtttaccgccactaagaatgctttgatcaaacgtctgaatacccgaattcatatggaagccaaacgagactgggcgcagttgcgcgtttccgatctgtcacaaactgaattggaaaccttgaccgccgatcacgaattcgaaaccggtgaagatgaacagcgatttgtctcggaagctattgtctcaaaagcattttcaccaatctacgatgcactgtacaacgatcatttttacgatgtgttccaagactatcagcaattcatggcacaggtgaaaccacccgttgctccggctatctggcacacaatggtcaacgccttttcagacggaatcgaagcgcatcaattacgcttagaagatgccgccccgctgctttatcttcgtgatctcagcaccggcagcggtcaaaatagcctgattcagtatgttttcgttgatgagatgcaagacttcagtatggcgcagttgttgtacttgaaacacgcctttcctaaagccaagttgactttgttgggcgatgccaagcaagacgtgtttaccagtaattatcagcctagtgatttcattcatgaaatcgaggacgttttttccggctataaaattcgactcattacgttgaacaaaagctaccgatccacgcaaccgattactaactttgccaaagctttattaccagaacacgaccatattcaggcgtttaaccgtgctggtgataaaccagaagtcttgacggtagcgcgcacggaagcacccgatgctttgtcaaaactggtgacgcaactgctggcaaccgataccaccgtggcgattctaaccaaagatgcccaaacggctgatcaactttacgccactctcaaacttgatgcaccagtcaccttgctatcggctaatgaccatagccttaaaaacggttgtgtcattttgccagtctatctcgcgaaaggtttagagtttgacgcagtcatcggttgggatatttctgcaaccacgtatcaaaatgaagccgaccgtgatattctctacacactttgctcccgagccttgcaccatctcacactcgttgctttggacgccccaagtccattgatcacggcactgcccgctgatctctacacacatgcaggggatgcctctgaggcgcgtgtctaatgccacccatgcatcatcaacaaacgcccgtgtcttcgctgacacgggcgtttgtttggcttctagaatcatgataaattatcaatggaacgatttaatcaattctgtttattaaaaatttggatggtttatttttgtttaatctactccgtaccttcatggccgtttacgaaacacgcagcttttccttggcagccacgcacttattcaccagccagccaactgtgtcacaccatattcatcagctggaaaatcaactaaaaacaaccttatttgaacgaaacaaacgcagtgcgacgattcccacagcagctgctgatattttgtatacctttagtggcaacctgctggctgagtgggaaaaaacgcaggaagcgattcaaaatagtcaaaaggatgccattgttgacctgcatattggcgtatcgcaaagtgtcgccgctgttctattttcccgaatcgcagcggctttaaaaaaggcttttccctacttgcaatatgatgtcgccgtgctcaattccttgcaagttgtcaaacagctggaaggccaacatttagatttaggctttattgaacaacctttaaccttaaagggcgctgtccgaacaaccctttgtacggatcaactgatcgctgcaggttggtctaccggcacttggattacccgcgaagaaggctctgggatgcgctattacaccaccgcttatctgcaaacagccggtatttcgccgcaacacatgatgactgtcaataacaatgccatgctgctggcattggtacaacaaggtgtcgggcaggcacttttgtcggatcaagtcgcactcggcaatgctccggcacaagcaattgggccgcaatttcaacggcatttttacttgctgcaaaacccaaccgccaactggccccacaaacaggccatgctagataaaattgttgaagcagctcgcgcttcggaagtaacccgctgatggccaagctgctttggatgactattaatcagacagttcttgagtagcagttgctgtttgcttgactgttttagctgtaagccgcaaaaagtttagataatggccggtcacaaatatcagcatcaaactcgctacaagccactcaccccactgcaacacgctcaacaagttatgcaccaaccccttgctggcaaagatagcaataaagcgggtcaaagcagttgcggaaatgacgagtggaaaggtgaaggcggcaaaactcggataaaacgacagccgcgtatactgtcgaatgctgaaaagggtcagaaaatacaggcactgtgcaaaaatcaacatgccggctgcaaatgccaaattcggatgcgtgaagctggccagataaccggtcagacaaagcgaagccggtgcggcgatgatcgtcagtaagggctgtgttgcctcaggcagcggtattgtcctgacacgatgcagcacaaacggaaaaactgccacgtagatcacaaatgcaagccagaaaaggggctgcccaagtgctggcacgaattttccactggtcacgggaatgacgccgataccgacaaaggtgacaaaccagctcggataaatcatttgccattctttttgttgcgggagcaaatgccgtgaaacgaaaaaaatcattaagccaaaatggataatcactgctaatacccagatgacagtagcgatccccaccggcattccccaagcagttaaataagtgcacaagatcatcaaggtcatcgaaaatgtcggcgacaccgatgcgatgatcggatcctgtaaacttttagctgcgtgtaagggagtcaggcaaattttcagtaaaatcagtccaaacagcaaagcagctaagcctcctgttaggttccctactaattgccaacctgccagtttgtatagattacccaacgatgccaatcccagtgtcagtcccgccatcggtaacggcactcgtttcaaaaatgatctcataactgcctccttatattcttgctattaagtgtagcaagaatcatcgtcatcggctaaattgatcttttgcatgattaacattcacttattgaattaatcatggtgacgatcatgcgaccaatctaggctaaaagtttcttgccatgccaaactccgcaatctccggccagatgaggatggaacgcgtgacggctgatccccatccggcctaagattgcttcgccttggcactgggatctttaaaaccccaataaatcatttatgagaaaataaaaaatgaacaacttccaattgcgaaaattgttcattcttatttgacgcttatgaataatgtcctaaccttagtttggaaaattctacacgagcaaaattgttgcattgttgagcatatgcaacccaatcgaataacgcatgtctcttgttcgcaagtaagtccaagcaaggacgccgccaagcgcggcatagatgaagaagttataatccacttttccggccacatgtgcaaagccgaagactgcggcactgattagcacactcacccattgccaggatcgctgcttcaaagagccgaaactgttcatcaagaaaccccgaaatagatactcctcaacgattgggccaccaacaactgctaataacttgattgaccacggatagtttttaactaaatcaagcaggttactttggttggcagcttgaggcgcgtgcatgacttgcgtgagcgtcacgttgatgagctgaatcaaaaatagcaatccgataccttgccagatcacgctagaaggatgagccaccgccagcgcaggttgttggcggtaaaaatgtcgatagcagaccatcaatgcagcaatcagtgcaccgaatacaaagaccaaggcaccaatggccccataggcaccccatgtggcctcactgcggatcaacgcaagttcggcggacgaataggcgataaaacctgcagcaacgccaacaagttggacaaatgagcgaagaattttcatgaaggcaatcctttcttggcatgtttgtctttaagggtaacattttagaagccagggtgcatggtgaaacatagccgtgaagaggcgtgtcatgcttagaaagtgaagcataaggtcccaccataacgcgcaagtcatccccaaaacctacgcataaggagcttagtcgtaatgatcaaagcccgacctcacgtccaagaccacatactttccggtttctaaccgggttggttcgtgctcacaaaaaaacctgacagatttaatatctgtcaggcgcggtactatcagccgtctatcggattcgaaccgacgacctcatccttaccatggatgcgctctaccgactgagctaagacggcaaatggctgtgttgtttaaaaacaactgcctaattaatgtacactaaatccccatagctcgcaagtcctttttataaaaatgtagcgtagaaagcaaaaaaatgcgcattgctacagctgttttaactggccatgctgtcctttcataaaagagccgccttgccttaccgtctaccgtgccactcggctttgaactcggttagaaaatcttccataacctgttggcgatgcatcgccatttttttggccgcatcggtgttcaattgatccttgagtttcaacagtttttcataaaagtgattgatgacggtgccttctgttgtacgatactgagccgcggttaagtcagctcgtggtggtaaatctggatcatacatccgcccaccatgtgcaccgccatacataaaagcacgaccaatgccaatggcaccaatggcatcaagacgatcggcatcctgaaccagttgtccttcgaccggcaacgattgatggtgttgtaagtttgctttaaacgacatgtgatcgataatcgtcaataccatttggacttggtcagcgcgcatgccagcgtcgaccattgcctgctgggcggcggctttggctattggcacatctgtaaccaatttatcgtcataggtatcatgcatcgtggccgccgccaacacaacggctgtatcagcctctggtgtttgcgcagctagttgttttgctgtcgccacaacccgctgaatatggtcaaacccgtggccactgtgatcttgctcagataccttttttgcaaaggctgtcagctcttgccattcgatcatgaatcgttgctccttttcgttgtccaccattcagtcacctgctatgtgattttgttaacaaattgagcttttttctgccgtatttattgcgtcaatcaacctcaatccttcatactaaaagtatacagaggttatgaaaaaaagggggagcacttttatgaaaaagcaatatttggcagccagtcagtcggtgaatcaattcaaccgactcttttcaccggtttcaacatcggagattccattgaatcaacaaaacctgcttttctggatggcgaccgatgccacgccaagaacaccaacgagcttggccaaagagatgcacgtcaccaaggctgcgatcaccaaagccagcagcccgttgattgaccgggggttgcttgaaaaacaacccgatcctgaagattgtcgcagcttcaagctggtgcttagcgaagaaggtgagcaagcaattgaggatctcgggcctgaatacttgggcaacttagaacgtctctatcatgaacttggcgagaaaaagtatctgaagttgatcaaacttctcagccaagcaactggcaccttagtcaccgaataaaccggtcatctcgtggcacaaacacctcatggagatcaccacaatcaagcctgacgctcagttgcgtgaggctttttcagttgactgggcgacacaattttgtcgccgactgttgccgtttttctaggagcgttacaatgacaatatcaggacgtagctagcccgattttgtcagtagccggctatgtctatctttttaaaggagtggtttgatggcaattcccgatcatatcagtgttcgcggcgcttacgttaacaacttgaagcatctcaatgttgatattccgcttaacaaactggtggcgatcactggtcggtctggttccggtaaaagttcattagccatgggcgtgttatacgctgaaggtatgcgccgctacatgagtgctttgtccacctacacccgccggcgccttggccaaacaagtcccgctgctgctgactcagtacgccacattcctagtgccatcgctttgcggcagcggccaaccgttccaggcatccgctcaactgtcggtacggccacagaagcgctcaacgtcattcgcctcatgttttcccgtctcggctcgccggtttgtcctaatggtcaccgcgtgtcgccaactctcgatattgccaaggcaatggatctgcccaatgacggtgaaagtggtatgggcatgatcacttgtccgacctgtggcgtccgtttcatggcttttgctgctgaagatttcgccttcaattcaactggcgcctgcccgacatgcggcggtactggtcaagcgcgcacactggccgccaaccggctcatccctgatcaaacactgacaatccgtcaaggtgccgtggcctcgtggcgcttgcccggtcgcaattttatgccctttgtcgcacaagcaatcggcattgatattgatacgcctttccaggacctgccaaaagatcagcaagaacaggtttggcacggtgaacgtaaaaaatacgccatcaatatccccagcaaaaccggcaaaatttttcatatggaccatgcacagtacgagaatgctttcaatgcggtcgaagattctttagcgacgaccaaaaatgaacgcgccattcagcggctgaatcgcttctatgagtttggcatctgcccgacctgccatggcagccgatttgccccgaaattattgagccagcacctagtggatcaaaacattgctcaggttagtgatatgactttaacgcaattagccgcgttcattcccgaaatctatcactggttgccagcagatatgcagtcactggcgcacgatattatccaagaactgacgcaattgcttaagcccatcatggaccttggcctcagttacctgaccctgagtcgagccgcggcttccttatcgactggtgaattgcaacgcatccagctcagtcgcacgcttcggactgaaacgaccggcgtcctttacgtccttgatgaaccgtccatcggcctgcatgctgcaaacgtttctggattgctagaagtcatgcacggtttggtcaatcaaggcaactcgctggtcgttgtggatcacaacaccgccatcattgaggcagccgatcaagtgattgaaattggtcccggtgcaggcgttgctggcggccgactcattgatcaaggcagccctgaagcgatcagccatgatacccattcgttgattgcaccttttttaaccggagcggcttccttgattgttcgcccgcaagccggtgaacaagaaattaagcaaaccaaacaactgcaattaaccgtaactgatcgatttaaccttcatgacctgcatgtccattttccagttaactgcttctcagtggtatccggcttttctggtgctggcaagtcaactttgatttttgacgccctagtaccagcgctgtcagcaactgctgaccaaccagctccagcatttgttcgtgatcttgaccgcggcggcctgcgccatgtagttgcgattgatgccacgccggtcggtaaaaatgtccgctcaaccgtcgccacctacacagacattctcgaccatctgcgacaccttttcgccagtttgcctgatgccaaagcccagcactataccagtagtcatttctcttacaacgtcaaagctggcgcgtgcccgacatgcggcggtaccggcgtcattaacttagatatccagtatctgcctgacatgcagcaaacttgcccgacttgtcacggccgtcgctacaaccccgaggttctgaaaatcaaatggcagcagcacagcatcgccgacttgctagatctggacgtggactccgccttgaccgttctgaaagacgaaccggctattactcacacattgcaaaccctgcatgacatgggcctcggttatttgcatttaggtgaaagtaccccgacgctgtctggcggtgaagcgcagcgcctgaagctagttgcccacatgggacgctcccaaaaagacacgctttttgtcttcgatgaaccatcggtaggtctacaccccttggatgttcaaacgttgatcgctgtttttcaacggttgctcaaaaccggtgcaacggttattgccatcgaacacgatctagacgtcatcgctaacgctgattatgtcttggatctcggaccaaaaggcggtgcagaaggtggccgcatcatggctgctggcacaccgcaagcaatcgccaaacaagggaaaggtgaaactgccccttacttggcgggccatctggcggcctttcacgttaagtaggcttgacaaaaagagatgcctcggaaagtgataaccgagacatctctttttcatacatcaactttaaacgttcaagatcgaatcaatgtggctgatttcttctgcactgaaggtcagattttcggttgccttcaggttgtcttccaaatgatcaaccgaggtggtcccgatgatgacactggtgacaactggatcacgtaacagccatgccaatgccatttgcgttaacgtctggccacggtcatgtgctacttcgtttaactcgttcaacttcttcacaaccgcgtctttcccatgggcaaaagtggcttggttggtcggatgaattttgaacgtatccggaataccattcagataccgatccgacaacaagccttctgaaagcggcccataagcaattaggccggcaccatcggcttgaagagccttcgttaggccagaagtttcagcctcacgattaaacatgttgtaactgaactgattcagcacaaatggcgtatgcagatctttaaacatcgcaatcgcatctttggtttgctgggtatcaaaattcgagatcccgatgtaaagtgccttaccatcacgcaccgtctgatcaagcgcattgacagtttcttctaaatcaaccgtatcatcaaagcgatgcgcataataaatgtcgacatagtcaagctgcaggcgtttgagtgaatcattcaagccttgaatgaccgctttgcgcgaagtcccaacgccatatgggcccggatgaatctcataccccaccttggtgctgatcaccaattcatctcgataagccttcaaatccgttgctaaaatttgaccaagcaaactctcgctgctgccaaaaccaggttcatgatcaccattaccatagtgattcgccacgtcaaaatgaaagacaccatgatcaaaagcgtctaaaataaccgaacggcgtgggccaaatggatcaagattgccataatgctgccacaagccaagtgaaattgccggtagcatcaaaccggttttcccggcatgacgaacaggcatcttgtcataacgatcagttgctgcataatacatgacttttccccctctacacgttcacgagtgcagaaacctgcatacaagcgccttgaacgcttatacgccagtttcgaccgcaccagctcacgctttgacttaaacgcgctcaccgacccaggaatcatgtatacaagccctgaacgctatggtcaaaattcaaccatcgtattcaagccaatttgcatacggatttctaaccgggctgtctcacgctcataaaaacgtttaccatcttctatggtggcaaacgttgacccaacaagcaacttaaaaagtcaactttttaatataaaactacttatttttcaaaaaaatcgttcaaaaagttagctacaccatcatccacattggcatctgtcatataacgggcagtctgcttaacctgtggcacagcattttccattgccacactaataccagcagccttcagcatgccaagatcgttgagaccatcgccaaaggcaatcgtttgctccggaccgattcctgtgagcgtctgcaactccttgacggccgtggccttatcaatatgtttaggaatgagttcaaggttagtatgttcagaggctgaaacatgtaaaacatcctgtgcttctaacgctgccttccccttagccaattcttccgaatcatgcgggccaaaaatgatcccattcgtaattgcaggtgcatgtgctaaaagatcatcaactgaaggtaaggctacaacgtcaatgctcaccgagctgggggcaaacttgcgtgcagctgcttcaatggcaggcggcactttacctgtgtaataaacggtatcatcgctgaaatacaaggcgttcaggcccaactgatcggtcacagtttcaaccgccgtaagtgccgcttgccccaaaacatgatgcacccgctcgccggaaaaatcgtagacagcaccattcgatgcaataatcgaagcttctggttcgaattgtttggccacaacctgcgctaaagcgtgcatgcgcccggtggcaacataaaaagaagcgccgctagcaacggcagctgcgatggccgctgccgttttgggcgtaacgtcatgatgattggcggttagtgtgccgtcaatatcactaataattaagtatcgcggcataaccgttcctttctaccctaaggacacaaatggcgaccgatcaccatcggccgccttatttgttaaagtccttgcggtaatccgtcaatttgatcagcgtaccaatcgttccatggtgtttcaggtgcgccttgcgcattaaaagttaccttaacttgtttcaaaaggtccaacaagttaccggatcggttagtcagaagaccggctgtcaattcctcgcgagtcagtggttgattatcaagcaagtaatgattaatatctgctagattcccctgcgtatcaatttgggaaaaagcatcgagaccggcgccgaagaagcgatccaagtagaactttgcaaaagtttccaatgctgtatgttgtgctgtttcatttaattgatcaatcgttgtgttgcttgctgccataactattttcgtcctttctgctttattccattataaccacttttggttgcgttttggaaaacatcgtcccacaacgatcacaagtttcacataaacttacacgttgccgtcgaccaccattttatgagtgctcctggtcatattcattaatgaaaagatagtgtttgatgacatttttataggaaatcaaaaatgccataaaatattcgccttttttgaaattttacgactttggtctcttgctattatggaacggttgttataatatgccaaatatgttggggatccgtgaaaggctggagattttatggaaaaagaaaaattacatctcggtgacgcggttgtttgtcatgtcaaagaagatatggaagcaccttttaccggaaaaatagaaaaggtttatgagaactcggcgctgttgagtattaccgattatgctgataaagaccggcagaatgccgcagagctcaactttaagattgtcgcaaatttccacgcgatgactcagaacctcggcggcggcactgtcttggcgttcccgccagaaccagccgaagagccaaaaaaataaacgttccaatcacattgtctcacaatatcactggcatctcgtgccagtgagtggttgttattatttacttagggatcttcaactcaaacaaacaaagtcaaaccggtcgacaggacagcctgctgatcggcttttttagttgatacccaagacaactttcatggtcattcatgaaaatcagcgtagaatgagtcgcaaacaatctatcgcaaaagcacaagtcagttaagctcgaagtcttatatgcaggtttctggcctgtaaacgcgtttaagggagcgaccaacatgaacgagaaaccctatccagtccacgaaagtcttttgatcggcacactgctcacagcagctgctggcagttttgatgctttcacctatctcttacacggtgaggtattcgctggcctgcaaaccgggaacgtcatcttgttgggtattcatctcggtcaggcgcaatggactaccgctgtccgttacatcgtaccgatcttcgctttcatgttcggcaccatggccgcccgcgcactgcaactgcaggctggcaaaaaatcacgacctttaaccgaacaacggtggctcattcaatacgaaatcactttgattcttatcgtgacattgtttggccactggctgcctgatctagccgccagtgctttggtttcactcatcgccgccgcgcagctacaggaatttcgccgtttaaaaggcggcccttttacttcactgatgatgaccggcaacctccgcaccgcggcgcaaagcctttatgatggcttcatccgcgggcagcaaaaaggccgcaaagacgcggccacaattgggacgattattttatcatttgctatcggtgctgccgtgacaggtattttaacgaccctgttcggaacttatgctttagtaggcgccgctttgtgcctcgtctggattgatatcattttttggcgtgatcaggttgagcttcactaagccacttaattagccgcttgacctgcatgcaagaaactaaggtcattgaaatccgtcacagtaaatcgatcattttcccacatcagtttcgtcacgctagcattgtctagcatttcgcgaccatcaatgttgtagtgaacataattcaaccacatgagcgccgctgtcccgtgtgagacgaccaatactcgctcccagtctttggcgactgcctctacagcaatcgcacgcaaagttcgattcaagcgttcctgcaccatgcggttcgtttccgccttgttcgggtgctgatccatattcgccgtaaaagctgcatctgccgtctgggccaacgttatttcttgattggccaatgcatcgtgaaagttagcaatccccatggtcgctaaggaaaaatcatttgccagttgaccttcgaacttgccgtaattttcttcacgcaaccccatcaaggtcgtcaccggtatcggttcatccaaaccgctcaaaacaaaatgggcagtatctaccgcgcgggttaaatcgctggcaaaagccgcgtcaaagtgaatgtttttagtcttaaagccttgacccaaagctttagcgtccgcaatgccttttggcgtcagtgccgaatcggccatgccttgcactcgtttttgtacattgaattctgtttgcccatgacggacaagataaagcgttgtcatgtctagttgactcccataattttcatttttcctgcgacaatggtttaagccagtttcaaataatctgccaaatagtttgccaccccatcatgctgattatcgttaggggtctgcgcatcggcgattgcaagaatcgcaggacgggcatttttcatcgcaacaccatgacccgcaaactgcaacatatcaagatcattcatgtcatcgccaaacgcaatgatatgcttttgatcgattccgtattggcccgccacgtaagcaagtgcccgtgacttgctggtattcttacttgtcacttcaagcgcagtgtattcaccactccaagcaccccacgttttggccgccaaatgcggatacaatgcgttgacttgttttgaaactggatcaaaagttttagccgtcataaacatcgtgaccgaaataggcggctgccgcaaaccttgctcatctaacagcgccttaggatgcggacgatctggcaaaaacggaatgttcgcgtatggtcgatcagccaccagcaactgtttcccttctgccaccataactttaaaggaaaagtcgcgttttagctgccgtaacgacagtgccaccggaatgggaatggtgacctcttgctcataacgccagtgttggtgcgggatgtgaatcagcgcaccgttgaaattgatcatcgggccatgaagctgcaagtcgtcgtagaaatgttccgaaatcgaatccggacggccggttgtaatgacaacgagatgtcccgcggcttgtgcctcgcggaggacggcaatcgtgccagcgcttaattgtccatccgcattcaaagtcgtgccgtctagatccagtgcaataagatagcgttccatgcagcagcctcttttcaaaattttttcttagtgatgtgtctagccatctaaaacgcgttcccctacaatagatagcagttagaaagcgaggaaatcatggctgaatcaattgtactttatacagatggcggtaatcgcaatacaggaaatcaggcgggtggatcggttcgccccacggataaaagcgcatgggccgcattgctgatctacggagatcacgaaaaaatgctatctgacggcgactatggccgaacgaataattatatggaaattatggccgttattcaaggcttaaaagccctcaaacgcacagatattcccgtcgatgtttattccgactctgcttacgtcatcaacaccatgcagcaacgttggtgggtaaaatggcaacaaaacaattggcgcaaccatggcaaaccagttaaaaatgccgagctttggcaggccttgttgcaccaagtcaatcgctttgaaacgattacctttcacaaggtcaaaggccatgccaccaatcgcaacaacaatcgcgtcgatgcggccttgaatcaaaccatggaccagcttgacgatcatgtttaactattttacccctgatggccgagaaatgcttcaccataagtctcagctaagaaactatgaatcacctgctgcatgcgctgcacagaaggtgatttttttatggtcggattaatcacgagacacagcgtccgctcaaagggctcagaaaatggatacatattgacatcgccaactaacttctgcaccgctagtttcggcaaaatgcccatccccaaacctgattccaccatcgacagaatgctttggtcatcaatagaataattaattgcattgcttgacacatggtagcgatccaacgcatttttggtatctcgatcatagtcaatctgctgcaaaatgaagttctgcttatcgacatcggcctgtgtcactgtgcggccgtttttaggcttgaattgcttgggcgtgatgcagtagatgggatcctttaataacggctctaccacgacgccagggccaactggtaaggaggaaaaaccaatgtcggcagttcccagtcggaccgcttcaacaatccggttaaaagtgccttgcaccacgctaatttcaatgtgcggatagcgctttttgaagcggcggataattgttggcagccaattcgtcgaaaccgacgagaacgcaccaatgcggatgcggccggtattaaccccattaatgttgtccgcaacctgcgtcagctgctcctcgagattctggatgctttgaataatcggcagcacctgcgccccatcttcagttagcgccacccccgttcgattacgaatcaagagtgggaaacccagttctgtttccagctgactgacactatgactcacggcactcggcgttacattcagctctgccgccgctttcgctaatgtgccgcgctctacaaccttgctaaaaacttcataagaaaagttagccatttgcccctccttgatgtgacaccaactgtcacttcgttgtgataaatccttttagactaggaataacagctgttcgttccttttaaggtgaataaaattcatcataaactgaaatagttgagctttactcaatcatacaagtcgttttacactagtgtcaataagaaaacgttggtacttcaccaaagcatcaacgtcataaagacgtcggcacccgttttaatcgcaaacgtcaaagggggattcatcatgaaattcgcaacacgtactcaaaaaactggtcattcaggtttagaagatctatttgctgcttctggtccaaatgtcatttcatttgccggtggttatccagatcgcgatttattcccgacaaaacaacttaatcaggcatttagtcaaaactttacaagtggcgatagggaattgcttcaatatgccagcacagaaggttacgaaccattgcgtgccaagattgcagctcgtctgcagacgactgggatgcaggtcgacgccgatgacatcatgatgacccaaggcgctcaacaaggcatcgatctagtggcgcggttaatgttggatccaggcgacggtttggttgttgaagccccaacttacttaggtgcacttgctgcttttaacgcctatcaacccacctattacgaagtaccgatgcaagctgatggcatggacatcaatgctttacaacgcattctaatgagtcgcaaagtcaagttcatctacaccgttcctgattttcaaaatcctactggggttgtgatgtccttggccaagcggcaggcaattattcgcctcgccaaccagtatgatgtcatgattttggaagataatccgtatcgcgaccttcgttatactggcaaagccttgccgacgatcaagtcacttgacacagaaggacgcgtcatctatcttggcagttttagtaaaattctttctccaagtctgcgcatgggctggttggtcgctgcgcccaatcttttaaaagagttgctggccttaaaaggcggcagtgatctggaatccagcaatctggtaatgcacgggatcaatacctatatggaaaataacgatcttgatgcacatatcagggaaattcaggattgctatcgtgagaaaaagaatgccatggtggcggcgatgaagcgctatctgccagaagaagcgcacttcactaatcctgacggcggcttctttatctggctcaccatgccagccggcttcgatatgggcgcgttcatgaaagaacacctattaccggaagccaatatctcctatgtgccatcaaccaatctatatgcgacagcggctttgtccaacggtgcccggttgaacttcactggtcctagtctggcgcaaattgataccggcatgaaagctttgggtgcagcattaaaggttgccctgcaacacaatctggttgccgaacaagcctaggctaaaacgcgttcaaaaaaactcggttaaccttaacaaaatgacaacgtaacgatcacattttcgtcacactttgccggtagtattaacagcatagaagtgagccacccactcattcctaaaccccaacctaattttcatttttctcctccaaagaaaaatcggtgattggcccccatccgatcacccaataacaaaaacgcccgctgcgatggtagcgggcatttttgtgttttgaagacaaaaaatcgccgcacactttctcaaagtgtaaacggcgattaatcaaacatccatcagttgcttaaactaaccgatcaaccccaaagctggcagggtcatctttcttgtcggctttcttttcagtatcagtggtcgttgtcttttcggtctttttatcagcagatgcctgatcgtctttcttatcatcctgcttctcatcggtttcttcaggcttctttggcgcaacttgttcacgaatcttttcttcgatttccttagaaatttccggatgttcatccaagtagtgagatgcgttgacaagtccttggcccaaacgttccttgccatagttataccaagagccagacttggtgatgacgtcaatgtcattgtctttatcggttgccaagttaatcatatcggtattgtgttcaatcccgtgaccaaatgacatcgtggtttcaaccgatttaaacggcggtgcgaccttattcttagtgactttcagtttgctagcgaagccgacaacatctttgccgtctttcacctgctgcccacgcttgacttcaatccgcacagacgcatagaatttcaaggcacggccgcccggtgtcacttctgggttgccaaacatcacgccaactttttcacgcaattggttaatgaaaataaccagcgtattggtattgttgatcgaaccggccatcttccgcagtgcctgcgacatcagccgggcttgcaagcccacatgactatccccgatggcaccttcaatttcagccttgggaaccaaggctgcgacagagtcaatgacaacaatatcaacagccgctgattcaatcagcatttcagcaatttcaagcccctgttccccagagtttggctgagacaacagtaagtcgtcaatatttacgccaagttccgccgcatacttcgggtccatcgcattttcggcgtcaatgtaagccgccttgccgcctgatttctgcaattcggcaatagtctgcaacgcaatcgttgttttcccggtactttcaggaccatagacttcaacgattcggccacgtggtaacccgccgacaccgagtgcaagatccaaggataaaatgcctgttgagacgacatcaaccttcagttctggtcgatcgcccatcttcatgacggcaccttcaccaaaggctttcttgatcttctgaagggctttttctagttcggtatcgcgatctgtagcatcggatttagtattatcattctttgcggtcgttttcttagccatacttgtctccttaaatgcgctcactggcgcaaaagtctgtgtgtaagcaccttggtcacaatagctcaaccagaccacttatatcccagtctttaaccatgccagtgcacgctttgtcttataaaaatgcgccagcagttccaaaaacctgtgcacgctattttaaacatatacatccgagtgtcaatttacgctgtctccattatcgaacatgcgtttgttttttgcaagcttttacgttaaaaaagtcatccccaaaaattgtttgcaggtgactgctttattttacctgatactgacacctttttggtaaaaatgacgcgttatttatggcacacaagcatggtatgatgaggcgattggcttgatactacaaaaatatgtaaacgaggaaaatgaaatgatgttcatgggttctattgtcaatgggttgacgattatcggtggcgggctcttaggcttgattctccacagtattagcgatcatgctaaagatactgtcaccaaaagtcttgggcttggtaccttcgcattgggcattcaaatggccttgcagacaaaaagttttattgttatggtcatcagcctttgccttggcggcttgatcggtgagtggttgcatattgaagatggcatgaaccacctcggtttgatgttggaacagcgctttgcccgcggcaatcagcattttgcggaagggttcgtgaccgccaccctgattgctgtcatcggtgccatgggtattttaggcgcgattcaggcgggcgtttctggagacaataccacgctatatactaaatccgtcatggacgggttcatggcgattatgctgaccgcgtcactcggggttggcgtgatcttttccgcgttgccagtgatcatttatcaaggcacaatcacactcttcgccagttttttagtccaattcgtgcccaaggcattgatgacgaacgcactccgcgaaattggtgcagtcggcggcttaatgatcttggggattgggttaaacttgatgggcattaccaaaattcgtatttctaatctgctgcctggcttgctagtccttgttgcgatcctaactggtcagtattttctatgattaatgattgaaccatttaggaggaggctattggcagatcataaactgaccggtttgaacggttgtggtgataaatcagagcagatttttaccaaaaaaacgaccccctgcttcactggcatgggtcgtttttttggtaaaagtgccgattatgattcagaaattcggaatgagccgctgcttttggcgatggaaacgatagtaaaccagtttgcaatgccaatcacgcacgacacccagcaagtgcgaattggcatcataataccagtagcgcagatcatcttttaggtactgctgattcaaccatgcatgatcgtgccgcaagaaagtataactttcaagcatgtcctgctctcgccaaacatcaggtaataagaattggctacgggtaaaccgttttaaaaaccgatctgaataataaacccgctcaatgcgcccgacaaacaatgccgtctcacctttacccacatatggcgccatgggcacaacaatcaaaccaccgcgtaaacgttcaaaccagtctgtttgctgactgacgttaatggcacgtgtgacatccttgggtaaccgaaaatccaatactaaaccattcgggcgtcgaacccgagcaacgatgtgtcgttttttcatataaagttcccccaaaacaagtgagcgcgagccagcgtgggtgaaaccggagtgtaagcggccttgggcgtgatggtcgcactttgaccattgcgaccaaggtccttacacgcaggttgcagcgctggtgagcgcgttataacttggcctataggcgacttgtactaatggcaaaagtttaacactaaatgacctcatctgcattgaaaacgcttgtttcgacaaagtttttttaaacagttctgtctgtaaagcattgttctacgctcttttttaaatgtgaacaatgtcgccacaaaacgataaccaattgttggatttgtcttcacatttcgttcacacccggccggtagtataggaaacatagaaatgagccacccactcattcctacaaaccccaacccaactttttcatttttactcctccaaagtagcaatcgtcgatcgtcccccaaacgatcgcaacaaaagggccgcccacccagcggtcctttttgctgcacccgatcacaagcaacgtgaaaaattctcaatcaaaaatggcctcctgaccgaacgtgtcagaaagccattttggttaattaacgattaaatagatcatacagtgcatctggtgtctgtgctgcttggaaactcttgacgaagtcttcgtgcgtcagcaactttgctgtattggacaagtacttcagatgactgccgctgtcatgttctgggatcaagaaggagatcacggcattgacaggcttaccgtcaaaggttttccactcaacaggttgcgccaagtgcaagatcaacatagccgatcgtttgatggtttcatcttgagcatgcggaatggcgatccctttttccatccctgttgatccttcctcttcacgcgctacgtacttcttgaaaatggcgtctgcgtcggtggcaagtccatccttgaccgccatgtcagctagataatgcaaaacatcatctcgcgtcttagcaggtacgttgacctcaataaattctttgttgagaatttcgccaggatcaaaactttgatcatcatcggtggttggtgcaggttgattgcgagcatcgtcgacagctattggggcagcagcgacatcgtcatcggcagcttcggttgctaacgccgcttcaacaacaccggtttttacaccacgttttctagccgaccgaccagcgatcatggcaagcagaacacctgatgctgcggcgcctaccagaatccatgcaacccagagaaatggcttattgaccaacggcaacacgatgaagccgccatgtggtgcaggcacctgaatgcgtgacatgtaagtcaaaacagccgcaattgccgaaccaaccatgaatgctggaatattcattaacggattcttcgcggcgaatggaatcgcgccttctgtgatatgcgtcgagccaagaagtgcattgacataaccagcactgcgttcatcgcggttataagctttcgggttgagcagaaccgaaatcgttgttgccaacggcggggcaatgcaggccgctgatacaccagccatgaagaagtaattgccttgtgccagtagtgccgtcccggtcagataagccgctttgttaatcggtccgccaaaatcagcggcacacataacgccaacgacaatacctagaatgatcgggctggagctttcaagtccttttaaccaagccattaagcctaagttcatcgccttcattggcgtattaatcaaaaacataattgatccggcaatgaaaacgcctaataccggatatagaaaaatagcttttaacccacggaactctctgtcaggcatgaaagcaaatgccttttgcaataataagatgaccaatccggccatgtagccaccaacaatagcgcctaagaaacctgacccgttgccgccgttataagcaatcatgccgactgccatcccaacgatcaagccggaacgcttagcaacagcttcaccaatataagcagccagcactggcaccatgagtcccattgctgcaccgccgactgcattcagcatggctgcaaactgattgtattgagcgttcttgggatcggcagaataaatgccccagaagaaggaaatcgcaatcaggacaccaccggcgaccactagtggcaacatgtgtgaaacaccattcatcaaactcgtataaattttgttcccgatacttgctgaactagtttcggtcttttcaccggcttcagccgtggctttgccacctttaggcatgaacaccgccgtatcgctgcttaacgcttcttgaatcagtttagccggttcgcgaatgccagcagcaactgggacattgaccagtggcttgccagcaaagcgatcggcgtcgacatcaatatctgatgcgatgacaacccctttagcgccgctgatttcttcttgtgtcaacggatcgtccaccccggtttgtccgtgggtttcgactttaattgtcaagcccattttcttagccgcttgttccaaggcttcctgcgccatgtacgtatgagcgataccagttgcacagcctgtcgcggcgattaaatcatactttgccattacttaaccctccatcttgcgaattttgatttgtcctaacaactcatcagtatttgaaaaatcagtgatccatgcctgtcgtgccgtgtcactgccagccgcaatcgccagtttcagcgtctctgccagatcatgatgctgatacaacccggctaaaaaggttccaagcatcgtgtcgcctgcaccagccgtgtttagaacggcaattttaggagcattgccaaccagcgttacatcctgattcatgaacaaggcacctgccgcaccaagtgacactaaaatgttctgtgccccagcttccaatgcccgatggcctagcgtaatcatggtcgttaaatcagcctccccggtctggtggaaccaattcatcaactcaacatcgttcggtttcaccaacagcggcttgtaagccaatgcctcaactgcttcaggatacgcactgtcaatgatcaactggaatccatttttttggctcaatgcacccagctttaataaaaaggctggcgcgatgccttgcgcaaaactaccagacacgcataaccaatcgtctgaccccagcgtggttaattgttggtataattgagttaatgtgtccgcgctaatctgcggccccggattgaccaacttatactccgtatcggttgtcacaacccgcgcaaagacattaatccgggtaaagccagcatccttataaaaatgatttggcacaccttgttgcgttaaaaagtcggcgatgtaatcaagcgtaaatccagcaccaacgccaagcgccgtattgtccacgccacgccgtttcaaaatgcaactgacattcacccctttaccattggcttgcacatcataactgtcggttcgattaaccgtatttggcgccatctgttgggttttaataaatagatcaattgcgggatttaaagtcagggtataaatcaagttaagcgctcctttgtgtcgtttgttttgcttatccttatgttaaccgctttcagccgaaaacggttttcagtttcaggcaaatctgcgccagtactgaaaatgcttttcaggaggttaaattcatggccacactcagtcccaccgaagcgtacctttgggattacattgaaaatcatcagcaagccgtcgttaacgcatccatcacccaactcagtactgcggccaatgtctctcctgccaccgttgttcgcaccatgaagaaaaaagggtttaatggctataccgatttccgtcacgatttgctaaaacgcacaggcgatgccgcaccgttcagcattcttgaccaagttgacgaccaaatcaaaaaagtcattatgcaaaaccaagtggaagtctataatacgctggaaaatttgaaggtttctgtcattgaagactcggttcaattgctagctaaggccgaaatcgtcctgattcttgcgcgcggcttatctgaatcaattgcgtcggaagtcactttgaaattgcagctcttaggtaaatacgccgagttttttagtgatccgaatatcattcaaacgattgccggtcaggtcagcccgaaggcagtcgccattactatcacgttgaatggcgaaactccagagcttgttgctgcggcaaagactttggcggcgcgcgacattccgcaaatcattttgacaaccaacgcagaagcgccaattgtccaatatgccgatgagttatttgtcgggtacaaatccaaagccgcttacttcgacaaatatgaggtggcatcacgcttgccgctgcaagttatgagccgtattttgctggatagttatgttgtgcggaaacgtgggcagaaaagttaacggtcactagcaggctttgataacttgctcgtagccacataaaaaggcaatgatcacttgaaaaaagagtgatcattgcctttttcacttcatccaaccatcaactatgcttttggtagcggccgatgtttaaatagttgtgtagcggcgaccgcttgttgccagccagcgtataaattctcgcgccgggcttctgacatctgcggttcaaaccgcttgccgatcttgaaaatctttttgagttcatccgtatcttgccagaagccaactgccaatccggccagaaaagcggcgcccattgccgtcgtttccagattggccgctcgttccaacggcttacctaaaatatcggcttggaattgcatcaagtaatcatttttagcagcaccaccgtcaacacgcaaggcggggacagcgatttgggtatccttgtacatggtatcgaccacgtcgcgcgtttgataggctagtgcctgcaaagtcgccttgatgaaatcggttttcgtcgtgccgcgtgtcagcccgaaaaccgcaccgcgggcctcagcatcccaatatggcgcccccaaacctgtgaaggccggcaccacatagacttcatcattactggttgacgcattggcggccatctcagtatctggtgactttgcaaccaaccccatttgatcacgcagccactgaatcgctgaaccggcgacaaacaccgagccttcaagtgcgtaattaattttgccgtcaatgccatacgcaatcgttgtcaacaaattgtttgcggacatggttggtttttcaccggtgttcatgacaatgaacgagccggtgccataagtattcttaaccataccgggtgccagcgccaactgaccgaaaagtgcactctgctgatcgccggccatcccggcaatcggcacagcactgccaaagaagtgataagccgccccttcgccgtatatttcggagttactgtgcacttcaggcaggattgcgcgcggaatattcagcagttgcaggatgtcgtcatcccaatccaacgtatgaatgttaaacaacatggttcgacttgcgttcgtataatcagtcacgtgaatagcgccaccagacaacttccagcttatccacgtatcgatcgtgccaaacaataactcgccattttctgcgcgctgctgggcaccgggaacatgatccaaaatccaacgaattttagtcgcagaaaaataggcatcaatcaagagaccggttttctcatgaatggcatccccatgccccgctttgcgcaactgttcagcaatgccattcgtttgccgtgactgccagacaatcgcgtgataaatcggcaaaccagtctttttatcccagaccaccgttgtttcacgttgattcgtgatcccaagtccggcaatttgactaggctgaatcccggtcgaaatgaaggtgtctgcgatcgttgacaacacggcttcccaaatttcattcgcatcatgctcaacccaaccaggttcaggaaaatattgggtaaattctttttgcgcctcacccaccatgttgccagcgtgatcaacgataactgccctcgtgctggtagttccttcgtcgattgccatcatatacttgtctgccatttccgtatccccctgctaatgactgttgccgctttcaattcagtataccggatgtagcggaggaggttaaggttcagatggtttaaaaatcccaccgcctcaagtttagccttattgcaacgattagatccggcatgctataatgaagatacaaagaggggcgctggcctcaaacagcactccctaaaaagaccgtcaccaaaacttcgtcaaaagttttggtgacggtcctgttgttgtctaagatttgaaattgacatcgttgcgacgccttgatactgcatgctataatgaagacacaaaagggagcactggccataaccggtactcccttgacaagaccgttgaagacggtcgacattcgtttaagcaatcaattaagaccgtcaaactctgtcaaaagttttagtgacggtctttttgattgtctaggattgctaccacaatcgtgatgatgagcgcaatcaatgatagtatgaaaccaccaaagaccagcatcagcatcaaggcgtcagcaacggacaactaggcacctcccttcgtatagattttgatcatcgcgcataggcgaccacctcacaatacgttggatttgccaaccgtcattcactttcttgtctcatccattatgccataccaaatagcaaaacgcttagagtcgcaaagattctaggcgttttttaattgctcgtgtcaccgtggcagcgactgcttttgaaaatatgcaatacttttccagcagtgcttacaattctggctcaatgaagccataggttgagtctgtctgcagcccccagaactcaggaagcttgtagctgatggcgtattccaaatgacttgctgcgtcaaatggcaggtaggtttgccggaactgctggataaaggtttgttgttcagggcgctcgggaaaataagcggtcacaagtgccgcatcaatggtccccgctaaattgcgctgggtgtatggcaatttgtacgggtcaaggcggctgtcatcacgaatgcgttggtacacggataaaaaagcctcagggtgactaatctgatccgtattgatataggctgcattaatattgttgaccgtgtactgaacggcttggtcaccgatcatgcgcaatcgtttgatgacaacataagcttccttgtctgccaagcgtagattttgccgcacgactgggtcctcgccaaaagcaacactcaaaaccttcgtccattctggctcggttttggccatattgagatcagtcaggtaaacaacccgacgatgactttcttttgccacaaaagtgccgcggcctttaatacgtgtaacgcgattttctgtttgtaataagttcagaactttgaccgcggtcgttgagctgacatcaaagcggcttttaagttctgcctcactgtaaaagcgatcaccttgattgagacggccttgatcaagctcgctgatcaacacatctgcaatttcttgatactttggcttggtcatgacagagactccttgttttccgtacactttcaccaaccccatttttgagttggtgaccgtttactcgtaatctatttgggcaattcgaaccacccagtcactcccataaggataacccgttgcatcaactgtgagaacctttttatctagatcatgcgcaaaactcagcacttcatcattatctagccagtgaatgcgctgaattggttgaccaatgccaacaaacgaacgcggattaaccccttcaccgccaagcaccacattatcattaccgacaacttgcaggtccaaaatacataaaaaatcatgcttcgatgtgtgcaagacaaagtcacgcgtaccatgtgccgaagttactggcacaggtcggcctttgtacaacacgggtgccgccatcgctgtccatcgtcctagtaagtgcatgtatgtttgcgctgcggcaggaatagcgcctgtccctgttagaccaatattgaccaagatgttagcgccaatatgccgcgcatgtgcgaccgtttcaatcacctcagcaggcgacttatagttaagatcgttggcagcgatgccccaatgttgatttaaggtgattgaaatttcaccagcaacatatttttcgttcggagcaccgtggtaaatctcatcaggtgtgcgtcgctcgtaagtcaccacatcaatttccggatcactcacctggccgcgattctttaagccggtattgttcacaatgatcgcgttaggttgataatgccgaatcatgccatacagttcaggcagatgccaatcagcgtcttttttgttccagttgccgtcaaaccaaaacccgccaactgggccatagttgcgacatagcacctcaaccgatttttgcagatacgttaaatacgccggaaaatcatcatcatataacggtgtgtgccaatcataggtggccatataaaagaatggtaacaggtcttcttcacgacaggccgccacgaattcggcaatcaaatctcgtcttgctggcgcatgcatgatatcaaaatcgcttaatcccttcgtgtcataaagaaaaaaaccttcatgatgcttagtcgttaaaacaatatactttgcgcccatcgcctttgcggcgtgggcgattttttttgcatcaaattgttcagccgtaaaagtcttaatcaactgctcatagtcatgctgattgcgatggtgaataaattccgtccactcaccaactgccatctgagaatataggccccagtgaataaacaatcctaggccaaggtcctcataatgttgaatgcgcggtaatggttctgtcatgtcttcacctcatttgttttcttatgacacatatcctaacacattaagtagccagatttaaatttatttttatctagacccattttcggcttaaccgctttcttttgctttagtacagcattataagaatgtcccagagtgttgccgccgacaaactatcgtgctattatttgcgtgtgaagttaacttaacacattaagaaaaatggggtgatataggtgtatgtcttcgcaagtcatggcgattatgctgccgcaacactcgcaagttgtgagctaatcgctggcaaattatccaatttcgccacggtcacatttcatgatccaatggggttggctgatctcatcgcggcctatgaagcactgttcgcgaaagaaaccgacccagccaattttcaaattatcaccgatattccaaatggatcacctgccaatgccgccttacagttcaagcacaagcatccaggtgttcgcgtcttctccgggttgtcgctcggcttggcattggcgttagcaactggtacgcccattgccgaagcgcttaaggagtcgcaggctattgctaaagaactctttctcaaaggtgagtctcaagctgaggcgccggcagacacggctgtgacatcaactgaaaaagcatttgttcctgcacctgaaaacacaaacactggcgatccattgatcaacgtccgggtggatgcccgcctaatccacggacaagtcgccaccatgtggacacgcatgctgaatgccacgcgcatcatggtcgttgacgatcagatcgtccaaagcgaagttcaaaaaatgacgctaaaaaccgctgttcccggtggcgttcatttaagtattttgacaccatcaggagctgccaaacgaattttagcaggtaactatcagggacagcgggtttttgtcatcgttcgcaatccaaaagcattacaagaaatggttgaagccggtgtcaccttgaaagccgtcaatgttggcaacatctccatggcggcaggtgccaagcaaatcgccaaaagtgtcgccgtcacgcctgataacatcgccgtttttgactatctaacaaaacacggcgttgagctatatcaccaaatggtcccgaatgatcaaaaagttgctttcaatacgctacttaaaaacaaagcgtgagctggaccgtttagaaaccggaacataagcggccagggtccttatgtgcaggtttctggtctggcgaacgcgtttaaaaaaggagagtgagttctatggcaattgcatggtggcaaattctactactgacaatgttggccttctggatgatcattgaccagatcaccgtcggcattttaacaaattatcctttactctacggttttgtatccggcatcatcatgggtgacgtcaaaactggcctagttgttggcgcaacgctgcaattgatggtgcttggtgtcggtacttacggcggcgccagtatgccagacttcatgactggggccatcattggaacagcctatgccgtcatctcaggaaaaggtatcaacttcgccattggcctcgcggtgccagttggtttattgatggtacaactggacgttcttgcccgtttcaccaacaccttcttcctacatcgcgtggaccgctacatcgaaaaaggcgacacgaagcgcgtcgcccgcaatatcgtttacggtgtcttcccatggggcctttctcgggccattccagtgttcgcaatgctcgttgtgggtaacaccgtggttcaaaaagtggtcaacgcgatgccgcaatggctatcaaaagggctaaccgcggctggcggtattctgccagttgtcgggatcgccattttattacgcttcctgccgacaaaacgatttatctcgtacttagtcattggctttctggcagcggcctatctcaaggtgccgatgctgggcgttgctttgctaggtttggcattagccatcatttattacaaacaaggcagccatcaatcaagtgatcatcatgacgatccggatacaaacaaaggaggctatgaaaatgccatcggcgaatacgaagactgatctgccagtcaaactcaccaaacatgatttatttcaggcaaactggcgctggctttggggcagtcaaatctgttggaactacgagcgaatgatgtcaaccggttacttatttacgatgttgccaacattgaaaaagctctacaaaaatgatcaggatctcatcgaaatgatgaagatgcataatcaatttttcaataccaacgcgtacgttggtggcttcatcgtcggcatggacatggccattgaagaaaaacaaggccgcaaagctgaagacaccgttgccggcttaaaagcgggcctcatgggtccttttgcaggtgttggcgatacgattgtcggcgtcatcctgccaacgattttcggttcaatcggcgcgtatatggggctgaagggcaatccaaccggtgcaatcttatggttactcgtaaatttcgccgtccttatcctccgattcttcctcctgccccttggttattcgcaaggtgaaaagctcatctacgcgacaggcgataagctgaatcgcattacggatgctgcaatcctgctgggggtcacggtcgtcggtgcgttaattccaacagtaatctccgccaatgtaccattggtcttcaaaaccggcaaagtcgtcctcaaggcacagacggttttggatcaaatcatgccgtcgctcgtaccagtagcattagtcgctttatgttactggctattaggcaaaaagagaatgaattcgacccgactgattgtgctagtgctgattcttgggatcgcacttggcgcatttggtattatcggaaagtaagtcgtcataagtatcactgtctcagttatcaaaaaggcgcaagcaacgtgtttaatatcacgatgtttacgcctttttactttccatgaaacaacttgctgcgttttttgtggtggtcgtcattgacttaagctaaagtttctttacttcccacaattttaactcgtcaatgaatttaccgactggcgatctgctcatgtaaggcaacaatctcgcccgccaaatcccggaaagtaatcgccgtcatcacatggtcctgtccatgcaccattaatagggataccggctgatgctgtccacttgcctcagcggttagcatgccggtttgtgcttggtgtgcctccgccagaaattgatcggcttctttgagtttggtttcagcttgagtaaagtcaccagctttggcagctctaattgcttcaaccgctgccccttttgcattgccgcctgccatgattaactgcatgacgacaagttgttgttgttcatccataaaagcgttcccccttaatagccttgagcgccagcactgtctcgatgtcctgcaagcaaattgttgacgccttttcgtcctgtttataccatcaaatcaagcgctgtttgtagaacatgatcgcctttcatcaggccgtaatcttgcatattaatgaccgcaactggaatcgtcagcgtctttttaaagtcgctttctaagtaacgcacttgcggcccgagcaacaacacatctgggtgctcagctgctaattgatcctgagcatcggaagctgatgcggcaaatattttaacgtgaacatctttctgttcagcagcatccaacattttcctaaccaacatactggtcgacatacctgctgcacaaacaagcatgatcgtctttttattttcagccatgatccttttcctcactttcaaatggacgcaacgttggcgccaccagtccagtcgccgccacctgactaaaccagtgacctgattttttgagtgactttgtttgattgcgtaagtcattacgaatcaaaccgtaccgattcttgtaagaattcagccatgaccagcagtcaatgccggtccacacgaagtagccatgacaattagccccttctgcgatagcctggcttaagaatcgcaggtgatcggtcataaactgaatgcgataatcgtcttggaccataccgtctttcaaaaatcgttcttcgtttgctacccctatgccattttcagccacaaaccaaggcagattgtcgtagcgacgcttaatggtcattgcaatgtcatataatgcgtctgggtatatttcccagcctttatccaaattcatttttcggcctggcatgtcgtaattgtcaaaatagatgtcaggcaaccacacttgtaagctatctggtgaaacagccggggcttgcacccggaacggatggtagtagttaaccccaagtacatcaatccggttggcagcgatcaccgccaattcgtctgaggttgcctcccataaaacgccatctcgtttgagtcgtgctaccagctcttctggaaaacgcccatgaatagctggctctaaataaagatcattcgcccactgttccgcaaatcgcgctgcagccaagtcctcaggtgcctgcgaggccggataaaccggtgtcagattaacaattgtgccaatcgttccttgcggctgccgattgatctgccgaaacgccgccacagcttgggcactagctaagttcaggttgtacgcaacttgcacagccatccgcccatcgacactattaggatagtgaaactgatataagtattggccgtcaacgatgactttaggttcattaaaggtaaaccaatgcgtcacctgatcgctatacagttcaaaacaacgcgtggcaaatttcacatagagatccaccacatgctttgactgccagccgccatattgatgttgtaacgtcactggcaagtcaaaatgatgcagattcacatacggcgtgataccaagttgatgcatagtcttaaaaactcggcgataataatcggcccctactggatccaccgtgcctgcttcaagatcgtcaatcaggcgcgtccactgaatcgagattcgtaatgcctgcacgcctgcttgcttcaacaaagcaagatcgttttcataatcgttgtagaagttagaggcaacatccggaccaacgttgtggtagaagtcttgtggccgagtatggtaatgataatcaaaaatgttttcgtgctttttatgaaaagtgccttctgcctgcggaccgctggttgccgctccccagacaaagtcagcatcaaattgaatggtcatgtcttagcctaaatgcgcttgccagacgagaagctagtctgacttgcgctcctttctatacttgatttctgatgtcagcggctgcgttgatgctgttgaaaattaactgcggcgccgtataaattggcttcagcctgaaacttggcaatgcgaacgattggccgaatgggggcaatttcgacttttgccatcacaacatcgagcgcctgattcaaatctgcaagcaagtcagaattttgggaaatgccaccgccaatgacaaaacaatctggatcaagactgtactgcaaattgaaaatggttgtcgccagcacctgtagcatgtcacgaacggctttctgggctaatggctgtccggttttggccagttcgtaaagggctttcccgtccaaatcagtgccatttgcccggttgtagcgatcagccgcgttcacaatggtaccaagatgactgaccgtgtcgccattgccgtacaacatatagccaaactcgccgcctaacagatgtcgaccacgatgaatccggccatccaaaacgaccgcaccgccaaccccagtgcctaacaccagaaaaatgacgtcacgaacatctgttgctgaaccggcctgaacttctgccagtgcggcgcaattggcatcattttcgatggtgacaggcagctggaaacgtttggtcaattcagccacaattggaaaatggtgaatatacggaaccgcactggcaccgcggatgatgccggcagtttgatccactgaaccgggactgctgatagccacaccggtaatggttgctttacgctgcaattcacgaacctgagtttgaagtgtttggtaaaacaagcccaaggtctgcggcgttttgacactggtttggtgggagatgccaggcacctcatcgtaacaaccgaatttaagggttgtgccgccaatatcaataactgctaaactcacagcgccacttccttttcttgatcacgcacgtagtccaacgccaattgacaataagtcatgtttgcccacgaaaaccacgttcgcgtgaactgtgtaggatcgtctttgtgcacgccttcatgacattggccagtaccggctgttgtggctgcaatcgtggcaagtgtggctgccttctccgttttgctttcagccactaagcctgccattgccactgcaatcggccaaacatattccagcggggtgtgctcgctaccaatgcctgccaaagcttctccttggtagtagtaaggattttgtctactcaaaataaaggttttggttgccaagtaaatcggatcgtcagctgcaatggcccccagaaaaggtaaactcaacaaacttggaacattcgcatcatccatgaaacgtgtcctgccaaggccatccacttcatacgccaaaccttgatccccgctcggcaacgtttgaatcgcatacttagcaatgcctcgctcaattgctgtcaccaaagtttgtgctcgtgcagccaaggactggtgattggccggaatcagcggcaacaagcctttcaaaaccgtttttgcaaacaaattggctggaatatggtacccatattcacaccggttatcgctcggccggaagccatcccagatgagcccagtataagcaacaggggtgccataaccgttatttggcaaagtatcgttagctgcagtgtcacgccggcggaaaaaatagggtgactgttcatgatgctgttcctgttcaaaaatatctaaaatgaccgcgaatgtttcccaaaaagtcgcatcaaacagcgctgcatcgcctgtttcagtatgcaaccgcaacgccaacagcaacggtgcacatagcgtatcaatttcgaacttgcgctcccagacttgtggtgaaaccgaaatattggtttcatcgtcatcgcgccaatgagccgcactggccgtctgattaaaggcattggcatacggatcaagctgcacgaacgccaattctcgtcgtaggacaccttcaagaatcggctttaaatcaggcacgtctttgatgagctgtacataaggcaacacttgaaaggttgcgtctcgtagccacatcgccggaatatcgccggtcgcaacaaagtaggtcccatccgcctgccgacttgtggccttcaccagcgcatccggcagtaaggtgcgaaacatttgctgagccggggcatctggtaatggatgctcatcagcaaaagcagtgagtgccgctgctaacggtcggctgtcttcagtcataacgactcctttttcgatgctaagctgatgtgtcgcggatagataccgtacgtccgaatctctcccggcttaaaggctggcagcttaaatgtggtgacatcggtggcaagcgtttgcttcgtttcatgattgagattcaattgacgaatacttgccgcaacttcaaggataaagtctcctgctgttgccacagtggcatcggtcgggttataaacgcgaactaggtagccggcatggtcaggcgtttcactgacactcgacacaaccagatcgcgactcaccagttgcacaggtgactgatgcactaggtttgtctgattagtgttgatcgggaagtattgcaaaggcgtggtgaaacgatccaacgtctgtgtttgatagccaaggctgccaattgccaacgactgaacccgtcgttgcaactccgccgggacaaaatcagcatcaaggcaaatcccgccttgcatttgccgggtccctaaaagttgactatcaagcgtcgacacatacttggtctgcaggccagaggcatcaccaggccgccgttttaagtcaggtcggccaaggtacccgacaccgcggaacatagtaacggctaactggtcaaattgatcaccaatcaactgaaattctttttcgcctaatcctaagaaggtccagctcgttttgtcatcgtgcgtattggcaaaatgaatgagcggccgcaatgccgtcggttcttcatgataaccaatggcgcgccaatctttgagatgtggatcaatcaccggacgagcggcaattccgaatggcgtatcggcaaaactcgtctgtgcttgcaccggtgtcttcagaattaaacggagtcgatgatcacaaacggtgttttcaacggtaaattcaaaatgaatcaccggatcatcagcggccaacttcaagaccaaaacatacggcatctcgacactggcctttttggctgcacgttgagctagatcacttggcaactgccattgaccacgaaagacaagttcgcttaccagttttccttgctgacccgtgacctcggcttcagccagcgtcaagtccagcagccagtcttgaaaagccggcgagtagtcataggtatcaccttcatcaccgccatcgtcaaaatgaatcgggttcacaaacgattgcttcgtgcgtcgatcaaccaacaccagctggcccttgtcgaatgtcagcgtgtaataggcgttgctaatcgttgtgctcggctgacgattcgctacgcactggctcgcttcctcaagcgtgaagcccacccaatccatcgccttcattgtcaatggcacgacaatcgttgtccgataataaacatcaggtttttcctgtgctggatcgcgccgcaaaacggcgttatcaactttcacctgttttaagatttcatacgtgacaacttcaccattttcatctttaagtgaaaaatgcttgccacgcgttgccaacgtgatctcaccattttgatgaacgggccgcaccgttggattccagaaaaagacatttagcgatgccggtgctccgctagccagtttgcgtaaaagataatcgcggactgattctgccagttgtagcgcctcaacactgcgttggtaaatatcttgattcgtcgcatctgaattgcagccgcctgatgaatcatgtgcttgaccacgggcgatggcacgccagatatgagccaccatcccatcttgcgcttcgatgccttgatgagccgcaatcaccatcatcggttcaaccacatcgaccatcaaatgctcaagccgatcgtacaaatgctttaaatctgctcgcgatgaataaatgccgcgatgaattttcgatgctgacggatcaatgaactcgccttgataggttggcaaatcagaacttgttgataaagctttgaaaaaatccggataattgtcttccaccaattcaaagtcggatgtctgctgattggcgtactgaagtcgatccttcaagttaaagtcgaccgcgcgttgatcaccacccactggcagcgctaagtcatgtgcttgcgtatctgtggcaatacggtgcagcaaagccgccgcatcatcgttttcaattaggtcaacgcctgcatagtagccattcttgatattagccgctagaacttttgaaccatcactagccgtccagtagaagtaacgggcattcttttcatgcggcatcccgcgccaaaagacagtggcggtaatgtcaaaaccttgataaatcttcggcatatcctgtccttgaccaaatgagtcaggtagatagccaactttcatgatgccgcccaagtcagccgctaatttgtggccaagctgcaaattgcgaacgatggcttcaccactcgttaccatctcgtcaatttgagtgtaccaagggccaatgaaaagccgccgtgctttgacaaagcgcatcatggctgctcgtttatccgggtttgtctgcagataatcgtcgacaatcgccaattgcccatctaaaaggtaactatccagctgattatcggcgagtgcctgtaagacttctgccatgtgataggcaaattgaacccgtgcttgctggcgcgtgaaataccattcgaaatcccaatgtgtatgggcaataacatgaactttctgcatcaaataaacttctttctattctttatcgctcgttaagtttgcaactcattaagctgctgccatttgtcgctcgttgcgttgattcataatgacaaacggtgcgtaaaggaaaacatcaaagatcactaataccaaggccagaatgacgggactcatatgcaagccgccaagaatccaggtactaaagaagatcggttcattacccgagttaagtaccaccagcggcacaacccaaccgattgacgtcactacataagccacaatggcattaaacagtggtacgacaatccaaggaatgaacatgatcggattcaaaacaattggcagtccgaagatcaccggttcattaataccgaagcaacctggcaccagcgccaattttgcaacttcgcgctccttttcgccttttttagcgaaaatcaacatggcaatgatgaggccaaaggtagcaccggaaccgccaatcatggcgtacacattcgtcatggtgttaggcgcgatcgaaatatcggcaaaacttttggtttcagcaaacttagcaacattttgtaagaatagcggtaaccagaaggccgatacgatcccccaaacaatgttgaagccgtgcaagccaaggaaccacagaatttgttctagtaagatgacaacaatgatagctggtaatcctgtacccacggtcaacagcggcttaatcacgaccgtcgcgatcaattgaattaagcttgcataccccatcgcctgcaatccaattcgagcaagcccaaagagcaacaacacttctgccattggaattaaggcaaaaaatgaatcaaaaacattttgcgggacgctgccgggcattttgatcgtgaatttggaatggctaaatgccgcgaaaagggcaacagccaacattccgacaatcaagccggtaaacatcccttcataactaaaaagtgatgacgcgaagccttcaatcaccttcgccttaggatcggcaaagttcacattgttgggtaccatcacaaaatatgcagagaaggctaacaacgtggcgataataatgttcatactcttgttttcatcgcgctgttttaattcaactgcgtaggaataggcgcttgagatcacgacaatcaaaccaacgatgccaagggttgcgacgcctaaataaccgaataaattgctaatacttgtcaaccaaccccagtaaagattttgagacttaatcaaggcatccaactgcatcttgattaagttagaaaaagacccaatcactgtaaacggaatcgttcgaacaaaggcgttcttgaccgcctgtaaaatcgtgttgttttgaacccacattgatgctttaagcaacggttcttgaagcttatcaacattgaacttcatcattaaccacccctaagtagattttgttgtgacaacgcgctgtgatattgtcagtttaaaggcgctttcattttttgtaaagacttatttttatcttgtgtatacaaattttgagaaatagaaaaatgttaatatacaaatatttagatatttaacgggatgacctaccaaatatctggcttgtgttacaattagtgaacaaataatccagctgaggtgacatcgttgtatctatattgggaaatctattccgacatcaaaaaagacatcctgacaaatcattatcgcgcaggcaaaccgctgccaactcaggaagttctcgccagaacctaccatacaagtcgtttgaccatcaaaaaagcccttcgtatgttgcaagatgaagggctaatctataccaaacaaggatcaggcagctttgtgcgcgcccaagcaccagacgacgacaaggaattgttgccgcttgatgcaccaattggcgtgacttattcgcatcgtgatcaaaaaatcaccagcaagctgctttattttgacgcccgcttaccaagcgcaactgagcaaaaaaatcttggcattaaaagtaatgaacctgtctacgatatcaaacgggttcgcctcgtgaacgggcatttttacagtctagaacacaccaccatgccgaccaacatcgcgccgctcgacaagaaaatcttgaagggctcgatttatgattaccttggcagtaagggcgttcagttaactgatgcccgacgcatcttgtatgccaccgaagctgatgaagaaacagccgaggcactccaaatcaaacaaggcagtccagtgctggttatcgagcagaccgcctatgatcaagaaggtcacgcatttgaatactcggtttcaagcttcatccgcgaccactcgcgattcgttttgaatatccatcgccgcttgccggatttaccgcattagtttggggctgtgcgaattcattgaagctgtgattactgacagccaagatgaggaaaacggtccctctgtacgcaaagggccagactaacgtttctcttgccgtgccaaactccgcaatctccggccagctggggcttgcgacgcgaagctagagcggagacggcgcttcgagcccaaagcccggtctcgaagtcgcctaacaacatcagcgacaagcccagtcgctgtgttgtttgcacggctgagccccatctggcctacgattgctccgccttggcactgagatctttaattaccgacaacgggtttctagacaacggggatctatgagtaaacaaaagatggacgaattttcctcgtgcaaggaaaatgcccatcttttttaccagttttaactttttcaattctgctactttgtttaaactcagcttttcaacccggctaggctttcaaaggttccttcaacatgccatcagttgttttaccgcaggactgatagctttctaacaatcccagtttcatgaagaccgtctgttgataagcaatcttcgcattccattcaacggtttccagaatttctgtggcatgatgcaagtcttcggaagtgatcaaaacaccatggctgtttaagaggaagatgtgctcttttgccgcatctccgacttccttcaggccattgtagaccgtgtctgcaagttccttggagcaggctggtgcgtatggcagtacccgaatcggaccaacttcttcagtaacttcggtgacatttggcatatccaatccagctgttgcccagaacatggattcttcagcatgggaatgatagacacaacggatcttgtcgttggcccgataagcttcttcatgcatgttgatttcacgggtcagacgaccaacgccgtcaatcagtttgccggtttcaagatcaaccaccaagatttgagttggttgcagcttggcataccaggcttcagacatcatggttggcgtcataatcagataatctttgccagctttaatatgaatatccccgtaatcaaaatccttgtcaggggtgatccgaacgctaatgttgccacctgcaacattggtattcttccgcatgaacatttcgcgggccacttcggctaaatctttccgctcattttcaaagacatattgttcggtcattttgaaattccttccttatttgtccgacgcgccaataactcttcccgttttttttcaatcttttccttgcgtttgcggtcataatcgccaaacaaaattggattgactttgacgtaaaggatcacggtggcaattcccatcaagagacataaccatgtgttaccgcctagcaaagcaattgatatcccaatcgtatctaggaaaaccaagaatgatgctaaggttttactcacctttatcaccgcgtttcttatcatgactggtctgactgaaatccagtccgctaatgtcattcaaatcaacatcatcagctgtatcattttgcttatctttggtagccttctttgattcgttcgacgctttcgcatcgctgaagtccaaaccgctgagatcgctcagatcaacatcggtagcatcattgctggttgaagccggtgctgttggcgcagctgcggccgtgaccggcactagtgcaccgtaacgttgactcggtaacttgatcttgatttgatcgcggtacaaccagatgaacccgagtgtccaaagcaccgccagcgcgattgcccaccactgaccattgaaagcttgcgcgaagagcaagcggaagtccggcccttcaaatgtggaccatgaaagttgctgaccagcctgaactttaacagtgccggttgatttggccaggttcgtgataactggcgcaaagtacgtggcaccatataagaagatcggcgtagtaatgatgcccaatgtgatcatccgcaacaggtttgccccagtcagtaacaacgcagcgttaacaaaggacaagttgatgatgccagcgaatggcaagacggtgttgtgcggcaagatcatggcgaagaccaacatgatcggcaccagaatgatcaccgtaacccacaattcgttacgtccggcaaggattggccaatcaaggccgatataaacctcacgacctttaaagtgtttctgcatgaagccgctcatcgcatcagcaattggtgataaggcggtcatgaaaagtttggagatcattgggaataaagtcatcgcagttgccgctttaatcgctaagttcaaggagccagaaacggaatacccggcaccaaagcctaatagcaccccaatcaaggcacccatgacggtattgtcaccccagacaccaattcgcttttgcaacgcatcagcgtcaaacggcttgttcataatcggaataaagtcaagcaacttattaagcggttgcaagatgaccgcgaataaggtgataaaatgcggtactgtgacacccggcatgcctgtcaaatcctcaatatgccgttgccacatatcacctgctttcagttcgaaaacaatttgaatcccggcaactaagaatccgaagaaggcattgtgcgtaaagtacaaaacaacgacgtaagtgaaaatcttgttccaaacgttccacatatcaacgttcagggttttggtccagttgaacgtcaacatcacgaagttaatagctaataataacgggaaaaataggaacgcggacttgtacgaccaagtgatggcagcaaccccggtccagccggcatcaatcgcattcaggctcaaatggaagagcttggacatggattttgccgctggtgaaatagcctccatcatgtagttaacgaccaaggtcatgccggagaaagcaacccccaaggtcaaagcggccacaattgattttttgaacttcaacccggcaaccagacccagaatcaacatgatcaatggcacgaagaccggtccacccaaattcaggatataattaacgacgtcttttaagattgtcacgattttccacctcctctagtagaatgggctgttatttcccagcagcctgcatgttcttcaatgcttgaacaatttctttgtaggatttttcaggattcatgttcatgaaaatcagcatcccattcacaacagcgatgttattttccttggccagttcctccaactgttgattcggtttagcgatccagacatacacatcatagttatgcaaaatttccggtaactgtttgaaatccgtcgcatcaaccgaaatgcctttaacgttattggtttcaaaaaaatctttgattcgactagcggttgcttcgctggaagctacaccggaaccacatgcaacaacaattttagccataatagtttgctccttattttgattggatcagttatttgttagcagcttgtgtcttgaacgtatcgacaaagaattgatacattgcttcaggatcagtcgttgccttgaacttggcgacaaacgccttgtcttgcaacagatccatgaaaacctgcaataacccgacttgttgactggcatcggtaatccccaagaaaaacatcgccgttgcatcctcaggctcgttgtaacccatttgcagtactcgaactggttgagcgtttttgacgatggccataaacggctcactcacgttctcaggatcggcatgcggcaacatgaccgagatctcaggaaaaacaaccccagtcgggaactcatcttcgcgtttgttaagggcagcttcataagtgtccttagcatacccagccgcgcgaatcttcttggcaacatctctaaacagtgtttttcgatcggcagcgttttcgttgagaaaaattaaatctttgtgaatcattgtgctatagtccatctttatatcacctcatcttttcgagtggccttagcatttggaactttttgaaccttttccttgtttccaaagctaatgataaagcgcttacagccttttgtctacgctgttaagtggaagtcatcaaggttgacaatggttcatgaaagcggttaaaatttgttcagatagattcataataattcataaactggaggtgttaactgtgtcacaaaaaccagctaagtttgaaagactaaatgacatcatcagaattttgcgtgaaacaccgcaaattagtgtggctgaactcagtcgacaaatattcacaagtaagtccaccttgcgtcgcgatttgattgagcttgaaaacactaacatcattcaacgccaatacgggatgattcagctcctgcaaggtaacaacattgaattcacctacgaaaagcgccgcaacgaaaatgcgcggctcaagcggattatcagtcatcaaattgctgacaagattcctagcaacgccgcctttttcattgacggcagttcaacttttttcagcttacctgaactgttgcacaatcaagtcggcctgcatgtgattacaaacaacgtcaacatggggctacaattcaattcactgaacaatatcgaaaccattatcattggcggtaaaatggccccacgatcggcttcgacccttggctcaacgaccatcgaggaaatccagagtttccatccggactttgcgctgctttcgaccggttccatcgatgcaggcggcatttatgttgccgatccagagcaagcagcagtcaaagaagccatgattgccaatgccaagtgtgttatcttcggcattgactcaactaagtttgatcaaagtgactacattcgcattacgaacatgaatcagattgatgaaatcatcacagataaaaagccaaatgccgcctatcaaaatctatttgaaaaaaatcatattctgctgacctatccgcatgagtatcgccaaacacctaaaaattgatttgctcatcaccataattaaaatcattttttccccagttcaaagctaagtcactcaagctgactattccaaatttcagttgcttagaaaccacgatcacgtacaaagaaggcggttcaaagcgctcccaatcgcaccagtacgcgtgattgatgagacccacgctccgggaaaataagttaactaaaagactcatttagtcgcagtatttaaaaagaacctgcccgagcaatttttactcaggtaggttctttgtcatatttgttttctagccaccagcgaaaacgtcaacggaatttgtggcagatcagccggcatctgccaaccatcctcttcctgattgaacgtcagcatcggcaatgcctgccaatcggtgatgcgctgctcccccagtgcttcaatcgttaaaccagccttcagtagcacactcgttatttcttgaaaatcatgtgcccagttgtggttgcgggtgtgttggattagccctttcgatcccgccgtgtacgaaccatctgaatcgtaagagatttcggccccgctaaaataattttgcgtgatggtaagcccgtcattatccagtgcgaacaaaagtgggtgattgtcacgtatcatgaaaatcccgcctggtgcaagtaatgccgcgattgaattagcccaatcttgcaaatctggcagccaagtaatggtacccgcactagtcacgatcacgtcaaacccctgagcttcattagccagcgcctttgcggcataacgcgcatcactttggacataagcaatatccgcgccggcttgcttggcaatgtcacgggcgtaatgtaatgaattaggcgaaaaatcaatgccatgaacatggactgcgcctaggcgccaccagctcaaagtgtcggtgccaatgtgactttgcagatgcaacagtcgctgacccttaaccgaatttgctggcaagtgcggcaagagtacttctaaatcgcgtttaactgtgccagtcacaccgtttggattgttaataaagccagcaatgtcaccataaccgccaccggcatggatgttggcgcggtcatcccaattgctgagattgtcttgaatatcgtgatttgttggcataaagttctcctttttgaggatgcaatttaaagtccgtatggtccttgtcatgatgggaatacctcagtggctgcggcttgttagtattaaaaatatctcatttgaagatgtgatgcaaaatatcaaccatgtgtgagctattttttagctgcttgtcgctttaatgccaccctatcagcaaaaaaccaactaattttgaagattacgaaccaagtccatttaaatatcgcgtgccacgtaatcgtgaattcacgctaccgactgacgcacaataacttgaaattaataattgtttatgattacatttttacgtcattttcacttgggtaatggttatgaacctttatactgaaattgacgtcaaaaacgagcgcgcgtgaactggtgcagttagaaaccggcgtataagcagacttgggcgtgatggctgcttcttcatcattgcgaccaaaggcccttacgtgatggtttctgcgccagtgaacgcatttaaggaggcattcatatgcataaaagctggtggcaagaagctgttgtttatcaagtgtacccacgcagttttcaagacagtaacaatgatggcattggtgatctaaccggggttgtcgagcacctagattacatcaaacagcttggtgttgatgttatttggctcaacccaatttataaatcgcctaatgccgataacggctatgacattgctgattacggaaaaattatggcggagtttggcacgatggcggacttcaagcatttgctaaatgaagcacatgcacgtggcttgaaagtcatgatggatttagtggttaatcatacttctgatgagcatccgtggtttcaggctgccaagcaaagtcgcaccgatcctcaccatgactggtatatttggcgcgatccagttgacggtcatgaaccgaccaactggcgggctgatttcggtggctctgcgtggacctatgtgccagaagtcggtcaatactacctgcatctttttgcgaccaagcaaccagatctcaattggacgaatcctgcagtacggaaagccgtgttcgacatgatgacatggtggtgcaagcaaggtatcgatggtttccgaatggacgtgatcaacctgatctcgaaacccgagcaattcactgatgatccttacatcgttgaacatcctaatggcagttcattgggattcattgcaaatggcccgcatgttcatgaatacctccgggaaatgaatcaaacggtgttgtcaaaatacgatctcatcacggttggtgaggcccccggtgtcacacctgttttggcagagaaatataccggctttgatcggcacgaactagagatggttttccagtttaagcatatggggctggacgatgatccacagtttggaaaatggtccttgcatcggccaaagttgaccgatcttaagcgcgtgctttccgaatggcaaaccgacctgcacggaaaggcttggaatagtttgtattgggacaatcatgaccaaccacgagccgtctcgcgttttggtgatgatcgtccagccttccgagttcgctcagcgaaaatgctcgccgcaaccttgcacatgatggaagggacgccctacatctaccaaggcgaagagctggggatgaccaatatcgatttttcctccattcacgattaccgtgaccttgatactttaaatgcctggcacgagctcgttgatcaacagcatgcactgacctctgaagacatgctgaaacgaatccatcggcgctcgcgtgacaacgcccgcacaccaatgcaatgggatgccacgcaacatgcaggtttcacaaagagtaccccttggatcaaggtcaatccaaactatcagaccatcaatgcagcggctgcattggcagatcctgattcagtctttttcttctatcaaaagctcaatcagctgcgcaagcaatacccagctctcattgtctatggtgattatgagttattggatccagacgactcagatatctttatgtatcggcgttttaccgatgatcaagagttgctcgttatcaacaacttcaccgatcaggaacaatcccgcccaattagcacgcgcttgcctaaaaacgcacggctaatgatcagtaattatgctgacgatcgtggtgacgttttgcggccttatgaaacacgcagctatcttggcgaacggcgttaaagaaccaatattcaatatctgtgacaaaaactaaagcgtcattttaacgcaaaagtataacgatggtttggattagaactcactgcaccacctaacctcaagtaacaaggccaatcgctttaggtcaccacattggcctttatgagcagtcaaattttcaccttgtatgaataacacaatgaacatttcaacgtcacaatttcgtcacacctagtctgtagtattagcaatatagaaatgagccacccactcattcctacaaaccccaacccaactttttcatttttactcctccaaagtagaaatcgccagccggcctcccaccggctggccaatacataagcaaacccgcgtatgaatgcgcgggtttttgtttggctttatttagcaataggcacaacttccctaggcggtttatatcattaagaacaggtattgtgagtttggaggggtattcgttttgaagaaaagaacatgggtgataacaatcacaggtgtcgccattttattggtgaatacatttagcgtcatactcattcagaaaaacgacgcagaacgccgattatcattagggcgctcaagagtatcaagtatatcgacatcaaaagtgaaagcgtcaaagtggcaagtctctgtttcggaagcacaaagcaccgcaaactcaaaattttatgcagataaaacgtcaaaagacgcggtagcttcatcagccattgtcgcatctgaagcaaagagtaaagcagaagccgttaatcatgttgacttcgataagttgagcaaaattgaccaagcaaaagcggctatctattacggattaggcaacatgcaatattttaacgacaaaagcgtcagtaattaccccggagacgctgtttattcgagtagcggcgttgatgtggtctttgtaaaagatatgtccgcaggcattggcagtacaccttatttagtagcgcctcatctttctcaagtaagtgctgcagcaccagtattttcatacgtcgaactaggtatgcaagcagatggtcaccgacctgaaggattgacatatggaaaagttgatgacgacgccaacggctacgttcccgatcctggactccacaataccgttggcgtctcatttaaaacggtcaacgactggattaattcacatggaggtatggccgctgttcaaaaaatcaacatcaaccgttttattgactttgaccaagagtaatgccaattttgctagcaaacaactaaattgattctcgcaaatttagtatgcaagccaaaatttaagggtaatgccaagggtgactcaaaaataaagagcaatagcttagtcctttttactagctgctcaaatctgctatttttctgtatttgaataacacaaagaccatctttgcttcacaatttcgtcacacctagcctgtagtattagcaacatagaaatgagccacccactcattcctacaaaccccaacccaactttttcatttttactcctccaaagtagaaatcgccagccggcctcccaccgactggccaatacataaaagtaaaggaccctcgccgttttatgacagcgagggtcctttattagcgaaaggcgtcaatacggtcattatcagtctatgttagtctttcgaattagctttcttttgggttgtcttgcgttggtttcccatgctaaaatgcacataaagaggcgtgctcacggtaatggactcgtccctagcagagccgtttaagacggctggcattgaataacaatcaaaaagaccgttagacttctcccagaaatctaacggtctttttgattgtcaagaattgcgcgaacaaggatcaccactgattttcgttttggttgtcttgtgctggtttttcgtgctaaaataaacacataaagaggcgcgcctgcaggtaatagacacgcccctagcagagccgtttaagacggctggcattgaataacaatcaggaaagaccgttagacttcggccagaaatctagtgacggtctttttgattgtcaagaattgcgcgaacaaggatcaccactgtgccaacgagtaacagtacaaaactgccaaacgctaacataatggttattgcatccgcaacggacaaccagacacctcccttcactggattttgtgcgtgactcataagcaccaactcctgtgattggatttgccaaccgtcattaacttctctgctgtcgctatcataccatacaattcgggtgaacgcttagagccgtaaaggttacaggcgttttttattttccggtttgagcaccttctcggacacatggacaatcaataaacattacaaataatgactatccttccacatcaccaacgaactgaggtcatgaaccgcaacagataccttggattgcctttccgataccgagataagcaaagaacccctttgtcttcctcacagcggtgccctttttacctttccgacccatttctacaagagtctatcattctggctggcaagtagttgtcgagatcaataatttttcctacttgttcgctacgtatttgcgccagccaataacgccaaagccacagacaattaacgctacgagcccaatgatcggcaaactgttcatcatcatctcgccagtttttggaaaagcctttgattgatctgtctctgaatgctgcttctttttgacgagcgtctctgacttcatcattttttcaggatcgggcttgtttagtgtaccgggtacatcgtccttcccatcaagtgcctctaacgcccttcgcaatgccgataccatgttattaaccgtgagttgatcagcaatttgattggttaataagctttgtgccttggcaagaatttgatcaaaagctgccttgttatctgaacttgccttaagatatttagccttctctttaaccgccagcgcttggtcaatgactgtctttaactcgcctttttgcacaggaatagttggcttggttgcctcaaaagctccaattgttggtctttcgaaattaattggtttccctgaaaaatcttgagtaatcggaaactttgcttgaatagctgcaggtgttagctccgccacgctgcggccagcattggcaacaggcgaacctgctatgggaataaagctgcccagcgattcaacagacatgctgcctgtattatgattgatcaggccactaggttttgctgttacatctcctaattgcggatcgacaaataagttgtcactcacatcaaccgcatcagtatgactctgatcaagtaatgcttgtgggtagaaaagattgtgatctaagttgccttctgcaaatagtggccgcttgtttccagcctgattaacaacaaatttaggggtattacctgctggtgcatagaccaagttattcacaaaacgaataccagtttggccattatttgaaaccattaaatttttcacagctttaccaacgataaaggtgttgttatgaaacaagggaaaaccagcaataccatcatttttccctgacaccacaaaaatcaggtgattgagcgcgggcgatggcaaatcgcttacatcattgacgctcaaattgtaccggaaaacattatctgtttgatggtcacccataaacaaagtgaaaccacccgaattatcatgggagtagttatattgatacacgcctttagatgcaaagccgtcaaagtcaaaagctgctccatcaagataatggttgggaatgccaaacacttcattatattgggccagattatattcaccacccataaaccacaatccagcaaagtttttgctcgcacctgattcgttcttagatccaggcatgctgttggctgcttctaccgtgttgtattccgcagtcccattctcgcttgaactgatgacaatgccatcaccggcactatttcgaatataattgttcctgaaggccgtatgtgcactcgctctaaaggaatattggtcccagcctccagggaggactgacgcattggcatcattacgtaatccttcatttgaaacatccgtaatcacgttattctcagcagtgacgtctgtattgccaacgataataatcccgccagagtttttgccagatggcaccatttttcccgtctgatctggaactggatcactttgataggcaccgtcgacatgatgaacattgttgtttctaatattaataccggtacgatgtgaggctttgaaaatcgctagcttctgttgaatagacgcagcatctgtcccacttggatatggtacattgatatccgacgctaccaaaataccaattcgcatcgcttgacgattgccatcattcgaaaaattggtcacctctatattcgagatcgtccaatgattcgcattccaaagttcaacagcccccgtcattaaattgatattacttaaattacggtgatggtatggactttgattcgcagttgttcccataccattaatgattgctttttttctgacatccccttggtgatagctgccgataacgattggctcggaagcggaaccttcaccattcttagtgccatcaagaatgagttgaccattccagataccattagcgtcaaatagaatttgatctcctggttgaaacttcgtggccatcacttttgctaatgatcgccacggatgatcaacggacatgccatcgttgttgtcattgccattgttggcaatataaaagattcgattttcagcagcgctcagtcgatttactttgccactagccgccacaaatagcccaacggacaatgccaacaaaaccagcaaaccaacgcggattgtctttgatgtcttcatcatactccccctcatagcgttatctttttaactcagcttttgttttgacaaagctgctttgtttacctgaagaacagcacgagcagcttttttggccaaagtagcatttagccttctttccaacaacttgactgctacatcttcctttaccgttgaaaaatcataataaccgccattggtaaaagtaattggtctaacaaggctcatggtttcgttagatgtccatgcaataaaaatgatgccttgctgaacgtcaccactgttagatgcacgtaagtagttaccgtagtacttatccttatcatgactcgaatcggccatcacgaatgttcctgaaaaaccttttgacgcaaaatcattttgaatggttgataaatcgctacttttgccactgacttgctgtaccaaagccgtgaatctacccagatcattgatcttttctcgttcaaaggttaatgcctggtagttaactaagttgggctttccccaatacttatccttattttgagaatagaaattttccaattgttttgaagtgattgtttgccgatatttctttgcatactgagatctgagtctcatcatcagggcgctgtgtgttttttgcgctgcagccatgccagaaagacttgctcccgtttgatcagctttcttcaaatctgtgaaagctaccaatggcttttttatcagaccagccgtcacaagcgccttgtcctcaacaatatattgtttaagtgtcctcaatgccttgtcttgtgcaaactgctgtggtgtttctgaaccatacttcgtcagccagaagtgctcgttatatgttgtgtgatacttcgtcatatagtgactcactgtactggctttttcgttctgcaagaaatattgatagaccctttgcgaaacaggaacaccggcaacttctaagaaaggcggcgtctcttttgcctggcaacctgcaagcatgaagaccaacgtcagtaatccgattagcaatttgttaacctttttcgttgtcatcacctcaactagttgtacgaacctcattatctcagcattttgcttaatccttttaacaactcgttttcactataaaagctgaaagtgcttttccactcgttgaccctttcgcttaaaaagattgaagctcccataagtctcagtcccatcaaaccaatacagcttgcggccaacaatcgtattctctgactgtaaggtcaccaaataattcacatcccgacccagatcaacccgaaatccggttgctaactggtcatcaacgatctcatcatcgttaccagaatggcgtatttggaccggcgtcaccgttatgtcaggattagccggtgaaaagactgcggcttgtgcggtaaaatctttgaatagcgtttcagattccaaacgtgtcagatgatcaagagcattgtatcgtggtgagaacaactgccggctcttccatatatttctctcagtaacagcaaggctagctacgttgcctaactgatacccttccgcttgcttagtcactgtcaggtcaggcgcaatctgccagaaacgtttaagtgtgtgatagccagggtcgctaacaacgtccagtatcagccgcaatctctcctccgcaagattgattaaataccggacaaccatcactggtgtttgctgggcgcgatcaatatacactgccttaatcagctggccggcgctaaaatcaatcacctgattcgtaacaggtgtggcagcatactgatacttccatgagtcctttggcaaactgaaaggcttgtgatctagcatcacagtgttatgtgcttcaacggatttcagataacggcgttcggtgccatcaacgtacgtatatcggccgccatcgacaagcacgtcatgcccgtccatcaccaaatcaaggtgccccaaggccgcatgaccatgaccgctgccaagattgccattgaataagtgccaataatcagcgttttcaccccagtctgagcgccaaaagtaattgccgctgatcggtgcggcatattgcttagtaagttcggcttttttggctgctggttgccacgcttgatgcgccagttctaataaaacaaagtcgaaaactggttctaatcgatcttgcaactgtgctggctgacttaagatagcggcggagctgttgaacaagctgtcaatccgaatggcatcggtatcaccttgctgtagcaatgtcagatcgggtttgacatattgcgccatcatccgctgcatggcacgggttttttgtaaaatattcggggccaccgtctgcttggctcgttgctgagcagcaatgaccgccaacgaactgcgccaaacttctaacaaatatagcggcgattgttcccactgcatgccttgcgtgtccacttgaagatccagttctacctcaaatcgctgttgcgcccaggtaaccgtgtcgcgatcaacgacgtcagggaatcttgccgcatatgttaaaatacctgacgtgattaagatgccccagttactgatatcaaacttttctgtgtagttttggcggagatagtcagcctgaaccttcaccgcatcatgaacagaaaccgactccgatgcatttaattgctcactttccaccagattggcgacaacggatgtccaatttaataatcgaatgcctgtgtcaattgttcgccatgtttcgggtaacgccaaattctgatcgatccaagaaaaaagaagggctttcatttttgtttgatatttaacttgaccagtcgtatagaaagcttccaaaagatccaaaaggtactcttgacgttttaacatgtacagccattcaggatcgccattaggcgtctcctgccatttaattggatccatagtatagctgatttgggtgggttccatcgcataaggactatcgaacaaaaaagtattatctaatagccgatctgcattcgtctttgcgtctttagtgagatgttgttgctgcgctagttgctgaatgtaccttgcccaactttgctttgtcatgccctgacacctccttcaccaccccagcaattcccatccgcttaaccgttatcactgtcttttcagcgatttcaacctgaacatcttcttgattcaagctttgtatgttacctaagatgccatcaatcaggacaatttgatcgcctatttgtaaattagcgtgcatctgatcaacagcatcagcttgtttttgcatggcatgacgttttgccagaggaatggcaaccaaataaagcaggcaaacaaggacgaccatgatagctaaaataatttgccagaaggtcatcagataccatccccttcatcttgatgtgtcatatccggaaccggcgccgttgctgaatttgtgttcatcctgtcgggcagaatctcaatcagttgtttcgaaagcgtcaaggtgtgctgcagctcaccttcaatcgtgtcatcttcaaacccagtcaagcttttggcatacaaatctaacatcaaattgagtggtgcacttgagatcacatattgatgtggctgattgccttcgagaaccaaacgcgacacaatctgatgcggcgcaccaccagtcatgtcggcaaaaactaaaacccgttcatgctcactgagcaactcggttaattgtttttcgaatttttcatgcgttgtttgttcatctaagttaaatgccttgatcccttcagttgtaccgatcagtaactggagggcagacaagacaccatccggatagcggccatgacccacgatcactatttcgtaattcataaatgttgactccttttttagttattcggtcgtcaataaaatgttgatatttcttgtttttacctactcctgaaaacagccgtctacacattatgtgacggctgtttggtatgagcatttcacttcaagatgcctaaaacggagagcaggacaccggcaacaaatagcagaatgacaattttataaatcgtccacttcttctttgtgatcagccaataaacaaaatacgtcagagcaattggcaacataaacggcatgattttgtcgagaatcgtttgaacggccacaacctgtgttttccctttgataacttgggagtattgccatgccaaattcacttttacaaaggacacagacaagccagcaataacggttagccccaacatgctcgcaacatcagcaatggcagccatccgatcagatagtgtatcaatgatgctcgtgccgactttccagccgaggtagcccattagcatgcgaacgccgaaagtaataccaaacagacacaagataaacggaattggcgcccaagtcatgccctgcaatgcaagtgacgcaaagattgagctgaataacggtgccagtccaaactgcgacaaggcatctccaatcccagctaacggtcccatcaacgcgaacttgatcgcgcggacgtcgtcttcatcttgaccactgtcatacatggccaacataatactgctcacaaatggataaggttgcggattggtattgtaaaattctaagttagacgttgttacccgtttaaattcagcttcatcatttttatagatctttcgcagttgtggcatgatgctattggccatcccagttccttgcatcgtgccgtaattttgtccattttgcagaacataagatcgcaaaatggagtttaagtaatcttttttggttaaaactggcttccgactagatgccatcttcaatacccccttcatccccgtcactaccaagatcatttgtgctggtactgccgcctttgttcttgtctgcccgccgaccattatagtaattgttgaaagccagaacggcacccgcgaaggctaaaccaataaccggcatcttgagataagccacacagacatacccaagaatcaaggccggaatatattccttcttagccattgtgctcataatcagcgcaaacccgacagcaggaagcaacccacccgcaaccgttaaaccgctaattagccattgtggaattgcctgaacaaaaactttcaaagcacttgtacttaaggtagccgcaaagccaaaacagaaggcaaacaagatgaaccctaataatgttgtgtttgccaaaaagtggaatttacgatactttccctcttcaattgcttttcttgaccacgccaggttgttggcgttgaccgagaaaataaacgtaatcacaaatggaatcaaaattgcaaatggatatgatagcgataacgccgcagctggtttaagtccgctgattgagatcgccatgattgtaccaaccacacctggtcccaatggattaggtggtgtagaaccaccgggaccgacgccgaatcccataaatgccaattcggcagtggctccaaaaacaacagctgtttgcaagtcacctaggatcaatccgatgccaaatgagataaataatgcccgattagtataaatgccccattgctggccggcaaaacaaaaagccgcccacaggcctaccaaaagcgcctgaacgatagaatatgtcatgctctttcctccctaaacgtaaacgcgttcgcaggcgcaggaacctgcacataataaggacccccaagcctaaatggccaaagcccagccttttaggcttggggccacttatgctccggtttctaaccgcgcctgctcacgctcttcaaatatcagtgtgtcgcaacataatcatttaaatcgaaatccgagccaacatcattgccaagcggtgttgtgcgggtgttcaaatttgcgtgatatttttcatgcaatgttcttaaagcattgagatcatccgcatcaactgaaataaaattcgttaagcgcgtcttaccatctttcatatggatattacccacatttagggccttaatcggcacaccgccttcagccagcttcaaagcatcttgcggggttttaacaatgatgaaaattgtttgccgcggcgctgctttgaaaatcttatcaatcgtttccgccagtgagaagaaacgaatgcccactgattctggcatcagtgaagccatcaattgttgttgaatatgactcttcgcaacctcgtcatttgcaacaatgacaaggttcacaccaagattcgaaatccataaacgcccttgtccatgaatgagccgctcgtctaagcgaactgccttaatgtttggttctgccatcaacatttccctccataacgcgctattcagtctataaactgactggcttgcgctctgtctaaacgcgttcacctgcccaaaaaccggattggttcacgctcaccaatataattgccaatctttataaaatctgatcaatgcttccatgtaaaaatagtctccccagagattgccttcatcaacaccatggttggaatgccaagagtaaacgccgtggcgtaataacggttcaacggcctgaccgtccatgggcatcgcatatttttgaatcaacgactttaactgagcatgcatggccacttgataaacagatttatcaggatcagcttctggcaaatacttcaacatttcgtgcataccgcacaccgcgatcgccgccgatgaagtgtcacgactttgaccgctgcctgcttgaaaaatgagatcccaataaggtacatgatcaggtggcaatcgattcaagaaaaagtgggtgaccgctttgaacgtctgaaaagcgccagcatcatgtgtatcgtaataatgcaacgcggtgccataaatcgcccatgcctgtcctcgtgcccaagccgaatcatccgaatatccctgacgtgtcgcaccgcgaacaggttcgcctaagtcattgaagaaatatgtgtgaaaagttgaaccgtctggccgaaaaacagtctgtaaagcggtttcataatgtcggtcagcgatttgctgatattgatgattacccgtgactcgagttgcccaataaagtaatggaatattgagcaaggcatcaacaatcaaccgattttcgtctttagcgcctttttgtccccacgcctgaataaaaccgcctttatcattaaatcgcgtcaataattgatcggccgctttgatacccgcttctttagctagttggctccctgtcaattgataggcacttacaacggatggcgagtataagaagcctaggtcatggtgatcaacagcgattcgctggtcaattcggtttgcaaaactttgaacatttttctctgcaagcgcacgatattggtccttacctgtatattcgtaagctagccaaagcatccccgtccaaaagccattcgtccattccgtgtttggcatagcggcatagcgctcttggactgtggaaggctccggaaagctttcacctaacacctttatgttcaagtcgaggtgccgaacaacgttatctaaagcgttagtgaccgcatgaatgtcaactgcgccggcattaaagaaacgctgtgcattggttaaaggttcaattttcaatttgctatctcctcgacgagctcacaaccatacgcttctatttcgatcaacgccggaaacggtgaatcatcatccgctttgatcaaatccgccaactgaagctcgctgatctcttctttgttaatatcgaacatttgccgttgatctgttttagtaaagtgaagcagcatttgactgccgtctgagagtcgcaaggtgccttgtgtccaataactatcgtgaggaaaatccgcgcgtaatgtgatcgctaaacgcgttagcttgatcggacgcccaaatgtgagcgtgaaccttgccgttgggtcttgattgatcccccaagactgatacggaaattttccatgatgatcattgagccgataaccgtcaatggcattacgcgcggcaaaagttgggtcatgccttgtttcgatattggcacttgcatgtgggtaagcaccgaaatgtacagcctgatcgtgactattaaacgccacattgcgttcttctgatacttcgctcgcatctggcttccagatgcgaatgagatgtgttttaccggcaaaagctgtttctggatagatactttcgtgctccggatgggtcacggcaagctcgtcagttggaatgacataatgccatgttgactgggtaaaataaagcaagctgggcaccaatgcggcatcgacttggacccagaagaaaccaggcagaagctgacgctcaaactcaacttgcacataatcaccctctgcatagacatgatccaagtgcagataaccgtcagactcaccgtttcgacttgtatcaatcacttgatccgacgccgaaagcaacgcaatttccaaaatagcccctcctttatttctttataggaaaccctgtttctttttgtttactagtgtatcttaacgtgcattattttccctgtcaacaaaaaagtaaacgtattcacaaggcgattatccataatgtcggattagtattgatttttttgctgattgtgactaaaatgatcagtagtttccaaataataaactcttacaactggagggatacgcatgggcaccacaacaaatgagtcaaaaccttatgggaccgtgctgatcaaggctaaagatattttagatttcctacttgccactactgatccaccaaccttatctgacattagtcgcggactgcatgcttcgaaaccgaccattttaaagatcttaggaacacttgaatcgcttggctttgtttggcgggataccacgacaaaacaatattttctaggcacgcagtttgtgccatatgctcagaaagcaattgccacttttaatattgtcagagtcgcacgtccttacctcgaagatttgcgagataagacgcaagaaaccattaacttagggattgtccgcgataataagatgatccttgttgaaaaattggaaagccccaccagcatcaagttgcaatcaactattggtggaagcatgaacatgtactcgtctgcaatggggaaagccgttctagccacgtatgatgccaaggaactacaggcttacttcaagtctcacaaactcacgcccatgacaccgcatacgatcactacacccacaaaacttcagcaagatctaaaaacgattcaagagctcggtgtcgcgatcgataatgaggaaaacgaggaagaagtttattgtctcggtgctgcactacaaaaaaacggtgaactttatggtgccttcagcattagcacaccgaagtatcggcttcccaaggaacgtcgagctgcctttgtccgattgctgttggacacacgccacgcaattgaaaataccctttaactttcaagatactttttgaaattgtttaccttacgcaatcaaaacaaacaggccccagaaagacgtttcctcgtctctctgaggcctgtttagtttgttcaatttctcctgattttttgttgaatcgattcttttcgttttggacactcacataaaaaatttgctttagtggcttgtgttctttttgaaaacgttttatattgatgaggtagcagaaaaggaaactgtgtttctatataagaaatcacggaggggattattttgactttccacatggcaacacgatatgcgcacagtcccgaagacattaaacactttgatacaactaaattgcgccaagaatttttgatggagaagatttttaacgcgggtgatatcctgctcacctatacctataacgaccgaatgatctttgggggtgtggtccctactgaatcttcgctggaaatcaaattatcgaaagagctaggggttgatttctttctgcaacgccgtgaacttggggttattaatattggtggcccgggatctattatcgttgatggcgataaagcagcaatggtgaagcaggatggttattacattggcatgggaaccaagcaggttgtctttgcatcagacaatcctgccaacccagcaaaattctatgttgtatccacgccggcccacaaaacttatcctaacaaaaagctgccatttgcaaatgcgctggccaagccaatgggtgatcaacaacatctgaataagcggacgatctacaaatatattgacgcgtcacaaatggctacctgtcagctgcaaatgggctataccgttctcgaacccggctcatcttggaataccatgccagcccatacacatgcacgacgaatggaaacttatatgtattttgactttgccgaaccagacacccgtgtcttgcatctcttaggtgaaccaacggaaacccgacatatcgcattattcaacgagcaagccgtcgttaaccctagctggtcaattcattgcggtgttggcacgaccaactatgctttcatctgggcaatgtgtggcgaaaaccaaacctatgatgacatggatcaagtacccatgaatgaattacgttagcaacagataaccctatcaaaaaggagcaatacacatggctgaaattcatcaaactgaagaagaaatccggaaacacgagcaagaactggatcatttcaaaatgtcacaatttaatctcgcgggcaaggttgcgattgtcactggcggtaacactggtttaggccaaggttacgctgttgctatggcggaagctggcgctgatatctttatcccaacctttggcaaggccgagtgggacaacacgcggcgtttaattgaaaagcgtgggcgtaaagtcgcattcatggacgtcaatctcaccgcgccaggaagtgcagaagcagttgttgcagaagccatcaagcagatgggccatattgatatcttagtgaacaatgcggggatgattcgccgcaatccactacttgaatccaaagataaagattgggatcaagtgattgcgattaatttaagcagcgtctatcacttgtccttagcagtttcaaaggaatatgccaaacaacgatctggcaagatcatcaacatcggctccatgctctctttccaaggtggcaaatttattccttcttatgccgcaagcaaacacggcgtcgcaggtttaacgaaggcttttgcttcagaaatgggtgcgtataatgtccaaatcaatgcgattgctccaggctacattaaaacggaaaacaccgcaccgattcgcgcggacaaagcgcgtaacgatgaaattttggaacgaattccagctcgtcattgggcagaaccttacgaactaatgggcattgccgttttcttagcgagtgatgcttcaaactatatcaatggcgctattattccagttgacggtggttatttggttagctgaattcgttttgaaccattttttcggttaagtgtattgacttcgattatgacgtatcgtcctgcttgaagctcttttgcgaaaaaaccatcctctggaaagaagaattcatcatgcaaaaatatgattttttgaatcggttaattgccactggctgtgttgccgttgttcgcggtgataacacccaaaccgccattaagacttgtgatgccgttattgctggcgggattaccggcattgaactaacttttacggtgccgcatgccaatgaagcgcttgagaccttaaccgaaaaatacgccggtcgtcaagatgtcgtcatcggtgcaggaaccgttcttgaccctgctactgcccgacttgccatcatcgctggtgccaagtttattgtgagtcccagttttaattctgacgttgcaaaaatatgtaacctttacgctattccatatacccctggcgttttcaccccaaccgaaattcaaagtgcccttgaagtaggcgtcgatcttgtcaaaatttttcctggcagtgtcgccgggatcaatatggtgaaagctttacacggcccattcccgaacttagccatgatgccaaccggtggcgtttcattagcaaacatcactgactggtttgaagccggcgtgatgctggtgggtgccggttcgaatctcgtagatggcgccagtcaaggcgactacgaaaaagtaaccgtcaccgcacaacaatatcgcgccaaaattgcccaaattaaggatacaaggagatgatggcatgccaacagtactgacactcggcgaaatgatgctgcgattaaagcccaccaatcaacaacgaatcctccaaacatcagcattcgcggctgattatggtggcgcagaggccaatgttgctgcgtcgctggctttacttggtgatcaagtacaatatttaaccaaactccccgaaaattcactgggacacaccgcccgcaacacgattcgcggcctgggtgttgatacccagaaaatcctttggggtggtcctcgactgggcatctatttttttgaaaaaggtgcaagtgtacggaatacaaatgttgtctatgatcgcgcgggcagttcttttgccacgatgaaagcagacgaatttgactggccggttttgctaaacgatatcaactatttttatttttccggcattaccccagccatcgggtcagaacaacaagcggccgtttttgctgcctgccagtattgttccgatcacaacatcacggttatttgtgacatgaactttcgtgaaaaaatgtggtcccctgaagcagcccaagcattcttcaaaactgtcatgccatttattgatgtctgcattgctaacgatgaggactttgaagcaaccttgggcatcaaggcgtttgatgggaatatggcaaccggcattgaccaacttgcggattttaaagaaggtatgctcgaagttacccgacgctggccaaatgtccacacagtcgccagtgtcgttcgtaacattcattccgtcgaagaaagtcaatggaccgctctcctggttcaaaatgataaagtctaccaaggtcctacgtttgatatgcatatttttgagggcgttgcggctggcgatgcgtttggcgccggattagtccacgctctcattcatcattttgaaccacaacggaccattaactacgccatttcagcgagtgtcctaaagctgacaattggcggtgatctcaacttggtgacaaatgctgaagttgaggccagcatgaagactaatagcggagtcaatcgatagtgttttgcagtcattaaagaccggttagatttctggcggaagtctaccggtctttttcgatgcctaacgcccgccctcaagcacattgccgatcagcaagccctacaaatacttactgccttcccggatcgccaacggactgagcgcatggacagctatgaatgttcgcacccaatctgggtcaaacttactatactgccgcaaagaccacccgatggccttctgaatgaaaaattcattcgtatccaaatcagccaagatagccttgctaagcagcgccgtatccatcgtttctttttctagcagttgtaaattaatcccgatacgccgtaaccaaaaattcggttgatcgaaaaacaaattaaagacagccagtttctgatcagggtgcagcttcacatagtccgcaaaaaccttacgccaagcatccactgtatcccaccaacttttctgcacaacaagttgtcgaaaaacctgcatatccgaaaattgccagcgtttgatgtgataaagtgccaaatcaattgccacatattggtattcccgggcatcgcgttgatacaacgcatcaatccaaactcgaatcgttggtaagtcctcaccacgactggctttaagcaacggtttcgtctgtgctttgcgttccggtgttttgagtcctaaaaatggaaattgatgcttcatatacttcgccatttgcggcgcttgcgttggatcgccgcttagttcaaaatctaaagactgcatatgttttctccaaccatctacaaaaagtacgatgccctcaccaacgagaacatcgtactttttgaatgctatccacgatgtgcgtccaaaatctctgggccatgtgttgtgccaaccaccacggttttgaccaaatctaaaaacaagccgtgctccacaataccgacctgcttattcagccattcagccagcagatgcgggtgctcgattttgcccagatgcaagtcaatgatatagttcttggaatctgtcaacgccttgctcccatcttcatttaagcggtatgccggtttaagtccttcgtcggccaaccgttgcaacagcttgccgctgccaaaagggatcacttcaagcggcagtggaaatttgccaagggtatcgaccaacttggtttcatccacgatccagatgttgcgggccgagttgatagcaacgatcttttcgattaagtgcgaccggccgccacccttgatgccctgaaagtgcttgtcgacttcatcggcaccatcaatcgtcaaatcaatctggccaacctcgtccagtgctttcattgggatgcccagcgattctgcttgtttacgcgtacgaacactggtggcgacaccggtgagattgagatgctcgtctttgattcgttgcgcaatcgcttcgaccaaataaaccactgtcgaacctgtccccaaaccaattgtcataccgtcttcaacaaactcagctgctctttgcgcggcttcctgcttcaacttattctggtccatggccaaccatccttttcgcttagttgccttcattataatatgaatcggtcgacagatggcgagttgtgtagaaaaagccaaattaatagatctgcaagtttggccacgtggcatcctgcttgttggccgcacgcctttacccaaaaggtacaaaagatcacgttggttgatacaaactcgtataaacaaacgatgccgtcgcgttcttgacgccattgacgaccaatggatactcggccaactgatatctctgggtgttcacaacatcgacttgctggccaatgccggaagtgtttttagccgtaattcgataatggcccgcagcaatattggtttcgagtttataaacagtagcggctggtttcagcttgtacactttgccagtacttagacttgtcagcgttaccttcatgccagcggcttggtgaatttgaactgatatgtaatttgatgcaccgttcaaactgatttcttcggacatcactgtatttggtgcaattagttgcggctttgcatgatattgcgtggagagttgggaacgttgcgccgccacaacgatcgtattcggatagtccttcgctaacaaccccgaaaacgtgctcagcccaagaatagcggccaaagcaaatccaactgccaaccgattgcgcgtccgtttaggaatgacaacacgtttgcgcgccgtattaggcaaagcacctagggcaaaaagaacaagcggcacgatcgcctggccgtacctttcttcagtttcccataacaaggtatggaaggcgagatatccaagtgcggtgacaatcgccagcagtcctatcaaggcagtttcatcacgtaaatctggccgccatgccagcaaccgaatgattaacgtcaaccaaagcacaatcgtgacaacttgataactcacagccgtaactgctctcagaaattgtgaatgctgatcgtaccaagtcggcgccgattgaaatccgccattgtaccagtcttggatggatctgacattaagtagaatccctattttgacaagccaaagcttcattaatccaaagacgccgagcttcttaactcgagtttgaatcgtttgaatgtcgtattgctcaactgcctgtttatcttttaaggtaatcgctttttcaatatccttggtgctatacatcccgtcagagtttgtattcacgcccattagcatccaagacgtaaccggcagttcatacgcagcatttggatggaaattagccgcagtatgaatcgcctgtgtcgttggcacgctcaggccgaaaccagcaacaatcaaaagaaaaggcacagtcaacttagtagttctaagaagttttcgatgccacaggatcacaacgatgatgaaaagtgctggcaagagaacaatcaaatttggttttagcaattgaccgactaagacaagcatcgtcaagccgatgccagcacaaattcgttgcagattactcttgattcgccatcgccataagatccgaaaaatcatgagtaaaatgagcatagaaggcagatcggaataaaagacctgtaaatagtaagtgtacgcgaagggacttaagactaggaatgtaaagccgcctaacacgatgctattgcgctcgctcaattgtttcaaagttactaaggtcatgatgataaatgtatctaacaaagtgatggtcaatatatgactcgcagcgttcgttgacatccccaccaagctcgtcaacctgaaccaaagcgagagcaagtaggtcagcgaaacattgttgggataacgccagaagtaagtcgtgttccaaatgttgtggcctgccgccatttgatcagcctgtgacaaaattcggtacggatcatggtaaatcgtgtctggcagaaagatcagaatcaaaacttgccccacgagcatcagggttaagccaattccgatcattatcctcatttgcctagcattcaatcgattaaccaacggacctaagttgtgtgcagctgcgaaagtaacgacactgatgagcaggacaacggcaccccacaaaacagcaccagatttcattaaattgccgcaaatgccgataatcagacaaattgctaggaaaactgccatccatgaatgtttagccatttttgtcatttttatcacttctaatctaagcgggtttgaatcgtataccgcggtcgtcctttgacttcagtcatcattttaccaatatactcgccgatgacgcccagactcatcatctgcaaaccgcctagaaaccataaggaaaccatcaatgatgaccacccatgaacggtcaatccaaggactttcacgatgattgagtaaactgacatgccaaaagccagcatcacagcaagtgtcccaagcagaagaattaaccgcactggcgcaatggtgagtgaggtaatgccgtcccaagcgaaagcaagcatttttttaagcggatacttcgactccccggcgagccgcggggtgcgtttataatagacttttactgtttgaaagccaagcttcgggatcaatccgcgaatgaacatgtttcgctcaggataagtgagtaacgtctgcaccgctcgtttggacattagacgaaagtcagcatgattgggtaccatctgaacacctagtagtctgagcagtttgtaatagccttgtgctgtcgtacgtttaaaccagctatcagtttcacgatgggtgcgcacaccatagacaatatctgcaccggcactgtatgcctgaaccatctccatgatcttctcaggatcatcttgcaagtcagcatcaatggtaatggtcatgtttgtggtcttaatcgcttccgtcaacccagcgatgagtgcagcttgatgcccaaaattgcgtgaaaaacgtaatccgcggatttttgagtgctgcttatggaaactttcaatgattgaccaagtgttgtccgatgatccgtcatccacaatcagtatatctgaatcttcggaaaggaaattttgggtaaccacatctcgttcaattgaccataatctcggcacagtgtcttttagcacttcttgttcattataggctggtatcacaattgttaacttttgcatgctacttatcctccctttgcggacgaaatgctgaacgttgtgctgcctttttgacaatcaaagcatcaatgtatcttgcttgcggcaacataacgaaccaaagaccatttgcgagtaacaagctgccaagaatatcagaagcaaaatgatcgcgcagataaatccgactggtagcgaccatgccaatccagatcatactgagtaagattgccacaaattgattttcttgttctttaatttttggcagcatcagcattaacagactcagcatcagtaccattgagcacatgacgtgaccgcttgggaaactaaaacctgtgtcggcaacaagttgatgtatcggtcgcggacgttgaaccagcaacttaattagtaagagaaggcctgatccaagtaattgacacgcaccaatccagatactgtcggatcgtcttcccttgacccatagatagccgcagatcgcggcggtcaaactgatcacaacaggcgggctgcccaacagcgctactacttcaaagatacgggtatccatttgagtatcatatttgatgatgccctgaacactgcgatccagctcaccgacccacgctacctgcatcacaacagaccaagttagcaaggcaaacagcagcaataatccaccgccccaaaaatagtcttttttaatgttcatctgcagtcatcccccgttttcgtatggctatcacgatcatcgggaacaaggaaatgccgataattgcaagcatgatgagttcaaaatgtgctttaatgaatggcacatttccaaacaggtaccccgcgccagtggccagtgtcacccagctaaagccgccaagaatgttgtaaatggcaaaatctcgataatgcatttttccgatcccagctgtgaaagggacaaaggttcgcacgatcggtatcaatcggcctaagaaaatcgcaatatgaccgtactttttgaagaatgtttgactgcgttgaagatacgctggtttcataactcgtttaaacttttggctggtggtcaagtaagcgccaaaatgttcgccaatttcaaaattcaaggcatcgctgatgactgcagcgccagtcaaaagtccgactaacaacccgtagttaatggcgccattacctaacgccgctagcgagccacaaaggaaaagtagcgagtcgccgggtaagaatgggaatatgacaacgccagtctcgataaagataacgccaaacaaaatgacgtcaatccaattaccggtgtgggctattaatgacggtatcagctgattaagattggtgataaagcttgtgagtaaaagcaatgccatttgaaatgccccctttggttggtgtttgctaacagcatctagcttaatcgtctaatcggttcatcactacctagacaaaataaatcatttctaaattttttttagttttctccatgctattgccgagaatagcgacatctttccttaattttttgacgcaaatcgttttgccaatcacgcaaaaacgccatctttttgcagatggcgtttcagctttcattcaattgatgccgttccttcgttcttgccagcggcaggataagttcggcaatcgttccatgaggttgattgtctcgcaacttgattctgccattgttgatcgtggcgagctggttagcaatagcgagcccaaggccagttccggaaaccgtgccccggacgttagcactacgataaaagcgctcaaagacatggcttttgtcttctgcactaatccccgcgccttgatcaagtactgccaatacagcattgccatcatcatcgcgcgtcaaattcaccgcaatgattgtatcagccggtgaatatttagcagcattcgtgacaaagttatccaaaatctgctcaatagccgactcattactttctacagacatattaggcgtcacgtgtacctcaatggtttgagaaaaagcactggccaatttttcagctaagtgttgaaccgtttcgctcaggtttaacaaatgcgtatcaagcgttaacctgtcagcgcgtgatagctgcagcaattcttcaatcagctgttgcatctgtctggattcttcagtgatatagttgaccgatttgagcacaatttcaggatgcgcccgcccatgccgctcaatcagttgcgcgtgactgcgaatcgtcgcaatcggtgtccgcagttcgtgggccgcgttcatgataaacaacttttgctgttcttgccgatcatgcagttgtttcaaaaggtcattgaagtcctttgccagatcagtaacctccgtcggtttatctggcacaggcaacatcaccacaccagtctttgcgtgctccgctgcatgcttggtgctttgcgacaggtcactcaatggaccggtcaggcgatgtgccagtcgtcgaataaagatcggactgacgactaaggcaagtaccaaaacgatcatcgtgacaaccaaaactctgatcaggactgccagataactgttcatgctctgccagatctcataacggatacctttagcatgaacctcttggtagtagaacaatccttgattcgcttgatagcgcaactgcgtcaaaaacggaaatgatttcgccaattgaacttttttagtcgcaggcgagtaataatttttcaccttcgcatcttggcgcatattatgaacatgaacataagttgagctcgtatctaacgtgctgtttttgcgccaattttcccagtcatcatcaccgtcaatcacagtctgcttgaggcttgcagcaatatgatctgttgacaataccacttgctcataaagctgatggccaactgccgccacgataagcagacctagcgcaagagtcagcgtggccaccatactgactaacgaccgctgcatgatcgcagcacttgattgattctgctttctctttttcaatcaatcatcgcctcactaaatggatgcaacattagccgagagcatatagccgacgccgcgaacagtatgaatgagtttcttgctacctgaatgatcatcaattttatgacgtaagtttctgatatagacatccaatatattaggttgaccgtcaaaatcggttccccagacggcagcaagcaagtcatccctcgaacaagcttcgtcctgatgggcaacaagttcgacaagcaactcatattcccgctgtgtcaatggcataatcacttcaccgcgctgaacgcgtttgtgatccgtatccaccagcagatcatcgacttgaaaaatagtcgctggtgagacagcctgccgattgtgacgcaaggcgacttcgacacgagcaaccagttcttccatttcaaaaggcttggtgatgtaatcatcggccccgccagtcagtccagccaccttgtcgccgatgtagtcacgagccgtcaacataataataggcacttggctggattgtctgattttccgcaaaacactaaacccgtctagtttaggcagcatccaatccaaaataatgacattgattttaccttcattgttcttaaacagcgtcaatgcctccgcgccgtcttttgcccaaataactgacatattctctaactcgaactctgttgttaatgaatctgccaatgcagcttcgtcttccactagaagcaatgttgatttcaactgatttcctcctaacgcggtcatttgaattataagcgcaagtacaggagaattgacactgctttttctataaccaaaaactaccatcaattttgcttttggttcatagtttttctagcagccttagagaaggtgccacagcgaagagagcacgaatttacgataaaacgtgcactcgcaaaaggaccgtcaatcccttatcctgaaagaagttgacggctcttagtctgcgttaaagtgtcgaaaaatgtttttgtaaagaactcctcaaaatcaccaagccctaaatttcgctcactgcgctctcactaatcaagtgcacctcatgttcatcatgcttcaactcaggccaatattcccgattggcctcgatgagatcatccaagactttcttcgccacttgggcgcttggtaaggttttggataaggtcaaggcttgccacagttcttgataatcatgattaatccacgcatcgacgactagtttttcgaccatggcttgattgaggatcatcccccgttgaaacatcgggatcttgccttgcgtcagcggctcggcaccgtctttaccaacgatgcacggtacttcgaccataatgtcgtcgtcgatattggccaccgcaccgttattttccacgattagcaacatgcgttcatgcgtgttgaaggcaatggcacaggcaagatcgacgatgaaagaggcgtggctgtcgatcgggaaggagccaacgtcactggtaccggcatcgataattttctgggcggcactgaagacgcgcttttcacggccatcttcgacttcattggcgcgcgtatagtcaggatcagagtgagccaccacgtaatccggatagagataatactttagatacgtgttcggtagataatgcggatcaactgccaacaaatcctgcgcctttttgtgtgttgcttgccagctggcatccatgtgctgggtgtcgacttcgatctgggtcaagtagccatgatgagccacataatcccgaatctgcggcaaatattcatgaccagccttatccttaacacttgtccaccagccaaaatgattcatcccaaagtaacggacttccagatctttgggctgcaagccgatgatctgtgacatccgccgctgcgtaccaaccggcatgtcgcaaatattgagaatcttagcatcaggccgtaatcgccgacatgcctccgcaacgatagatgctgggttggagtagttgagcatccagcagtctggcgaatacttttccataaaatcaatcagttcgataatatcgccaatactgcgcatgccgtaagcaataccgccagggccgcaagtttcttgaccgaccacgtgatgttttagtggaatcttttcatcttgctcacgcatcttatagccgccggaacgaatgtgggcaaaacagaaatcaacatcagtgaaggcggtctgcggatcagtggtccaagtgaagtcaatcgctggagccttttcttttagctcaatagcaattgcctcagcaatcgtcgcctgtcgcgcttcgtcgatatcataaagtttcaatgctcgcagtggaaaacgttccgcattttccagtagcatcatcacgatccctgctgtgtacgtactgccgccacctgcaatgacaatggaaaattgtctgttctgattcattatattgtccccctaaacgcgctcactgccacagaaacctgcgtgtaaggaccttgaccgcaatggcccaagcccggccatcacggtcaaggcacttacacttcgatttctaaacgggctggttcacgctctttctactcaacttctgccgaatcaaagcctaatgcttcatccaccgccgcgcgaactttcgtaacggcaaggccataaacaacatgcacgttattgccttttttgatgacaccactcgcgccggtttcattttttaagactgtttcgtttaccaattccggattcttcaaaacagttcttaagcgtgtgtagcagttcgtgacactttcaaaattgtcggcaccgcctagcgcctcaataatcgttgccaccggtacttccgtcgcacctttaggaacactgaccggcggagcttgtttcttttcttgatactcggctttgctgtaaagcttagtctcttctgcatcagcttcacggccaatcgttttcaaattgaacctgccgattaagaatctgaaggtgaagtaatagataaagaagaacatgatgccgacaacgatatacattggccaatgggttttaccgacccccagcggcacattgtagagcagaaaatcgaggaagccattcggaccaatcgcccgaacgttcagaaggttcaaaaccaccatgcttaacccgcttaacgctgcatgaacaacaaacagcaatggtgcgatgaacatgaaggaaaattcaatcggttccgtgacccctgctaaaaaggaagtcacaacggctggaatcaaaatagccttcactttgttcttgttttcagattttgccatttgatacattgccaagcaagcaccgatcagaccaaacatttttgagatgcctcgcgcgtcccagataaccgaacgtgacaacagatgaatattggggttagccatttcggcgtagtagatgttccgtgcgccttcaaaaatgtgcccgccgatttcttcaaccccaccaagcgaggtatacaggaatggcgtatagataaggtgatgtaaaccagttggaatgagtaaccgctcaagcgacccatacaggaagaggccaaaattgccggtttgattaatcacgtgccccagactggaaatcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcg

SEQ ID NO: 13 - DNA, 18222 bp, Lactobacillus paracasei
ggtattccaaggacggacagtgtaggatcgtattgggacatttactcataacctcgcttgcttttggtttcgacgctaacaagcatagcatggacactgagtaggtgtctttttgcgttatccaaaaagggcctacacgttcagtgttgattatttctcaacaccagaaagtgtagaccccttttttgctgggaaagcacaaaggaagagcaccaacggcaatcagattgccgttggtgctcttttctttttgtctaggttgctccggttagacgcaccactagctgtccggcaaagaaacgcctgtcagggtctttattccaaaacgccaaatttataaccattgtcacgataatactgaatgatccgcggcaacgttttaaccgtcagatccttaccaagggcatcatgcattaagacaactcgcacgttactggccggataaacattcagggaacgtagatggtattgcagcatcgcatcctcagtcttcggctcctgcgccggactaagtgcatcgccgactgccgcatcccaatcaatccaatcgagaccaagccgactaagcgcgacatctgcggcagccaagcccttccagctaaaatgaccacccggatatcgccaaatatgactgcgaaaatccgatcccaaaacctgttggacagcggcttgggcactcttcgcttcattctcgattactgccgtggctcccacccgactaggataaagcaaactataatcgtgcgtcatgctatgtaatccaattgcatgcccagcatcatattccgccttaagaaccggcgctgtctctagactaacctgcttgccaacgacgaaaaaagtcccatgaacgccagcctgactgagaatatctaaaaccttaggcgaattaaccgtattcggaccatcatcgaaagttaaaaataccaccttctctttaattggacttgtatacggtgcatccatctcttgtttgacttgggcaactggataagcatattgattggcctcagcaatatgattttggcccacctgtgccgctttcgactgcgcctcttccctagaagcctccgctgctgcccgtcgccgagatgacacagccgcaacatgccgctttgatgccttcctcgccgcgtgccgccgcgaagaagccacagccgcctcatgctcactcaccgacttcgcgtgcgtcttgcttgctgccatggccgctgcgtgtcggtctgcgtatagcttaactgaaaagatggcgattacgattaggaaaacgcctaatgtaacagcccaccattgccacctgaatttgctcttcatcaaataacctcattcgttgtttcatacacatgcagtattaaaagtaacataaatgtacctcaaaacgatattctttttaactcggtgaattgtgctcatcagacacataccgcgcgtacggctatccagtgccagacaaacgccacagcccgccatcgattatgccaattttttgcaaaaaaagaaaggttacccaatgaggtttacctttctatcgattgctattattcactacagggtcggtaatcactgtttgccgcggccatcacaggcaattgccgcgtcttcatcaaccggtaaaatgatacttcactttaagtccttctgattcatcaaataatttgacttcaaataatactcgatatcatcataagttttaatggccttttcggttttctttgccggttttgtcgtcaaggcaccattaatcatataatggttcttcgtgccaaagacgggtacttgttgttcaagcttctgcagtacttgcataaactgagatccttgccaccccgcatgggtaaaaatctcaggtagcatatacataggactcattgtcgggcctgtgccgctgaaatcggtagtcaatattttttttgcagcttgattagaccaaatgacatacggcgtgttgtagtagttctcatacccttcgtgggtcgattgtttcaagttaatccccaacatcttgtacgttgagttcttgtcgcctccccaagggttatggtcaccccaaaaagctaagaccactggttcatcaagctgatccaactcatttttaagttctagcaaagcatccgaggtttccttaatgcccgtcaaatagttgttaataatcgcatagtccttcttgttataaccctttttccaaggaagtagcgcctgaccatcaaacactgtgtcgtaaggtccatgattttggatcgtgactgtttgattgaaaaattgtttaccattggcattcacctgttttaattgttttacaaggtctttaaaaaccaaggtatcaggcacgacgtcagcatcactaacatgttgatcatagtagttgtctctaaacagagttttctggaaacccaagtaccgatcaatattttgccgattataaaaccatgcatcacctggatgcatgaatcgcgtgatatagttttgctcattgaaataatggacaaaagagttagtcatgccattaatcggactcatatcggaaaagccagttaaaaccttacgctcggtatcaattgtaccgccaccaaaaatcgtagttgttaattgtcctgccatcccttcagaagcaacctcatgcaaacctgcatagacagaaggatcaatatctaaatcagaccactttgaaaagtcctgaaaagcctcaagctgaacggtgatgatattaatacgtttgtcagcgggaatactttgatattgatatttatttaaagcttccttagcattgtcagcactgtagttatctggtggcactaaccaatcattcttgactgaatgaataaacgcaaacatgtaaccattcacaacgtaacgatcagcatcaggtccccaagggtcatcattagctaaaacatagtgatcgtcaacgagatagtaacgactaaggccatatgctgacccaagcaataaaagaaagaccatgactaaccgaacgttcaatcgtgctgataccggtttcaaaagaagggtgataatgaccgttaataacaacaaactgccaattacaaataaatatttggctggcgggacataactataccgtgcacccatattacttgcctcagatgccaaggaaatgtcagcaaagtcaaatgggtaatcacggtactgcaacataaaataattcaccattgcgacaatgattgccggaatctggccgacaaaaacggctaacatcattcggttaaaaagtgcataggcgatcagcatgatgacaaaaatcggcatgaaattgagtaaaagtaacgttggactcgtgaaaaccatcttggtcagtttcaaatcatacgctgctgatgacatgtaaatcgttgcaacgccagtaataatggccagcacagccagcacaacaatatttcttgtgactaacccacactggtgccaacgatactgtctaaaactggtaaagaatttacgattagcatagatttttgtaacaggttgtaactgtgtacctcgaacaatttgtcggtaaaaatgcggggatacaacaagggaatcagtccgcaaataagttatcttttcagcaagtgggcgcgccgctggtaaaggataaccttgctcatctaaatctaagccaatatgcctcccccctgatagtagccagtccaaaagcttgtcgggtatcggggccacaatccatgtgtcagacttgaccttgtgatgagatttttttacgagtcgctggccaagtcgtcgccatctcgattcattgattggttgtttgaataaccattgccagtatctagcttgaaaggtcgttatatcaatacgtttgaacctaaacaacagccaagcatagcccattggaaagatgatccaaatttgccaaggtctataccgcaaataaaacagtagaagcgtagcattaaaattttgccgattaaatcgagtatcaatatcaatcacttacattgcctcccaaacggtgccatgaccatcccccaatggacatttttcgtacagccaaaaattattaatttaatgctcaaaatattgaatacttttaagcatatcatgatcccttgtcaaacaaaaccgttaactgcttaactgtcatattagttaaaaaaaataaaacaagcgggctgcttacctggcttcactgtaaaaacagccggtctcccagatcgagaggccggccgttattttcgtgagcattaagcttcacaggtagtgtgctctgtcgtcaaactttaaaaagccatttggtatggaataaaggttttgtatgctccactaatcaagaaaatcaagacaaagatcactgcacaaaccccgaccatcgacaacgtccgcgtcttttttggcataatcgagaagacgattgttggcaagacaatagtctctgttgttgtcgcgatagttgacagacggccaccaatcgtcgacagttgcgacaatgacaataatgtcaacgtggcaaataagtatacaaccatcaaaaacttgaacttttccgatccaccaatcaaggcattcgaaaccataccacggtttaaaatgtaaaagcctgtgatgcaaatcataacctgcatcaacgttaccggatcaaacaaacctgaagataaataattagcattagtcacatatggtgcatatcgaggcaaggtatggacaatgatcacgcttagaatcttcggtgccacaaacccgacagctgcaccaaaaactaaaaagcctagtacccatttaaaattaattcttctaaaaagcagccaaaatggatagatcagcaaaaagaacaacgcggaaacgtggattgtggccgatagaccaacgatcaccaagaatggtaacggcttctcatcatagacaaattttaacgctaacatgcatgtcacacatacaagcgatgcgcgaatttgccccatatcgcgcataaagaaaaaacgactcaagtaatacgcgatcggaatgatagctggacgaaaatattccttggcaaagaaataaaaaagtgtcagcgtgacaaccgcccatgccaagagaaaaagccaaaacggtgcgtgaatccaattaaacaaatttcgtaaaaatagaaaccctggctcaacctgtcctgccgaatagtcaccagcgtatattgtcttgtaagggagaaaatcgttacccgtttcataccgcaacccggctacgagcgcgagtatgatgacacctaaccaagcccagatcgatgacatggtcacacgcccgagtaacatgaagatcatcataattgcaaagagccctagataaaaaaccacgacatcattctcctattacccgtcatgagacgactcctaaaaatcgtcatcaaagtaaatctcatctaatttgatgcttacgcttgatttaaaaccgtaccgacaagttccgcattcaagtcgcgaacttgcgcaattgtttgtttaaccaaccgtttcgaaggaccatctgctttggcaacgacaatcacacccgatgccagttccgcaatcaatcctgcttcgctcgcatcagccatggccggtccatcaatcacaatgatgtcaaatttggtcttaacttgttgcagaaattccttgaatgctgcacttgctaagagctgtgccggatccgccaaagattcgccagcaacggcaacggccagtcggttgattttggtatcaacgactagcttgtcgacatcaacactctcgagagccacgtcaactaacgatgctagcccatcttgggcctttagatcaaataccgacgccaagatcgggcgatggagattaccttcaaccagaagcgtccgtttaccttcagttgcgaagctcgctgctaaattagctgcaacatacgacttgccctcccccgacgttgccgacgtcattaacaagacaggaacgtcatcgcggctcacttgcaaggcaatattatttcttaaagtgcggaactcttgtcccgaaaccgattcatcactaataaattgatgcgtatttgcgtttgtcatggaaaactcctcttaatttgttcaacaaaaccaaatcaaaccacattagcgggcagattagagtttcttaagtgtaataaccccaagaacaggtgcattagcgatttgccccaatgtttcttttgtcttaattgtagcctttttgatttctctaaggacaatccaagcaagaccaattaagaatcctacaacagcaccaagaacaatgatgaacatcggtttagtacttgttgctgccgaactgggtgttgcctgtgccagaattgtcactgtgtcattgtgattggtaatagcagagatagtcttttgaaaagcagcggccatttcgttagcaatcagtgccgcatccttgctgtgtttagcggtcgcatgaatcgaaaaagcacgggaattatcttcattgtcaactttaacttgcttttgcaaatcaccactgctgatgttcaggttgtcctttttcaatagttgggctgaggcttcatcaaagacagcagatgttttaaacaaggacttgctggttgccaacaattcagaatcatactgattttgattcaacatctgattgactgattcagtattatttttctgctgatttacaacagtgagtgccgtcgaagaataagctggtttcatgactccatatgcaaaaccggctgccacagcagcacccaacaataatgtgcagagagcgagccaccagctcctacgaagtgataccatcaattctttcatgctcagtaagttttccatgattcctccatcattaacacgatttcttaaattcacaaacagtgtccgactcagcagaccctatcgtcaaaacaacattgcaatgtgtctaatgtaccacaatatttccagagatcagccagctcaagaattaaagacatctgccttacaaacctttctcaagttatcttctcggttgatcggtcgcttagaattttcttagcgaccatccgcgtttttatgataccgcaaagaatgcggaagtcatacgtttgagccggatttaaagaaatttgcaaaagttttcccccaagcaatggtgccatttttgatggaagagaacaatgaactgtgaatcatcttgtaataataagatggccaacgccaattgttatacacaccttgaaccaagatcggaaagaacaagagaaaatacatattgccgtctgtcagttcaagcccgagccaaagtcccaacagattggtgcctgcagaaatcaggaacgctttggtatatggaatgatgtttgcgttcgcaatataggatgcgtgcacagaatgctgctgatagaggaaatagtacaaaagcagcggcaagaagacctgaagtgtcggcacagatgcaggcttgatcaacttcaacagtgggaaaatgaccagcaatgtccccacaaccgcaatgacgaacaaccaaacataggcggcaaccgctttagaggtcttgtccctaatggaatcaaagtcttgtttgacaaagtttgactgcaagatcggattataagccccattgatagccgatgccgcggtgccaatagcagaagcgaactgaacacccactgaatagacgccggtcactgataatggcaagaaagcaccggccatcagggacatgccttgtgacgtcacataattagacatgctaaccagcccatcacgccaagtattaggccagataaacaaaaacacatcttttatttctttccaattcattggcgatttcaaggcgtcccggtgcgcacgaacttcttcgtcttgccaataaaagtgattacaaattgtccggaaaatgatgccgtacatcaccaaaccaataaccgaagctagaattgaaggatagagcagaaaaccgccaaaagttagcagaatttgtaatgaacgtgaaaacacttgtgctttattgacagaatcaatcttgcctgacccacggagcaacgctgaaaaatagccaaaatagaggttcaaaaacaacgagaaacagaatacaagccaagtccacttatattcagccgcgggcaatttgctaaaaacaaaggcgttcatataaatggtcccgaaaataccgaccaaaataactgccaccagcgccaaaatcatgtaaatggcgcgcgccgcgtgaatcgttgatgccaataaatggtagtttacagcggtgtgatcgtgttcttgatcaactccgcgcgacttcaacgtttttgctcctgaccagatgtaagcaatgtttcgagcaaaagctggatcaaagccaaaatcaaatagcgcaatcaagccgttgatacttaaaatcaaataccaatatccgatttcttgagaactcaagaaatgaaaaataattggtagcaagataaaattgctcgccatcgaaaaaatagtccctgcataactccagacaatgctttttctggttacttcaaaccgatttcgcaactcatttcctcgtttcacttgacttcaaagctttgataaatatcgcgcaaccgctgttgcattaacgaccatgaaaattccttttgataaatttgccgcatcaaggttgcctctttagcccagttttgacgcttatcaataagacgttgcagtccatcagctatatctgcttcagaagtgccacagacagcaccgaaaccatacttaatcagccaatcagacataccagacttttcgatcatgagcaatggcttgccaagttccatagcttcaaaaaacttgttaggtgaagcatataagtgattttttagcacaggatcatataacgccaccagaatatcagctgttttttcaataccatttacctgatcataaggcacaacgccaagatattggatgcgcggatcacgtttaccagcatcagcaaacatatcctgatactggccttgaccagcaaccgtgagtgacaacgccggttttttttcaacggctcctaacagctctggcaaacaacgatagggacttaacccaccaatataaacaatcttaaaatctttctgcgtcgggtcaacggcttctgcattagtagcaactggactatccaatggcgaattataaatgactgccaaatgttgcggcttagctggttctatttgacgacgacgatcttcagaacagataagcgtccaatcagcagtggccatggtgacattctcccaatgaacaaccattttacgataccattccggataatttcgggtatcaggtgcgtaatcaaagatatcataaaccagtttggttttggtcttcttggcaacctttgacgtgatataacccgtatgcacattacatgcttgaaccgcatcgtattcatgcaagtgcttgctcaaccaacgatagagaaaagcttcaaaacgcataaaagcaaaaactttaaaatatttaaaagaatatgaaatcttaatgccggtaaagatcgccttcaatgtctggccgtcaaagtcaaacgtatctgtcgtcattcgtccatgcggatcttcacgccagccaagaattgtgacatcatgaccagcagcctgcaaagttgcactctcttttaacaatcttgaatcatcatcgacatgaccagtcgatacaaatagaatcttcatggttcctcccagtttattgagaatgatcgttaagacacgccaatcccagtccaactaatagacatacttcagcaagaacggcagtacttctaaaattcgaagtttgtagagcatgattttgaccatcaacttcttatcttttcgatacgccacgagttgcttaaacgaatattgccgcatcctttgacgaatctgctttttaatctcagggtctttcggaccagcaagattttggaagaagatcgacaagcgtctccttagcacatactcattgatatcacgattcgaagcaagcccactctgccttaattgacgttcaatctgatcaacaactttggcgtaatcagtcagcttcttagtatcaacttgatgaacggtcgagtcattattctgatagtaataatacaggacttcgtgcaatctataaatatgctttgatcgtaatagaatcggcacaaaaaaagccaagtcttcagcaaagctacaatcaggaaaaatgtccgacccaatcaagtcgcgtgcaaaaaccttattatgaggaaaaccgccaacaacatcccgcgaactgcctaacatttcatgaagaatctctggcaatcctactttttgactgttaacgttaatttgagcattggtctgaggcagcggtgcgccttgctcaagaggctggtagttaaaaataaaaagatcgaagtcaattgtcgtcacaatctggagaatccttaaaagtgcatcactccgaaccgcatcatcggcatcaataaaccaaatatattttccttttgccagcgcaaggccagcatttcgggcacttgcaacgccattttgcttctcaaagaccactttcgtatgtggatgagctgcccgataagcctggataattttaacactaccgtcagtcgacccattatcaactagaatcaactctacgctcggcggaatcacgccgatacttttcaacagtctctctaaataagcttcaccgttatatataggtataataatactcagctgatacatactgcctcctgatgaagatactatcgattgaagaatttgttttgagatgaacacaatgattgcccttcgcaaaacatgaaggtcgtcagaatttttaaagaccagacttcaaacgtcaacaaccaatctgattttaaatcgtcttaaaaaagaacattgccgtctgttcacattgaaagcattataccatagcaccaaccaagaacttagtcggtctaaatatgtgatgatggcagtaacttctgactttaacaaacaagcatattcgtctgtatgttaaactattttgacgatatttttttaagagaaatgcgtggattcgtgactgtttttcagtgagaaaatcgtaagatagcttaaaataatcaacatggggaataaggactagttaaattgggggcatatacttaatgagcattaacagaaccaaattactcaaaacaagcatcatcatcgtaatactaggtctgatcagttttttaaatatcctaccactactaaatttcaactttgcaacatcgtatatgggtgatgatttctttttccatgttcaaagggttttggcactgagcaatatctttaaaagcccagtgaattttgatgttttcgcacatactgccacaatggcaaacatattctatccttgggaaacagtctatccgctttacctgatctatcacacaaccggcgactttatttttagttataagctcttctactttctaataacattcttgacagcaatcttggcttattggtgtttgttcaaaatttcgaataataccttcagttcattttgcttcgcggcactttacgttttctcgttttaccgaagtaccaatttctttgtacgctctgcattaggtgaagcagtcagcatgacctttctgccgctggttctgctaggactatactatattctctttgatgactacaataaatggcgatctctcagtgtaggtatgactttgattacctattcgcatacactctcacttttcatgaccagcatcttgattgttgttggcttcatggttagcttgggttttttagatcaacgaaaagcccgtattaaatcgctttttacagcgggtttttggaccgtgattttatgctccccttacttatttttggtaattaataccagcttaaacaataagctttacttaaactggcaacccgccttgcatgggctgccgttgaccgactggctgatgaattcgctagggaatcgtatgtacccaaatctcaacgtcagaagtagtttaggggcttctgtcgtgatcgctggtgtcttagcccttatgttgttcatcatcgtgaaacgatcccgaacagcttttagcacattctgtctatggggtggtttgggaatcatgcttatctcaacgtcccttttcccttggtttctaacgaacaacaccatcttcggcagaattcaatttgtgtggcggttaaatgcctacatatcgcttctcttgcttgcaagttttagtctcattcttgggaccgtgattcggaaaaatgttttgttgaaatccgttttcttattagcacttatcgcaggattgacaattggtaatacaacggcgcttgccacttttacggccgccaaagctgaaaaggcccctcgagaaggaacacttgtcaaaaatgttaaaaatattttttatggtgactatacgccagagcaagtccagagcaagaaaaatcttcaacaaattttacaaaagcagttcttcctaaacgcgcagcaaattaatccggtctatcacttcactgacaatgactttactgtacaagttgataacccaacgcaatcacacgcaagactgacaatcccggtattctggtatgcgagtcaggtcgtaacggttaaccaaaagccggttcattcaaaaatctcgaaaacaggtgcaacccttgttacgatccccaaaggcagctcagtgatctctgtctcatatcaatatcccaagtcagttgttgtttttattgtgatagcttgctttggactagcagccatttttatgccattgatctttcgcaacacaggctcggcaaaagttacaaaaactgactaaccttctcatgacgtccaaagcgtgagctggtttctgcgctagcgagcgcattttatcctaaaaatgacattactaagcttaaaaacagcctcgacaagatgcatgctgagcaacgcatcttactggggctgttttgtttaatcagcgcaaagccttattgctttacgcaagatcgcaaaaactgaattaatttcagaagtccgtacccaaaaatgccaagtaaactgataccattaatgatcgcagccgcccagaaaagcttcgacggagcataaccaacgaccaaatgattctcccccaatcttggtgtcacaatcaatgcgccaatattgcttcgcttgtactgtgagggctccaattttttgccatttaaaaaaacggttgaatgcttataaacaatcactggcataagcgtcgattttcgctttttagcttgccaagtgaagtcaagccgactgtctgcatcaacttgtttcctgacatttacgtgattgtgcagaatttgctgtttgtacgcatcataagcgtagagcgtgttttttacattcgggacaggtaaataatctggcgtgtttttggtaataacaccaaaaatgtttgcctgatcatatgcatgattaaacaagtcgcgaatctctgcctgattttgaatggttgaatcagcactaactgcaacctgatcgccttgccacgctgttgctttctcgtttacccaggtgtaaccattgactaaatttaacccagcgacactaatgaaaagcgctgagaacaagcgggtgcgttccgtcttggcattaatattcagtttttgaaccgatattgttgtacccagaatcatcattgtcaaggcgactgggttgaagcgttgcggaaactgaatcgtttgaagaacattaaaatgatcagcaagaaagttccatggaaaaagtggtgaagatagccacaaaaacaaaaatccatcaaggttaattagtttttcaacgattttcagtcgtttccagttcaacgcagcaaacactagctgaaagagaatcatcgctgacaaaatcaaacccaagtccagacgagtcatgttgccaagcgacaatcgcgaagcactgccaagtaaatcggtgactttatatggcataacaaggtgctcgttatgtagctcataaattgctgccaatgtgctagcattcaaggcaacagcaaccccaacggctgcaacggcatcaagtattgttcgccatttattcttagccaaatagagtcccggaatgaagaaaatggcggcactaataacgtacagtataactgtaaagttctgaaccgccattaacgtagctgctgataaaccaaataaaacaggactaatcggcttttcgtgattgatcaccatgcggatcagcggaatcgttgtcagcggaagtagcgccgctccccatccccgcaaagccgaatcggtgacataaaacagcactaaaggtgttcccatgtataaaaccgcagcagcaaaagccatttgacgcttcacttggcagtaccgagtcaaaaaatacataccacttcccgctgttactaaacataaaaaactggaaatgatctctgctctaaaccaagttttggcaatgattaagataaaaccgtggcaataagcaaacgcactgccataaaccgcgttaataatgcgtcctgattgtcgaaacgaatagagtgactgaaaaaagttgaacttgccggtcttgagttgcatggccgcttcataaaaacgattccaatgaaattcccagtcgtcgccaactgccaaagcatgatagcttaattgcggtgacagtacaatcaacgccatgataacaattcctaaaagccacgcaagctcatgcgcccaactcagtttatttttttcgtgcatgtgaatcactccaacttccaacgattattttcaacaaagtatcatttccgaaaaaaagtttttcaagactaaatcgctcttttttaaacacgaattcattaaaaaggatcctgcaagcactagcaatcatctagtaaatgcaagacccgttttactttctatttgcgactgacaagctgctggcttggtttaaagctacctaatagtaagggcacctttgtcaatccaataaatatggccatctgggaattgaaccttaacgtaagtggctctatcagtcttttgttcaattgtggcatgaacgttctgaccatcatattgcttagcactgtcgttgccaacaagtgtcgtaatgcttgtatgataagggccatcagcgtaaaggccgtctacccgtgtcttctgattcaccacggcattataattaacatctgacgttgaaagaattggactcaatggtgacatactcgtcaaagccaatttgtctgtccaataagttgtgccattgccaagtcgaatctggacataagttgatttggtggatcgcgaggtggtggcctcggcaatcacttgcaccaactgtccattcagagatttggtgttgctattgccaatcgcagtcgctgaagatgtgtgatagggcccctcttgatacaaaccatctgcccgatgactctgatcaacaatggcaagatagctaaccgtcttggatagagtaatcttatcgaaacctgcctcatcagccatttgcaaaccacgtttatcaatccagaaagtttgcccattcgctaaacgaatctgattgtaggtcgtcccacccgctcgcgtcgtaacggcttcagcaatgacttgaacgcgttgaccattgtatctaggtgcgtcgctgttaccaccagaagttagcgcggacgtatggtacgggcctgatgtataaatgccgtctgagcgtccctgttgctgaatagtcgcagcataattgactgacttattggaaacaattttgtcaaagaaaagttgcgccgtcccatttttatcaatccagaaaacttttccgtcttgagcacgaacttgcagataagtcccacgtgaagtgaccgtttctgctaacacatgaactgactgattattgtatgcaacaccatcaaagttagaaattgccgtgttcgcactcgtgtgataaggagcatcagcatagataccgtctttacggctatcttgattgacaatggtcgtgtcgtaattcactgcttttgtagaaagaatcggatcgtatgaaggcgtttcaggcttaggtaccacagtatttgcctgcgtgaaaagtcctgtatagtcaaccgaaacatcaactgggcttgaagcgcctggtaagtatgctagcgaagaatactgccatgcgccaaagtcctgattccataatgaactagcacttggtgtgtacgggtagtccgcaacccaagtcctgttcttgccaacagtagcaattgcagcattcgaataactatagtacttgccggtatataaaacgtgattattgtagccacgattgtttaaggtctgccagaacgcatttagattcgcaccaacatccccaacgacatcattatcttcaacatctgccacaacattcgtttgtttatcaacatttaacgcatcaagtgtattggcaaaataattagcttcattgatcgcagctgcctgtgaactaaaatgcacatagtgataaaccgaaatcgccatgccagcattcttagcatactgaatctgcttaccggcatatggattctgatagaaattaccttctgacgtcttcactaccgcgcctcttaccccaagcgagcgaagtgtgttgaaattagcctgtgtcagccaatactgataagaagcgacatcaacgacatcggtccttggtactgacttatcaccaatggtaaagctcatcatcgtcaacgaattagccgcaaaggtttgtgcatttgcttgtgcgcctcctgacgtcgcaagcgtgccattactcgaaaatgaccgcgcacgtctagctggggcagctggtgcctgttcagttgtcgttgcaccagcagcatttgaatgctggttcatttcgtgaaaaggtgccgtttggtcctgactcgattgcgcacttgttcctgtatttgcactgtcgttctcagcagcagataccggcgtgcctaaaacaacttgtgaaaataaaagtgaagaggcaatcgcagcagttgtccaaaatactttattcttcaactttttctcctttttccccattgttaagctccttcttaattaagttctttaaaacacgatcattatacatggacttctgtgccttttaaagaaacattctggtgacacgttttgcgtttttgtgtcaaaggtcacttaaacaccgccatatcaatcagctcatgacaacgggtctgtcaaattatcggtaaacatttttctttgaatgatcttcaaccaacgataaataaccggcgttgctaaaaggaacaaagcataatattgctcaaagcgataccgcgtctgcgtttccataactatgtaagcaaagaaaaacatgccataaatcaaggctggcaacaggtaagcgactcgatcgatgagaaccttctcagtcacaacacgcttaaatgttcccagaactgtaccggcataaataatgataccagaaaagtttagtgatgaaatcaacaatgaatgacgttcaagaaaggcctgatcgcctccgagattgtattgattgtcaacattacctaaaaaactagtaaatcgatccatgacatcttgaaggttaacgccatgtacaaaaacacgccgtaatttatcagcagctgcctgtttatataagccatagtcaaagtgataagcttttaaatcataatataactgtgatttacgggcacttgttgtatattttccactaacgccttttccggtaagtccaatcagaaacttataataaggattcccacctttgataccgtaaggcgcaacacctgaaatgataaatagtccatttatgatccatcctagaccccaaaatgcggctacaaaagcgatagtaccaagtaatctttgatggcttctgtggtagacagcctgaatcaatagtgtggcagcaatcgccatcgcgacgacaacagcggtcggccgcaaagtttgtgccaaagtgatacaagccgctgccagtaaaagattctgccaagattgtcgttttaaaataaaataaatggccgctgcttctaataaaagtccctcatgttggttattgataatgcctgcacctataaatatatatgggaagatggcgaataatcctgcgccaaaagtggctgtatgtacatcaacatacaatctcagagttttaaacagaatcaaaacggtcaaggtgatgacgatcatttcgacgattttgaaatacaataaccgataaccaaatactcgcattagcaacgataaataataagcatagccaatttgaaaattataatacctaaaatagtcactaggctgagcagcatgcttgccaaacgtaccattcacgatatcttgcgcgccttctagcaagaccttatagtcactgaccggaactggacgatagatatagttccaaattcccaataatat

SEQ ID NO: 14 - DNA, 45430 bp, Lactobacillus paracasei
gggttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttgacgcagagccaaaataaaaaacatggttccttggaaaaggcagccatgtcaatgaacttttattcacttcaattaacttaaatgcgtaatgtcctgttccaccacaatatcatgaagtttctgacgtggtggttctgggtcttcatctaacccttgtgaggaaactttgtcaaacaatattttaattgtttgcaataagatacgcgcatccagaaaaatactgtaggtcttaatatacagcagatcgaacttcagtttactatgataatcagaggcatacttgccataaacctgagcataaccagtaataccagcacgaacgttatgccgcaagtaataatggggttcctgctcgttaaactggttcacaaaataaggtcgctccggtcgaggacccacaattgacatgtcaccctttaaaacattaaagatttggggtaattcgtccagccgaaatttacgcaaatacttgccaaccggcgtaattcgtgagtcatgtgcagttgccaaaacagggcccgattttgcctcagctgtagccgacatcgttcggaacttcagaattttgaactcacgttggtttagcgtaattcgagtttgcttataaataattggccctggtgaggtcagtttaaccaataaagccgtaaccaacataaatggcgaggccaaaatcagcatgagaagtccaacaacaatatcaaaaatgcgtttgagaacggcactttcaaatttaattcgaaattgtgtaattcccatgacgctttcatcttcaaagttcataaggttgggacgcaacatcaacaggttatcaaacgttgaaggcaggaggatcgtcttttcgcgcttaatgatgatatcaataatctcacgacgcgtttcatcaggcaagctcttggtcagatagaaaatgtctaccttatcgataatggctttggcattctcaacaaaatgatcagaaataacgtaggtgactttatgcttattattcttggccgaattgaagttttccaaaactgctggcagttcatgttcataggataaaactgcgactttgtagttactcgtaaagcgaatgtacatgtaataaatgaacacccgccagacaccaagaatcaaaatgctgagcaggaatgagtaccccagcaccaatcgtggaaacgcgaaaaatcggcccatgaaggtgatcatcgtcaatcccaagatcgtaatcaattgtgccaaaacagtgttgaagatgatgtcactgatccgccgattataataaacgtaaacgcctaggaaaaaattaaccaataagaacagcaatgaaatatagatcgctgatccttcatacattttaaagttccactccggaatgtctacaccaaaacgccaatagaaggcgagtaggatacttaaattaaaaagaccgacatcaccgatcatcgttaacagccgtttaaagccattccactcggcactctgtttcatacagcaaccctctcaataattatctttacttgaaaacaagctcactcattatagcatacgtctaaaatttgaccgcactgaaggccggtgtcaacctgcaacgtgctggatgatcaatagccatcaaaaatcagcgttggtcaggaataccatctctttccgcactcttaatgcctcttcgagcggaaatgtctgcccacaaatatggaaagaatgtcttaaagatatgcttgaatcgcccacgaagccctagattcgcactgccccaagaattatcgaaaagatgttccatgtaattcgcactccgatttcggcttgcgtatgtaaagtaatctcgaggatagacaagaatccctgacgccagttcctgttgttttccattcatccgaaactccggatagagcttcatcaaaattttagtcaccactggattactcgtcatattttgcatgtcattttgcagttcaggaaatcgccgcccagcatagacatctaaaatttttgccaacaatggttccttggcctcagcaccaatgaatgatgtcaaaatgctgttgtcatattgaaatccccataccattctctgctttaaaaatggcgcaagatcttttttaacgatcatatccgtatccagataaaacccaccatactgatacaaaaccgcatagcgcaactcatctgccgcatagccaagtttaccagcttgaaacattttttccgaaaacgcgtattgactcaagtcaaagttttgatcgttccagaatttaaattcccagtccggcaatttctctcgccattcttggacacgcgcctcaacgaaagcaggcggttttgtcccaaaccaggcataatgaataatcttgggaatcatcatcttcctcttttctgcatatcagcgtttgtcagtaatgcccatcagcgaatagtgaatgaaataatacaaactcttgaaaaatcctaaatgctcatgctgccgatagattgtccatgtccactgagcagcctgaagtttattggagcttaatgaagtctgatgcttccggtatttagccagaatcagatctgaagcaagataggcaactataccactgcgcgcaatggataaccagcaagcgtaatcttcatggtttatctgtggaaatggatactgtaaggcagtctttcgagtcagcatcaccgttaacagtccaatacgattaccctttagcatttcttgataagttaactgagtttgcgacacttttcgctgaccaacctgagtaccatgatcatcaacaacatcataattgcagtacgagaaatcagcctgatgctcctgcataaagctaatctgaacctcgagcttttttggcaaccacatgtcgtcactatctaaaaaggcgatatattgtccttgagcatgcgcaacaccaacattgcgggcattggcaactccttgattcgctgaaagttgaacgagcttaattctggcatcctgggtcattaacttctgaacaacagccaccgtgtcatcagttgattggtcgtcaaccacccagatttcaaagtcctgaaatgtttgttgtcgtacagattgaatcgtggccggaagataagcggcagcgttatacgctgggacaatgacagatacgcgcggtgcacttttcaaaacgggttttctccttattcaaagcaaacaacgtctgacactaaaattatcagccaccattgtaccatatggccaatcaatctatcactgcaatgacgccacatacttcgccaacccctcagccagcggcgtatgcggcataaagtcgaactgatccagcttgtctacctgagcatacgagtcacggatatcgcccaatcggggttcttgataagtcgcgtgcagtgttttgccagttaacttttcaagctctttagcgacctgatttaacgaggtttgctggccattcgcaacattaaacacatcgtctcgggcactcggtgtttcgagcaaaccgcgaatggcccgcacaacatcgcctacatagataaagtcacgtgtctgctcgccatcgccgaagaaggtgaacggcttgtcggcttttaacgcatccatcatgattgacaaaacgccgctgtaaggtgatttcgggttttgctttggaccgtatacgttgaagaagcgggtgcagacaactggcatattgtacagccgcccatagttaagaacttcccgttcagtggcaaatttatccaccgcatattgtgtcaacggtttaactgccatggtttccgctttaggcaatgctggtgaatcgccgtaaacggctgcagagctcgaaaaatacagctttttaaacgtgatttgatgcgtacgcaaagtttccaacatgctaagattggcctcttgattcaccaaatgcgttgcatacgggcgctcaactgaatctgccacactggcaattgccgccagcaaaacgatgtagtcaaatttaccgtcaatcagcaaacgggacatgaaatcatggtccgtgatgctgtgttcataaaaagtcacccgatcagagtctggaatattttcccgcagacccattgataaatcgtcgacgatggtcacggtgttcttcgggtcggttaatagcagttcggttaaattggacccaataaagccggctccgccagtcactaagtagttgctcaaaatagtttcctccattatggtggcttcattttcttcattatcgtatcacagcttctgtcatgtcaccgccacttactgaaaatgttagcaaaatgataaaaagcgccgctgtctagcgccgctcctttactatgatatttttttaagctacattgatcctaattcgactgcacgagccgccgatccaaccaacgacttgccagtgacaaggcatagttgaccacgaagtacatcactgccagcgccacgaacatcgggatcatatagttgatattctgcccataaataatttgcgcgtggtaggttgcttctggcaagagaatgatggtggccagcgaggtgtccttgaccagcgagataaactggctgacgattggcggaatcatcttcttcaaagcttgtggcatgatgatgtagcgcatggcttgatagaacgtgagcccattgctgcgagcggcttccatctggccacgcggcaccgcgttaatgccggaccggacgatttcggcgagcatggccgattcgaaaatgctcatggcgataatcgccgcagcgacaacattcaagcgaataccaatgtcaggtaaggcaaaataagtgaagaacaaaatcagcagtaatggcagatttcgaatcaaatcaatcacaaaacctacgattgctgaaaaatatttaattttcacgtaacgtgctaggccaagaatcacgcccagaataaagctgaagaatatcgaaacaatcgaaacttccagtgtcacccctagtccttgaagcaggtaacgcaggttaatccatgaatacgcgtcaataaaactatgcataagccctgctcctttctaggcggtgacccattttttctcaagatatcgcatcagataacttaatggcatcgtcaacacgaggtagaaaaccccaacaatcagatacgtatcaaaggtggaaaacgtcgtggcggcgatcagtttgccttggtacatcaggtcaaacccagcaacaaaagcgaggacagaactgttcttgaccaagttgatgaattgattgcccaatggcggaataaccattttaaaagcctgcgggaaaataatctggatcatcgcttgattgtacgtcataccaatgctacgagcgccttccatttgcccgcctggcacagcttcgatgccggcacgcaccgtttccgcgatgaatgcactggtataaatcagcaaaccaatcgtcccagccgtaaaaccgtcaattttaacgatgaactgcggtacgatcacgtaaaaggctaatgtaataactagcagcgggatattccgcactatttcaacgtaaatgcgcccgatcacgcgcaaactcttgaatggcgaaatttctaggagtgcgaacaaggtaccaacgattaaactgccaatcaaggcgagaatgctggaagccagtgtgtaaccgacaccggacataaaggttccccagttattggtgagaattgaccacatgctattccacctccttgagactgaagcctggcacatcgccaaaccacttcttaattaacttggcataggtgccgttttgcttaagttgcttaatcgccttattgacagcctgcacaaatggtttttgacccttgttgatcgcaatcccataaggctccttcgtaaaggtaccgcctgtgacgatataatttggatcttgttcggacatcccataaagaatgccgttgtcagtcgtgagtgcatcgccctgccctgacttcagcgcagtaaaagcctgcgcataatcagacaactgcaaaacggtggtatctggggcggcttttttaacgttgtcaacggaattagagccttgcaccccgatgacttttgtccccttcttcaagtctttgacggacttaatcgggctgccttttttaaccaaaatactttggccggcgttgaagtaaacatcggaaaaatccaaaatcttttgacgttctggcgtaattgtcatcgttgcaatcaccgcatcgacgttgccgcctttgatcatcggcacccgagtatcactggtgacctggaccagttgggccttgcctttgctaccaaggatctgcttcgtgattgccttagccatatcgacatcaaaaccttcaattttaccggttttgatatccatcagtccaaacaaacgggtgtcagctttaacaccccagacaatcgtatttgtcgtcttggcagttgttaaaatatcgcgatcggcgacacttttgccgcaactacttagtggcatcattaacaacactaagagcaacggcaggagcatgcgtttccacaattttgccattcaacttcctcctctttaaacgcgatcgctggcgtagaaatctgcgcataaggatcttgatcttgatcatggtggccaaggccatcacttccaaggccgtttacgcgccattttcaccgcccagctcacgcccttagtggttaataattttactgagaaattccttggcccgtggttcttgaggatcatcaaagaattgatcgacattggccgagtcaaccagaatctggccgtcatccataaagacaatccgattaccgacgtgacgagcaaagcccatttcgtgagtgacaaccaccatggtcatgccctgttcggcaattttctgcatcacatccagcacatcgccgatcatttccggatccagtgcactggtcggttcgtcaaacaaaatagctttaggtttcatcgccaaactgcgggcgatagctacccgctgttgctgtccaccagaaagctcacctgggaaactgtcggctttattttcgaggccaaccattttcaacagatcatgcgcttcctgctcaacttcttgcttatttcgtttcagaaccaaatctggtcctaaggtcacgttttgcaacacattcttattggcatacaggttaaaatgctggaaaaccatacccacatttttgcgaatgcggttcatatcggttttcttgtcagctaggtcaaaatcattcacgattagttgtccagatgtgatccgctccagcccattgatgcaacgaagtaaggtacttttgccggatccagacggcccaatgatggtgacaacttcaccacgatcaactgtgagattgatattctttaaagcatgaaatttaccaaagtacttattaacgtcatgaaattcgatcattgacatgttcgaggacctccttgggttcactgatgcttatcatggattttacagagaaacttaataatgcgcaaatatttcttattcattatgacaacctttttgctttgaagagcttctcatcgcctttatttgggacttctgagcgttctatgaagttttaaaaggtcttgtgatcactggtatctaaaaccgctcagacgtcagtagctacccttctatgacaaatgaatcagtcttaaaacgttatgattgccttgctaccattcaaaaggacagttatcttgattgcccgccgctggttaatcaccgaactcacactcaaaaaaatcaggccaacgtcacttttgcgtttctagaaaagtaacgtcgtcctgactgtagccttttttcaattgatggcacaactatttcataacagtttattcatcgtggcgatgccgtctgctttcgcgagtcggcaagggcttggatgctgcctgcgaggttgacggggctggctcattggtcatcttagcagtttcgcgttggctttcgcgcgttgtgtgtcgtgaatccaaaggctccgcctcatgctgccgatcaccagtagttgccttgtcctgatacgccaactgcacggttaaactgtaaggttgcgcttccttgcgtaagccgcttcgacccagcagcttctgttcaccaccgatcaaaaagacattcgcaaccacaagatgatagtcacgctgcgccgcttcgaccggcaacaaaccgacccgatcaacggtggccagtggcttggccattaaggcattcaagccgcccgtgatgacaagcttactgtctaggtgctgtagatcaaagaatggcaacgggaacggtgcgccaatcgccagaaccggttgttgcgtctcctgtgccacacgaccaacggctttgtcatctaatccttgataattcaaactcagcacaccttgtttaacgaggctatcgacaagcgtatccaaattggcttgctgttcctccgtcatggtgacatcggccgtcagcaattgatcttgtgaaaaaacgccttgagccggtgctgcacccaattgtgtccgcaattcattttcgacagcggtttttttggcagcgttactgccaagccatttttcaaccttgggtgaaatgtcaaacttcgttgtcttatttgtaaaataatataagaagttcaagccaataaaatacaaaaagacaacaaatgcaagcataaacagtgcgccgcgaatgcgaaagtccggatagcgcaggttttgaatcgccacatatagtaaatagaagttggcaatgagtgccacccacgtgaaggctttccccttgggtttgtcggcaacgttaaaatagcccaacacgcggttgataatatcaataacagttaacatgatctcatcctttccgcgagttactgaccgccagagccggttgtgtctgtttcttgaccattttgattattattctgctgactaggtgtggttgagcttgttgaggcagaagcagacggggttgacgttgtgtctgagctgcttggttcctgagttgaagcagccgaactcacggtgctgttatcatcattttgatcttgattgctggtttcagcctgcgattggctagcctctggttgccgtgacgccgaagcttgactcggtgcaacatgtgacgacgcggactgaccagcacgcgaggcagattctgattttatttttgataccaattcactttgctcagtcgccgattttggttggttcaccggattgatcgtgttcacaatgttatatgcactgatcaaaacaatgagtgacacaatcgcagtcggtggtaataatggcggggtacgataagccatgaagccagctcctttcatccatcgtttaattgtacctcaataactagatgataccatttaagttcttgctaagatgacaaggttgccatttctggggtctttaaatggtggtcatgtctggcctgataacacgctcccattcaaagatggaagaagccgacaacggacacctaaacgtcttccacctcaactcattcggggcgcattccgctgacgccgtgtcttcaaagcgctgccgtctgcgttcataaaaaaagcacatacatcaacatgtacatgctcgcctgtcgcttaggcatttttaaggcggtctgcatgttgctggcattccgcacacagcccataaagttcaaaattatgactttgaatttttgcacccggcacttgtttctcgaagtaattgagtggacacattttcaactcgatcactttcccgcaatttgtacaaataaagtggtggtgatgcggatgctggaaatcacactgtaatttcacaacaatttgatcatcttgcatccggctttcaacaatgcccatctcaataaatgatttgacatttcgataaatagtatcgtgagagactcccggaaattgggtacgcatataacgatccagtatcgtcaccgccgtgtagcgatgctgattcctgccgagataatcaaccatcgattcacgctgcttggtcacgcgataaccgtgctgtttcaattcttctaatgcaatcgttgtgttatccatgcgaactcctttagcttgacactttgattaatggcgtgtagactattaaatcgtattgattacgattaatcaatcattagtgtaccacgcaaaacaggaggaagcaatatggcagaaaaaactgactacgcatccgcagcacggcggttgaagagtaaaaacccgaaaacccgttcacgggcaaaacgcgtgattaaagccgttaagaaaccagtcaagtaattttatcgcattattcaaacaacatgtagcaaggcgcgagccacggtgatgatcaccggtgctcgcgccttatttttgttctaaatcgatgcgggcaaggccgcaacttttcaaagccaaggttttcataaattgatccacttgctcgcgcgcctcatcccaactgtcatttttgatcacagtggcaaacggctttagttcgtctggcaaggttaaatcgcgcttatattccggacttttcaaccgcgcagcgaccatggcaggatcatcaccacggcccaacaaccgatcttttaataccgttgggttatcaattgttaaaaataagaccacgacctcctttggcaactcacgcacataggtaatggcaccttttgtgtctagaacaatactaaggaagggatgcttggtccagtttttttcaagcgattcatgggaggaaccgtactcataaccagcataagtgactttttcgataaaatgtttggtcgcaaaactcgccggtgtttcgaaatagtaatcgaccccattcttttcccctgtgcgcgccggacgggtggtgtgcgtcatcacgcggtggatgcgataattatcgcgaagataaccactcaccgtcgttttgccagtccctgttgccccagtgatcacaatcaacttatgcgcagctttcatgatcagcctcctcttaaatgattgcctcgattgtaccaaatcagcgcggattagtcagcttgaaaacaggttgattgattcggtttatcaataacgctgttaccaactaagaatggctaatgctgatcatgataaaaagcaatcacgcccatttgttgactctccacaaacccagcggctttataaaagcttcgcgttttcggatcatcgtccgtcaataaaacccgttgccgcacttcagggaaccgcgccagcaaagcttctattaattgtttgccgatacctcgacgctgatattctggcaaaaccaacagatcctgaataaaaagaatggtttcgccgtcaccgactgctcggattaagccaactaactgtttgccctcatacgcacctaacaccatcaatgaatgggtcagtgcccgttcaagtcgcgcaggatcgcgggtatacatgctccaaccgacacttttataaagtgccaaaacctcgggcatagttggtttttgatcagtaattgtcaccatggcgtgtgtcctcctttataaaagaatgctttgcttagagtagaaaaaaagatcgatcacgcttgatcgacctttcaaatgctattgcaggatgtgaacgatatttttacagacgacgaccaaagcttggtgcgaagtatgccatgctctgaatcgtaacgttttgaccaggagctggtgcgtgcagatattggccaccgccaatgtaaataccaacgtggtaagcactaccaacgccgccccagaagaccaagtcaccggcctttaagtcagaaacggaaacgtatgagccaagcgtactttgagcctgcgaagtccgtggcaagctgatcccagcttctttagctgcatagtagatcaaacctgagcagtcaaagcctgatggtgaagtgccgccataaacgtacggaacaccgatatacttagcggcgttgctggcaatactgccaccggaaactgaaaccgagctggtgtttgaagcaggtgcttgtgaagcgctggcgcttgaagaagcactggtggtgctggtgttagcactacttgaagctgcactgcttgaggcggtgctggttgaagaagcagatggtgttgcggcaacagcagcggttgctgcggcagctttagcagcatcttcgctggcagccaactgagccaacttatctttgttagcttcaagtgtttgctgtaaatcggatgcagatttttcagcatcactctttaagctttcgattttagccttgtcgctttccaactggctctttgtcgcaacaagtgtttcttgcttggcttcttgttcagtttgcagagccttaactttggcctgtgaatccttaaccgcctgcaatgcttctgcactggcttggctaagtttgttgaccgtcagtgaacgaccaacaagatctgtaaggctgtttgaattcaaaacaaagtcaaaatagacattgcctgtaactgaattaccaacctgcttttgcaatgaaatcaattgttccttcagattgtctttacgcttgccgacttcgacttgcgccttaacaatttgctggttgtaagaggcaattttagcctgactagcactaattttttcttcagcattcttaatgtctaatgctttgttagaaacatcattgctcaacttcgcggttttttcatttgccgtttggatttgcttgagcaaggcatcattcttggcagtcaagctagacttatcgtcatcagctttaactgttgtgggagccacccctgaaaccccaaccccagccaatgttgcaactgtgataaagcctgtaactaattgctttaatttcatctttatcgtcactcctgctttcgttttgttcacaactgctacattaacactggactgttacagtctcgttacagcatgtttactatcagaatactttcttcaacatattgtcatggtcaaatataaggaagttcataagaactttttatttcagttattttcaagaagaaaaggagagtcgaaggcaccaaaaaagcctgtgataaacgtttgttttatcacaggcctaaatcaccagtcgtcatttttattaactgttattgtttaatagtaaattggctataccaatcatgcgacttaaagggttactttgccgccttgatatcgactaaaaagtaccgctttttaccacgccgaacgatgacatattggccatcaaaatgagtgctcggatcaacctcgaaatcgagctcccgctgacgtgtaccgttgatcgtaatcgcaccattttggatgtcttcgcgggcttgacgacggcttggttcgattttggtagtgtcgactaaccaagtcacaatgttttctgcggtctccggtgcctcaactgttggaaactgcttgaaaccctgcttgatatcatcagcgctcagctcagcgacatcaccggaaaaaagggcagcactgatgttttcggcctgatcaaccgctttttgaccgtggacaaactttgtcaccgcacgcgccaattcacgctgtgcttcacgtttttccggatgtgtcttcgttgcttcaaccaattcggcaatagcatcgcgcgacaagaacgtgaagaacttgaggaacttctcgacatcggcatcatcctgattgaaccagaactgatagaactcgtaaggtgacgtcttctccggatcaagccaaacggcgccgccagcagacttaccgaacttggtaccgtcagccttcaacatcaatggattggttagaccataagcacgggcttctggtccctcgatgcgatgaatcaaatcgatcccagccgtaatattgccccactgatcggccccgccaatttgcaattgaacatcttcgtgtttgaacaagtgcaggaaatcgaccgactgcagaatctgatacgtgaattccgtgtacgagataccgttttccaaacgactggcgacgacttctttatttagcatactgttaacggaaaaaagcttgccataatcccgcagaaaatcaagcatggataatttcgataaccaatcataattatcgacaatccgaaaatcatcggttccgaataggttctccatttgggcggtcaatttctttttatttgcagcaatcgtgtccatggtttgcaagacccgctcggaattacgcccggatggatcgccaatcgagccagtgcccccaccaatgacaatcacgggacgatgacccagaagttgaaaccgtttgagaatcatgaacggaatcaaatggccaacatgaagtgaatcaccagtcggatcggtgccacagtatacactgactgctttttcctcggtcagtttccgcagaccatcttcatcggttaattgattcaacgccccacgccactttaattcgtctaaaattttgcctctgtctgtcatgttacttgttcctccctaaacacatttgctggcacagcaaccgctgtataagcgccttggggctattatggccaaaaggcgcttacattcaacttttaagcacgccagttcacgctcttgactaaaatttgtctttgccagaatttaccgccacctgtgagctgagatgaaggatggcaacgtctagatcgttggtcaaggtcattcacaatggcataaaaaaagcccctgatcttcaacgatcagggacgactttcaccgcggtaccacccacattatgctttgcatcactctaatggatatcggcatgacccgttaaccaggctttcattgaggtgtaattcgtgatcaaaggcggaacggtttgcagcaaccaccgtttttcttagacctgcctaggaccactactgcggctcatctggtgactttatggtttagatcttaacacatgtaggcaaacggttctattctttttggacattcttccggagttcgcgctaacgacgcagtacttctgaagtgcgcctaacttttcacttttgcgggtcctgtggtgcttcttttggatctcgatcggctggataggctttgacgtcagcgtctagaatatcgtattcatccatgagtctgcgttcgacgcgctctcctagatcataggaatcggctacggtcatattgggattgacacgaataccgatggttagcaagacagcatcgcctgcatatcgtgcttcaatactttgaacgcctttgacacctgggactgcactgatggtttggcggtaagcagcaatttttttggtgtcgaatccatctgttaattcaaaaatggattctcgcaggatagtccaagccgcatataaaatcaaacaaccaacggccacagctgcgccaccatccagccaaagccagccagctttggcacctaagatggcgagtaacgtgccaccactggtcacagcgtcggcaaagctatccttggccgccgctcgcaaaacactgctgtccaattgcttcgccctaatatggttaatcagtgaaacggtgcccattgccaatcctgccgctaagctaacataaaccgcaagttctccgggaacctgcagcttaccttgataccaagcttgcagaccgtgataaccgtcaatgacaacatctagaccgacgacgagcatgattaagccagaaaagagtgttgcgatggtttgaaagcgccagtggccaaatcggtgttcgctgtcaggccgttgttgggaaatctgcaaaccccaaagtaaaatcagcgcagaggccacaccagtcaggttattcaacccatccgcagccaatgcccgagaatgagctaactgcgcgatccacaattctgccacggtcaacccgccatatacaatcagattcagtgcagcagcatgctgggcacttttcaggcgggcaaaccggcgttgttcatcttttaaaatatttcgaccagcatccatgcgacatcctcctgactaaattaatttgtttattaaagactattataattcaaataacgcaccggtgactggttataactttacaaaaggatagtgagagcgctttcttacaaaatttttcacgccaataaaaaaagcccagcaaaagccgggttttatcaagcatcgttcatatcagccgttttcgttttgccgcttcaaagcgcttgtcaatcgttccaatcgagcaatggtgtcatctaaggtcagataataataaaccatattgccttcgcggcgtgagccaaccatgccaatgtctttgagatgcttcagatggtgcgaggtcgctggctgtgacaaaccgatagcatcagccaagtcgttgacttttaagcctgtatcattgtctgccgttcccaaaatcataatcaatttttgtcgacttgaattcgataacgcattgagatgtccaatatcttgcttaaactcttttaaagcctcttgttgcgcagagctatatgccgccattatgatggcctccttataaacgcgtttacgattgcagaaacttgcgtctttagaacacggtatgcatcaaatttcactcataacgaatattacctgaaatcgtaacgattgcaaccaatatgcaaaccgttcatactgaatgcatgtcaatcgattatttttggaggtgccaatatgaccacgacgaccacttttcatggtttgggtgcggataacacgcttaccgtttatgcagatggtgctaatgaactattgaatcaaagcatcagcatgatcaatgcttatgcccatttgttatcgctgtatgatgaagcatccctgctgactttgatcaacaagcaggccggcaaagaaccggttcacattccggttcgccctgtgttcaatctgattgctcaagcgatcgcctggagcaaacgcggattaggttacaacgccttaatcggcccgatcatcaaactttggcgcatcggtttcgatgatgcccatgttccgactgccgaagaagtcactgccgcgcttgctttgactgatcccgatcttgtcgagcttgattcggaaaatcaaactgtttttctgaccaaacccggcatggcccttgatcttggcggtatcgccaaaggtttcattgtcgatcaagtctatgatctttgggacaaaaccggcgttgaaggtgggctgattgacttaggtggtaatcagcggctcgtcggcaatgcagccagcggcgtaccgctatggcagtggccaatcactgacccgcggacaccgagaaaacgcagtattgccaccttgacaaccacccctaaagccgtcgtgacgactggtatttatgagcggcactcagcgatcaacggcaaagaatatcaccatttgcttgatcctaacacaggctatcccgtcgaatcagacatggccagcattaccgtcgtggccgatagtggcctgatcggagacgtgttatcttccatcggtttttatgctggcatccctgccggttacgatgccgttgaagccgagggtgaggaagccatcttcgttactaaagatacccgcgtttaccaaacaagcggcctgcgcgaaaccttggccgtcaccatgtaaaccttagccaccgttgtcttcagacataatagtttgggacatcactcataatcatcaaaaaggcaaacaaattccactgtaaagcggaaactgtttgccttttcttattgtaatctattggaattttaaagatattagtgccaaggcggagcaatcgtaggccagatggggctcagccgtgcaaacaacacagcgaccgggctttgtcgctgatgttgttaggcgacttcgagaccggtttttgggctcgaagcgccgtcacagcgttccagccccgtctggccggagattgcggagtttggcacggcatgagactctttggcctagaccttaccccccgattattcagaatctaataaatcacaaacccaatacgacaattatgccccattcttttatgccaaaatgctataacaaatcacagcattcataaccataacataagcgttaaatctgctgccaaatcacaccgcctgccggtaccatcgtgcctactggcaataaagcgcgcaaactttttggcactaattcagcatgcggatcctgtaacacttgtggtgatccagttggattggccagaactaccagcgtttgggtatcattttggcggacgaagccaaaactgtcttcaaacgtaaatgggaaaaaagcggcacctgcagccaaggctggctgatcaatgcgggtctgaagcgcgatttgataaatatccaaaacagcctgatcttcatggccccatggataaaaggcgcggttatccgggtctttaccgccagttaacccggcctcatccccgtagtaaaggcatggcaccccgggcagccagtaaaatagcgagacgataaactgcaacttacgccgatcaccatccaacatcgttaaaatccgtggtgtatcatgactgccaatgttgttgaaattgaacgcaaacgcatttgttggataattctccttcaacgtcatcaattgacgcacgaatcctgccgcgtttaattgcccatttgtcaggtcaatcaacatggatcgcagcggataattcatgaccgcattcaattcgccgccttcaaaatattgccgccgcttgccataagcctgtttgttggaggcatcctcccagacttcgccgatcagcacccgctccggaaattgatcaagcgtgctgcgaatctgctggataaaatcgtccatcaattcatcggcaacatctaagcgccagccatcaacgcctaagtcagtccaataactgatcaccgaaccttttttagccgcaatgaagtcatgaaaatcttgattatccttattaatggctggcagatccttcacgccccaccagctattgtagtcatcaggaaatcgcttgaatgaaaaccacgaggcatatggggaatccaagctattagccgcacccacgtctgaatattcattgacggcattgaagtagcggctatcagcgccgacgtggttaaacacgccatccagaatgacatgcatccccaactgatgcgctgccgccaaaaactgcttaaagtcatgcagcgaacctaagacttcatcaattgcaaaataatcgccggtgtcataccgatgattgctccgcgcctgaaaaattggacttaaatataaggcgttgatgccacgggctgccaataatggcagcttttgttgaatgccagtcagattaccgccgtaaaaatcccagcgaatgatctcgccatcgttcccgcgaatatacatgggccgatcggtttttcgcccatacagaaaagagttttccttcggagcattcacgtgaccgtcagcattcccattattgaagcgatctacgaagatatgataaaaacgggcattttgataccacgccggaaccggatcaaatgcggtcacaacggtcatctgataattaaccacatccacattttccgggtaaagctgacctagcccgccaaaaccaccgccgaccgcaccaaagcgttcgcggccattgtcgctttgcaactcaaaatgataaaaccaaagaccggcattaggaggcgtaaacgtcactgtgtagccgttagggcttttcgtcatcggcaaggactgcgtttgatcgcaatgttcgtctggcataatgacaagtgtggcttgtgtcaccgcaccatcagcctgtgccgtcaatgtgacagccgtgcctttttgcaccgcgccaaaaggtcggcgatcggtaaatgaatcaaattgaaacattgtgttcctccatgtgtcatgtacacgaaacgttctcaaaaccgataaatgaaccttcattaatcacgcaaccgatagctggattgataacaatgagcgccaaggcatgctgatcagatgctattctacgtcgagtgtttccgataagtccgagctggcgtcgcggcgattcaggctggtggctgcgcggccaactttctgcatgttatctaaaaaacaatcaccagaagtagcctctgtatgaccgctttaagcctcgtgatcatcttctggtgtctttgccaccacatgccaaatctcgcgaccataacgttgaaccgtaaaatcggccgagaatcggccactttcggcaatattagccaacgcctttttggcccaaatgcgcggttgttgataaagcttatccagtctttcgttcgcagccagataactttcaaaatcggccaacacgaagtattcatcgttgtaagtcaacaacgaattgaaaatgtcacgaccttctgtttcaatccccgggatctgcccattgaccagcatatccagtgcggcgtgcaagcgtggatcttgatcgtaaaagtcgcgagcatgataatcgccacgctggtaataaccggcaattgcttcctctgtcaacccaaaaatctcaacgttgtcatcacccacggcatccttgatctcgatatttgcgccatcaagcgtcgccaaggtcaaggcaccagcactcatcagcttcatgttactggtgccgctggcttccttaccggctgtggaaatttgttcagaaatatcggccgcaggaataatcttttcagctatggtgacaccataattcggcaagaaaacaacttgcaagtacttgctgacatctggatcaccgttgaccaaatcggcaactgcattcataaccttaatgatttccttggcataaacgtaactgggcgcagctttagcgccaaaaatgtgcaaacgctttggtcgtttttcgccacgcttgatcgccaagtaagcatcaagaatccctaagacatgcaataattgccgtttatacgcgtgcaggcgtttgatctgcacatcaaaaatggcatcaggatcaactttgacgtgcacaacttgatcaatatacttcgccaatgctcgtttattttcggccttagcagcattcaggtcgtcgagaaaacgggtatcatcggcgaagtcatgcaactgccgcaatgccaacgggttttttcgccaagttgtcccaatttttttatccaaaaggtgggaaagcggtcgatcgccaatctgaatccaacgccgcggcgtgatgccgtttgtcttgttattgaaccgttctggaaagatttgatacaagtcatgcaggacgtcttttttaagcaactcactatgaattggggccacgccattgatcgcatgggaaccaattgatgcgagataggccatccgcacctgtccgttaccaagcggcgcaatccgatcaatcattgcttgaccaaattgcggcacgaaaaccagccggaagcggcgatcaatttcctgaatgatttgatagattcgcggtaccatgccgctgaacatgtcaattggccaaacttccagcgcctctgacaacaacgtatggttcgtgtagctcatcaccttgagcgtaatgcgccaagcttcgtcccagctaacatgttcatcatccattaacacccgcatcagctccggaattgccattgctggatgggtatcattgatatgaatggcaacgcgatctgcaaacccggccatgctgttatgggtacggcgatagtgccgaacaatactttgaatcccagcactggtaaagaagtactcctgccgcaatcgcagctgcttgccggatgcatcggaatcgtcaggataaagaatctgtgtaatctgattgatccgttctttttgttccaacgtaaaatcggtgccggcattgatcggtgcttcagcagaccacagacgcaggttattcaccacctgattgtggtaccccaccatggccacatcgtatggtacagccaatacatcgtcagtattgtgatagatcacccgcagattgccgctacgacttgggcgtaactcaacccagccgccgaatttaaccgtgactgcgcgattttctttacgagtctcccacgcaaagccattccgcatccaatcatctggcagctccacttgatacccgttgacaaaggcctgcttaaacagcccgtactggtagcgaataccattgccgttaccagccatgccgacactagccatggcatccataaacgctgatgccaaccgacctaaaccaccattgcctaaacctggatctgcttcagcatcaaaaattttctgcggccgcagtcccaactcattcaaccctgcttcaacttcactcagaatgccaagatttagcaaattcgactgcagcagtcggcctggcagaaactcaattgaaaagtagaagacctgtttcgtctcctcctgatcgtaacgtttcttggtttcggcccaaggttggccaatatatgaccgcgttaatagtgccaacgcctgataaagctgttgggtggacaggtcatcgagcggtgctgcatacagcttcaaagcaatatctttgaattctgtaatgaattgttcctttgttaatgacataaacacacctcaccaaattaaatacagcaacttttaaacgcaacgcaccccgggagtgacaccatgtcgttgtacccacggcgactccaaaacgagccgaaactcattttgataaacaaaacgaggtcggatcgggtcaccttgccagccggtttgacgcatctacgcctcgcctgccttccgactgatcccgacacgacctcgctgttggtcacctcatgctttgcccagaatgcgttgataacctttcaaatactcagctgcggaatggtgccagtcaaagtccttcaccatcgcatgttgttgcaacttagcatagacttttggctgatccgcataaacactcttcgccatgcgcagaatgtttgtgaacacgcctgcgttgtaatcccagaaactaaacccatcaccagcgccagtttcagcgttataggctagaactgagtcacgcaaaccaccagtttcatgcacaattggcagcgtgccatagcgcatcgccatcatttgtgccaagccgcttggttcaaaggcacttggcatcatgaagtaatcggcgccggcataaatccgctgcgctaagccttcatcaaaatcaatccgcaccgccaattggccagggaaccgatcctgcaatgatgacaaatcttcttccagatcttgatcgccagtaccaagaaccacgacctgtacattattttgaactaagaaattctccaaagcatcaactaagagatcagcccctttttgccgggtcaagcgactgaccatcgcaaacagcggatcagtcctctttggtaaatgcatctcgtcttgcaaagcctttttatctttggccttgccagccaaattcttggcgtcgtaattataagccagattctgatcagtggctggattatagacttcagaatcaatcccattcagaatcccgaccagtttaccactttgttttcgtaacgtgccatccaaatgctcgccaaaggctggtgtttgaatttctttggcgtaactcgggctaaccgtcgacacaagatcggcgtaattaatcccgcccttgagccaattgattgacccgtcttgaccaaagccatcgtcgttgaaaccttcacggccaataccaaaaacggtcgctaacgttgacggcgggaaccagccttggaattgcagattgtgaatcgtcagttgtgtcttaatctgttgatacggcttgatccaaccatacttttcttttaatagcaccggaatgaaagctgtgtgccaatcgttggcatgaatgacatctggaatccattcaatcacctgaagcatttcaatcacggccatttggaaataaccaaaccggccgccgtcatcccagtaaccgtacaagccatcccgatcaaaatactgccgattatcaatgagatagtacgtgacatccccgagtttaattgttttaaggccaacgtaaactggacggccatccatctccaaggtgaaatgggtcaaatccttcaccttaggcagatactttgccggaaacttcttttcatagaatggaatggcaacccgaatgtccacaccttgcttcttaattgctttaggcaaggcataggttacatcccctaaaccacctgttttataaaacggcgcactttccgcagctgtaaagagtactttaagcacgggccgtcaccccctggccatctggctgaaagactttctgattcttcgaaaagaccaatggctcctcaggggtcccttccaacgcaaggtttggcccaatgaccacgcctttgtctaggatcgcatacttcacactggagcctgtgccaatcttactgccttgcatcacaatactgtgatcaaccactgcatcacgatgaatatgcacatttctgaagagaatcgaattatcgaccgtaccttcaatgaagtcaccagtacctaacaagctgttggtcaccttggattcggttgaatagaaggtcggaatttcattcttattcttcgtttcaatcgaattagcactataaagcaacgcttgatagttttggtcttccaacatgctcatgttcgcgtcaaaataccgctgagtcgtattcagctttgccagaaaaccagtatattcaaacgcgttagcattattttccagtacggcttcacgtagaatttgcggcaaccgtttgaatgttggcgcttcggaggcatccgtcagaagatcaatcaagtcaatcgtcccgatcagataaatatccatgaacgccgggatcttaccttccttgagatgcccacgattttccgatgctgggacaactgagctagccgtgccaagctccgtcatatccaacgttaagtcttccggcttcatcgcttcttccggcagattcttgtaaaccgccgtcaccggactctcgccagcttggtgataggcaacgatggcatcgacatcgacattggccacattttgtgtacccatgataatcgtgtactgcgcgctgcttttgcgcagaaattgcagatagtcgtcaaaataccgcgcgcgtaattttggatcttcatagtcgcggccagccatatacggatacgtgaaaataccaccagtaatctgatccatgttccaagtcgacccgctacgaatgtggtccgtgacactacgaccggactttggcaggaaaatcgccacgctgcgaacattggcatgatccaatgatgacagtggaaaatcgatgagacggtagcggccagcaaacggcaaggtaccgatcgggcgggctgctgtcagcggctgaatttggtcgtctggttcattcagatcaataattgctgctaaatcgccttttctcattctttttcagtccttcctaaaacttccccataaccaacaacgctaatttcattcggtttgccgacaactttaccattgtccccaataatcgcattttcaccgacaatggcatgatcgacagtcacgttcttaccaataacggcgtttggcatgatcatgctgtccttgatcacggagccttcaccgattttgacgttttgactcaaaatactgtgctgaattgaacctgcgacatagcagccgtcaacaatcatggagccagcaactttggcggtcttggtcaggaacattggcggcagcgcctcgttttgactgaagatccgccagttgcgattgccaatgttcaatggattgttaggattcaaaaattccatgttagcttcccacagactctgaatcgtcccgacatccttccagtaaccgcggaaggcataagcatagctggcttcattatgcgtcaggtaagctggaatcacgtcatggccaaagtcttccatggcaccatctgttgcataactttcggtcaaatattgtttcaacgtcggccagttgaaaatgtaaatccccatcgaggctaagttactctttggcttggctggtttctcttcaaattcaataatccggtccgtgtcatcggtgttcatgatgccgaagcgtttggcttcttctttttcaaccggcatgacagcaacggtcaatgaagccttcttggccttgtgataatccagcatcgcttgataatccattttataaatgtgatcccctgaaaggattaacaaatattgcggattgtaggagtcaatataagcgatgttttgataaatcgcatgcgccgtgccttcaaagaacttttcgccttcacttgaagcgtaaggctgcaggatggtcacaccggcaccgcgttcattaagcccccagctggcaccattttgaatatggcgattcagctcaagcggttgatactgggtaatgacccccgcggtgttgacccctgaattagctaaattactcagagtaaaatcaataatccgatatctacctccgaatggcaccgaaggcttagccgtcgttttggtcagtttccctaaacgggttccctgccctccggctaaaatcattcccaacatttcagtactcatgattgcggcgcattgtgcgccttcccccctaacttcttcgattgctgatggttaactttgctaatgtcacgtggttgcgaccgcgctggcgatgtgccccagtcgtcttgatgactaatcggttgccgttgatgaccggcgagtgacaacggtgtttcgtgtttcggtaatgccttggttggctgcttgcctttaagtgccaacggttttttcggcaacggcttcagctgttttggtttaatcaacaaagcgcccatggctggtaaaatgacgtcaagccatgcaggaacgtcatggttttcgccaatctcagcagtcaaggtctgctgccacttggtccatgtaccgccaaaagccgcatcctcagtatttaaaataatctcgtacgttcccggactaggaactggcacgcggaaatgatctttttgaactggcaccagattcatggccactaccgtaaagtcatctttttgtttgccataacggatgtaactcagcacatccggctcatcggcaatcgtgattttgatgccgtcgggttcatgatcttgttgccacaaacttggccgagctttataaagatgattcagtgtggtggtgaaatgctgcatcttcttattcattgggtcgttaagatcggtccattccagctcgctccagtcgcgccattcaagaaactgcccccactcgctgcccatgaataatagctgtttaccagggaatgttgcctgccacacatacatcgtccggagattagcaaactggttataccgatctcccggcattttgtgcatcaggctctttttgccatggacaacttcatcgtgtgaaaacggtaagacgaattgctcgttatacatatacatgaatgaaaacgtcaataaattcatatcactgtggcgataaaccggatcctgctcgaagaacttcagcgtgtcattcatccagcccatgttccacttgtagttaaaccctaagccgccagtatcaatcggtgctgaaacttgcggataggcggagctttcttcagccatcatgagcacatctggatgtttggcaaaaatctttgtattcaattgcttgataaaggcaatgccttcaaggttgtcacgcccaccatccttgttgcgatcgttttctttgccagcgtcataatccatgtacaacatgttcgagacagcatcaacccgcagaccatcaaggtggcagtgatccaaccaatacatcgcactggaaattaagaaactctgcacttgtgccttgccaagatcgaagttccaagtcccccagcggacattttctgcgcggtgcggatcggtgtattcgaaggttggcgtgccatcaaattgggccaacatatcggtgtttttgatgaaatgccccggtacccagtccatgatgacgcctaatcctgctgtgtgagccgcatcgaccaaccgcaagaagtcttgcggatcgccgaaccggctcgtcggcgcgaagtaacccattaactgatagccccatgaagcgtcaagcggatgctccatcaacggtaaaaactcaatgtgggtgtagcccaactcctgcacataagggatcagtttgtcgatagcgtcttgatacgtcatatagccgccatctggaccggcattggtgtcgcgaatgaaggagcctaagtggacttcgtaaatattaagcggttcatcatacggacgccattttgcccgcttggctagccaatcttcatcatgccaagtaatgcgcggcacatcgaccaacttagccgcactgcctggcttgcgttcaaacccaaacccgtatggatcaatcttctcatgggctatcccatcaggaccgataatccgatacttgtataactgattctttgcggctgcaagctcaccataccaacaaccggtggtgccttgcagtttcaacggactgccttgccagttgttgaagtcgccttcgacgttgacttgttgggcatgcggtgcccaaacgaggaaggaccacttgcctggttcgacttcatgggcgccaaaccgattgtaactttgaaaatcttgcccggagttgaagaggtataaccaatcttttaatccctgaatcatgatcactcccccaatcaaacgataccgtcgtacatgtgaaggcttctcattcactgtacggccggacttttacctaccagatcaagtgtaacagtaagactatcaaaagactcaagaaacgctcatcaaaaaccttcacgcacgccaacataaattttttgataaggcatatactcccagtcctcgtctcaattgtaaccgcttactgttaatattaacagcgattacaatcttttctgttgagttctttgtgagaatactctaacatgataggtatattatttaatgaaaccgcaatgttcacgcaacgttactctgaaatcaacctcagccggctgttttcagtcagacgcacacaaatactggaggtactgccatgagtgtcaatattgattggaacaatctaggcttcgattatatgcaactgccataccgttatgttgcccactggaaagacggggcatgggatgaaggtaaactgtccaccgatcccaacctgacgatgaatgaaggctccccgattttgcattatggtcaaggcgcttttgaaggtatgaaggcataccggaccaaatcaggaaaaatccaacttttccggcctgaccaaaatgcccatcgactgcacaattctgctgacaaactactgatgccgccatttcctgaagatcgctttattgatgcggtcaagcaagtggttgccgctaatcatgaatacgtaccgccatatggcaccggtgctaccttatacttacgcccgattttgattggtgtcggccccaatatcggggttgctccggctaaggaatacattttcgatgtcttcgccatgccagtcggcccctacttcaaaggcggcatggtgccaaccaagttcatcgttgccgatcaattcgaccgggcggcgcattacggcaccggccaatcgaaagtcggcgggaactacgccgcatccctgcaagccggtaaattcgcccacgagcacggttatggcgatgcgatctatctggacccaattgaacataaatatattgaagaagttgggtcagctaacttcttcggcattagcaaagatggtaaaactttgaaaacaccgaagtcaccatccatcctgccaagtatcaccaagtattcgattttggcactggcgcatgatcggtttggcatgaccactgaagaaactaagattgcgattaccgatttagaccaattcggtgaagccggggcctgtggcactgcggcggtcatcaccccgattgccagcatcacctacgaagaccacgaacatgtcttttattcggaaaccaaagtcggtccatatactcagaaactgtatgatgaactgacgggtatccagtttggcgatgtaccggcacctgaaggctgggtcgttgacgtcccgtttaattaatttaaaaatcatttatcactcggaaactgtgagaacttgcacgcgctataacgcatctgcaatcgcgtacgcccgctcacgcttccacaaaaaaagcagctgcccgttttaccggcggctgcttttttgtgaggaaagtcattttgcctaattcaacaatataacagtcaatcaattcaaaacttactaagcaactttacgaaaaagcctggaacctgacaacctgaaattgaaagccaaaaaacaatggtgatcactcaacagccttaacgtgcaaaggcaatcaagcgccagtagttacctacgcaagtttgtaaggtaatgcgctgaccgccgccagtacccgtgattgcgttccataaatcttgtccactggcagtgacggcatttggattcactgtcgccaattgataaacatggtacgtgcgcgggttaccagcagcgtcggtcactgtgatcggcgaaccaatgccaagtgatagcatcgcggcaaaagaaccaggattgtggccaataaaatgcgtgttttgaccactattgttactataatttgcttgaccgccccacgttgcagctccagtgcccggtgctgcagtcatactttcatttccaatgatataaggcactgtcacacctgcaaacattaggacgcggctcgcgtaagcaggtgcttgctgtgcttgcggttgtgctggttgttgagcaggttgagttgccggttgttgttgcgccggttgggcagcagtcgcggtttgtgctgcagacggagctgccgatacagtcacttcggcagtagaagtcgaagcccctgtgtttgaatcagatgaatcagaagtagcaacagcttgttgactagccggtgcgcttgaagcaacggatgtacttgccgccgtctgtgatgatgatgcagcagacgttggtttagtcactgaaacagtgcgaacgctccattgcggatgtgctgcagcctgtgatgcaggtgccttggcagcagtggcatcaagcaaatcgttagaactacttacagtattaactttctccctcgtgcttgtgcgcgatccggccaagtcttgacgctgaatggtggtgcctgctgcagtggtgataagcagcccactcacgacaagagcgaaagtgatgagacttctgcgtaacatatagactcccccagtccatatcggcaaaatgacttaccacatattcttttcgagatggccatctcatgcttttcattatggcgcattagttttgtaggtaaacatatatgcttaccgattgtaagtgcttaacgttatttttaagttaaataatccttatttcatgcatttatcagtgtttaacgccatatttgctaaacattcttttcaaaagttggttaaaaccgttagcattcaaaccgacttttgagatttaaccgtctgatttctaaccaagcgactcacgcttatcaaaaaactgcgacaacgtccgaattttttcgggaacgctgtcgcagtttaataccatgatgaagcttaaatactgccgccatgaacctcagttgctgccatggtcaagatgaaagcattgggatcaattgcgtggactaagtcaatcagatggcggaagttggcttgttcgaccacgaccatcaacatctcctttgactcatccgagaaaccgccaacgacgcgttgcaccgttaagccatgcggcgtttcgtcgcggacttgctgtttaatcgtcgccaattgcggactcatgatgtaaactgcctttttccggtcaaaaccggtttcgacataattcatgaccagtccggtaatcgccaaagcgaacacggccaagatgaaggcctcgacgccggatacggggatgttaaaaagtgacacgatcacatcagtggctagtagcatgactgatggtttcaagccaaagtattttttgaaaatgagcggcggaaccgtggtcccaccgcttgaggcatccatttggtacaggaatccaacaccaaaggcaaacacaacactgccgacgatgatcgccagcaaccgatctgtgaccaggttgatttctggcgtcagccatagcagcaatggcaacatgaagctgccgaataaaatgcgttttaaggtgctgcgatccaagaagaaccaagctaaaagcagcataagcaagttgacgcccatggtggtgataccgacttgaatgccggcaacttcttgaaccaaaatggcaattccggttgcgccgccagctgcgacagcgtgaggtgcatagaacatgttaatactgatcgcgatcagctccagcgctgccacgatccaaaaccatttgaatatcggatgacgcatcgttttctgcatcaagccaccctttctgttaatcatgtttaaaccgactcttatcgtagtaataactatactggaaaagtggtggtgtgacaaacaggcgttatttggcgtgtggtttggttttttatgttctatttctgttaggaaattttcgaaagcccgggctggctacgcggcgattcggggtggcgaccgcgaagctagcgcactgggcacgacttcaagcccgcaaagcccccgcggtcttgaagctcggccttggtctaggcggagaaaaccacgccaccaagaccaatttcagtgctgagcccatcgccgctccgccagccctcatcattctattctagaattcgagagaagttgacgctcgcactgttaatgaaatgatgcgaaataacacctgcttaagacagccaacccaagatataaccgccaatttaaaaattagggaaccacacctagacaatacccacgctttctagtcctcttcccgcaattcacccaagcgccgcttcaatacctcaacctcatcctgtagctcagtgccgatgtcggtttccgccactgttcggcggcgggcttcggtttcgacgacgcggcgggttgaaatgatatcggtgaggttggcgatagcatcggcttttgtggtgaatggttggtgcgtcactagttgcataccataggaattatccaaaagcgtgtagccgccgatcccggtggttttttgatacggtttagaaaagccgccgtcgatgacgatcattttgttgtttgccataatggggtcggtgccttttttgactggcgtatgcccattaatgacatggccgacttcaggatcgaggacaaattccgccaagatctttttgataaattccgggtccttacgcaagtgataatacggattacgaccttcgacatgggctttcggatcgctaatgaaatagcgttcaaaggtcgtcatgtcgtgcttgccaaaaagcggtgaatttggaccggtccagagataccacatcagatcagttgctaagtccgcattctccgttggttgactgtatgccaaccgaagatttgcttccagcatgtcaaatagttgacggccagtataagtcgtccctttaatggtcaagccaataaaattgccatcctcgtccaccggcacacacccgtgcagcaacaaattccggttgtaccgtaaatacatactgccgtgatcaagtaaaaaatccatgtggcgatgcaacttttcagagtgcgtaaaggactcaaccagcgagtcaatgacctcttgctcctctggcaacaacttgtaaggatcagccggatcaaccgtcgcaaaacagccgttttcaatcgtataagtatcaccattcaacttgatggttgagaaatcaggcgccagtttctccagcactagccgatgatccatgtcaaattcaggccgacgtttaatcactggtccttccaacttaaattgaatcatcgcaatcgcctgatgaatctgggtaatttgaagtcgctccgcctcagtaattggtcgatctgatcgctccatttttggtgaaaaggcgggattatcttgatagtattgttccgctaatcgggccaaatgccgcaaattaatcccataaacatcttcgagaatacttaaattgttataccgcgcggaaatccgcaccaaattggcaatgcacaaagccgagcccgcggcgccgccgatccaaagaatatcatggttgccccattgaatatccactgaatgacgccgatcacgtctaatcaagctttcaaccacctgatccggcgccggtcctcgatcatagatatcgcctacaacgtgaaagtgatctaccgttaaacgttgaatcgtttgacacgttgccgcaatccactgatcggcctgttcaagaacgattaaattacgaataatttgccaataataagccagcttgtcaggcgtatcggcatcattgtacagcaactcttcggtgatgtagacaaactccggtgccatcgccttgcgaactttcgaacgcgtgtatttggtcgcggtgaacgccagcaagcgaatcaaccggcgaaaagtcgtcaaataccactgttgcaagtcatcccccgccatctcccgatgaatcgccgccattcgctcagacggatagtacaccaaaaaagcgaagcgctgcagggtcgcctccgtcatttcatcgcgaaaacaggaacgaattttgcttttcacattcccgctgccgttccgcaaaacatgctgaaaggcgttatactccccgtggatatcgctcataaacgcttccgtcggcttaggtaaattcaaaatggcttccagattaatgatttcagtcgcaatcgctggcaccgtttgatacttcgccgtcagttcactgtacaagtccatgaaacagcttcctttcacatataccaattttggctcatggcaatatcatagcataatcctctaaaatgtatacggtttcagctgatttcaccattcccgcttgaaaaataacctctgattcagctctgtcgtcactatcatgtcctaacattcatacaaaaaacgtccaaatactccctagctaatagtcaatgatgaatgtccaacagtaaacagcgaccagttctcgctccaccatcatcctgcgattgtcaattgctcatcaaaaccaactcggtaacacccaaagcatacgcaccaaggactcctcacccatgacgctggggccaccatacgctaatgaccaatcgcatcaaaaagcacaaaaaaaccgtctaactatagacggctttcattgaaacaactagtaaaactaacctaactgtgcgcgtttttaaacacttgaggtactgagtaacgccgcccacaacttctggcgccgaacttcgcgtggtaaaaatacccgcaccgagtcctgattgaacccaaataacagacgacgatcgtccacaatgatcggccggcgcaaaatcgctggatgctcggacaaaagggcgaccgcttccttcaacgacaacgcatcaaagtcaatatcaagggcctgaaacgcctttgaacgacgggaaactaaactatcaatgccatcttccgaacgagcgagcaattccaaaatctgcggcttgctaataccctgctttgaaagcgaaatctcttgaaacggtaatccatttgcttcaagccaagctctagcttcacgactcgattttgacgagcccgatgtatacaacttgatcatccaatcacctctcaacgaaacaacaattatttattattgtttctttgccaatatcacccacacattagatgccaatcacaatcacaagtcaaaaagatttactcacgacacgtttttattctctttataataacttaccatagtcagatgatttttacaataatggtactcataatttcgctcatagccatcagtgccagctaatcattgaaaagccatctaaatcatctttcaaaatgagaagtccctcctgaataaaagtagtaaagcccataaataacaattgcacgaacataaaaatcgtcatgatttcttgtgaattactagcacaatccttgatacattatttttgcatcagcggttagtacacaacaaacttagcacaagcttatatcgctttcaataacattttttcgaaaatttaatttcaaatactaacaattaaataaaatcgatgacaggaaagcagcaaattccttagaggctcatggcatttcgaattgattgaaaatcatcgactgccaaaattcacaaaaaaagctgtgcacaatttattttaaattttattatacggcttattgtagaccaaaaaaaaaccgccaagtgcatgtgcacttggcggcagacgcgaacattacttcgcaccatcggttactttctttgatttaacagctgtcggttgcttctcgctaatcacaattgcatcatcaaccagatcagcttgcaacttcttagcctttaaatgatccaaatagaagtcagtcaccttatcacgaatgttgcgttcgatcacacgccgtaatggccgtgcgcccattgcttcatcataaccttgttcaatcagccaatctttagctgctgcggtgacagttaacgtaatccccttcttggtcaaggtggcgttaacgtcatcaagcatcaagtcaacaatcttacctaaatctttcttggtcagatgactgaactcaacgatcccgttaaaccggttcaggaattcaggacggaagtaaggtgccaaccgcttcatcagatcttcgtcttgctccttcttgccagtcagcgtctcgttgccaaagccagcattggaagtcgcgatgatcactgtgttcttaaagtcaaccacgttaccttgaccatccgtcaaccgaccatcgtccagcacctgaagtaacagagtcaaaacttgcggatcagccttttcgatttcatcaagtaaaacaatcgaatatggattgcgacgtacttgttcggtcaaggtgttgttgttgtcgttatagccaacatacccagcactggtaccgatcaacttggacactgccgtacgatcactgtattcagacatatccaagcgaatgatcgcatccttgctgccaaaaagatctaacgctaattgcttagccaactcagtcttgccgacaccggtaggcccgacaaataggaaactgccaattggccgattgccttcatcaaaaccggctcggttgcggcgaatggcgcgagcgaccatctcaacagcttcatcctgaccaatgaccttgcccttaagacgcttaccaatacccttcagacgttcaatatcggaagcgccaagtttggaaactggcacaccagtcaagcgttcaaccgcagccgctacatcattaggcgttgcaacgacaggcttctcgtctttcgtaccatcaagctgatgttgcttgtcggcaatcgtcttcttaaggttagcggctttttcgaagtcctccgccttggccgcagcatccttttgagcgttcagatccttaatctgtttctcgagttcaaccttatctacaatcggatgcttgcttgccaaatgcgccgccgtcatgtcaatcaaatcgatggctttatccggcaatgaccgctgtggtatatattggatactgtaatcaaccgcagccttcaaaacattttctggcaattgaacgtgatgatgctgttcataaagcttcttgatgccttccaaaatcttaacggtatcagccgcggtcggttcattaatggtgacatcgttgaaccgccgtgccaacgcgctgtccttcatgatcgtgttacgatactcatcttgcgttgttgcgccaatcacagtaatctcaccgcgagatagcgccggcttgatgatatcggccaaccctttgccgccagactcttcgccgccagtcgcaccggcaccaagaatttgatgaatctcatcaaagaacagaatcacgttgcctgccgctttgacttctttgatcagattctgaatcttctcttcaaaactgccacgatactgcgtgccagcttcaaggttcgacaaatcaattgaccaaatctgcttgtccttgatcgactcgggcacattgcctttgacaatcgcctgcgccaaaccttcaacaaccgccgtcttgccgacaccggcatccccgaccaaaatcgggttattcttcgtccgacgactcaaaatttctgctgtttcttgaatttcatgctcacgaccgatcacaggatcaagcaaaccatccttagcttcctgcgttaaattacgcccaagcttttcaagaatgccaccttttttaaccgcttgttcaccagtcgtttcaactggaatttcgtcaccttgcttcggcaactgcccagttgcccgatactgtgcgaattcatctggcgtcatttcgtgaccatttaccacataacgggcagattcacctttgcccataccttgtaacatttgattaaaaacatcatccatatcatgattgaaaaacggatcgttaaagtttgccataacttcattcctccttgttgggaaagtgctcggaaaaggcgtggatgctgagaaagtgcggtgcaactttctaaaacgcgctcacatgttgcaggaacctccacgtaagggccctgaacccaaatgaccaaacccgggtcaatgggttcagagccacttacactccggtttctaaccgctcatgttcgcactcttccatagcaaaaagtactcccaggcgcactggcagtacttttgtgtcgaacttattcacttgttggcacgtttgccgttgcaccttttccttgtttacataaagtagtatagcatgattttagcactcatgcaatgagagtgctaaaattttccaaaactattttcataggcaaacaaacaggccgtctaataccgtgacaaaagccgcttttcaactttatgctcattaaaacgatcacggttaacaaacggttgcgcatttccttcaaaaatgtgtgcctttttctcaccactgcagagattacgagtgtgcataaatacatttgacataaagtaaccaaaactaagagctgctcagcaatgttgactttcaacattgctaagcagctcttttcgtttctatacatagaagctatagaaatctacttttcaatcacctgcaaaaactctttcaaagcatcctgccaagtctcaatcttgaagcctgtcgctttggtcttgcttagatccaagattgaatgccgcgggcgccatgccttttgcggatattctgcagaggagacgggcttcaccgtcacgtctttgtttgccaaaatggcactcgcaaattcataccagttacagctgttatcattggataaatgataaatcccataggccaacttttgatccactgcgaaggtcatgaattcggctagatttttggtccatgatggtcgaccatattgatcatcgaccaccgtcagctccttatgcgtcttagcgagatccagcatggtataaacaaagttgtgaccatattcgccaaacacccatgaagtgcggataatataatacttcttgaggtatttctgaacctgctgttcgccttcatacttagcgcggccgtattcgttgcgcggtgccggttgatcatcaacggtgtaaatatcttttttgtcgccatcaaaaacataatccgtgctgatataaactaaagtggcgtcaatggccgctgccgccttggccaaaatacgggtgccgtcaacgttgaccttctgattcaacgccttgccttcatcttcagccttgtccacagctgtataggcagcacagtggtaaatcagatcaggctgataatccttgaaatactgatcaaccgccttttcatcagtgatatccaagtcatgggcatctgtcccgcgataggcaatatcgcgtgaatcaagcaaatgccgtaattcggtgccgagttgaccctgtgcaccggtaatcaaaatcttcatgtctcttcccctctacatctacaaactaacgaaacaacgattgaaaataatcatcagtcttgatctagcagggatcattgaccgtgttcctgatacttttcttcaacagcagctttttcatcttgccaccagtcacggtgttcggtgtaccacttgatggtatcggccaagccttcttcaaaatcggtgtactgcggcttccagccgagttcttcacgagtttttgaggcatcaatagcataccgcatatcatgacccggacgatctttcacctgatcgtaatagtcggttggcttgcccattaacttcaagataagttcaagaaccgtcttattgtctttttcgccgttggcaccaatgaggtaggtttcgccaatcttacctttggtcaaaatgtcccaaatggcagatgaatgatcattagtgtgaatccaatcacggacattcttgccggtgccgtaaagcttgggtttgatcccgctcaggatattcgtaatttgccgaggaatgaacttttcaatgtgctggtatggaccatagttgtttgagcaatttgagatcgtggcccgcaccccaaatgagcgtgcccatgcatgtaccaacatgtcactagcagccttcgttgaggaatatgggctagaaggattgtaacggctgttaactgtgaatttctcgccaggaccttcgccatggccaggcaaatcctcacgcaacggcaagtcaccataaacttcatccgttgagatgtgatggaatcgcacatcgtattttctggccgcttcaagcaacgtataagtaccgatcacattactatgcaggaatggatctggattaatcaaggaattgtcattgtggctttcggccgcaaagttgacaaccgtatcaacttttgccatccacttgtcaacaacggctttatcggcaatatcgccaaccaccaattgcacccggtcgccaagaagatctgcaatgttggccttgttgccagcataagtcagcttatcaagaacaatcatctgaacctctggatgatgacgatagacaaaatgaacaaagttggagccgatgaagccggcaccgccagtaatcataagtttcattattaaatctccccgtaaacaaaattattttcagcatctttgagttgcggatgcttcttgtctttatcagacataattaagtgatctgtcgacattggccattgaatcccgatatccggatcatcaaacgcgatcccgcgatcagattgcggggcataaaagccttcaactttgtagcagaaattgacattaggcgtcaacgtaataaacccatgggcaaaaccctttggcacgaagagttgccgatgattgaactcgcttaaaatgtacccttcccactggccataggtcggtgagcctttacgaatatcaaccaacacatcttcaaccacaccagtcacaacccgaaccagcttggtctgggcatcaggcgccatttgataatgcatgccgcgtaaaacgccagcttcggctgaaagtgactggttgtcctgattaaaatcattcgtgatgccagcggcaagaaacttatcacgcgtgtaggtctcggtgaagaagccgcgattgtcgccaaaaacatcggtttcgactaatttaacatcttgtaacttggttggaatcacttttaaactcaaggttctgcctcctaggctttttcatctgctaagcgcaggatatattgaccataatcattctttttcagtggctgtgcaagttcacgcaattgatcgcgatcaatataacccatccgataagcaacttcttcaagacaggcaatttttagattttgacgtttttgaaccgtttcaataaaaccggctgcttcgtgaagcgactcgtgtgtgccggtatcaagccaagcatagccgcgaccaagcaattcaacatctagctggccacgttccagataggctttattcacatcggtgatctccaactcgcctcgcggtgacggcttcatatttttggcaatgtcgacaacctgattgtcataaaaatacatgccagtcacggcaaaattgctggctggatgttccggcttttcaacaatcgacttaacgtgatgttcgtcgtcaaacgaaacgaccccaaatcgttccggatcgttgacttgatagccgaagacggttgcgcccgaggtcttcgccgctgagcgctgaaccaacttggacaacccactaccgtaaaagatattgtcgccaagaatcagacaaacagaatcttccccaataaagtccgccccgactataaaggcttccgcaaggccgtttggtttgtcctgtaccttataagtaatgttaagccctagttgcgacccgtctttcagcagatcctgaaaacgatcaatatctcttggcgtcgaaatgaccaagatatcccggatgcccgctagcatcatggttgataggggataatagatcattggcttgtcataaactgggaccaactgcttcgagatggcttctgtaatcggatacaagcgtgtacctgatcctccggctagaataatacccttcattaactactcctcctatacgttcttaatgttttctaaaaagttcacaacaaaactttgacttaatgcaaacctaagccataaaatttattttatcagtttatacacaatttgttacccttactttgagtactataacaaatttcaaattaagccggatttaaaattaatccagctatttcatcgcaaacacagtggaaacttaataccgtgataacaatcttttttcaactttatgttcattaaaccgcaccaacggatccccgttaacaagtgcccgggcattctcttcaaaaatgtgtgccttcttctcaccacgtttgcgagttaaccgcttgaaggcatcactcatttcgtagctccgacctggcaaatgatgggcgtcggacgcaaaaacatgcgccaaaccagcatcgatgatatcttcagaaaattgctgcacctttttgccaaacgtgcctacataactgctggccgtcacttgggcaaacgcaccgcgttcaatcatctggtaaagcaaccccggatgcttcatcaaacgagtattgcgctcaggatggacaatcacaggaatcatcccacgctgcatcacctcaaacaacatgttttgggtatacagcggcacatcatcagacggaaattcgatcaacacataatgacccgacgcgtcgcaagtcaaaatatccccatgatcaatcgcgtccaacaactggccattaatccgaacctcttggcatggataaatcgtcaacggaatgttgttgcgatccaactctccttgaaactcgtctgtcataagaatcacatccgcagcgtgattcgtataccgtccattcatgtggtgcggggtcatcaacgcatgcgtgatcccgtccgcaaccgccgcttgtgctaaatctaatgaagtcatcaagtctttcgacccatcgtcaatgcccggtagcatatgacagtgtacatcaatcatctttcagttccccttccaatatgtactagtatctaatgaagcgctgacaaggtcaaatcgttttttgtaacagtttgttaacgatttgcaataaaaccccatcagccgcgcgagatttcaaactttgcggtataatattggaatattcggacactatggaggaaatgaggtttagaaatgaaaaagattctagtacgcgttttactcgtgctactcgttgccgctcttgggtttggcggtttcgtgtattatatggtacataattctacgtcccagatttattcttataacaaaaagacgaataaatcgtcggacgataaaactacaagtaaaaagcctgtgtcctacttattgcttggaacagacactggtgcgctcggccggtcatataaaggtcgaaccgataccatgatcgtcgtcgtcatcaaccccaagtctaaaacaacgacgatggtctctgtcccccgcgatacaaaagttgattttgacgatgtaaccatcaagattaatgcagcatattcctatggctcctcagatacggctatgtcagccgttgagaagcttttgaacatcaaattggatggttatctgctcgttaacatgaaaggccttgagcagctcgttgacgctgtcggcggtgttacggtgacatctcctctcagcttcaactatgaaggcaagtcatttgttaaaggacaatcgtatgatctttcgggaagtgatgcattgaagttctctcggatgcgttatgatgatccgcaaggtgattacggtcgacaaatgcgtcaacagcaaatcattacggcggtaattggcaaacttaaatcgaatccaacaaccgttattagtcaaaagttcttagatgccgttggcaagaatgttcgaaccgatgtctcgcttggttcagttaaaaatctagcgactgattatagagatgccggcaacacgatcaagagtgatcaattgcatggtactggtcagaatattgatggtcaggcttttgaagtaatgtctgattcggaaattacgcgagttcataacgttattcagaatgcgcttgattctaacaaatagtctgtgcagtatttgacgagattcaggaatccctttagtgagctaaggggattctttttaagctttaaaaaattgcctccaagtataaatttatgaaatcatctagtcacattcgcataacaagtcagggagaaatcatgtaccgaatcacattattatcacctttttttggtgaaaaatttccgccaacatttccaatactccttaattctctaaaggataatccaacaattaaatttgttattccgacggatattgatttttcaacgattgacaatatttcaaatgttcaattcgttaaaaccagtttgccagcactcaaacacaaaattgatttaatgcttggataccatgcccatataataagcccttacaaattggtcgatttcaagcctacctacgggatcttgttcaatgaatatataaaagactcagagtggtggggatattttgatatggatcttgtttttggaaacatttcacgctttttaacagaggatcttcttgactcgtacgaccgtatattcactcatggtcatctcactttatataggaataatgaactcgtcaataatttatggaattataaatatcacctccatgaggttccaaattttcaaacggttgcaacacataaggctatcttcgcctttgatgaatggggttggggtaaaaataaaggccgtgggatatcttacgctctgcatcaagttccattagttcgtcaatttgatgatatctcattctttgcagacttaactccgaatctttttagctttagaacaacgaatggaacaaacattacaaaatttgaatactatcaaggtagtttggccggaatcgatcagttacaaaataaacatccctacttgtacgttcatttccaaaagagaaccatgactaacgacgtaacggattacactaagccaatttatattgttcctaatatgtttttaaacaaaataccagtatcaattgatctaatgaaagaacgatcagtgtgtgtcaagggcggttttgaaatgtaggtttatggcggtttaaaaatgtaggttttcggcggtcaaccgacacctttcaagcggtacgatttgccggtaatcttcacaacgtggacatggtgaacaaggcgatccagtattgctgcggtaacggtgggattttgaaaaatctcaacccaac

SEQ ID NO: 15 - DNA, 24867 bp, Lactobacillus paracasei
atcgaaggggttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttgacgcagagccccaaaaagggttaaacttcttcttttacagcgaatcgggccaacttacctttttgtactgggttgacgacagcggtaataagcgtgccatcttcgcggtagtcagtggccttgacgacagtttcctgattcagataactgacgagttgaccttgatcaaatggaatcaggtaggtgtgttcttcgtcttggccgaagatgtcggctttgatcagacgggtcagggcttccaacgagtttttgtcgcgggcggaatacacgatgcgttggccagtgacttcaggatagcgggtgccttcacgcaaatcggctttgttgtaagcttcgatcatcggaatattttcgatgccgacttctttcaacgtcttttcagtgatagccatcatttccggatagttttcgtcggagtagtccacgacttgaatcaaaagatcggcgttggctgcttcagcgagggtggctttaaaactgtcaatcaaattatgtggcagttttgagacgaagccgactgtgtcgctgagcaggaacttgcgattgtctggcaaggtgagttgccggacactggtgtccagggtggcaaagagcatgtctttttcaaaaacttgtttgtcttccggacggtcggcaaaaagattgagtaagccattcatcgtggtgcttttgccagcgttggtgtaaccgactagtgcaacgacggggatgtcattaccttcgcgccgggcgcggcggacctgatcaccaacactcgcgtctttgagttcgcgacgcagatggctgatccgcttgttgagaacccgtcgatcaagttcaagttgtgtttcccctgaaccacgtgtggcaaaaccagcaccaccaccaacctgctgatcaagccggttggcgctgggatgcagccgcggtaaggcgtattgcagttgggcaatttcaacttgggttttggctgccttgctacgggcacgatcagcgaagatatctaggatcagctgggttcgatcaatcacgtgcagtttggtttgcttttcgagattgcggagttgtgatggcgacagttcatcgttgatgatgatagtcgttgcgtttttgacgtcagcaagttcgcgaatctcatcgactttgccactgccaaaataggtggcggctgcggcgcgatcgagactttggcggacctcgccgacgacggtgtagttatccgctttggcaagttcgccgagttcggtcatggtgtaatcgaagtcgggctgctgacgcgagataccggtaattaaaacattttctgattgaggttcattggataattgttcagtcataaattcctttcattgatccgggcttggtcgccgcggatcggtgctagcagatcatcattcatggtgcgcctgacgtaaccgcatggcgattcacccctttcgattcattagaccaagtgtaacacggtagcccaaatctacccaacattcggtgccaggacctgaatatgatcgctaatcaccttcagcgtcaatggcgttttggtactaggatcgccgtcaatcctgctttgtaaggttttcggtgtcttgatggtcaactctttggttgcaaagtaggtcataccgggcagtttttggaagttgccggtgatgaagtacgggattgctagtagtgatcgccacaaggtcagtttgggggcgaggaaaacgtgcagccgaccatcatcaggggcagcgtcagggacggcgttggtgaagccgccgactgagtttgtcatcgtgattaataggaactgcgtgtctttttgccacttaccatcggcgctatccaactgtagtatccaatgttgatgttgagccagaactttaaagcccttcatgaggtagatgatcgggccgaagtgttgtttttttttctgggtcacagataaagccgcatttgctaagacaccgagggtcaacgtgctgaccatgtagtgattattgacctgagcaacatcgagtggctgtggggcagcttcaagaatgtttttgatggctaacggcaacagtaacggaatatgcaaaaccttggcgagattattaacggttccttcaggcaaaatggccaacagtggcggatttttgcgcggtgcgagaccagcgacaacttgattgatggtgccgtcaccaccgacagccaccacaatgtctgcttgggcgtgataggcgaactcgcgcgcgtcatcggcacttttggttggcgccatcgtgacctggtgctggcgatcttccagtttcgttttgagttgttcggcagcagttggtcctttagaatgcccggacgccgggttgtagataatcgtatagctgagcatggcggcacctcctattaactagtttatcacggtgaacgatagcgcatgctggccggtgataattttaaggataaaaagacgaccgcctgtatgattttgacggtcgcagttagtgacgattcaatttaaaaacggttagtcagtgctaatttgacggcggccgttggcggtgactttggcaacgacaccaatgatgacgagatcaacgacaaaaatgatgctccattgcaagattggattgagatggttgagcaggttgacatgcatgccatatgtggcggcactgaccaatccgagcaaaatgatcacggtgaagccgagccaagttgttctgccaaatgcgagaccgtttctcgcttttcgttgacgttgggcgatccatggcatcaaaaccccaagggccaccatgccaatcggaacgacaatgtttaaaaccagcattaaagcgaacgtctccgcagtcgcatctgtcgggaagaagccaagcgtgccaagcaggaacgtaattcccaacatccagatcccaacgagtaagccaactttccgattttttagataagtataggctggcgtcgggaagcgatcctgatgtaagcgaaccatggtgtaagaccagaaaaggaagcaggttgacaacgggctgacaatgccattgaggttcaacaaccaattaaagatgtcgttgatttttggtagcaaagcacctaacgccatgatcaaagcacaaaggatcgtggtcatccaatagccgttgattggcaagccgtcttcattcattttcgttaattgccgcggcataaagcgtttggcaacgtcagatagaaagacacgggttgaagcgtcaagaataacagctagttgggccaacatgtagatgccttggacaacagcgaaaagatacatcaggctgttacctaatccaaactggcgaccgattgcctgaaaagcataataggaaccattcattttcaagtcattcggcaagtgatgagcgttgaaataaacgccgagcgagaaagtgccgaataatgtgagaaacatggtcatgatggcaatcattttcaatgccttggggaagtcgcgggctggatggcgcatgtctttggtgtatggcgctgcaagctcggagccgttcatcgcaaaaacgaacaggccgaaagttgataagaaactaagtgagaagaaatctttgggaataaaagctttgaaatcaaagggtcgcgtggcaattggtgcacctttggacaaaccgacaaaggtcatcaccacgaagagaacggtcatgataaacatcgcgccaccgccgatcgttgacatgatttccagacttttatttttgaagaaatgctgaagccagatgaagatgacgaaaatgacggcggtcagaattccaaaccaagcattgccaaggttggcttgaatgttgccattgccatttgcgatccagccaaatgagatgacgacagagttggcgacatcgacgacgtagggcaggccggtaatccagtagaaccaagccgcatagtagccgacagtgtcgccgttggtttcacgcatccagctggtgatgccaccgccatgctcggaaaaagtcgagcccatgtgcgcgacaatcaggttgtaaggaatcacatagaagaaagtcatgatgatccaactggtgaaggcgaccagtccttgattctggaagttataaatgatgtcatcgaacccaatgactgtgacaaagtccatgaggccgacaaccacccaagggatatattgtttctgtggtttatctaattcattcatataaaaggctccttaaatatctgaaggtttaaaaacgactggtttttaaactcatccccggcgccttattacggagttttcccactgcgacccaactttcatgtatattttcaaaagccattagtgattatatcagggattgcggcggttttgcggcaaaaagtaaagaaagactaaagcagcttacaaagccgtaagttacaaacaaccatccgttaggccattatcaggaaaaaggcagcctaacccgctatcataaagtttgtaaacaaaacataaagatacaaatggaggtctattatggacaagcaacctgtcgtaactgttgacaacgttacgaaaacctatggtaaaaaaggggaaaaacaaacacccgcattgaaaggtgtcagtttcgaagtacaacccggtgaattcgtcggcatcatgggcgcatcaggttcagggaaaacgaccttgcttaatatccttagtacgttagatacaccgacttctggctccgttttgatcaaaggtgctgacgtcacaaaattaaaaggggatgccttatcagattttcgagctaaaaaaatcggtttcattttccaagattttaatttgttggagaacctaactggccgcgaaaatattgccctaccgctcgcgttgcaaaatgtgagtgcgaagaagcaagcggcggctgttgatagcattgcccaaacattaggaatcaatgaagtactcgaccactatccaacggagttatctggtggtcaaaaacaacgagttgccgctgcccgggcgttggtgcagaagccagatatcctgttcggggatgagccgacgggtgctttggattctaagtcagcccgtgagttattggataccatggaacagttgaataaggaacaagatgtctctatcttgttggtcacccatgatccgttttcggctagttatgccagccgtattttgttcattaaagatgggcaaatcggttccgagctggtccatggtgataagagtcaggaagccttctatcaggagattcttgacacacttggcacatttcaaaagtaaggggcgtcgtctatgttaacgaaacttgcactcggcggcctgaagaaccgcttccgcgactatgcggttttattctccggtctggttatcgccagcgccgttttctacatgttcatgtcacttgccacaaacacaagctttttaaagaaaaattcgccgattggctttacaccatttatttttggcttcggcgcggtgctactggccattatcacgttggtttatatcgtctatgccaatagttttctacttagcatgcgccaacgcgactatgcgatgtttatgatgctcggtgcaaaagggcgaaagattgcgcaactgattttccttgaaaccgtggcaattgggcttttagcaacagttgccggtattttggtcgggatggtcggcacaacctttgtgggacaatggctcattaacaccctacatgcgccggcaactggcttctcagcgttttggctgccagccgtattgtggacattaggcttcttcattgtcttattcattctgtcggcgttctataatgctggaaaactattgaaaaccccaatgctacggttgttgcatcaagcgcagacaccaaatcgaatcaaacaacgcaaagggattttcgtcttacagattatcttgggactgattttgcttgcggttggctactacagcatgtatgccatcgccaaaattgggattatggcgattccattggccttggttaccattgttctaggaacctatttcctgtttaactcagtctttgtcgcgctgattggcttattgaagcgaaaccacaagtttgcggccaaacagttgcatacgtttaccttgtcgcaactgagtttccggattcgggactatacgcggattttatccgtggttgccatgctgtttgctttagctttaggagcgattactgttggccttggctttacgcatgatattccggatttggcgagtcaggcgaccgcctacgatttaacagttgcctcgccaaatgccgcgacccgtgcgcaaatcagtcggttgcaggatgtcactgctaagcaagactatacgattaaatcggatgccaaaacggtttacatcagccagcaagctctcgatgcccatccgcttgaaatcaaagccaatgacggaggacttgatacgccgaatattaaagtcacgagccgcaactttgcggagatgactgaacgttacccaagttcttttggtatttttatcggcaataatcgaggtaaacaaatgaaagtcgcagatgccgcgaccttcgcgaagctcgggaatgcagaaactttgaccacgttcaaagttaaggatttcggtcaaaactacgacacgattcagaaaattgtcgagctgcaaagcaagcaatatccgcgattatggagcagtaacggcgatcagaagtttatgatttatgcgctagtgaacagcatgttctctggcctcgcgtttatgggtttcttcctcggcattgctttcctcggcatgttagcttcgacgctgatgttcaagattctatctggggccaattatgacaagagtcgttatctgatgttgcagaaaatcggggcacgaccgcgtgcattgcgacgctcaattcggcaagaaatcggagccttgttcttactcccaggtttcgttggcattatccacgtcttgtttggccttcagctttttaagaccatgttgcgcgcaccatacgggcatcttgcgttaccattcggtttgttcatcgttctgtatgcactctattatctggcgacagtttggatgtaccagagcattgtgatcaataagaacttagcggaaaaagcctaaagaaaggatcctttaggtcgcactataggctggaacataattctcagctgacaattaaaagcgaacaatttccctaatatcgggaagttgttcgcttttacctgtttatggattattattgtgattttaaagaccggagtttggcacggcaagaagtttgagcctaccatctttgttttcttgaaaaatagcagatttgaacgcttaaagttaaccggctaaaacgtcgtgtgcagacatctattgacagatgaacaacataaaaatgcccttagagactggctttgtctgaaagggcatttttatttgctcgacaatacaaaagtggcaaaaagttcggtttggacaaactatgcttcaaactcgttataactcaatactttaatgccttcatcagttaaaagaattttactgatggagccgttgcgaggcgaatcggtgaccacatacccatcatttttgccgaacttatcgacgatgctgcgaatggtcgtgccgtggctgaccatcaggactttatcaccttcatgattttcggcccgcaactggcggaagcctttcatcagccgggtccaataagtgcgcgcatcttcggcttcgtggaaaggatcagcatcgtgcatgaagtcttttgaggcgtcaaccccatatttttccaaaatttctggataggtcttggcaccatgcgggaagccgacttcataccaagttttgctagaatcttcaccctcaaaatagccataaaattgttcgcgaaagtattgggtgacggttagcggaatcttgccagtgacgtttttgctgagaatcagatcggccgtgcgagtagctcgcatggtgtcgctgcaataagcgtgtgtgaaggccacgttgcgtagaatgacacccgttttagtaccatctttaatcccattatcggttaatggcgagtcacaccaaccctgcattttattaaaatggttgaaccatgtctgaccatggcgcaccagatagactgtgatgcctttcattgtattcatctgcctcctcggaagttaattgctaagactagtttagcatagaaaagcagggtggttatgcttaaagagcatcttgaacaacgccgcaatcagtcctaacgtgtgctattctttaattattcagtgaatcacatgcggaggtagcaggatggcaaaagggttgttgattgttaatttgggatcgccggtttcgccggagacaaaggatgtacggcggtatttacgggagtttctgagtgatcagaacgtcatcacaatgcctaaagccctgtggcaaccgattttgcgtggttttattttaccctttcgcagctggcggtcagcaactttctataagcatgagtggacccaagctggctcgccattgattgcctatacgcaggtgacccgggatcggcttcgcgagcggttgcctgactgggatgtgcagatggcgatgaactatggcggcgagtatccgattggcgaaacgctgcagacgatggcagcgcgtggtgatgcgccgattgtggtgattccgctgtttcctgaatacacgcaaagtacgacgaagactattttggataaggtcgcggcttcaggcgtgaagaccgtggttattgaccgtttttatgatcattcagactatcaaaagattcttgcgcaacagatcgacgatgcttatgaagcgggggcgtatgataccgtgattctgagctatcatggcattccgacagcgatggtgcggcatggtgatccgtatcagcaggaatgtgaaacgaccacagcaggtgtgaagcagtatcttaagaaagtgccccagactaaggttgagatgtgttatcagtcaaagtttggcccggttccttggttgaagccatatttacgcaatcggttaatggaactggctgctttgggtaagcgcaatgtgttagtggcaaccccgagttttgtggctgattgtttggaaacactggaagaaaataatgtccagaattatcaaacatttcgtgctaatggcggcaaaaactttgcgactgtccgaccgatgaatggttgcgagccgttttgtgactttttagctaagttggctgaggataagattgcggcggaggcgaaccatggcaaggcctgatgaacgcttaacagtgcaacgcgaaaaacgcagtcttgatgacattaaccgcagcgtgcaggtgccgagtgtttatgaatcttcgttttttcagaagtttctggcatacagcgggccgggtgccttggttgctgttggttatatggatccgggtaactggctaacggcacttgaaggtggcagtcggtatcactacgccttgctatcggtactcttgatgtcgattttggtggccatgttcatgcaaacgctggcgattaaacttggcgtggtcgcacgattagatctggcccaagcaattgccgcatttattccgcactggagccgcatctgcttatggttgatcaatgaggcagctatgatggccacggatatgactggcgttgtggggacggcgattgcgctaaaactgctgtttggcctgcctctgatgtggggaatgctcctaaccatcgctgatgtgctggttgttttagtattcttacgatttggaattcgccgaattgagttgattgtgctggtatcgattctcacagtcggcatcattttcggcattgaagttgcgcgagccgatccgtcaattggcgggattgctggcggttttgtgccacatacggacatcctgacgaatcatggcatgttactgctcagtctcggcatcatgggcgccacgatcatgccacataacatttacctgcactcttcactagcccagagtcgcaaatacgacgagcatattccggcacaggtgaccgaggcactgcggtttggtaagtgggattccaatgtgcatctagtcgccgcttttctgattaatgccttgctattgattcttggggcagcgttgttttatggcgtgggcggccatgtgacggcttttcaaggtgtctataacgggttgaaaaatccgatgattgttggcgggctggctagtccgttaatgagcacattattcgcatttgcgttgctcatcacgggcttgattagctcgattgcaagcaccttagcagggcaaattgtgatggaaggttatctgaacattcgcatgccattgtgggagcggaggttgctgacgcggcttgtgacgctcattcccatcatggtgattggcttcatgatcggttttagcgaacacaactttgagcaagttattgtctatgcacaggtgtcattgagcattgccttgccatttacgcttttcccgttggtggccttgacgaatcggcgtgatttgatgggtatccacgttaattcgcaactcgtgcggtgggtcggctattttctgacgggtgtgatcaccgttctaaatattcagctggccatttcagtctttgtttaaacgattatacgcaaaaatggccacggtgatgtcatacctccattattgaggaacatcaccgtggccgtcttttgtatgtgtaagcttatcaagttaaaaagttgtcttttttcaatagctgcccttgatgacgaaaaaagacccccgaatggtgccagcaagcttcgacttttgccgggcaaatttaaacttgccttcaagctcagtcggcaccgccatgccatcgctaagtttaaagccaaccgcgcgttttttggggtcggacaagctatacatcacgttgatggctaatccgtcttgatagtaaacctcaacccagtgcaaatctggtaagttcaaatcgctgacttccaagggcttggcagaaatttgtaagtcgcgttcggcgagaatttcattaacccacgcgagactgtcaggtttttcggcagccggataagtgatataaggttccttatacttattccagatgtaacgcgcttcatttgcgcgcaatcctgccaatgctgcagcaacaggcgagctttcaagaccaatggtgctgaccgttttaaaatcaactgtataagccatgctttcatactccttcgtcagaaaaacgcgtcgctaactgcggcgcgttcggtgatattagtcgttaaaagtcccattttcaacatcggagataaattgcttcaaatgtttgaagtaaactggggcgttatcaatcatgtgatggtggccgccgtctggggtggtgaccagtcgggcatgtgggatgacctcagccatacgttgggctgacttcagtggcatggtttcatgctcgccgaatgtgagcaaggttggcaccttgatattgtgaatctgatcactgatatcccagttcttcaacttaccggtcacaacaaactcattgtcgccttggaaagcattgtagacaggcgtggccatggtgctaatcaggtgtgaaattgctggtggctgtttgcgatcaacataaccgcgattgaggacatccacatatttttgatactgcgggtcgtcccagttaccagctttttcaattttcttcatgtacttaaccgcagacggcggcaaagcctcttcacggacgaggttgatatgatcaacgtattcgttgatgttgtcgaccattgaagagataattgcgcctttaagatgctgaccatatttcagggcatatagctgggttaaggcaccgccccagctttggccgatgagataaaaatgatccagacccagcttttggcgaacttcttctacttcgccaagaaagtagtcagtggtcaggtattttttagcgatttccgggtcggtataatccggctgatcggaataaaacgagccaagttggtcgtacatatgtacctgaacgccaagatcggccagctcttcgccaaagttttcccaatactcatgagtgccaccagggccgccatgcaagcaaagaagatggatatcgccttcaccttgtgtgttggtccacaaatgatacccattgtctaaggtcaggattgttgtcccttgtttcatttgatcacctttttttcttagaataatctcattgtaccacgcgatgcggtgagctttaattcaatttctcgacttgttcgcgaatgtcgcgaatcacgtgtttatcaccggaaaagattaaatgatcgccgagatgaatttgggtgtcgccatgcggtgcgacgaactttttattgcgatagatttgactaacggtaatgtcatcaataaatggcagatttttcaattcaaggccagcaaatcgcgagttgcgaacggtgatttcgtaaatgccagcaacggtgtcatctagaatttgcaaggttgacggcgtttcaatgagactccgcaacaaagcaacatttgcctctaaggcgttaaacacttcgacaccttgggctcgcaagcgatcatagcgatcactggtagcatcttttggagcgaatcgcgcaatgatccgtggcactttttcggctaatgccatggtcgcgagatcgtagttggtgtccgcatcgaagtcgccaagaaccatgatgtcacagtcataagcaccagcggctttcaaagcggattcggtatagtctgccaaggcaatgttgatttctgaattatacgtgtggtaattttctggcttatctgtcaacagttttacttcatagcgatcaggactgagatgttgggcaatcggtactgttagcagattgccaccgatgaaggtcacttttgtctttttaaaatgttccggttccggttggaaaaaggtgctgaagagaattggaccggcgacacaggcaatgacagcggcgagggtgaacgcgccggattgctggtctgataaaatatcgagattgcggccaactgtcagggtcgggatgaccagcgtgatggtcgttgtcagcaagaaaccgccagccaaggcattttgaggcttaaaccgccggcgcagcactgggatcaagccaatcttagcaataaagaagccgatcagaactagcggaattaatgaaagactttttgggtcggcaaccagtgcttttagatcaagattagcgccggtgacaatgaagaaaataggaatgaagaacccataacctaatgaggtcaacttatcctgcgtttcttgccggggaccgagcagtttcatcaccatgccagctaggaaagcaccgagaattgattcggcgccgacccgtgatgctacggtgactaaggcaaaaaccagaaagaaagccagccgaatgtctaactgcgtcgtacttttatcaatggtggcaaggaagccgtagatgcgcttaaaccggctcaggaggaataaggcggcaagcagcaacaataataatagccacaaattacgatccgatttgcctgctaacgctgagtaaaccgtcaaacttaccaacggcaccacttcaccaagggcggcaattaataaaatagtttggccaatcggctgatgcagcaactctttttccttcagcgcggcaatcacgacacccagcgcgatggtggtgaacaaaatcgtagcaaaaatcggatagttaaagaagtgaatgagttgcaggaagtagctaaacccgagactaagcacgatgatagtcaaaaatcccgtgattgctagcatgaccgggtttggctgtttgggtccatcagttgttttgggctggggcttgaacagcgagaagtcaatttccatgccggaaagaaaaatcagaatggtgacacccaactcactcagcgagcccatctcaccaccagtcctgacccagcctaagacacttttgcccagcacaatgccaaccaaaatttccgcaacagcagtcgggatactattaatatgaaaatgtgccatcagcagcggcgtcaaaaacgccgccgtgagcacaattaataacgaaatggattccataaggtcctccaatcagcgataatagatgggtcaatggtaacgaaaagtgcggataaaagaaaggaaatatcatgtcacaaaataataaatcaaaaaaacaagggcaggggttcttcaatcggcgctctgtcatcgttggtacatgcgtgttgctaggtcttttgattagcttgccattcaagcaaatattattaggcgtcgcgattggcttagcggttgggtacgtgcttgaagcatggacgccattgttgcggggaaagctttaaactgcttccattggcgattagcttgagcaaggctgtgtccagttgcctttctatcttagttggaggatgcccgatagtccgagttggctacgcggcgattgggctggaacgtggtgggcacgacttcgagccaacgcgcaagcccggcgcgctgtctcgaagctcggccttggtctaagcggagaaaaccactccactaagaccaatttcaccactgagcccatcgccgctccgccaactctctgctttctatgttaggatctttcgacccatagattgtcgttaaggttaaaaggaacatcatttttccaaaaacgtttgccagcccagtagccagcgtatagcgaccacaaacatagctcacccatttttgaatcgagttcgcagatgtttcgattttttgcctgatctggtcgcgtatacaaaattttaagagattagcagaactgctcagacatagctagaataaaatagtttaaaacctccctgtcgtttaaaactcagtcacctagtctacttttgctccgccttgacactggaatctttggttttcacctgtttaccaagaatagcggggtacctttgtttggtggttatgaatttttgaaatttcctacaatttgaccgtcattatcttgggtaagatgattctattttaaagatagaatgcaagagttggcggagctgcgatgggctcagccgtgaaattgttgttggcggtttaccgcctacaacaaggccagactttgaaatcgcgcgggttttgcgcgagttcaaagctgtgcccacggcgttccagcccaatcgccgcggagccaactcggactaacggaacccaccgcgtagaatagaatcggtatcagaatcgtgtttattagctcagaagcttgcgtataagcaattaaagaatgctttgctcgggaaggtttctaaccgcgcctgttcacgctcttttgctacaaagacgcataagtgataagatgttataacgattatttagtaaccgttaaaggggatgacgtcgtggctgagaacgaacaagcaaaagagcagacacatttgacaggcatcatgaaggagctctccggtgccgaaagccgtctttcaaaagagatggctaagacaaagtctgaagagaagaacatcagtgacaacttcttcaatgatttttccttgaacttcaccgactacgctgaaacgattgaaactgcggcctcaatccagcaacagcaacgcgtgcttgatgagcgaaccaatgcgtggaagcaaagcgcacagcaactcgcgactgttaagcggttgatgggcaatccgtattttgcgcggattgatttccaagaaggccgggaaaagccggagacgatttatatcggcttaggttccttcaccaatgaagctggtaagtttctcatctacgactggcgcgcgccgatcagctcaatttactatgatggcggtttgggcaaggttacctatcaaacgcctgatggcccgcaacaggtcacggtttctttgaagcgtcaatttgtcattaaaaacggcaaaattcagacaatgttcgataccaccgaaaccatcggcgatcagatgctgctggaagtgttaggcgaaaagtcagacacccaaatgaagacgattgtgaccacgatccagcgcgaacagaaccagattatccgtgacaccaaagcggacttattgtttgtgcaaggtgcagctggctccgggaaaaccagtgccgtgttgcagcgggtcgcttatctgctttatcggtaccgaggcaacctgagtagtagtcaggtgattatgttcagtcctaaccaacttttctctgactacatcagcaatgttttgccagaacttggcgaacagaacatggtgcaattcacttattaccaatatgtcacgcgacggttaccacacattgacgtccaaaaccttttctctcagttcgagcaacagctaaccccagttcaaaagaaaattgcacgtgtcaaaggcagcttagacttttttgagacagccaagaaatatgcgacaagtcttgaaaaatcaggcttgcgcttccgtgacattcgcttccgtggtgaggtattcttctcccgccggcggattcatgaaatcttttatagctacaatgaaaattatcacatgggcaatcgcctgaccgccaccaaggaacggctgatcaaaatgctcaatcggaaaattgaatccgaaatgaaatcgcagtgggtgcaagaagccgttgagaatctaagcggtgaagagattcgctccatgcaacaagacggcccgaaagagtttaagaatagtgatgacgaatatcggttcttcgcccgccaactggtgatgcgtggcttcaacgaaattcaacaagatattgtccgtaatcgcttccttaatattcgcggacagtatgttagtttcttgcgtgaagtaccagctatttatgacctcgaagccgagggcattagtgctgatgactggcaggcagaagtcgatcattttattaccttatttaaggaacgccaactaccaatggcagacgcaacgccatatctgcacttgtatgatttgatcactggtcgccatggtgaacgcgagatgcggtatgtcttcattgatgaaattcaagattacacaccataccagctcgcctaccttaaggacagcttcccgcgggcgaagtttacgttgctaggcgatctcaatcaagctattttcacaaaagacgattcgcggacgctgattaacgaaaccagcaagctgtttgatccagaaaaaacccgcgtcgtgcagttaacccaaagttatcggtctactaaacaggtcaccgactttacgaaagcgattctcacatctggtcaaaaaatcgtggcgttcaatcgccaaggaccattgccaaagttggtcgttcgtccagatgaagccgggttgatggcggctttgcaggatcaattgaaaattaacaatgaagcgaagcagacaactgcggtcattgcgaaaacgctggaagccgcagaagccatttatgaacaaatgaaggcggctggtatcaaagtaactttgatcaagtctgaaaatcaacgactcgcagccggcgttatcgttgttccaagctttttggctaaggggcttgaattcgatgccgttgtcctttggcaaatcaatgcggccaattaccatgaagaggatgaacgtgagttgttgtacacggtggcgtcccgggccatgcatcgactaaccatgctggctagtcctgatgtgacgccgttgttagacaaagtaccggctgacttgtacgagcgggggtaaacagatggtcaaaatgcatgacaccttagctgtttctagttatcgtgtttttccaggtatgctgaatgcgcatcagacattgtttggcggtcagatctttacttggatcgatgacgttagttcaattgccgcacaacgactcggccgccgtggtttagcgactggctcattggacatggtgcatctggcagcaccggttaaaatgggggatgcactggtcattaggtgcatggtcagcggcgtgggtcaccgttcactggaagttttcattcagttaattggtgaacatctagccactggcgaacgcttccaagtcggcaccgcctttgcaacctttgtagcccgccacaaagaagacggcccactgccgccggtcgaagcagaatctgagtttgaaaagcgcttgctagccggttacgacgaacgacgcgccgactatcggaaaatcaatgctagcttcggcgaggtaccgttggattgaaagcttggattttgaaaagtttaaaaagatcgtcagtccagagaccagaacagtttgactagacgcgccattaaaatgcatgataaatgagtctgtaaaaaggttaccgttttccagtcgctagcctctatgaaccaacaacgccgtcaacagcggctctgaatttacaaatagccatcccaaggcggttaaactttggggatggctatttttgttacttattttcgggcacgcttggcaaacccgttttcgcgcggtaaagtaaaccataaatcaactcccgcacagtgctgcaaatatgcggattcattttgaaagaaggacgattattttggcaaaacgatatgtcggttcatgtaccacggtgcttgttggcaagaaagcttcaattgatggctccacgatcattgcccgaaacgaagacggtgagtcaccattgcatccgcagaagttcgtgtacgtgaaacctgaagatcagccgcgtcactatcaatccgtgctcagcaagttcgcgattgatttgccggccgatcccttgggctacacggccaccccggaagcagaagacggccacggtatctgggcggcagcagggattaatagcgaaaatattgccatgacctcaaccgaaacgattacaaccaatagccgtgtccttggtgttgatccgctggtggcagcggggattggcgaagaagacatgccaacgatcgttctaccatacattcatagcgcgcgggacggggttcaacgcttgggcagtttgcttgaacaatatggcacatacgaaagcaacgggatcgcatttgctgacaaagatgaggtttggtactttgaaagtattggcggccatcattgggcagccatccgaattcccgacgatgcctatgtggtggcgccgaaccgcttcaatatcaccgatttcgattttgctagcgatgacacgatgagcagtgccgatctgcgcgatctgattgaaacctatcaccttaatccagatgcggaagggtacaacttgcgtcacatttttggctccgctacgatcaaggatacccgttacaacaacccacgtgcttggtacggtcagaagtacttcaaccctgaattcgatacgacaccgatcgatcaggatctgccattcatttgccggactagcaaaaaaatcagcatcgaagacgtgaagtttgtggaaagttcccactatgaaaatacgccatacgatgtttacggcacgacaggcacgccagcacagaagaagctttatcggccaatcggcatcaaccgtaatcaggaacttcacattttgcagattcgcaacaatgtgccagctgcagttgccggcattcactggttggcatttggcccgaacacctttaatgccgttgtgccgttttacgctaatgtcaatgacacaccagcagcataccgcgaaaccggcgacaagttcgatgtgacgaaaatgtactggctaagcaacctgttagcaacgtttggtgactacgacttttccttatttaaggatcaggaagatgtttttgaacaaaaaacagtcgccgcttgccggcacttgcagctcacaactgatgaagctgtcaaagatgccaaagatattgccgatcatctgacagctgccaatgagcagatggcaacgatcgccatggccaacagcaatgagttgttaggtcaaatggtagcggcagcagcgccaaaaatgaagttacagttcaccttgcacgactaggtgatgactggcaccaattgaaggcagacaaaaagcgctcgatgaagagcgctctttgtttgcctatttttgactacgatggcgataccgattaaattgggtggtcgcgcgaattaagaagagtggcatcaacactatcaataagatgccaacaaagacgataatgccggccgtggtgcgaaaccgcgcgaggacaagcagccagataccaaagccagtgccactgacacaaaaaatgaccagtaacacataccatgcccagtaccaaaacgccgatggactgcggcggaatgttggcacgaggaaaagagccagcaaaatcgataaaataaattttccaatttggttaagcattcagcgtgcctccttggatgttaggcaaatgcgtacttcctcaatgttaaagttcctgataaggcttttcggcatcacgcttggccgtccgaatatgacgcaactcgcggatgtaagcaccgtatttgatgatagcacgcacgattaagacgaagccaagcgagaaaatgcttagtccgacaatgatcgccgcccctgaaactggtgaggtcgtcgcggattcgaacaacaaccagccgccaccgcctgcaatcacggtattaaggatgagcgtaatgcccagtctgagtgaattggttcgtaaggaactttcttgtttaaaagtgggcgctaaaagtggggcaattacgccatctaaaatcggttcaatgaaaaaggaaaggagaaactcgcctactagttcaagcattgctggcacctccgtcagtgttcgagctggcatcgcgtcgttttgataggttgattgtgaagatttttttctttgttgtcaagaaaaggattggccgaacaactggggctttctatgctaaaatgagaacattaaacgcaaggaaacggtaagttatgcaatccgaaatgaattactataaatttgatcgtgcagaatggtcgcaattccattcccagaacttcaccaatgtcactgatgaagagttggcgcagttgcgatcattgaatgatgaaatcagtcttgatgatgtcaaaatgatctactcaccattgcgacacctgattcacatccgctatgaggattatcaaggcgatatgttcaccttgagccgctttttagggatgcaacgaaatccgcacacaccattcatcattggtattgctggatcggtggcagttggtaaaagcaccaccgcgcgcttgctgcaactgttgctgagccgggcttatccggaaaaacgcgtgcaacagatgacgacagacggctttttatatcctaatgctgagttagaacgtcggggaattcttgatcgtaaaggcttccctgaaagctatgatatggaacttttaatccatttcatgaacaacgtcaaaaatgcgagcggcgctttgcgtgcaccaaagtatagccaccagatttacgacattgtcccaggcgaatatgagctgatcgatcgaccagatattctgattgtcgaagggatcaacgtgctccagctgccaagcaagcagccaatctacgtcagcgactactttgatttctcgatttacgttgatgccaatcctgacctcattgaacaatggtatctggagcgtttcggcatcctgctcgacacggccttcacggatccgaacaactattactatcaatacgcgattggcgaccgggccgatgccttcgcaatggcgcggcaagtttggcgcgatgtgaacctcaaaaatctgaatgagtacatcctgccaaccaaaaatcgggctgatattattttgcacaaaacaacgggacatgaaatagaccaagtttcgctgcgaaaatggtaagatatggctgataagtcagttgataaacaactggttagcagtgtcggacacgcctggcttttctgaagcttatcgctggtaacgcttagatgagaggcttctcacccgtgattgaccgacatgtgaaaactctgtaaaattagtgcattcaaacaagggagtgtggcggactgtggcaaatgaccagaacaaggattacgacaagatcatcgtcctcgattatggcagtcagtataatcaattgatcacccggcgaatccgggaatttgggatttactctgaattaaagcctcatacgatcacggcagcggaagtcaagaagattgcgcctaaaggcattatcttctcaggcggccctaacagtgtgtatgacgaaggcgcgttaggtgttgatgaggatcttttcaagctcggcattccgattctgggtgtctgttatggcatgcagctgatggcacaacggctcggtggggatgttgaaccggctgacaaccgtgaatacggcaaagctgacattgaagtcactgatgacagcgccaagcttttccgcgatttgccaaaagatcaaaccgtctggatgagccacggcgacctcgtgacccgtgtaccagaaggcttccggcgaaccgcaaccagcatcaactgcccaatcagtgccatggatgacgatgatcgtaaattctacggcatccaattccatgctgaagttcaaaatacgcaatatggccatgaaatcctccaccattttgccttcgatatctgcaaggctgaagccaactggagcatggacgacttcatcaccaaacaaatcgacaagattcgggcagaagtcggcgacaagcgcgttctcctcggcctttccggcggggttgattcatccgtagtcggcgtgctcctgcacaaagccatcggcacccaactgaccagtatttttgttgatcacggcttgctgcgtaaaggcgaagccgatcaagtcatggaaagcctcaaaggcaagttcggcctgaacatcatcaaggtcaacgccaaagatcgcttcctcggcgacctcaaaggggttaccgatcctgaaaagaaacgtaaaatcatcggtcgcgacttcatcgaagttttcaatgaagaagcagccaagctcaacggcatcgatttcttagcccaaggcacgctctacaccgatgtggttgaatccggtaccgacaccgcccagaccattaagtctcaccacaacgttggcggcctgccagaagacctcaagttcaagctaatcgaaccgctgaacaaactcttcaaggatgaagtccgtgaactcggcgaaaaactcggcatgccccacgccctcgtctggcgccaaccattcccaggcccaggcctcggcatccgagtcatcggcgaagttaccgaagataaactcgaaatcgtgcgcgattccgattatatcctccgtgaagaaatcgctaagcatggcttggacaaagacatttggcaatactttaccgtcttaccaggcttccgatccgtcggtgtcatgggcgatggccgaacctacgactacaccattggcatccgcgccatcacctcaattgacggcatgaccgctgattttgcccggatcaactgggatgtcttacaggagatctcaagccggattgtgaatgaggttaagaacgttaatcgggtggtttatgatattacttccaagccgccggcaacgattgagtgggaatgaccggtcgcagatttaaatgaatttagctgaagctcaatgaagaaaatcgttgatgcttcagcttttttcttttgggcgaaaattcttgagaacaattaaactcattgagtatcaattacagtcagatacgaatgtttgtcacaaattttctaccgataaacatttctttaaaagattaggaattcatttgcaagatatgtacctactttagctacgtatttgttgacgaacatgggtttgcaaggtatacttgtctgcatcaaaccaagttaaggggtcggtgccccggttggttgacaggttaataccacatgatttgacaccccgtcaatactgccgttgccaagaacttagctaagttctcgccaactggtgagttggccatgtcttcagcattcatgaactcatgaacaatgagcatggtgatagttgctgtcttatcttgattatccaataatcacgcgtatcacgctaaatatgaacactgaatagtatttggcggtccttgcatttgttaggatcctttacagacactccattgtcacaggtagcgtgacgcctgggggtgtctgttttgttttaaggaaaaggggaaaattatgggtgcaaagcgtaagaaacgatatattgttcgagtgggtgattttgaggttccgttgattaaaactgataggagttatccgcaatttgacaacgctattttggatctgggacgacaaactgctaagatgaaggaaatgcttgagcgtcctgaactggtgacgcatcaccagttcttacctgttgtgcttagagaaaagatatttctaaagatgcattttgatgataaggcaaagagattgaaattagacaagaaaatccgtcctattgttgaagttgcgcattctgattcagttatcttctccttgtatgctgcaatgctgaataaatattatgaacaacgggttgcagatataggaattaaggaggtggctacagcttatcgtcggggcagagggtcaaatattgaagccagtaaagaggtcattgatcaagtttttttaacaaagcagtgttggattatcaaaagtgattttgttggtttctttgataacttaaaccaccaactgattaaacaacgtgttcttgatttggctggtggatataaatgcaaactgccagctgattggtacgctgttctgcatgcattaactaagtaccgggacattcatgctgatgccattcctgatgaaatgctgtcttatgcaaaaaaacattctaagcttagtgatgaaccatgatccgacggggttgtgattcaccactaagcttttttggtacagtggtaacggagttgacatgtcggaggttattttggcgcaaagacgtcgcaaaaaaaactggcaacttcgcagattcatcaatgaactcgatcgaagagtgtt

SEQ ID NO: 16 - DNA, 28623 bp, Lactobacillus paracasei
cagtcagacgctgcaccattactgcgacgcggcgatggtaatatgattgcaccaccatcaatcagtctagatcgttatcgtatctttctatataggcggtccttgccgggacaactattgattcagacgctgaagcggcctcaattgacactgcagatgcttttggatgaaaccgggttttcacgagccgcctttttccgccgaatctcggctttgcgcctttatttgcggaaagccggcgttaccatcagcctaaatcctttagcgcttatgggaccggaagcccgcgttagacaagtttaccggcaattattgtggcagtttgtcgactttgcccatcccttgttttcggaaatttttccgcagtcgcgtcaattaatgcgcgaactcgacaaagctggtctgatccaatcagatttttcgcgggcgcagcttctattcgcagctaatgttcatctacaccgattgttagcgaatcactccatcgttggtactcttgattttgacgaattggcacctcggccaacactaactgcagcactaccgagtgcgtttgataatctgccgagaaaggctgctgaggatgaaacatggcatctttttttaactcagtggcgcgtacctcggtttcactcggaacaacaatttgatgccgctactctagttggctatcacgcagcgcgtaatacacctgcatggcagttagtcgagaaaatccgcaacgagttcagtcgaacagttgtcgggattgccccgacagtaacaacagatctagcgttggcagggaatctcttgaagattttaatcagcgagcgcattttccccggtggcgcctatattgatctcacgcgaacagcgagtccaatgcgtgctttttatccgcgattagaagctgccttggaggcttttttcgctcgcgaagcgccattggaaaatgcatcaaaagagatcattgacgggttctatcaactgctgtggccatttatgacggacagtgcgattgctgataagctcaaggtagcacttgatcctttaatgccgcagccgttatatgaaaccgttcgtctcaacttgactcagcctgcgtatattcgactagtgacgactgagcaacagcctgatcttgttatctcggcgcaaaatcttgcgcctggagaagaacctattgtaccagatacaccagtcttttatcttgccagtgatcggtttgaaagctggtcacaactttatcaggaattattcgcgcgttcccgtaaattaatagcccactgaaataattaatttttgaaatgttcaagtttgctttgatgcctagcaccagcctgactacttttgatagctagtagcacatagcaaaggcaccacgatcagctttaaaaaatggattagcaggcgcatacttgttttattgggagatgacaaaatgaaacgagacaagcaagccgatgaagccgccgttgtggatatgaatgacacgctcatggactatgcgcataaacgtcagccgcatgtcgacgatttggccgaagaattggctaaacgggcgaaagataatatcaacgcgattgacgattatttaaaagatgatggtgaggcgcgtaaagagtatcaggcgattgccaccggctatttgcgtgataaatatgaccttgaaggtgacgatctcaccgctgcccgtgacgaacttgttcatgccgcgattcattacttagtcggccacaccaaagtcttggacgactggcaacgttaatgaagctttatatagtaaaaactggcgctttattctgacatcattcggaataaagcgccagtttttacttaaagaataggtgataataaccgtgagaagtcttgtttaaaccgaagccaactgctttgtttggcgattagctcaggcgtcagtaagtaactgcgcgccatatcagcctcgaaaatctggcccaagctactggccactttacgatcataaataaacgcattaatttcaaaattcagcttaaaactacgaatatcgaaatttgccgagccaacgctggcgatggcattatcgacaaccaccgttttcgcatgcataaagccgtgttcgtaatggtagattttcacgccagcgcgagtcagataattcgcatagtattgtgtcgcgcggaaaatgaacgggtgatcaggcatgtcaggaatcatgatgcgaacatcaatccctgacatggcagcggatactaaagcgtcgatcacggtatcatctggcaccaaataagggctttgaatccaaacagatttggtggcactggtgattaacttggtgtaccccaacttaatttgttgcgttgggcggtcaggtccggaagcaacgatctggataggcgttgcaccggctgtcaaactgtcggcagtgacactatcggcactatcttgttcaacactataagcaatttcgtcctttttgctgactgttgcattccaatccatggtgaagcgaatttttaaagcgtaaatcgtattgccgataatgcgcaaatgtgtgtcgcgccaataaccgaacttaggtttgcgggagacgtattggtcaccaacattaaaaccgccgatatacccgacgtggtcgtcaatgacaacgatcttgcgatgatcacgatagttcaaacgaaagtcagtgatgggatgcttggaactaaagtaactttcagcttgcccgccaacgtcggtcagccggcgccaccactttgctgtagcgcccatggaaccccaagcgtcatataggacctttacaacaacgccttccttagctttcttgatcagcagttgctggaattgattgcctaattcatcattgtaaatggtgtagtactcaacatagatataatctttagcggcctcaatatcgcagaataacgccgcaaactttttctcgccatccgtgtaaagttgcacttggttatgggcaaggaccggtgcttgcgcggtattcagaaaaaaggcggttaaagccttggccgctggcgtgtaatcagtcggtggcaataacttattccgggcgttttcgtgcttttgtagtgagacaaatgcttttacgccagactcatattcgtgttgaatccgttgcaattttttcgttgataagccgcggccagcaaataaataaaaaccaaacccgacgatcggtaaaaaaataagcactagcaaccacgcccaagtcgttgagatatctcggacctcgcgtagaaccgtgaagattgccccgaaggtgtttaaaaccaaaataataagaataagccaggtaatcagcgacataccgcacctccaagaagaataagttcattgtactcaagcgaagcgaggctgtcacgttggaggggcaaagctgtcacgttggaggggcaaataggaggatttgcgaaatatttgggtaggaggaaagaaaatgttgatatttggggtttacttacttttagtcagttggtagaatgatacttgttctgaaatgcgtctgcaggcgcagaaacctgcgtgtaaggatcttggcggcaatgaccaaaacctggccatcaccgccaagactgcttacacgccggtttctaactgcgccagcgcacgctttaatttataaaaaggtggttttctcgtgaatcaagacttactgaatcttttaaagcaacgccgctcaatttatgcacttggcaaagatgttaaacagaatccggatgacttagtggatttgattgaaaccgtcattcaggagacgccgactgcgtttaattcacaaacgacgcgcgctgtttttctgtttggcgagcagcatgacaagctgtgggatattgtcgtgaagcggctggagagtgaagtgccgactgagcaggcttacgaagcaaccaagcagaaaattgccagctttaaagcagcttacggtaccattatgtatttcaccgatactgacgttgtaaagcaattggagaatgattttccattatatgcggcaaactttgcgacttgggcagaacaggcgcaaggttccgcacaactcaatacatgggtcaccttggcgaacaatggcatcggcgcgaatctgcagcactataatccaatcattgacgatttagtgcgtgaagcctttgatatcccgaccaactggaacttacgggcacaaatgccatttggttccattgaaggttcagcaaaagataaagattacatggatcgaaaagatcagtttaaagttttgaaataagcacccatcagcttaatttaaaattgtcgtgataagacgacaaagttgggatattattcacaaccattaataaaggcaaccgtttccgtttacaaggaaatggttgccttttcttttctcagaaacaagcttttgttgaacttaatgatcacggcgccagtaccgacgagagtggcgtttgccaagaaaaattgctttttgcctcgattgttctagtcatgacgcaattttgccgaaaatttatattttagtttcagattggcgcaacccttgctgagctaacatatgggcgccacgattggcccggtcaggcagccagtttggcaatactaaaggaaattgaccgattaaggtcagcaaacggcctgctaggtcgggatagtgcttagcgtattgcttttcaatcgcctgaatcacaagcttggaatcactgtagaaggcgaccggtgttgtatttaagccggcttggatcagcagttcaaaaccagcgattgcggctgcaaactcggcttcatgattactcattgctggcagtgcagcatgtttttgaatttgatggggcaagccactgaccaagatgccgatcccagcgggtcctgggttgccttttgtcgcgccatctgtgtatagtttaagcataatttctcctaaggaagtgtcaaagtgccagaataccgaactcattatcaacctgcctggatcgattttagcatgttttggagtatgatcgtgatcgggatcagccttgccacgattgttcagttagaaagtaccaagccatcgctgttagccattggcattgccgtagtgacagtgcttgttgcgatcattcaagtgctgcttcatcgtcttgttgtccatgaacaaggcctaaaactggttagtctttttaagagtaacacctcggaaatgacttggccggaaattgaggggtttacgtttggccatttgacagttattcttaaaaccaaacgatatggtcaagtgacttttgttttgttcggtaaaaaaagaaaacaaaaagtagtgtcgttgatccaaaaagggctgaaagagtccgccaaataaggagtgtgttgtatgtctgatattgaaattgcacaagccaatgaagcgacggcaatgtggccgattacgaaagttgcggctggtttaggtttatcagaagatgatcttgaactttatggcaaagccaaagccaagcttagttttagtgcacttaacgccttaaaggataaaccttttggcaaacttgtgctggtaacgtccatcaacccaacaccagctggcgaaggtaagtcgaccatcaccgttggcttaggagatgcgctgcaacaacgtggtaagcatcctgtgattgctttacgcgaaccgtctttaggcccggtaatgggtatgaaaggcggtgcgacaggcggcggttatgcgcaagtagttccaatggaagacatcaacctgcattttacaggagatatgcatgcacttaccacggcggtggataccctagccgccttgattgacaatcatttgcaacaaggcaatacgctcaatattgatccacggcggattttatggaagcgtgctttagatatcaacgatcgcgctttgcgtcatgttacgatcggtttgggcggtcccacaagcggtgtgccgcgcgaagatggctttgatattacagttgctagtgaattaatggcagtgttgtgtctggcggaaaacattgccgatctaaaggcgcgtatcggccgaattgtcattggatacacttatgaccggcagccggtgaccgtggccgatttgaaagtcaccggtgcgattgcgatgctattgcgagatgccttgaaacctaacttggttcagacattagaacataccccggcattcatccacggtggtccatttgccaacattgcgcacggctgcaactcggttttggccacgcgtacggctttgcagctcggggacatcgcgatcaccgaagccggcttcggtgcggatctcggcggtgaaaagtttatggacatcaaaacacctgtgctcggcaagacgcctgacgcagtcgtcattgtcgcaaccgtgcgtgccttgaagtataacggcggggtcgcgttaaaggacctgcaaacggaaaatgtcgaagccttggcccaaggcttcggcaatctcaaacgccacatccacagtatgcaaagttacggtgtgccagttgtagttgcgattaaccgattcactagtgataccgatgccgaaattcagtttttaattgatgcttgtgcgaaactaaacgttaaagccgtcaccgccaccgtttgggctgacggcggacgcggcggattggcggttgcggatgctgttttggcggcacttgatcaaccggcgcattttactcgcttatatgatccgcaaagcgatgtcaaaaccaaaatcaagacgattgtgcaaaagatttatggcggagctgatgtcgattatgaaggcaaagcaaacagtgccttgcgcacgatcgttaaaaacggctggcaggatttgccagtctgcatggctaaaacgcaatattcgttaacggataacgccaaaacgttgggtgcacctgaagggttcacgattcacgttcgcgacatcatccccaagttaggcgccggcttccttgtcgtcatgactggctcggtgcttaccatgcccggcttgccaaaagtgcccgcagccttgaacatggatgttaccgacgatggcaagatttccggcctgttctaattttgtgtggtttttaatcagctcatgcgtaaccgccatttttaagatggcggtttttctttgaccgcggtacactaggaaacaaacgcttttactcagggggaacttctgtgcttatttatctcatcatcgccgctgcgctcgtattaattgattttctgattaaggcgtgggttactgctcacattccattaggcgaaagccaacaactgattccaggcgtgattgatctcacgcacattcgcaatactggcgcagctttctccatgtttgaaggcaaacaatggtttttctatatcacaaccttactcgcattcggggttgttgccatgctgtggcgcgacagtttgcacaaaccgatctatcgcctaggactaaccttgattactgccggggccatcggtaatttcattgaccgattgcggtttcaatatgtgacggacatgtttcaccttgagtttttggatcagtggcgctttaatgccattttcaactttgcagacatgtgcatcacatttggggttattttagtgctaatttttatcctgttcgatcatgataaggcggtggcgtgatgactagcacctttacgatcacgaccgagcagggacgcatcgataaggttatcacggcgcatgaaaccactcacacgcgcagtcaggtgcaaaaatggttgcaagatggcttggtgacggtcaatgggcagccaaccaaggccaattacaaagttgctagcggcgatgtgattgctatctcaattcctgaagccaagccgctggaagctattccggagccgatcccgctcgatattgtgtatgaagacgaccaagtcattgtcgtcgacaaaccgcagggcatggtggtacatcctgcacctggtcatccagatggcacactggtcaacggtttgttatatcatactgatttgccgggcatcaacggtgtcattcgtcccggcatcgtgcatcgcatcgacaaggacaccagcggactactgatggttgctaaaaccgaaaaagcgcaactaagtctttccgcacaattaaaagccaaaacatcgattcgtgagtatttagcacttgtccatggcacgttcaaagaagatgaaggcacaattgatgcaccattgggtcgtgatccccgcgatcgtaaacgtcaagctgtcgtggcagccggtcgccatgctgttacccattttcaagtattagagcgttttgaacattacacgttcattaaatgcattttagagaccggccgcacgcatcaaattcgcgtgcacatggcatacattcatcaccctgtggccggggatccactttacgggccaaaacgcaccctgcccggcaaaggccaatttttgcacgcggctaaactgggattcgttcatccgacaaccggtcaattgctcgtcttcgaagcaccagtaccgccaatttttgaaaaaaccttagccgatctacgtgcaggcattgacaagacccgcaacgttcggtaatcttaatgcaatcaaacaagcacctttaactaagtccagtgaggcttagaaggtccattccgctgtggcggattattcaggctacggtcgccttctatcccaaattggattgaaggcgactttttttgtagagcgcgagcaggagcgcttagaaaccggagcataagtggcctcagatctaaatggccggtctttggccatttagatctgaggtccttatgtgcaggtttctgcgactgcgagcgcgtttaggaaatgccagcatcggagcgtaacacccgcatcactgttcacttccaaagcatcaaaaccgcaatacatataagaaagggtggcacatcaatggcacagtcaaaacaagttgtagacgaggtaaccatgaaacgtgcattaacacgcattagctacgagatcatcgagcaaaacaagggactcaacgatctcgttttagtcggcatcaaaacccgcgggatttatttagcccatcggatcgccaagcgtctcgaacaacttgaagggttacaggttccggttggcgaattggacattcagttttaccgcgatgacgtccataagattgatcatgatcatcagccagatgttgaaggcgcacagttaccggttaatatcaccggcaaacatgtcattctggtcgatgacgtcatcttcaccggccgcaccattcgcgctgctttagatgccttgatggacgaaggccggcctcgcaagatcagcttggctgtcttggttgatcgcggacatcgcgaattaccaattcgtccagattttgtcggtaaaaacattccgacctcattagacgaacaaattcaggttcaagtttctgagcttgacggtaaagacgggatcagcatcgaaaggatggagggctaagatggcatttcacaacgacgaagccgttttagatatcggcgacaagccaaaattcggtcaatgggttggcctttctattcaacatctgtttgcgatgttcggctcgacagttcttgtgccgatcttagttggactcgatcctagcattgcccttttttcaagtggggttgggacgttaatgtatatcctgatcacgcgcggcaaaataccggcttatatgggatcaagcttttcttttatcacgatcatgcaggccttgatgaaaggtgctggctatccggccatcgctcaaggcaccatcgcggttggggttgtatatctcattgtggccttgatcgtagcgcgcagcgggtcagcatggattgaccgggctttgccgccagttgtggttggcccgattgtgatggttatcggcctatcccttgccggcactgctgccactgatgcaacgatgcggaccatcagcgccaccaaaagcgtttatgacttgcgttacttcgcagtcgcaatgatcactttagcctctgtcattatttataatatgtacctcaaaaaattcattagtctgttgccaattctactaggcattatcactggctatcttgttgctttgctctttggcattgttgatttgacaccagttcagcaggctgcttggttcgacctgcctaagtttgaaattccttttatcagttatcagccgcaagtttattggggcgcgattctctccatggcaccaattgcttttgtcactatgaccgagcatatggggcacatcatggtgctcaacaagctgactaaacgtgacttcttcaaagatcctggtttaaaccacaccctagccggtgacggtaccgcatccattatcgccggtctggttggcggcccacctgtcaccagttatggtgaaaacatcggagttttggcgatgaccaaggtccatagtatctatgtgctgggcggtgccgggttcttcgccatcttgtttgccttcatcggtaagcttagcgccttgatccgtagcattcccagtccagttattggcgggatcagctttctgttgtttggggtgatcgcttccaacggcctgcgcgtcttaattgacaacaaagtcaactttgatcagaagcgcaacttgatgattgcttcaaccattctcgtgatcggcatcggcaatgccagcctacagttctccgggtatcaattctcaggactggccctggcaactgtgatcgggatcttcctgaactttgtcttacctgaacacgccgctaatgaagaagaggcagaaaaaaatgaccttatctaatttcacagatacatcctttcaagattttgtttccgctgaacaagttgatgacaaaagcgccatggctttgatcaatcgcgccgaagattttaaagctggtcaaaccgtccattttccagagccgatatacgcagctaacttattttttgaaaacagcacgcgcacccacactagtttcgagatggctgaacgcaaattaggtctgactgtcatcccatttgatccggcacatagttcggtttcaaaaggggaaacccttgaagacactattaaaacgattggggcgatcggagtcaacattgctgtgatgcgacatgcacaagatggctactataacgatcttttaggtgcatggccaacgacagcgattgtcaatgctggtgacggtgccggccagcatccttcccagatgatgctggatctgatgacgattcacgaagaattcggtcattttgacggcttgagtatcgggattgttggcgatttgagtcacagccgggttgcgcgcagtgatatgcagatgctgcataaactcggagccacgttgcactttgccggtccagagcaatggtacgattccagtttcgatcaatatggtgatttcatcaccgtgcctgaattggtcaagcaggtggatgtcttgatgctgctgcgcgttcagttggaacgcttcaacgccgaccaccgtcaggctttctcaaaagaaacctaccatgcaaagtacggtatcaccgatgatcttgctaagacaatgaaacctggcgcgattttcatgcatccggcgccagtcaaccgcgatgttgagttagccagtaatctggttgatggcccgcagtcacgcattttcactcagatgcaaaacggcgtcttcatgcggatggccatgcttgaggctgtcattaatgcccgtcattttggagaggagtaacccatgctcatcaaacacgcccatattgtcagcgatactgaatacacggctgacatccaaattaccgatcacatcatctcggcgattggtcaatcgctggcgccgcgcgatcacgaacaggtgattgatgcgactggtgccattgtcatgccgggattaattgatgtccatgtgcattttcgcgaacctggctttactgctaaagagacgatcaaaactggcgctgctgcggctgctcacggcggtttcacaactgttgtcgccatgatcaatctcaaaccggtaccagacactgtcgaaaccttaaaaccactgcttgagaaaaatcaaactgatgcgaagatcacggttttgcagtttgcaccgattacacatgacctgcattctgatcaggtcgttgatatggcagccttacaagctgccggagcgctgggtttttccaacgacggggtcggggttcaggatgccgacaccatgtatcaagccatgcaacaggctgctaagttgcatgcgcccatcgttgcccacattgaagatgcgagcctgatgcatggcggggtgatcaatgccggcccagttgccaagaaacttaatttaccggggatcatcaatcaaaccgaaagcagtcagctagcgcgcgaccttgaacttgccgctgcaaccggcgtgcattaccatgcttgccacgtgtcgactcggcaaagcgttgacctaatccgcgaagctaaaaaacgcggggtaaacgtcaccgctgaagtctcacctcatcacctgctattggatgaaaataacattccgggcgacaatccaatgtttaaaatgaatccgccgttgcgctcacgtgccgaccacttagccttacttgaaggcttgcaagacggtacgcttgatatgattgcgactgaccatgcaccacatacggctgctgaaaaaaccggttccttcaaaacagcggcatttggcattgttgggtcagaaacggccttttcaacgctctataccaaactggttaaatcaaagatgttcaccctaaaacagctgatcgcacgcatgagcacgattccggctgagaaatttgatctgccaggcggccatatcacagtcggtggacctgccgatttaaccattatggatctcgatacgccttacaccattgacccagccgactggttctccaaaggcaaaaattcaccttttattggcgataaagtcaatggtcaaacactgtacacgatcagtcaggggcaaattgcttacgcaagagcgtgaaccagcttgggcttctagctggcaagcacgtttaaaaaagcgtcagccagcccttaagaaagtatgaacaaacgcgattagcatcaggcaaacgggtttaagcaaagcgctcaccagatcggcttctgatctagtgaacgcctttagaggaggacaagcatgaagcgctatttaattcttgaagacggcagcgttttccctggcgtcggtttcggtgcggaaactgtcacaacgggcgaaatcgtttttaacaccgggatgagtggttatcaggaaacgatcaccgatcaaagttacaacggccaaatcattaccttcacccagccactgataggcaacgtcgggatcaatcgtgacgattatgaaagtatcgatccaaccgcaaaggggattgtggtacgcgatgttgcccgagtgaccggcaattggcgcagtcaaatgaccttagatgaatttctgaaacgcaaacacattcctggcatcagtggcgttgatacccgcgccttaacgaagaagattcgtgaagttggggcaatgaaggctagtattgtcgacgcagccgatgagcacgcattcgatcaattgaaagccctcgtgttacctaaaaatcaagtccagcaagtttctacccaacaggcttacccagctcctggcacaggccgaaacgtggtcgtcattgatttcggactcaaacatagtatcttacgcgaacttgccaaacggcagtgcaatgttaccgtgctgcctgccaccaccagcgcctcaacaatcctcgaattagcgccagatggggtgatgctcaccaatggccctggcgatccaaaagacgttcctgaagcactggacatgattcgtggcgtggaaggcaaaattccgctgttcggtatctgcttagggcatcaactattcgcactcgccaatggcgccaacacttttaaaatgaagtatggccatcgcggtttcaatcatccggttcgtgaaattgccaccggccgaattgattttaccagtcaaaaccacggctatgcggttgatcctgacagcattgatccagatactttgttgatcacccacgtggaaatcaacgacggtacagtagaaggtttgcggcaccgattgtatccggcctttactgtccagttccatccagatgccgctcctggcccacacgatgccgatcatctttttgatgagttcatggaaatgatggatgcattctcaaatcgcacgcagaaaggataatcatgccaaaacgtcaagatattcataaaatcttagtgatcggctccggtccaattattatcggtcaggccgcggaatttgattactctggtacgcaagcctgccttgctttacgcgaagaaggttatgaagtggttttggtcaattccaatccagcaaccatcatgaccgacacggaaattgccgatcgcgtctatattgaacccttaacagtcgaatttgtgagccagattctacgtaaagagttacctgatgcgattttaccaaccatcggcggccaaatcggcttgaatttagcgatgaaacttagcaatactggcattttggatgaattgggcattgaattgctaggcactaagctgacggccattgatcaagccgaagatcgtgaattgttcaaaaacctgatgcaaaagttgcatgaaccggtgccagaatcagccatcgctaataacattgaagaagcacaacaatttgccgataaaatcgggtttccggttatcattcgaccggccttcaccatgggcggcaccggcggcgggattgcgaacaacgaaaaggaattggcagaaattgcggaaaacggcctcaacctaagccccgtgacgcaggtgttggttgaacgctccattgccggctacaaagaagtcgagtttgaagttatgcgcgatgcagcggattctgcaattgtcgtctgcaatatggaaaactttgatcctgtcggtgtccacactggagattcgatggtctttgcgccaacccaaacgctgaccgataaagaagtccagatgttgcgcgatgctgctttgaaaatcattcgcgcgttgaagatcgaaggcggctgcaacgtccaatttgccttggatcgtaacagcttcaagtactacgtcatcgaagtcaatccgcgggtgtcgcgctccagtgcactggcttccaaagctactggttatccaattgcgaaaatggctgccaagatcgcagttggcctgcacttagacgaaatcaaaaatccggtcacgaaaaaaacttgggccgaattcgaaccggctttagactatgttgtcaccaaattgccacgctttccgtttgataagtttgaaaacggtgatcgcacattaggcacccaaatgaaagccactggcgaagtcatggcaattggccgaacgcttgaagaaagtctgctaaaagcggtgcgctcattagaagttggactaattcatccagaacggccagcttttgccaagttgagcgacgatgaactgagcaaacagatcattcaagccaacgatgaacgacttttctatctcgctgaagctttccgtcgcgactacaccattgaagaagtcgccgagttatcgaaaatgaacccattcttcctcgacaagatcaaacatattgtggaattagagcgggaactggcggcacataaagctgatctggggttgctcgccgaagtaaagcggtacggttttgccgacgaagagattgccaaactctggggcctgcacgctgaccaagtgcgacagatgcgcaaggaacaaaagatactaccagtttacaaaatggtcgatacctgcgccggtgaatttgccagcgacacgccgtattactacagcacctatgaaagtagcaccgaaagcgttaaaagcgacaagccgagtgtgctcgtgattggctcaggtccgattcggattggtcaaggggtggagttcgattacgccactgtgcacagtgttaaggccattcaaaaagccggctatgaagcgattatcatgaatagtaatccggaaacggtgtcgactgacttttcgattgctgacaagctgtactttgaaccattaacccttgaagatgtcctcaacgtcattgatctggaacagccagaaggggtcatcgtccaatttggcgggcagaccgccatcaacttggctgaaccgctggcaaaccgtggcattaagattcttggcacttcagttgaagaccttaatcgggccgaggatcgtgacttgtttgatcaggtgattaaatcacttaagttaccacaaccagagggcggtactgccacggataaagccggtgcgttagcggtcgctgataagattggctatccggttttggttcggcctagctacgtgttaggcggccgggcgatggaaattgttcacgacgcaactgaacttgacaattatattgatcgggcggtgtccgtttcacatgatcatcctgtgctgattgaccactatctagtcggtaaggaatgcgaagtggattgcatctctgatggtgacaccgttgttttgccagggatcatggagcatatcgaacgcgctggcattcatagcggcgattcgatggctgtttatccgccgcagacctttagtcaagacattatcgatcaaatcaccgatgccacgattaaattgtcgcggacactaaactgcattggcttgatgaacgttcaattcatcattcacgatggtaaagcctacgtcatcgaagtcaatccgcgggccagtcgaaccgtgccgtttttgagtaaagtgaccaacatcaaactggcacaagtcgcaacattggcaattcttggtttaagtttgaaggaacaaggttttgaaacaggcttgttgccgaatcagtcaggtattcatgtcaaatcaccggtgtttagtttttcgaagttgaatcacgttgatagtctgcttgggccggaaatgaaatcgaccggtgaagtcatgggcagcgacaccacccttgcgaaggcgttgtacaaagcttttgaagcggctggcatgcacttgccacaatttggccgggcattgatcacggttaaagatgctgacaaggctgaagcaacggcactagcaaaacgattccgcgaagttggttatcaactagtggcaacaagcggcactgctaaggcctttgagaaaaccggtatcacagtgtcaacgattgagaaacttgacagtggccaggagacgattcttgaagacattgccaatcggaaaattcaattagtgattaacactatgagtgcagataagaaggtttcaagtgacggtttccgaattagagaagctgccatcgaacatggcgtgccattgatgaccagtctagacacagctggagccattttgaaagttctagaattacaagcattttcaatatcgccgattaaaagttgagcgccttgccatacaaagtgattttttcaacactatctaggtatgatcaccatcaaaatgctcgttgcgttattaacgctgctattttagcttttatagcatgacgggcacgctttaacgcacttgcagtcgcagcagcctacacataaggaggtaccacatggccattcaattaccgggtttcacgatgaaaaatccgttaatgcccgcgagtgggacgtttggctttggcgaaggttacgccaaagagtatgatctcaatttgctaggggcgttagtcacaaaatcgacgacactcgcaccgcgcatcggcaatcaagggactatttttgccgacggccctgacagtactttgaatgcagtaggtctaaaaaatcccggttctgatgtcgtgctgcacgaaaagctgccatggttggccacgcagtattctgatttgccgattatcgctagtattgctggggtggatgttgccgaatacgcagcagtggcgaaaaaattgagtgccgctcctaatgttaaagcactagaagtcaacatctcctgtccgaatgtcaagcaaggcgggatggcgtttggaacagacccagaagtcgctgcggccgtgacgcgtgcggttaaagccgcgagctcggtgccgattttcgttaagctgacgccgaatgtgactgatatcactgccattgctaaagcagtcgaacaagcgggagccgatggtctttcactgatcaatacgtttgtcggcatgcggctggatattgccactggcaaaccgcttctcgacaatgtgactggcggcgtttcaggtccggctttgctgccaatggcactccacatggtttatcaagtggctcatgccgttcgcgtcccgctgattgggatgggtgggatcagctctggccatgatgcagcagaaatgttggcggccggtgccacggcacttgcagttggttcagccaattattatcaaaagcgagccattccgaagatcgcggctgaattggcagccatacaggaaggacagacagttttatgacgcctattatcgcactggattttaaggataagaccacaactcttgattttttaagccaatttccaaaagaagaacatttgttcgttaaagttggcatggaacttttctatgctgaaggcccagcaattatcaccgagattcaacaagcccgaccggtgtcgatttttctcgatttaaaacttcacgacatccctaacaccgtggaaaaagcggcgtggcaattgggtaaactaggtgtggcgatgaccactgtccacgcagcaggcgggaaagacatgatgatcgcagccaaacgcgggctactggctggcgcaaaggcagctggtcatccagcaccaaaaatgcttgcgatcacgcagctaacttctacagatcagacgatgctgacaaatcagctttcgattgagatcccgatcagtcaagcggttcagcatcttgcagccatcgcacaggcaagtaatgccgatggtgtggtggcaagtgctttggaaacaccactcattcgaagtgtgacgcgacctgattttctggtagtcaccccaggaattcgaccgtatggtgcggcagtcggcgaccaaaaacgagtcgtgaccccgggcagagccaagcgtttaggcagttcagcgattgttgttggccggccgattacgcaggctgatgatccggtggcggcttatcaatcaattaaggaagcgtgggaaacagcacatgactaaattagaaacacaaattgccagcgacttactccgtattcaggccgtcaccttgcgtcctgatgcaccgttcacttgggccagcggcatgaaaagtccaatttataccgataatcgcttgaccattggctacccagacgttcgcagtaaaattgcagctggtttggcgcagcaaattgtggctcactatcctgatgttaccgcgattggcggcgtggctactgctgggattccgcatgcggctttggtagcaaacttgttgaacctaccgctggtttacattcgcagtaagcctaaggatcacggtcaaggacggcaaatcgaagggcatctgccagccgatgctaagctggtggtcatcgatgatttgctctcaactggcggatcagtcttaggcgcggttgcagccgctcaaaaagatggtgctacagttttaggcgtcgctgcaatctttagttatcaactagccgcggtcaaaactaattttgccgatgctggcttaccgttcttcacattgacaaactatacggctttgatccaaacagccgagtcacaaggcgccatcactagtacgcaactcgcttcactgcatcaatggcgggaagatccggtcaagtggggcgcacagtttcaataagccgtcccaattgagtcccatgttcaaatcgaaaaagccaagcacggttacttcaaaaaatattttgaagtaaccgtgcttttttgtccttgccgatgacgtgaagctgcattcgttaatttatgggaaccaagtcgcattggtgagcaatctaagcaagccatgaggaaatgagaatttcggaatatgatcgttgattcacatagtggcaaataaaaaaattgttttgactgatattggattaattaagcagtaaaatccattttaaactgatttattagaaaatgatttgattgcatttatatgcacaatgcgttgaattcaggtttcatcaaaatagcttcatgagaattcaggaaaatcgagccgcgttttcttgctgtatccataccaactgttatactacagatagggacaattaaagcttatatacttagtttcattaatttatgagtaaaaattatggaaaatagacgtcatccggttaattgttatacaacagttgctcgcaatttaaatggccattggcaaaatatcgtttatcaactttggaggtgaaaggatgatcacagttgctattccaatgggttcgcaaccagacatactaactcttgtaactcgtgctcgcagtgagctcgcttcgaccttggcggacaaactgcaatttgttgtgtttgatagcggttcgaacgttgaccaagcagacacttggacgtttcatcaggcgcgcgatgaagcggacgcggtgacgcaagcggttggtttagtcgctcaaggtaaggccgatattttactaaagggcattgtgcaaacgcatacattactgaaagaactgcttcgtcctgactatcaactgcggcttcagaaagttttgtctcatgttgcgattattcatctgccacaactaaaccgaccgcttcttttgagcgatgctggtatgaatattgatcccgacgaagacaggctggccgccattgtcgaaaatgcagtaggcgttgcgcatcaaattggtttgccaaagccaaaagttgcgctactcagtgcagccgagaactttaatccgaaaatgccttcctcagttttggcgcaggcggtcgcaaaacagtttgaaacgcgctcagatgccgtgattgccggcccaatctcgctagatttggcattatcaccagcttctgttgcgcataaacattatgaaggcgtgattcaaggtgatgccgatgtgttaattgtcccaaccattgatgttggcaatgttttatataaggcgttgatgctattcacggatgctcgctcaggcggcacgattgtgggggcgaaagtgccgatagttttaacttcgcgcagtgattccgttgatagtaaactaacggcgctggcattcgcgattgcacaactgaaaggcggtgcctcatgaccatgcatccaaaacgcgatgttgtcatcgtgatcaatcctggctcaacttcgtccaaaatcgccttatttaaggctggtaaaatggtcgccgaacgcacacttaaccactccttagccgagctaagtcaatttgatgccgttattgcacaaaaagattttcggatgcaagccattcaagaatttttagccgatcaggacttttcagcaagcgaagtgctggcagtcgctggacgcggaggattgttaaaaccaattccgggcggtacgtatgctgtcaatgaggcgatgctggatgatttaaccgcagccaaacgcaacgaacatgcaagtaacctcggtgcaggactagcacagcaagtcgctgatcaatatggcgtcaaggcatatgtggtggatccacccgtggtagatgaattgcagccgctcgctcgtatcagtggtttaaaaggaatcgagcgacacagtgcggcccatgttttaaatcaaaaagccatggcccgccaagttttggctactatgggcaagacctatgccacaagccgtgtgatcgtcgcgcacatcggcgggggtctcagcattcatgcacatgaaaacggccgcatgattgacggcaataacggcattgatggtgaaggaccgtactcacccgaacgagctggctcactgccactagttgattttgttgccaaagtgttagctgagcgcctgacgctagcccaagtcaaaaaattattggctagtcaaagtggtttgcgctcgtacctaaacgatatcagtatcaaaaacattgtcgctcggattgctgagggtgacgaaaccgctaagttctacttagatggcatgatctatcagattaaaaaacagatcgccgaaatggcgggcgttttaaatggtcaggttgatgtgattattttgactggcggcgctgcctatgccactgctgtgacagccccgctgcaacatgatttagcctggattgcaccggtggtagtgcgaccaggagaaatggaaatgcaggcactctatgagggggtgatgcgcgttttgaatcatgaagaacccgtccgcgtttatcaatcagacgcgtcaacaatcaaagggggaactggcagatgacaatgaacacagatctggtggtcctgggtggcggacccggcggttatgttgccgccattcgggccgcacagttagtcatgcaggtcgttttagtagagaaggcaaaagtcggcggcatttgtttgcacaaaggctgcatccccaccaagtcactgttgcatagcggtgaaacactgcgactgatgcaatcagctgcgacatttggcgggatcatcgaaggcaaagtcggcattgattttgctaagattcaagcgcgtaaagcaactgttgtggaccagctttaccgcggggttcaaggattgatgaagaaaaataagatcaccgttcttaacggaactggcgcggttttaggcccatcgattttctcaccggtatctggaactgtctcggtaaccttcgatgacaaaagcaaagaagacgtgatgatcgtacctaaacacgtcatcatcgcaactggctctagtccaaagactttgccgagtctgccaattgacgaaaagatgattttgacctccaacggcatgctcgaactcacggctttaccgaagaaagtcgcaatcatcggaggcggtgtcatcggcgtcgaatgggcttctctgcttaatgactttggggtggatgtcaccatcgttgaatttttggatcaattggtgatcaacgaaagtcaatcgattgcccgtgaattacagaaacaactcgaaaaccgcggcattcacatccaactcggcgccaaagtggaacaggcaacgatcaaaaataagcaggtggcactgaccatcgctgaacaaaccgatcccttaatcgttgacaaagtcatggttgcgattggccgccagccaaatgttgaaggcattggactacaaaatacctcgattaagtattcggcaaagggcatcacccacaatgcgttttatcaaacaacggaagatcacatttatgcgattggcgatgtcatcgataccctccagttggcgcatgtggcgatgaaagaaggcatcatcgcggtggaacacatggccggtctaccagttgcaccgcttaattacaatgatgtaccgcgttgtacgtacaccgatccagaaattgccagtgtcggctatacctcatccaattatccgcaagatcgcgacgtgaaaattggccggttcaactttaatgccaatgctaaagcgatcattttgggcgatacagccggttttgtcgaagtgctgcgagatgtggtaaccgatgacattatcggcgtcagcatcattggtgcccacgccaccgacatgattgccgaaatgagtgacgcgatgtacctcgatgcctctgctacagagattggtgatgccgttcatccgcatccatcactatcggaagccattcaagaagcaactttagatacccacaagatagccattcacaaataagaaagcgagtgagtctgatgcaaaaaatgaaaacgacagggaaactgaaaacgacaggattgagtcgcgagaccattcttgacgtctataaggccgttatgcgtggccgccgcgtcgatgaacgtttatggcaactgacccgaattggtaaattctcgtttaacatttccggacaaggtgctgaagtcgggcaagctgctatggcgttggcgtttgattatgacaaagattattttctgccttattaccgggatctcaccgcagtgctcatgtgggggatgacgacaaaagatattatgctggccggttttgggaaagaggccgatccagcttcacatggtcgtcaaatgccaagtcattacggcagcaaggcgcataacattgtgagtcactcctcgccagtcagcacccagtatccaatttccgctgggattgcctatggtgctcagatgcgtggtgaagactatgtcaccgtggttaccactggggatggctcctttagtcaaggtgaatgtgcagaagccatgaacatcgcaggcgtgcacaagatgccagtagtcttcgtcgttgaaaataatggatacgctatttcggtgccagacaaagaacaatatgccgttgaaaagttagctgatcgcggcccggcattcggttttaaggggatacgagtcaacggcagcgactttgctgaaacctatctggctttcaagcaagcagtgacggatgcgcgtcaaggcaacggtccgaccttgattgagatcatggttgaacgactcaccagtcattcttccgacgatgatcagcgggtataccgtagtgccgaagaacttgccgaaatcaaagaaaacgatccggtgaaacttttccaacaacaattaatcgacgaagggtacctgaacgaagccgacattgatcgcattgaaaaggaacttgaaaccgagattaaccaagcaaccgatgaggcagaagccatgcctgatccagatccagccaagatcaccgaccagttgtacgcagaataggagagcgcgaactgccacgggtaggaaccggagtacaagtgtccttggacgtggatggtcgcactttgaccattgcgaccaagatacttacacgcaggtttctgggctggtgaacgcgtttaaaggaggatgaagaaccatggctgaattaacttatttagaggcgatccaacaaggtattgacgaagaaatggcgaaagatgaaaacgtccttattttcggggaagatgtcggcggtgacaaaggcggggtctttggcgtcacgaaaggcttggctgccaagtatggcgataagcgggttttcaacacacctttaacggaaattgctattggtggtatgggtgttggccttggactagttggcttccggccaatcgccgaattccaatttgctgattatattttaccagctgtcaaccagctcaattccgaagcggcccgcatgcggtaccgcagcaaaggcgactggaccgtgccggcagttttccgcgctccatatggcggcggcgtgcgcggcggcttttatcactcacaatcaacggaaaagatctttgccgggcaaccaggtttgcgggtcgtcaccccgtcaaatccatacgacgcaaaaggcatgattaaaaccgcgattcgtagtgacgatccggtgattttctacgaacacaaacgtctatatcgcttgctaaaagcggaagtgccggaaacggattacaccgtgccaattgacaaggctaatgtgattcgcgaaggtgacgacttgaccgtgattgcatatggggcggtgctccaacatgccttaactgctgcggagaagctggccggtgaaggcgtcagtgcagaaatcgttgatgtccgctcactttatccacttgatcgggaaaccttagtcgcagcagcaaagaaaaccggtaaagtcttattaatcaccgaggataacaaggaaagcaccatcatgagtgaagttgcagccatgattgccgaggatgcccttttcgatctcgatgcaccaatcagacggttagcaggacctgatgtgccggcaatgccatatgctgttgggctggaacgagcattcttagttaacgaagaacaagtttataacgaaatgaaagcgctcgcagcatattgatgaagggggaaaatagcatggcgatcgaacaaatcttactgcccggtttaggcgagagtgttcacgaagcgtccatcattaattggctggtcaaaccaggcgatcatgtcaaaaaatacgatcccttagctgaaaccgtatcagataaagtgacgaccgaaattccatcgaattttgctggcgtcattaaagcctatctcgttgaccttgataaagaggttccaatcggtacaccgatcatgagcatcgaagttgaaggcgcagcaagtgcacctgaaccagctgccgccaccagttcaccggttgcacaaccgacatcgccaccaacaccagtaccaattccggcagcaccaagcaaacctagtgccactggcggcaagcgtttttcaccagcagtgttggctttagctgaagaaaaaggcatcgatcttaatgatgtcatcggcaccggtaacaatggccgaatcacccgcaaggatgtgctcaattacacgcctagcgccagcgcgccaacctcagtgcctgagccacaacccgtttcggatgcggctcaagcaaccacccaagtgccaaccgcaccgcccgcatcagcaataccggaagcaccaaagccagcacctgaaacgatcaactttgaacctgggattcatgatcaaattgtcccggctgatggtattcgtaaaacaattgctcgtcacatggtgcaaagtgccaccgaaattccgcatgcttggatgttagtggaagcagatgtgacgaacatggttaaactgcgtaaccgcatgaaggacaactttaaacagcaggaaggcatttccttatcttacttcccattcttcattaaagccgtcgttcaagccttgaagaaacatccgaagatcaacactagctggcaagacgggaatattgtttatcatcaggatttcaatatctcaattgccgttgcaaccgatgattatctttatgtacccgtgataaaacatgccgaccagctgtccatcaccgggattgccaaagaaatcaaccgtctagcgcaactcacgcgcgctgggaaactgacgtcggctgatatggcagatggcaccttcaccgtgaacaataccggatcgtttggctcagttgcctctatggggattattaattatccgcaggcagcgattatgcaagtcgaaagcatcaacaagaaactggtcgtcaccgatgacggcattaagatcgctgacatggtcaatctgtgtctgtcgctggatcaccgtattctcgacggcctgcaagccggacgatttatgaacgatgtcaaattgaacttaagtcaatacaacatcgagtcggatctttactaaagcacagtacgacatgtttgcgttgagaacattgaatttccacagattttcaaaacagctgtagagatgtgccatgacaggaggaaaaagatcatgaaaattacaattgctggtgtcggggccatgggtggccgctatgcattgatgctcagtcgcgaaggcaatgatgtcgacggtattgacggctgggctgacaatgtgaatgctatcaatgagcatggcctgcaggctaacttcgatggcgaacaagttgttgctaagatcaaagcctatgaacaaaccaaaattgatccaagtgcagtggctgatctcgtcatcctcttcccgaaatccatgcaactagacggtatgatgcagtcattaaagccggtgatcactgaccatactaaaattctgtgtttaatgaatggtatcggtcatgaagaaatcatcgaaaaatatgtcacacgcgacaatatttttattggtaatacgatgtggaccgccggaatggaaggaccaggcaaattaaagctattcggcagcggttcagtcgccttgcgcaacgtcgaagacggcgaagcagcaaccgcggctgcaaaaaagatcgtgaaattgttatcagacgctggactaaatgctgaatactctgataatattctgtatacgatctacaagaaagcaacggtcaatggcacaatgaacggcttatgcacgattctggactgcaatatgagtgaatttggcagcacctcaaccgctgaggacatggttgtcgcaatcgtcaaagaattctcggcagttgccgcaaaagaaggcattgatttgaatgtgcctgacacggtggactacatcaaaacaacctgggatccaaacacgatcggccatcattatccgtccatgcatcaagacctgattaccaatcaccgcttgactgagatcgattatattaacggtgtgattgatcggcgcggtaagaagtacggtattccgaccccatattgtaccttcttaacccaactagtccacgccaaggaacagttgctgcacgcaaaataatgaaggggtgacacatgatggctgattcgacgaacaaggagatgacccatgcggctgcagatgcacttgtagacgaacaaaaggggaaagcaggcgggcttgttgaagacaacaaaacacctgaaaagtcccagaaaatgacgccacgcgtttttcttaataaggttttatcaggaacggccttgggcgttattatcggcctcatccccaatgctgttctatccggcattctgaaatacttcggcaccaacacatttgcggtcacgttgacgcaaattgccgtgatttttcaacttgcgacaccgttgattattggcggtttgatcgctttgcaatttgaattcaatccaatgcagatgatggtaacggctggtgcttcctttgttggttcgggggttgtgaaatttaatcctgccatgaaagcctatgtcggtgccggtaccggtgatttaattaataccatgatcac

SEQ ID NO: 17 - DNA, 73077 bp, Lactobacillus paracasei
cgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctagggaaacgaatcaatcatcgaaaaaaagtagatttaaagctgagtttttcaacacaatgaagttgactgaaaataaattaattgtaaaatattatgattatgatcttttggtgattggtgatcattcatatccggtaatcgtaatgaagaagtatatcagttcgtgtaaaggaaaaaaatttcaaaatttgaatgatgttaaaaagttcgtggatttcttgtttgaaggaatgtcgtttcttcatgaaatgggtattgttcatagagacctgaagcctgagaatatcttgattgataaagatggaaactattgtatttcggaccttggaatcgcacattttgacaccaataattttccagagttttataaaactttacaaaatgaaagattagcaaattatgctttttctgctccagagtgtcttagtgagaaaggaatcagtccgaataaaaatatggatgtttattctgttggccaattaatccagtgggctatttgtggttctttgcacaagggaacaaatagaaaaagattttgggaatgtgatttagaatatatggataaggattatttatattctttagacttggtagtagacaaggctattagcaataatcctcaagaaagatttgactctatcaacgacatgaggagagaactgtgtaggcggcttaaacaaaagaaagtgattgatccctttgacgaaatgcaattattgcaagagatgataacagatgcttatcctgaagactatggcgagtttacctgtattgatgatgtgcagcaaattacggctatattgaaaaacattaaatgtagcaaattttctgagaacagtttttggtttaatgaaggaataggaaataataaaataacgagatttgaacaattcgataatggagtaacgttgataaatagttacgaattatttgttaagaaaatatggttgagtttgggattatccatgtataatgatttgatcatactcgaaattgaaactgagaatattgaaccgtttaaaaacgaagaagaaagtttttttgagggttatttgatcgatgggaagtatatgatcccagcaagcaaaacaatgtcaggaaaatttagacatcaaggcaaagtaataaatcttgaagaagttaaggcagacgttcggtatagatatactgccaagaggtattttttcttaggcacccgctggacgaatgctatccagagcatcagtgacgatcttataaatgacttccaaagcactgatattaacactttgaatatgaaagcattgaagcaagtgctgtcttccaataagtcaccagaagtatctatgctattataaaatctgatgaatcatttaagcctcttaatgatcaaactcgggtacgaaaatcaggctctcaatccttctattctctcgaaagcgaatttgaatgaattttcaccagctcgaatagttcgacacaatgcgaatgagagttgatgtgtataccgcacttcttcctcagcaatataaataagacggaacgcaatgacacaatggcggtgtcgtgatcttctggaactagcagcaccagtctagccaatgaattattttaaccaaaaccggtccagtatttctctgccgagagaaccctggactgttatgtactcttacccttaaaccattaatcaccctgaacaatcttcgcaaatgccagccgcaactcctgattctgcgtctcactaaaatacaaccagttattgtcattaccctgattctgctgagtcacgagcacctctggctgaccattgtgtaacgtaaaaagataaacatgttttcctaggtaaggttcatgggcagcatctgaatagattgcgacaattgtatattcagcattgcttttgccattggtgctcagtgcccaggtgaccgccttatcaccaactgccattgccatggagccgggttggttggtgccagcttgacctaattcatcggggatcttcaacccgtacatatcaacactgtgcccttgccagtaactttcgtattgctgccccattgttttgctccagctggccatgaaagtagctagcttcgcgcttttggcgttagaccagaggggttgcttggtggttgagtggctggcatcgctggtactcgaagcgatcttgcttgagcgggaggatgattgcgaagcctgattgcttgaagtctgctgactagttttctttgaactgcttgaaggacttgcctgttgcagatgaccacacccgaccaatcctaatccaagaaaaagcgtacaaacagcaatgaatgttttttgcataatagacctccaaagtaatgactttccagaagctattatacatgaacggggtaatgctttaactgacctgttctgaaaatagaaagtcccgaaaacagcatagagaagagaacggcattttgtagcaagagaaggcgcatgtcgtttgcacactaattaaatgacagaatgacaatctatgattgagcgatgagagacggggccggtaaaaaaataatcgagttttaatacgataaaacgtgatcaaattggtctatttgctagtggggaataagaagtcacatagtgaaaggaatattgtcttaatttagattctttatcgacaaaaaattaaagcattagttgtgtaagatagaggcagacacgaagttttagcgcttcatagttttacccagcgccgcatcaacaatcttctgcaatgcccgaatcatctccggatccttgatcaaggtaacagaagcagccagtgtcatgacttcatcttggtcatcaccaaacgtaaaaaattcccgcaaactgacatccaagcctttcacgatttgttccaaggtactgattcgtatatcgccgcgactgccgcgttcaattctggccaacatggagacgtccatgttggctttttcggctaattgttcttgcgtcattgatttgctgaggcgcaggttgtgaattcgatgcgcaattttttcttgtaatgacaccgtttaaccccctatcaggcattcgtcataatatcaacgctacctgactcaggattgaaggattagtgctaattgaaacactttttaaatatatatggacttattagaccatggcggtttataataacacgtgtgatggatagccattgcataaaagttgcacgtaggctagtgacattaagttagccacgacgacgatagctcataataaaaacagatatcgttaggaaaatcgatatctagaaagcatcaggtccaacagccttcaatgctagtaggtcttgtgcggggtagtcaaccggattgatataacggtgtggctggtgagatggtggccggttaacgtcttgtgagcttgaaaagtgcgtggggcgcttatcatgactcacaattaaataaaataggttctgtttagaaaagttgaatgcggtcatttggggtggcatgttttcgacgataaacaggacttaaatagtcagcagtttataacttgccgacttggatttggctgtttttcacagcagtagtacttcatcaatttgatggggtgcttttttagattgtagtaggtggaccaattaaactagttaaaaaatttgaccgagcaccaaaaacaacgctgggatacattcccaacgttgtttttggtgaaggggttaataaaaggatcagaaggattctctctcaaagattgccagaattaaaaccgcttcgatcgcatcttctgaaccattccaagcccaaatgtcgctagcaacattaggaagcctacaatgccgcctttttcgaaaacgcgattaccggtctcaggtaaatctttggaagcgttctgctcttcatgtttggcgttgtcagctgcaggagccacatttgtcttttggggtgttggtgagctcggagcattcgcttgtttttcagccgttggaggaacacctgcctgatcgttctttgtggcaggatcagaagctgactgtgagggatcatcagctggattttcattcgttgacgcgtttttcttctccgagagtcgaatggtgtagtacatgtgcccgtcttggcccattgtcgcgccaaaaccgactgcggttacatctggttgataaaggtcgccgaggttgagtgtgcccggacgatcatcgagttgcaggatgccggttgcgactaaatcttctgcaccttcgccttcgtcgtgttcgaagggaatggtgtcactcgatagtgtgatgaggtttgtgtcaggggctgaccgatctgctggtgtgacggttcgtggattttgcgggttggccagttgattagcgtcggcgctggccgtttgttgcgcggcgttttggagctgcgggtctagattgagtggggctaaacctttgttggctcgctccttgtttagtagccggtaaaaggtgtcggtgacatcgctcatctctggttgataggcgccatcggcaggttgatagtacatggtgacggtgtgggcagcatcgtcttttttccagtagatgtatgaaaagtctggaaatggcaggacggcgattttgtcactggctacttgatcgtctggcttgagcgacttgccatcgagggttttgtaggaaacggtgtaggtgtcctgactcgagacggtaggttttgctgcgtagttgatgtaggcgacaaattcgccacttggcagccgaccaattgcgagaccgtaactggttgcgcctttggggaaggaggcggtgatgcgattcgccaccacttcatctgtccacttcacggcactagggtcgggattaaatgtttcgaccgaaccgcccttagctactaatccggcgtccgtgaagattttgttattagctgcgttatcaggccggagcactgagtcagcctgaatggccttggcaagatcagatgcggtaatttgagcgactgtatcatcatgctgactacctttttgttggagggcggcgtcaacgagtgatttgatgtgcgctaagtttggttgataggcttgcgcaatcggtaagtagagcaaccgttttccggacgtataattataaaaataatcatggccattggcgctgattttttctggcggagccgttggcgttgcgccgggggtgaccaccgtgatgggtccggcgattggcttaaaagttgaaaagtcggtgtaaaccggcgttgcgtcagcgtcactggctgcgttgacggtagccggcaacgtgaccagcgtactggtggcaataccaccaccggcaagggcggctacaattatgagggtacttgtgagtggcagatgcgaggaactagacataaaaaacacatcctttcgaagttgaaaaacgtaatcattacgattaacatacaaaagtgtacgctgaccgtcctagttaacacaattgcggtataagatcatttgcaggttttatgattatttttcagttttttgaaagtgaaaggctggttttgatagacaacgagtcggatggcgttgaagcgaaaagtgacttgagtctaaagtgggattgcacatttttagggtatttggcaatcaaacatgcaaacaattgtggtgggttaccaatatgacaggaacttcaatagtcacaatataggagcaagcttaatgaaaaaatcactggccaacgttcaagcgcggcgagctgacattgaacgactggttgatcggcacggaattgcaactgtgaaaggattggcacttcggctcaaggtttccgaaatcacgatcaggcgggacctgaaaatattgcatgccatggggcgggttaaatggcacaacggtcttgttgaagcgattgccggacaaggtgggggtgagcagagaactttggcggtgattgcccaaaggattgcggcggctgttcccaattacattgcgcggtacagcacccttttcatgaacgcaaattcgttgtgtctgcaagtcatcaatgaactggctaaaataccagtgaccgttatcaccaacaatccgtgtgcaactgcttgtgcgcggcatgagggcactaagattatgattacaggcggtagggtcagtacaaagaaaagtgtgctggctggcagtgtaacgttgaactttttgtcgtcaaggatagccgatgtcaccgtgatcggctgtgatggtatctcggttgacggtggcctaacttcaagtaatgcagaggcggcagcgatcgattcaatgatggttacaaaggcgaaaaaatgtgtcatctgcctagcagattatcgaaaaatcggtgctactcagcagtatcacattgctgatcttggcatggtggatgttttaatcacagatagttttgcagatgaagcggtgttgcagcaagcgcgcagaaaaggtatcaacgtcattcaagtgaccgtttggtaagggaaattagtttgacaaataataaaaacctcgggcaaaattttcaaattttgcccgaggtttttggtagtatttaatgatttcccatttaaaaataatgatgctgatttgagtaacgcaatttttacaaaaatgcagatagtaccaagattgactgttttaaataaaacagttttatcaactgccataaatcgccttcagtcccgcaatatcgcctgccgacaactgactaacaccttgcgtaattggatacataacggatgcttttgactgactgtgatcgagtcccaacgcatggccgagctcgtgcatcgcgactgcatcgttgaccgattgtaaaggataagaaagattcagactggcgcgggcgtggttgatgacagtgacttggctgccataggtttcaacaataattgtcgggccgccagcaccgagttccgttgagccaaaactttttgctgacatttcttttttataactggaaaacgtgatctggttatcggattttttaccttgaccggcaaccagtttgacgatgcccgttgcgttatacgctttgacggcttttaaaaagacatcgtgttcagactgtggcaagtcgtcatcaaaatggtagtaatagacacttcgaagttggtgcccttgaacaatactcaaggctggtgtggcatcgaccgcttgactcggtgtggctgaaggtacgtgactcgcttgacttggcgcggtgctggcaattgacgcaccattttttgcgacagatcgcggaccgccgtttagccaagtgctgacggtatcagttgtggcggtccagacattgataatgccttgcttgacggtgttgcgagcagcgatcggcaccggactttcagtgctatagattaaaaagatcccagccacaagcataatcagccaaaataaacggttgcgatgtttcatgagtggcctcgtttccaaaatgagtttgcaaaagcatactgttattgtatgttaccttatcgcagtttgtcgtgcagctttggactgaatttttaaggatatcgcaggatttagacacttttttgacaagttttaccttactgttatttgatgacatggtttgtccattaatcggtcaataacaacactaaacaagatctcaagattagctttagattggacaatggctaatgatttttgagcaagggaaaagtcatttatgagaaaacactttgattttaaataatagttacaagcccaggtaataaggaagtataataacaattgtatttgaatgaaaaagacttggaggagtaaagatgagagcaaagagacaacaactttggtcagcacttacagataaagaacataaggttaccttggttcatagtaagcatcatggttggttggccattggattgaccgcttttgcattggggacagcgggcttcagtttggcaactagcggtcaggttgtgcatgcaagcgatcaaccttcaacttcgcaacaatcgaaggcaaacaatggacgagtttggacgctacggccagtcagtcagatagaggcgcaaattaaggcttcaaatagtaaggtttatgacattcagtggggcgatacactgtcaacgatcagtgaagcgctgaaccacacaggttttacaacctcagttgatcgtctggctgccatcaaccggattgccaacgtgaacttgatttacgctggtgctaagttgtcacttcaaggtagtggcgacaacgcaacagtaacgacgcaaaatgctgccgggacgaatcagacgtttaatctgaatccagctaaaccggcacgtttaacgccagcgcaacaggctgaagtgaaatacacaactattggtggctcaggttctggcgctgggcagcaaggcatctcctcaggaacgggcattgatcaggctgccgaagacgccgcgcttaaggcagccgctacggctaaggcaaaagccgaagctgaaaaagcagctattttaaagcaaaaagaagaagctgaagccaaattgacggctttgctcaatactgaaaatgctcaaacattgaccgatcttcaagccaagcggacagctgcccaagctgctgttgacgctgccaaaaccaaggttgatgcggcccaagcaaaattgccagcagcccaaactgcagtggcccaagcgcaagccgcttttgacaccgccaatgcagctgtgaatgctaagcaggctgctgttgatcaagcatctgcacaggttaaaacactttctgctcagatgacagatttacagaatcaactgaacacgttgaccgagcaaaccaaagataatccggactcacaagcaacgattacgactgttaaagctcagctagctgttgcacaaggcaagctgactagttatgaaggccaattagctgatgcaacagctgccttggcagaagccaaacaggctgcaaaccaagcggttcaaaatctcaacacggctaatcaggcactgatcagcgttgacaatgaagccaaggcggcccaaaacgattttgcacaggcacaaacgaccttaaaggcacttccgacatcggttgccagccaaaatagtcaagccgcgcaagcagtcaaagcacaactcgctgaactgaatacgaagatcaaccagcttgatcaaaagattaagactttagatacccagatagctacatggcaggatcagttgaccacagcccaaaccaatgtggaagcagcgaaggccaatataacaactgctgaaacacaagcatccaaggttgatacgacagaccatcaacagacattgacagcagttcagcaaacagttgctgatgcagaaaagacaattccaacaatccatgttccacaggataccgaaaagcaggttacgattaacaaagatgaaaatggtcaggtcctaaccgatcttactggttacaagttgctcacggctggtaccccagttaaaacggttgaaacattggctaatggtgataccattacgacttatactacgaccaatatctatcacaagattgcgcatcaagttgtcaataaaaccgtgaacgtggatgaagccggcaatattttaaccagcacagatggttacacaaaggtctccagttcggataaatccgttgacaccactgatcctaagactggtgacatcacaaccacagtcacaacaacggttgtctggaagaagactgagacaccgacgcacgtcactgttaataagacagttaatgtggatgaagccggtaatgttttgacaagtacggacggttacacgcaggtatccagttccaagaaatctgttgataccaccgatcctacgaccggcaatataaccaccaccattacgacaacggttgtctggaagaagactgagacaccgacgcacgtcactgttaataagacagttaatgtggatgagtcaggtaacgttttaacgagtacggacggttacacgcaggtatccagttccaagaaatctgttgataccaccgatcctacgaccggcaatataaccaccaccattacgacaacagttgtttggaagaagaacgagaccccagcgtcaacacacacgtacgaccttaagacagttaatgaagataaatcgggtcatgttttaacaaatacagacggctattcaattgtatccagctctaaagagtcggttgatgcaacggatcctaagaccggcaacattaccacaactgttaccacaaccgttgtttgggaaaagacgccgcagcgtttgatcaagaaccaaaccgtgaacctggatgaggcagggaaggttttgaccaacacgaatggttacaatcaggactccagttctgtcaagacaacggatgtcacggaccctgtaactggagatgtgacgaccaccttcacgaccacgattatctggaagaaggatacgacaggtaacaatgtcattaacaagacgattaatgttgatgaaaataacaaagtgttgacttcgacagatggctattacttcctaggaagtgggacaacatggctttctagtgggggcaccacgactgtatcagtcacaaacaagtatcacaaaacgcaagccacgaccgtttataaagaagttgatctggacgagggcggttatccgttgacagacaagactggttatatcaaggtttcgtctacgccaacttctacgacggccctcgcaggcaactgggacaccgttaccacggtcacgacaaccaatatttggcgcaacgttgaggctgccggaaccatcatcggcgccatcaagagtgtcaacgatgcgacaacgaaactcatagaaaaacaggttcaggcaaacgatcagagggtctccattgaacaagctgaagcatacactgacgccgatttgacgctagcagttgccaagaagttcaatgtgctggttaatggcgagcaagcaagaactggtcgtactcagactgtgctgacatctgatccaaaagcctacaagatggaagcgccgcgcgcggtcgaagtcatgtataaattcagccacacccgtccagtcaatccaccagcaactggctcgcaaaatgtcacctatcaaaagggtgaagtctacatgaatcgcagcactgaaaacatctcgacttcttcgctctggaaaaaggatgttgacggtaatgctgataaactcagcacactgattgccaatgcgatgttccaacagtacattgttgatgaacgtccagaaaacaatcacggcgtaacaggcggtcactacgaaaacatcattaactctggcttcaagaatattgttatcggagtttatgtcgttgatcagggtgactactacgcagcgtcaaccgctgttgctacaggtaatgatgggacttacaacggcaattaatgtttgcctaaaatgatcttcaaccacgctggtgctgcggaatctctttcgcacgcgggttcgattcctgcggtggttctaaagtatcaaacatctggatgaacaatcttaaggttctttttctcaaagaaatacatgaatgggcaaaacataataccaaaaagtagggtctgaagaagctgtcgtggactagtcaggctctccgttattggccgctcttggagagaaaatagtgccaacagaacgtgaaaatcaaccaatgttaaggcaccggcccatattgttttggtacgcaatttttttaaagcagctggatacttttctgccgttacttctcgattatttaaacccaggcgaccgactgtcgtgctaatggtgataaccaagatgctaaggatgctcgccagctgaatgattaacaaggcgtcataagcattctcatcatggtggattggcaacattaagccaatagccgcaaaaaagagttcaaaaataaagatacctataactgcgtgcatggaggcacgaccgaggacggcaagtgcgtgttcatcaataggatcttgaatgccaaagatatgtttgatcagtttttttcaattcgattcattttctttcctccaaaataagctgttcaaatcggtttttagcgtccacgccagtttgagacaaagagccaaagaaggattgtatttgccgttttcaatgagattaatggtttgtcgagcaacgccgattttttccgccaaagccagttgtgacattttctttgcccgccgatagtcgcgtacgcggttcatgagtttacctcccgtatctttaggtgtcacatttatatgacatgagcaatatacgagaaccttcacgatgtgtcaattataattgacactttattcgcgtgcttttgcaagattgaaatttttagccgtagtcaatcgcaaataaaaaggcgacatcagcgaagtgaggtgagacaattgttttgtgacgtggatactttcgactcaagcatgaagtgcgattggatcggtatatgtttgaaagaaggtgcgagttgaagataattgaccgtgtggcgaaagtttatagtttaggtagcgttaaacatctacaggctttgcacaatggcaaaacgagtgcggcatggcaagttgaaacaatgaatgatcgatacatcgtgaagactattcaaagccaaaagcaagcagtctttgagtttgcagtgagcaatgctgtgcgtcagaaaagtcttgaactcacgcctgagatcttattaagtaccgcttgtcagccatttgtcgtcattgaaggccagacgtatcaagtacaggcatttttatcaggcacagaacggctgccatccttacgtgaaacgctcaaaagctatcggcagatgcgacaggtgctggatcaatttgactattcattttcgccacccgattcaaggccattggttgcattgtggcgtacccatctagaaacattgtctgaaaagaagccagctctgtttcatcagatagccgccatggttcctgaactgaagcgcattgatcagtcccgcgatgcttggattcacggagacttagggaagtggaatttactggtgactaactcagggcaagtcgttgtcatcgactttggtgaagctcggcttggcccgaagttgttggactttgcggcgttgtttcaaggttttatgccgaaaaataaacaggatctgacggcatatttgaatgaattcttggctttatctgggattcaaattactgaccgccatctttttctgatgacggttcagctttggttggtgaaggggttgttgattgtcatcaatgagcaagctagtcttgcaggcgtttttcaaaatgcaatcgaacttgtttcatcactggtatgatcaaatgaatggttaattcactcgcgcacaattgattttcccgcccgaaagtgtcacactaaaagtaagtaacaagaaaggtgacgatacaatggcaacgatcaaattatcgcaggcttttgttgatttgatgaagaagaagcatcttgatcagaagacgttgttgctgattacagatgatggtggcgggcggtattcgttgcaaggcggcgcctgcagtatcgggacgaagtttacgttgattgtgcttgatcaaccggattcggactatcaggtgaaattggaaaatgatgcgggtctggatctatacacgtctgactatgacatgattttctttgccagcggtttagcgatggattttcaaaatggagcgatcagcattaaggatgatgctcacgcttatttggatggcagtgttcgaattgccaacggtgcagatgtgttggcagccttcaaaaagggaatcatggttagcggcgcaacttgttagcaaaattagtgctgtgatgatttagcgcattagtgaaaatgaaatggttgcactttttgtgttgctgatgaggcaaattaattgacgatggttttgtcgtctgctaagctacagctaataaaatttgaaacagaacggaggcattttccagtgcggatcaatggacgctttaccctatcaaatttgaacgcagggactgcgttggcaatcagttttttggttgcggttcgcggggatgcttctggtcgttaatcatgtgtatgttttatttgcgttgattaaaggcggctgcgaagctgtctttttgtgtggccgcgagcaagtgtgttttgaagctgtcgcgtaggtgcatgatgttgccaaaagcgcagtcccaccagttagcgattggccagaccaatcgcttaaaggggacttaaagcatgcaaactattctacgaatcacttctatccgatatcgctggttgcttggcttactgacactacgagtgctgattgatggttttaacgttttaatttcgatgctgatacagcttggtttgaccgttgcactttcaggacaggtcaacttgcttgtggccatttttgctgggatgttagcggcagcggttgtctacactgggatttattttttgtcaggcgttgtcacagaacgtctcaaacgacgagtcagtggtgacattgcgactgctttgatggctaactttttgcaagacgacgcgacacaggtccccgataatggaactgctactaatctgatcgtaacggacacgcagcatatcatgcaatttttggatgcaggggttttgccactggtcgattttgggatcacggtttttcttggcgtcatttatgtcgtgacgcagtcttggcagttggcattgatgtttgtagcattcggcggtttatttgccggtgtttcgcggggcttgtttcgtcaacaaaatcaagcgcaaacgacttttattcaaattgatgacaaacacaaagcgtttttcaatgattttttggcaaatgtcgctgtggttcgcaatctgaatgtgtttgcttacagtcgtcaacgacacgctgattattttcagcaagcggcgccaagcatgaggcaaatggcaacggcctctggcgcgcttgccggtattttcaatggtggcgtctatttggctgaggtcttaacgttgatggtgggttttgccatgttaaccgtcactggcagctcagttgccggtctgttaggtgcctggaatgctggcgtgtgttcaatcctatggccatttttgggattagcgccgacgattggtttcttggctcagcaacgaacctctattgatcgcgtattgccacgactgacacagcaggtaatgccggtattttcgcctatgaagggggactttcagccggatacgatcaaaattcgcggcacaaaggtgagtttccattatccgcaaacgaatcgggagattttgcaacatttggattttcagattcataatcaaggcatcacctttttgatcggcgcaaatggtgctgggaaaaccaccttactgaagctgattctcaacgaattgcagccaacgactggcaaaatcgagattcagggtgtgcctgctaaaatcaagtcagcatcgttgtttgcgtttgtgccgcagcggagtgtgatgtttacggcatccatgacggctaatttgctattggcttctcaggctgatccgacaaagttgccagcattattacagcaactgcaacttgatcggtatgctgccgatcttgaccagacgttacaacctaatcaattgtctccgggtgaacagcgccgattaggaattattcgcggtattgccgcagatcgtccatttattgttttggatgaaccattgtcggacattgatgcggttaatcaacaggcagtcatgcaactgctgcggcaggaagctaagaagcgcggggttgtgatcattacgcacacgtttgattttgtgactgcggcagatcaggtgttgaaggtgggtgatcaccatgataactgatttgaaaaaagtttggcggcttgttgacagtccacttgtctcgattttatggttgctggccttggggtgtgctggtcttgagttatcactggcacaagtgattcaaagtgtgatgcaacatgctgcttttacagtcagcatgatcacgttagctgcagctacagctttggcgatagggttaggtcgctctgtgatggcaaagctgcaaacgcgcggtcagtatcaattgattcaaagaattcaaacgcaattgatggcagctttgatgaatgggccgattgcaactgacaatcaagctagcgggcggcgggtcaacgggttcaccacggatgcgcagactgctgcgccgttgttgatgcggtccatgacggctttggtggttggtggtttttcctttttagctgctggaacatttggtctattcagctcttggcaactaacgctattgatcatcggtctgtgtgcaacggcacttttgattccgaagatgatgtccggtcgcttgcaaacagcgcaaaatcagcgacagattgagaatagtcagatgcaggaaagcctcttgcaaattttgaacggtcgcgaattgctaaaaagctatcaaaaagaacagtttggtatgcaactatttaacggcgcctatcagaagttttctcaggcacagtatcagatggggatgcaacaagtcaaaacagttgtgatgggattttcgttggggctcgtttttgacattgcgattttaggcattgagctgctatttgttggcttcaaggtcatcaccattggtcaatttgctgcattttccatgttgacaccgagttttacttggttgttttacagtatgccaagtcagtatgctgaattgacgcgcaacttggtgtctgccaaacggttgttgccgttgatccaatcgctgcataaagaggagttggcaggtggacagtcgcgacaaaaaccagctaaatttgttcttcgtaatgtcacttacacgtatcctgatgctacgcaaccgactttgaaccagctacagttagagctcgacgtgactgcacacgcgaaaatgttaataactggtccaagtggtggcggcaaatcaactttgcttcgcctcatgctaggtttattggtgccacaagctggaacgattcagtttgaagatacagacaagcgcgatttggcggcagcagcaaacagcatgagctttgtcccgcaggttgttgcattatttgaggacacattggccaataatgtcacgcttggccggcaagtatcggatcagcaactgacgcttgtcttacaccaagttgggctaaccgattttattgcgcgtctcccgcaaggactggccacgcttgtgcatggccaagatggtgtcaatgtgtcggctggggaattgcaaaaaatcgggattgcccgcgctttgctggctcagcggccgatgttacttttggatgaaccgttcgcaaatcttgatgcggcctcggcacagacacttggcctcctcttgcggcagctgccggtggcgatgattgtcatttcacatcggcatgatattggccgtttttgggatcatgcagtcgtgttgaaggacggccaactccatgtggcgggcgaaatgttaccgggtgattattctcgaaagatttagttggcaggggtgatagtctcacgtatagttaaggcgtcatacttttaaatgacacacgggcttttgcagtttgcatttgtccgcaaacgataagggggagacacatatgttcaactggttgattttaggccacattatttttggactcgttgcttttgcgggttcattgttgctggcgctaggtttccgtacctctttccatagcttgacagccgttcaaaaatggggcattggtttgtcgatcggcggcttgttcgccacgatggccttcgtgatgtttacggccgctaatttgatgccggcaattttgttcacacttgcagggatcgccttgttagccgttttgatgcgcaaatcagcgcgcgcataggcgtcaagtcagatggtatttttggttcagtttagctggttgcggcaacacgctgtgatcagcttttttgttgccggtcaggagtagacaagcgcatttctgtggaaggaaaatcccagtaatcgtggtcttaccttcaagtgtcgatttattgactttaacaacattacatggtttaatggtttaaacaattaaacgaaagggtgaagaaatgtcaagcctaaaacagttgcaaaaagaactatctgatgttggtgattttcttgtcgcgctgggcgatgaaaagcgtcaagcgattatcatcgctttgttagcggatcaaccttgtcagggaaaacgcgtaagtgaactgacgacggcgactgcgttatcgcggcctgcggtttcacatcacctgaaaatcttaaagcaggcgggattagtggcataccggcgcgagggaacgcggaattattattatttatcccatgatacaagctcaattaatcagctgaaacaagttttggatgatgtgacatccgtgattcaggaggcagcaaaatgacaaaagtacttgttgtgttaacgaatacaacccgttatcagcatacagatgcaccaaccggattgtggttgggagaagcagcagaatttgttgatgcgatgcagcaagccaacatcgcggttgactatgtgagtccgaaaggcggctttgtcccccttgatccacgaagcatgaaatatacgaacccagcaatcatgaaaatatatgaagatcacgattttcaagaacgcgctttgacagcatcattacggccagagcaagtcaatccagctgaatatgacgccatttatttcactgggggccatggcgttatgtgggattttccagacaatcaggcacttcaagcaatagcgctggcaatttatcagcatcaaggatacgtgacatcagtttgtcatggcgtcgctggtttgctaaatatcaaagaccaagctggtcagtatttgattgctggtaagaagatcacaggttttacacatgctgaagagattttagccggtaaacaaaaagttgttccttttttaaacaaaacggttgcaaataaatacaatgctcattttgtacaaaaaagagcatataagtcgtttgcagttcaagacggtcagctaattaccggacaaaacccattttctgtcaaagcactgactgatttactggtaccgcaactcaaacattagttttttaatgctgattttatgttgcctataagcactgatacatcgaacttttgttgccaaatgatgacgatgatgcaatgccaatgagtcaattttttaaattttcacattgacgaactatttttttaaaagtatgctgttgctaatttcttcggaaggagtcgccgtgatgacaaagtttaaccaagccatgtccatgtcaatgtgctgctgctgtgaatcacacagcagttctatttacatggctagggtttggtttgggtgacgggatcacttgacttgaacgaaggacaaaactggcggtgtatctagaactctagatgcatcgccagttttattttgttttgggagatgaattttttatgcagaagaaccacttggtaacagcacttatcaccggcttggcactcgccaccattcttgtcgcttgcggcagtaaaaacacttcggcgtcgggttcaaggcagactttgaatctgtcagaaacagatgatccaaccacactcgatgtgaatgatatgcggaactcgaacgaaaatgacattttgtctgaggtgcaagaagggctgacgaccattgaatcgacgaatggcaaggataaggtggtgctgaccggcgccaaatcttataccaagtcggccgatgggttgacctatacattcaagttgcgcgatgcaaaatggtcagacggaaaagccgtgactgcccagcagtatgttgattcgtttcagcgtctgttgaagaaagaaaatgcttttgcgcaggcttcgagcgcgtactttatcaaaggagccgaagcctataacaccggcaaaggcagtgtggccgatttaggggtgaaagccttggatgcgaaaacactgcaaatcaggctggcctatgcttatccatcacttttgtcagatatggcaaccgtgatttattacccagttcgcttggacaagattaacaaagtcggcaataaaaagtggaaaaccgacgtgcaagatcaagttttcaatggcccgtttaaattgacgtcttggaaaaaggacgacaagatcacgctcaagaaaaataaaacatactggaacgctaagaaagtgaagctccagaccgtgaattacacaacggtgaaaaaaccatcaacggttctttcgctcatgcaaagtggtcagttggacgcactatccgcctcaggcaagctgatcagcgattttaatcaactcgccaaaagcagcaaactcgtctctcgaaaacagaacggttcgacaacgaaagtgttgatcatgaatcaacacaacggtggaacccaaggacttttcaaaaatgtgaaggttcgtgaagccttttccttgtcgattgatcgaacgagctataacaaggcagtgaatgatggtcgggacaagccaacatacacgatggtgccgcagtcgttggatgtgagcgggaccaattatggcgagtatgtcggcaatccgttgaaaacggcacaggcacagtacaacacgaaggcgaagcgacaagcattgttgaaagaaggtttacaagaattagggaagtcgactgatttgactaaactgaactttgtttatttgacgcttggcagtgatgatacggccacgtggttgaagcaaacgattcaggaaaatcttggtgtcaaagtgaccgtcaaaacagcacctgatactgccagctttatccaaatgcgaaatgacaatcaatacgatctgctggctaatggctggttagcaacggctgatccgaacgcctacttgagcctatggaattctggcaatggattccaaaaattctttggtggctataacagcaagacttttgatgatctggacgaccaattaaacggtaacctcacggcggcacaacgattaacgctctacaagcagcttgaaaatcagttggttgccaaggacttcggtgtcgtaccattgaccaacccgcaatcgcggatttatatcaataagtctgtcaagaatcttcaaacgacggtcttcggcggtacgtttaattacacttacgcatcaaaagaatgatgactttttgatgctgattgatgttggcggttggtgtccatagggttttaaaggagatgtcagtttatgcggcatgacgatgtcaaaagggggcaattagcaccatggtcaaattgattgttcgacgatttgttgaattgctgattgctacttttttaattgcaacggccacattttttatggtcgcagcagttccgggagatgcgttgagtgcgcaaaccgacaaactgccagcagctaccagagcacaggtgtatcaaaatacgggcttagataagccagttttggaacgttatggtatcacgatgaacaacatgcttcatggtcaatttggtgaatcaatttctgatccgtcagtgacgattagcagcttgattcgggatcgcttgcccgcatcggctcgattgggcattcaacagatgctgtttggcattccactggggttgttactaggtattttagcagccgtgtataaaaatacatggcttgatcggacggtcaccattgtagcgctttttctgatgtcaatcccaagcctcgtgctgggattgttgttgcaaagctactttggaggcaaacttggctggtttccaatcattggttggcccagcggcgaccaaacttggtggggcggctggatttatacgattttgccaaccattgctggcggcgtgacttacatcgcaatctatgcccgccttttaaaaaattcgatggtggatgttgcctctagtgaatatgtcatgacggctcgggcaaaaggactatcagaatcgcagatagtgttgcaccacattgttcgcaatgcttcaattcccatcatcacttctttgccggtgaccttggcattcggcatcacgggttcaattttcatcgaaagcatttttgtgatccctggtgtcggccaatacttcgttaccgccttaaacgaccgcgatgtgcccatcatcatgggcgaaaccgtcctactggccatcctctacatcatcacgatgttcatcaccgatatgctatacaccttggcagacccacgcattaaattatatgacagagcgtgagccagcccggttagaaaccggagtgtaagaggcctcaagcgtgatggccgtactttggccattgcgcttgaggtccttacacggaggtttctgggctggcgaacgcgtttaaagaagagcgtgagctgacccggttagaaaccggagtgtaagaggccttgggcgtgatgggccgcacttgggccattgcgcttgaggtccttacacggaggtttctgggctggtgaacgcgtttaaacaaagtgccattaaggaggctaatcaacacatggccgcaagcaatcaggattttcaatttttcaaaaaagcaccgacagttggtagtgaagctgcatcggttggctctgacgcaacttttgatcagtcaggggcaacgccagaaatcaatgtccacgagggtgtgcctaaaagtgttggtttctgggcctcagcgcgtcacaagctattcaaagatcggttagccatgttctggaccgtgattttgattttaattgtcatggttgcgcttattgggccaaaaatacaacactatgatccaaatctaatccgagttgacagtcggaatattggtccgagtactgcgcattggctggggaccgatcgacttggacgagatctttttacccgtctatgccttggggttcaagtgtccttattggtcgctattttaagtacgatcttggcgattgggttcggaacgatctacggcatgactatggcattttttggcggctgggtggatgaagtgatgatgcggattattgaagttttcaattcacttccgagtttgttgattacgatgctgctgatgatcgtgctaggcgacggcgtttggacgatgttatttgcgctggcagtgactagttggtcgagttcagcacggcaggcgcgcggtttggtgatgcaattgcgcggattggattacgtgacggccgcagtgatgttagacaccccgctatggcggattatgacacgacatctcgtacccaacatgatgagcattttgattttggacatcggtcaaagcattccgcagaatatttttggtgaagcaagtctaagtttcttgggaatgggcattcaggcacccaataccagcttagggattttgatttcaaatggtcaggatcagatgttgcagcaccccatgcagctttatgtgccgattctagtgttggttgcaattgtttttgctttcaacattgtcggggacggcttgcgggatgcgcttgaccctaaattccaaagctaggctaattttagcgcacatgacagtaagagacgacctttgtctcacccaaaagctactggtatgtgcctgaaatcaatgcgaagaaaaggaggttttttgagtgatgcagaaacatcattggcaaattgtcgcaggtgcgtttgctggccttttgttggtgacaacaggccttgcactgcgccaaaaccatttcctgctagccttgttgtgggggcttcatcaaaccttttggcttcttgcaggcgtgacggtgttcttgctggctatgagattgatttggcatactgaacgaccgcatggccatctgactgcacagtttatcaaacacttaccgacaaatttagagatgagtgtgctaacggcgatcaatttgtttggcggcattatcgtcgatctatttctatatgaaaagtaagtggttagcggcattgttaccccagaatgcgattgaaggaagtgaactcatggcgaacatcgttacagttaaaaatttaaaagtcgtttttaatgaaggcaacgaacaagtttatgccgttaacggcgtggatttaagtttgcatcaaggcgaaacattagcgctggtaggcgaatcgggatcaggcaagtcggtggcaacccatgctttgctggggttgttgggcaaggatgctgtggtgactgctgacgagatgctgtatggcgagaaggatttattgcagacgagtcggcgtcagtacacccatctgcgcgggcaagagctggggctgatttttcaagatccacttagcggtttgaatccgacgatgcgcattggccgccagattggcgaaggcttgaaggtgcatcgccatgttcacggtcacgccttgaagcaggcggtgtttgcggcgattgaagatgtcggattagctgacccagctttgattgcccgcaaatatccgcatgaactttctggcggtcagcgtcaacgcgcgatgatcgccatggcgctggtgatgcagcccaaagttctgattgctgatgaaccgaccactgcgttggacgtgacgttgcaggcacaaattttggcgttgattaaagcgcaaaaagtcaaacatgatttgagtgtcgttttcatcacccatgacttaggcgtagtcgccaacattgcggatcgtgtggcgattatgtatgcgggaaaaattgtcgaagtggggacagctaacgagattttctatcatccccagcatccctatacttggggattgctagatgccgttcctagttcagatgatcaacgtgaccaattgtttaccttgccgggaacgccacctgatttgcatcaacctattaagggggatgcttttgctccgcgcaatccttacgcaatgccaatcgactttaaaaaagaaccgccgttgtttcaagtatcgccgacacattttgtacgttcgtggttattagacccgcgaaccccacactatcagccaccagtcactattcagaaacgttgggcgcgatttgctcagttgcatgctgaacagacaaacgatccagtagttgaaagccaacaagcgggaggtgtgccagtttgacagaaccgttattgacgatgaacgatctaagtgtcactttttataaagggcggcaagcaatcaaagccgttgatcaaattaacttcacgatcaatgccggaaccacagtcggtttggttggcgagtctgggtcaggtaagacaacaactggccgcgctatcgctgggattggtccgatttccggtggtgatgttctttttggcggtcagtcgatccgtcatttctcacatgcggcgcgcaaagactttcgccgtcaggtccagatggtgtttcaagatccgttcgaatccttgaatccgcggcaaaaagtggtcgatatcattgctgaaggcatcgacaattttcatttggccacctcgagggaagcaaggctggcgcaagttttacgactgttgacgcaggttggtttacctgcagacgcgattaatcgttttccccatgaattttctggcggacaatggcaacgaataggcattgctcgagctttggcggtacagcctaagtttttagtgcttgatgagccgatttcagcgttggacgtgtcgattcaggcacaaattgtcaatttgttgcggcaaattcagcatgaacaacacttaacctatctttttattgcccatgatctatcgatggttcactacattagtgataaaattgtggtcatgtatcaaggtcgcatcgttgaggcgggcgatacagatgcaatttatcaccatccgctgtatccttacacgcagacgctgctggcatcggttccgcaggctgatccaatgcttgagcagcaaaaaccggtgttgcactttgaccggcaggcgcttgatccgactgcctcactggtcgaagcagcaccggcgcattgggtgttagcgcaataaacgcgagatgaaggtgtttagcatgttaagttatgtgattgatgacgattttaagttggcattaccgcgtccgcggctggattcagcaccgctctttgcaattatcgatcaagaacgcgatgatatcggtcgatttttgccttgggcgaatggattaaaaacggaggccgaggaagcaacatttttgcggagcgtcaatgatcattttggccgtgaggagtcaatgaacttggttttatggtatcgggatgagccggttgggatgatcagcttcaatcattttcgcccgagtgatgaaagtggtgatatcggttattggcttaaacaagctgtgcgtggtcacgggctgatgcatcgggcggtgaaagcaatgtgccagatcggttttgaagagtacggggtcaacaaagtgatcattcgcgctgctgtcgacaatgcaccaagcaatgccgtcgccaaaaaggccggttttcatcacgatggcactcatcgcgccggggaaaaactagcagatggtttccatgatgaaaatgaatactccttattacgcagcgagtggttacaaatgaacagaaaggtctaacacaaacagcgcctctcatgccttaaaaaggctgagggacgctgtttcattgttgatgcgaagaggacgtggaaatgaactggaaaattgtaatatcacttcaatcattagctaaacagaaactgcttgccaatgattcagatacgcacagtttcagccgcgggcatttgaatctccctttcaattcggccatctcgtagcacaatcgaccgtgaagtttccccagcgagttctaaatcatgggtgaccatgatcaaagtcttgccttgattgaccagttcttgaaatagcttcatgactaactgacgtgaatgcgtgtctagtgcacttgtcggttcatctagaaaaatgatatctgggtcagcaagcacagttcgcgcaatggcgacgcgctgttgttctccgccagaaagcgcgtcaatcgactggtgtaactcggctgtcaattcgagtttcgctgctaatgcgtcaaccattggcggtttaattttctgaccatttagaatacccggaagcagtaaattgtcataagcagataaagagctgactaactgaaagtcctgaaaaataaaacctatctctttccgacgaaattttgccaactttgaagcacgccactcgtatggtgattttcctttaatcaggattttgcctttagaaggtggtaatagactagaaatacagtagagcagtgtcgattttcctgatccggatggaccaacaatcgacacaaatacgccttgattgacgtcaaaagaaatatcatcaagcaccttcagcgtatttccctgagctaacgctacctcttttgttaaatgtttgacggaaacgactacatcattcatctcttttcctcctcgtatgcttattcattgacataagctttgcggtgcgtccgttctgaccaatagaccagcgtcaaacaaaggaaaaatattccgaataccccaaaagtcaggaggatattgacggtccagtttgccttagaaagatcaccgccgcctaaaaacgcaactcgcaacagcggaatagcgaataggcttgttccaagaaatgttattaagattgcgagaatagttgcagcaccgatttcggtcagttttaaattgaagatccagcttggggtgcacccagagaaaaagtaatgatcagattctgctgccgttttcattttaaaaagactaattgatgtcaaaatactggcaagactaatcatgataggtgccccaaatacaaaaatcagactcactgccagatcatagataaccgcgccgccattgttgccatccactagcagcttcgtattaagaaacaaagcgatgaagtttccggcaagtaacacgatgacactgaccgggcgaattaatttaatgaccgcctcctcgtggtgttgcaagtcatgaaaggcggaacggatcatcggctgtttggccatggacggtatatgaacaatgacgcgaaccattttgataaacaacggtctgatcaggaagttcatgctgataatcactaaaggccatagcaacagtaaaaaattcattgaacccttcatactgttgttatacgcattggctgaagttggatcaggcacaggttttaaaaataggaggattgtcacaaccaaacttgctataagggtgacgattcctagaaaactaccgacgatttttcgatgcttgtgcagactcgcaactaacgcgccttttcttcgttggtaagtcttaaggcagtaacgcatacaagtcatcacgatcaacaaagcctgaagaattaaaacggttcgaaccatttgccatgagaagctcagaggtagcctgactaaagactcagaagaagcactcacgggtaagaggcttaaaaaaccgcggccagctgggattgcgaaaagcatgccgataaccgcgccaaggacaccagtcaggagcacttgcccagtcatcagaaaacttaactggacaggggatgcccctagcaagagcatcacatcattcgtgtcatcaaagaaatcgatacactgtttcatggcattgttcgttaataagcacaaaacgaccccaccaatgatgatcggcgtttgcataaaaacaccataatcagtgcctgaagcgacaggaatggttgccatcgccgtcagtaaaattagagatgtactgaagacgatgccggaaacaatgaaaatcggtaagagggcctgccatatcttccagtgttgtaaaaattgtttagctatgattttaagcatactttccccatttttttgtcaatagatttcatcgtttagggcgcattatttagtttcaacccacttttcaagtaggtaaacattcactgcagagatcagcagaatggtgacgatgaagattccgatgccgacgagaacgcttgaagaacctgtcaaagtattgctgtcataaccaccaaagggtagtaagaacaggcgttggacctgatcgaatatgaacgaagcaacaatgataaccaccagatagataatccattgaacaaggcgaattcgagtttctggcaggaacgccataatggtcactgataacaagtgaacgagactgataaatgcccagataaatatccctaggacaatcaggaatatccccatttcgactaacacggtcatgggatcacccgttggtaagttgataccccaacgcgtcactgcaagtgctagtataacaacaccttcgaaggcagcatatatcagaaatgataggcaggttgccagcagattagcagtataaagtttaaggttggtggttggcactgatcgatagtagttattgacccaaacacgctcttgaatgatcgccaatctaacaaaaaacaccaaaccaccaattacagcataagcaaagagaagggttaagacaaaatcaacggtgatttttgcttcaccagtgaacatcgctagtaggattgatacaacggtcgcaaccagagtcacgatgaatgttttaaatgctgttagtgaacgttgccgggtcaaggttcgcatcattgtccatgtattagtcattgttggtcacttccttcatagaaactttcataatagttttcaatactcatgccggttttttctcgcaactcttcggcatttttttgtgccaccacgtgcttgtctttaatgatgacaacctcatccaacactttggcaacgtcgcttacgtgatgatccgaaataatcacagttgccgctgccggtttccacgcaatcaagttactgatgatccgtttgcgcgtcatgctatcgataccttcaaaaggttcatctagcagataaagttgagtttggcgggcaagggtcagtgcagcgatcaattttttgcgattaccttttgacagggccgccagcttctggtgggaatcaagatcaaatgtcttcaggaagttagcaaactcggcttcagaaaaatcaagatacatgtcggcataataagtggcaatttgcttgagcgttcgatttgggttgacgccatttaacgactcactgaagctgcttagttgtttccgttcaacaatactttctgatgagccaatttgaatggtgccatgaaaagtggtcgcgaccccgtttaacagtcgcatcaatgtggttttgccggcaccgtttgcacctaataagccgatgaagtgaccttgaacgaggtcaagattcaagtcgtctagaatcactttacgattgcgtttataagtcaattgtttgactgtgatcatgttagttgtcatgttttacctcctgctcatcaacataagcggcgaatgcgtctttcatttcctcatcacttaaattcaattctgatagttggtgataaaggcgatctaattctgttgcaatgacgcgttttttcatatcaattagcactttcatatcatttgtgacgaaattgccgcgtccccgttttgtttcaaggacgccttcttgaatgagttcagtcaaggcgcgctgaaccgtgttgacattgacggttaggtctgcggcaagttgccgaacagccggtagttgatcgcctgatttaagtcgatcggtgatgatttcctgatacaagtattgtttgatctgataatagattgggatcttatcgtcaaattccacggtgtgcctccttactagtgtattagattactaatacactataccaaggatcttgtgttttggcaagttaattcacttaaatagttgatagacgaagcaagagcgtttgtggttttaatttagtgagatcgtgttagaatgcaaagcatgaagcttcaaatgaaggcgagggcttatgctcatgaaaaaatggatcaaagtcatactggcagtggtcatcgtactcatcattagtggcggtgcgtggttttggatgaatcgcgggtcggcaccgtccactgcgcgagcagcaggtacgtaccaaacgccaacattgtttgttcatggttttggtggtggctatggatcggaaaaagatatgattgctgatctcagcaaacatcccggatatcagcaagtattacgctataccgtcaccaacactgggcaattgtccgtgagcggttcttggtctgccagtgtgaaacacccactgattgccgttgtcttcagcagcggccgaccagatgcgccaaccttaggtaaaattctcaaacaactgaagaaacgttatggtatcaagaacttcaacgctgtcgggcactcggccggttcggctgcttgggcaaactgggcagtgacgccagataagcaggggatgccgcaattgcggcgactaatcacgattgccgggccgtttaacgggtttcccggtatgccgggaatgaacggcggacagcatattacccttgctaaagatgggcggcctaacgttatgtcggatcggtacaaaccgttgtatgacaatcgcaggtattttcccaaaactgccgccgttttgaatctgtttggtaacctaggcaagggcacagatggccgagtgccagtcaattcagcacgttccttgcggtatgttgttgccgggcgggcgaaaagttatactgagcgcgagattaccaatagcaaggcgcagcatagccagctacatgagcacaacccattggtgaatcggtatctgtatgaatttctgaataatgggaaaattacgaactgatttaattgaatgagacattaaaaggccttcgacaacttgctacctgttgaaggcctttcgtgttttagtcatgatgtcattttgttagagattgtattgatggcgcagttgttgaaagttgggatttttttggagaaaagccatttcgggatcagcggtgaagatttgcaacagttgccgttgagcttccttgagcgatacctgttccttgcttttggctggggtcaaatgctgcaataccagtggctgcggttgattgagattggccaacacctctttaatgatcgtaacagcttgatttgggtcattactagcttctgcaactttcaactgagcttcgagcgtataaggattggagatagggatcaggttgtctattttttggctcatgtcagcataacgtttggcaacagcaagctggtgatcagcaagaccaacttgagtgagtacattcagtaagcgagacggcccccaagccagtaccaagcaacttttcgccgctaatgtaagcatccttgagttgaccgcgctgtaatttcaattttggctccatggcgttataggcgactacttcaggaggtaacagcgtcaattgcttctcggcagcatcaaaatctttttccttgaggtacaggtaaaagagactttgggccgctacttgtgcctgtggcagatcagtgctcttttccgcagtttgataaatggcaacaatttgttgatacactgaaggccagtctgcttcaggtatttgacttttcagactttgtaaaaaagccgcaatcatcaactgcaaactattcattgacgggtaatgtgcaatctgcgcttcggccagatcgacggccgcttgccatccggcatctttggcagtcgtcatcagtttttcgtataggtggcgactctcttctggatccatcgtgacactgaaagtaagcagcgtattaacatccgtgcctaaaatgcgagccaacgctggcagcaaagtaatgtcaggatatgacacccttttttcccatttactaacagctggggccgaaacgccaattttgttggcgagttcctcttgcgtgagtcctaaagctaggcgccgttcgcgaatcacttgatcaatatgcatgatcgttcaccccttccttattcaccttcattatcgttgccaaggtgaaggaaaacaatcgcgccgttttcaagtttggcacagaaaaattaactgttggttaagttagttgaattgcgttaccaaacctgggccaccgccattatcaggagcatgatcccaagaattggccgcaagatagctgtcagcaggcgcggatcgaagcgattgagaatacgcggggtaatggcggcaccaaccagcgagcctaacatcaataagccaccgacctgccaagcaatcgtgccttgggtggcgtgcaaaaggcagccgatgactgacaaagcaactaaagcgtacgaagaagtcgctgccgcatgaggcatgtcgagccccattaacatgagatcggccatgatcggaccgccaccgcttaatccggcaacaccaaccatgaggccactaattgcgccgaggacataggcgaaccacgcaggttgggtggcttttttgactttgcgcgcgaacgattgacgtaacatttggacaccgagcaccacaaaaatgaccgcgatcgcccatgaatagacgacttcgggaatatgtggcgctgcaagactgccaataatcgtggcgggcacggcggtcatcaggatttcgttacccgcgtgaaaacgcatatttcctgtacgataatggctgtaacacccaaccgccaaggccggaatggcggtaaatagcgatgttgccgcagcggtgccgggtgacagatgcgcgacgccggtcatgatgccaaggtaaaaagcaccgccaccgccgcccattgtcataataaatgccccgaccaaaaagccgaggaaaagcaagatgattgtcatgtatgattcctccgttaactaatgcttctatcgtatcgcatttatggatggaaagattgttaaaatggctgctatttcaggccgctttcataagcccttttaaaatttgacgttgttactgaaaatattgcgtcttatgatagaaaccgaaggggattgatcatggcgaagacaacgattgaagtaaaagaaactaatgctcggcacgcattgcttgtgatcagcattgtagcgctcatgtcatttttgggggtgttaaccgaaacttcaatgaatgtcacttttccaactttgatgcatgattttaatgtgtctttgacgaccgtccagtgggtgacttcgggctatcttttggccgcggcgctaatcatgctgagttctgcttacatgaaaagaagatttaccaaccgacagctgtttgtgacggcagcattgctgttcattattggcgacttgatgtgcgcaatggcaccagtgttctgggtgttgcttgcgggccggctggttcaagcaggttgtgtcggtttgtgtagtcctctgatggtcaatattattttggatacggtaccgacaagtaaacttggtacctacatgggcgtcgcgaacctcattattctgattggaccggcgcttggaccaacctttggcggtgccgtggcaaacttctttgattggcgaatgattttctggagcaccttgccgtttgcaattttgttacttgtgctgggacagggaagaatcaaacaatacacgccaacttcagattttgcttttgattggctgcgttttacggctctcggtgtggccttgatcagtttgaccgttgcattgaatggtgtcagtgatcggaaatggttaactgcgtgtgtgggtttattgatcgtggttacagccatgacagttttcgtttggttgtcaaatcatcacgccaaaactttgtttaagttggatgttttccacgatccagggttcttatacagttttctgccatatattctcttgcagttttcgaatgttgggattaattttttgctgccaaactatgtgcaaactgttgacggggcaagtgcttttattggcggattaattctcttgcctggcagtgtcttcaatggacttggtcagccggtttacggttggatgttagaccattttggtggacggttgccgttatttcttggcaacacgctatttacgctcggcgtgctcggctttacgatttttggccgccacatcagcgtactttgggtcacgatcttgtatctgatttttgccatcggccgttccatggcttttggcaacagtacagcatatggcttgaaagtcatccaacctgatgatcaaagcgacgcgaatgccttatatagcacagggcagcaagtgacaggttcaatggggactaccgttttagctggcatgatgacggctgttactatgccaggcttgtctcacgcccaaaatgttgggattggcagtcagctggcttttggcctgctactagcgattggcatcttaaacttctggttgtatgctcgtctgttcaagctgacaagtacaaaaaaggttgaataaggtaaggcatttctggtttatgatctaaaaaaccgcctgtactgaatcagatcagtgcaggcggtttttttaatctatcagctgacgtcaactttcatctggtaaaaagccgtgttcgacaatcaataactggcgtgccatcgtctcaaccacggactgcagatcttcaaacttgcgataatggccactggcaatgagtctggtggtgaccgctgtttgttgggcgattaaggcagaaacgacaccgaaaacgtcatcgactgacaggccctcacgacgaggcagctgttcaattttctcgcggaaaatgcgatcggcttcagcggatatggcagttgtttcttgctgcacttgttgtcgcaacggttcgggaaaatgcggtaaatcagcataggcttgcatcatcaagcggtattcagccgggaatttgaattgcagtttcaactcatacttaactgcagtggtcatcatggcagccaagccaggggcattctgccactttttggggtccatgtgatcataaattcgatgataggcatatttgaaagcgtcaagatacagcgcttgtttattgccaaaataatggaagagcaagcccttagatacttgtgcttggttggcaatctgatcggttttgctcttgatgaagccttgctggccgaaaatttccgtcgctgttttgagtatacgggtgactttttcgggatctgtcacaacatttttcataagctcagatcctgacgacgataaccgacaataccaagaataaataatactatagcgctaacaaccatcacgattagccatgtttgatcaacgctttcaaccggtacattggcaatccagccaaaaggtgtgaagttgcctgcgtgttttggcaaatcaaacaatccccggaaaatttgaacgatcagaccggctcccatatacagccagaatagactgcttaagcgtggccacagaccgactagtgcgatgccaagggcgataaacgatatcacagccggaacgctagccacgaataggcgaccgaggtacttaagcggcaacgggtgactgagaacagtgttcccagtgaagaacaaggccagcagcccggcagaaaggacgaacacgcctgccagcagaccaaagcaataatagctgacactgatcgtggttcgcgttggcttttcggcatgaatgacgctcaagtaaccaaggctgtcatcgcgtttgagtcggaatgccacttggacgccagcagtcacggctaatgcgacgaaaatgccgagatacatgcctaagaatgacaggaccatggtctgattggcagcgttgatttggccaacatctagtattttacgataaagcggattcgttttaagaatgtcgccaacgccgccgagcacactacccatgacgccgccaaacaccacggcgccgattaaccacccagcaaataatccgcgctcagttcgccacagtaaggcagggatcgagcgaagccagccggcagctttggctcggccggtgcgttcagcaataatcccggcgcccagatcgcggttgcgggcaatcatggtggcgctggccgcaagcagaatgctgaccagcaaggccaaacctaaagcccagacgttgttatcagtatagaagtttgctttttcgaaccaaccaattggtgataaccacgtcagattttgatgctggatatcggtgaccagccgaaccaaataagcggcagtcagcaccatgtagctcaacatattggctgtacgtgtgttattggttagttgcgcgaatagcaacgcaatggctccgaatagcaagttggcgatcaccatccccagtgaaaacaggaagtcgccgtacaagtcagtaccacccatgttgacagcggccaacgagacaaaatagaggatacccattatggcactgtcgatgagaagctccagcgaagcggcggtgatggcagccgttcgcccaacattgcgagcgcgaaccatttcgagcaagccactttcttcttgaccgcgggtgttgcgaatcatcagcggcataacccataaggcctgcaaaataatcatgaagacgaccatcacaccagcaaacacaatcgctgtgttatacgtgtccacctttggcatcgcgccaaacattgccgccatgcccggcgctcgcagcattttgacaatctctttagagcccgaggccccgcctgcaaaggctgcttccaatttgccagcaccactggcaatcatcatgatcaaaatgacaagccagatgagtgaaaattttagattttgtttgaggtttgcccgaagcagataacctgcgttccgattactgtgccgcatgggtctcaccttgctttccataataacgcaggaacaaatcttcaagcgtaggtggcgttgattgcatgtcgaccacggtgttggcggccagtgtggtcatgatggtgccaagcgcgtctcgatcagcggtgaaaaccgccttggtgtgctcggaatcgcgataagtgaggtcgtgaacgccagcttgctttgccaaagcagtcattggggtagcggtggtgacttcaattttaatccgcgatagatgccgtaattgatcaagattgccgctctcaatcacactaccatcacggatgataacaattgaatcacacattcgctcgacttcggacaaaatgtggcttgatagcagcacacttttaccggctcttttcagttttaaaacttcttgctggaaagtctgttcatttaatggatcaagcccagaagtgggttcatcaaaaatatacaaatcggcatcttgcgacaacgcagcaattaacgctactttttgacgattgccttttgaataggtacgagcttttttcttcggatcaaattcaaaggccttgattagttcatcggtcttttgattatgctggcggccatttaaacgtagcaataggtcgataatttcgccgccagaaagatttggccataaataaacgtctccaggaatataggcgatgcgtggatgaatcgccgcatcatcccgccaggcatctttgccgaagacggtcactgagccgccactcttttttaataagcctaaaataactcgaatggtcgtggatttgccggccccattaggtcctagaaaacccagaacctgaccgggtgccaacgtgaaactgacatcttttaatgcggcaaacttgccaaagtttttttgaagatggtcaagttcgataatagccgttgtcatttttgtcatcctccttaaggtcaaacttgaaacacgttttaatatgtcggtgtctgatcaaccttttcgcctgcagtatagtcgcgattgactggctagtcaacgaattattgactcgtcagtcaataattcttatgcgatgattgagaagaggggacgacttgagatatggcccaagcttaacgtttgttgacagcaaaaaaccgaaccctgtttgacgttaaacagaactcggtgcggcatgtttttataggttggggggtgagactaacctcagctttccggaaaaaagccttggtgtttcaagactttgaagagatcgccgcgttttgccggtgtggtgttggcggcgccaatcgcaagatcggtatagctttcttcgcgcggatcgccgcggcgagtggcgtagtagtggctaacagtgcggtcaaagtcagtcatggctgttggtgaagggacaggttcatcatagtggttggtgaaagcaaccaattgctgtggcatccgtggcttttcgtctggatcatcgtcgggaaaaccaatcgccagaccaagtagtggaaaggtgtatttaggtagatgcaacagctcaatcatggcctgcgcatcattttgaatactgccaagggttactgttccgaggccaagactctcggaagcgacaaccatattttgtaaggcaagtgtagcatcggcactcgcctgcagaaacttatccattcggccaagacgatccagtgattgaccagcagctgctgtcagtttcgcaacgcgattgaggtctgcgatgaaaatgaacagctcaccattgccattcagataggtctgcgtgctgattttagcaatttgtgcacgaatttcaggattgataatgtgaataaccgaaaacagctgcaagtacattgaactcgctgtatgttgtgccacatccagtaatgttcgaatggtggcgctgcttaaatgctgcggcttgaactggcggatggaacgatggtgcagttggtgacgaagggtgtcattgagatccaagtgggggtcactcctttgagttgattgggattaaggctattttacatgttctgcgcagaattgattaaaaagtggggatcaactctaataaaattgatgaagaagtcatttttttctgcgtcgaatccaccagacagttaacacaaagagaacaggaacgacaaccatcccaacataaagcaaccattgccaagcacctaggtcgatcttggcatgcatgaaacgttgaagaaaagggagtcgactcaagaaccctaacagcagaataaacattgaccagaagtaaaggatccgatcttggccagttaggcgatgaaagaaaggtaaaacgatgccaacgagcaagcccagagaggtgataacaagaacagtcgatgaagacaaagtgatctcccagcttgatttaaagaaggcaagcagaccaataatgacaacaaatagcagaccaccaccagcataaaaagcaactgtctgcattcgagttggatgaataaatgcataactaccaataatccactcgacgccccaaacggcaacaattgagataatggcaacaatcaacaagttgccaacgtcaaatttggttacaggtcgcgttaattgtggcaaccaaaaaatcataaacatcatcaatatcaactttaaattaaaccaagcaaaatcggcaatatttctgggaatggcctttaacatttcagatcctgtccgttctggatctttaccaaaataggtttgagcattcataccgctttgttgcgcatcaataaggtcctgaagaatggccagtaggttttgttcaacgataaaatcatcacgtaaaagtgtatgggcacgcatgtaaacaagtaaatcttcataataatggcgattttcagcattaagctgttttcgcaattggttattttcatcaattaatcgctttgtttcctgcttccgttgtttcatggcttgtcctcctcgtttatgagctgatcgacatggtctttcagttgtgaccactgctgttgaaaagtttgacgcgcagccataccctctgctgtgacagcgtagtacttgcggctggggccgtcaggtgagggacgcagatgactgattaacaacccttttctctccattgtcatcaggagtgggtaaatcgtgcctttgggaatatcaacaaagccaaaatcgttaagcgcctcactgatggcatagccgtaaagctcttctcgggaaagcaggattaacaggcagccttgaagaatccccttgagcatttggctattggtatctgttgccatcacatgtacctcccaactaatatgcattgcctactagtagtataaagagcgttgactagtatgtaaagcaaaatagttgaagcctgaaaactatttgttaactgatcttaagtgattggctcagcgtcatcagcatgagcatcgtttgacatccagtcaaagtcaaacctgaaaagccgatacataaaaaaacaaggcttatttgccctgaaaagaggtgtcgcgatataatgaaaataataacagggtggagtgatatcggatgaaaattggtatgatcggatcaggcaatgtcggacaggttctgacgcaacttttcgtgcaagcaggcaatgaagttgtcatcgcacatcggggttcagtcgatgcgctagaggatttagcgcgcattctaggagcagaagctggcacagttgaacaagccgaagcacaagaaattgtcgtcttggcagtgccttttttggctattaaggctttaccggaaccattggctcaagatccgatcatcattgatgccaccaattattttcctgatcgcgatgcgtggattgctgagattgaacgtcataaaaaaacgacgtctcagatcgtcgccgagcattttcaatcaagtaaagtggtcaaagcgtttaatacaattgggatgaccgttctcgctaggctggcacaacctgaacaaccagttgatcggattgcggtaccgtacgccggtgacgatgaacaggcaaaaaaagtggtggcgtcgttaatctggacgattggttttgaaccgtttgatctaggcggcttggcaacaagttttccggcgcaggcagatggcccgctttttctggtcaacgaaaccgccccagtgttgcgccaacatctgaatcccgaataagctgatgaaggctgtcagtagagcatctttttaaccatgttgtaccagatttcgccagcatgagtagaggcagcacgaccttcattttgaaagccttgatgttcgtaaaaagggatcaaccgttgtagacaggttaaggtgatcgcttggcggttttgtgtacgtgcgacctgggttagttgctcaagtaattgagagccgacattttgatgacgatggcgcggggacacagcgaggcttaagacagcgatgtacggatcatcgggccgattgggctgactagtactgaaaagatcatctgtaatcgttggttgatcagttgctggcccgactacgtaaccaacaatcgtgccaccagcgcgggcaacaatgaaggtgtccggatagttggcaatgcgcgctgccatgctggttctagtggcggcttcttgtggcgtaaatcctgctgtttcgatagtcatgatcgtatcaaggtcgttcaattgtgcttttgaaaaatgcagtttcatcgttttctctcctagttaaggttaaaaggtggaaaagggaacggacaatgatggataagcgattagtcaagattagcaagacgttaagcatgctcttgcgccaccatccagaaaaattgggcttggtgttagatcagtatggtcggacagattggaaaacattggtgcgacgcttcaatgcgcattatcaaatgcatcttgatcgccaagtcttacaagctattatggcacaaagcactaaaaagcgatttgcattggaaggaacaacgattcgggcggtttacggtcacagtgtgccagtcatgccgctcacaccagcaactgaaccaccgcagtggctgtatcatggcacctcacatcaggcggccactgtgattgctaaggaaggcttactgccgatgaatcgggattttgtgcatctgtctgaagatgtcgccactgctcagcaagtcggtgcccgtcatgacactcatccagttatttatcgcattgccgcccgtgatgcagccaaaaacgggatcctcttttatcccacgagcagtcgtgtgtggcttgtttctgagctgccagcaagatttttacatcatctaacttcatactttcgaagaccgtaaaatgtttttcaatgacagattacggtcgtttttttatgttagtattaggcatacttaaaaaggaggtatcacgatgaaagccgatgaacccgatgatttacggttaaatccgaaacagttcgcgaaccttgttgttgaatcgcaccaagtgcctgacgacaaagatccagagacgatcgtcaagcgaaaactgacgctctatctgactgcatattacttagcagagcgatttaatgagctgcaacagacgaccttgagccatgcaccatcgcggaaaaattaccaggagttgttaaaaaagctcgaagaagaacgtttccaagactggtagactgatacagaattaagcgactgtattagtagcatgtgaatatatgaacatcacgccagcattatccttttccaaagatgattcataactgatggacgcctccattgacttaaaaagctaattttaagccaatggaggcgtttttgtttttccttgacatttttcttatcggaagatcagtgattgttcttttagtgttctaaacgggctaaagaggcgatttcgtgacgataatcacgtactatgacggtagagacaaaaacttatgaaaagaggttgggactatgttactcaccgtcattgcttacgccatgatcgtggtctttatgtatgtcatcatgactaagaaactttcaccatttacttccttggttatgatccccctgctgtttgcgattattgcgatggtggccggggtggctaataaaggtacgatcggcgatttcgtgttgaagggactcacaacaactgccaacacggggatcatgctcttattcgcaattctgtacttctcaattatgttagacgctggtttgtttgatccaatcactgcccggatgatcaaaatcgcgaagggcgatccgatgaaagtcttgatggcaaccgcgattgttgcgatggccgtgtcactgaacggggacggtacgacgacaactttgatctgctgttccgcatttattccaatctataaaaagctcaacatgaacatgatgaacttaggtgttttgattattttgcagaacaccatcatgaacttactgccttggggcggcccaactgcccgagcaatggccgtgttgaaagttgacgctgatattctgacctatctgttgccaggtatgattctcgccttagcgtatgttgttttctacgttgcaccgcgcatgggccgagcagaacggaaacggttgggtgtccgagagttaacggatgctgaaatcgatgaaatgacttccgttgtcgacccagaagtttctgaaattcggcgcccgaacttattccttttcaatggtattttgacaatcgtcctgattgcttggttggttgcaagttccttcattaaagccattgcaatgccaccattgttgttgttcttagttggaacctgtatcgctttaatggtcaactatccgaaactgggcgaccaaagcaagcggatcggtgccaacggtggcgatgctgtccaagttgttattcttgttttcgctgctggtgtcttcatgggtctgttccaaggtactgggatggccgaagcgctggccaagagtttcacttccattattcctgattcattggctggcttctggggccttgtcattgctttgatttcagcaccagggaccttcttcctgagtaacgacggcttctacttcggagtgatgccggttctggctacagccggtcgagcatatgggtttaccaacatgcagatggcgctggcttccttgatgggtcaggcgttccacttactgtcaccattagttgccttcatctatctgttactccggttgaccggcttggacatgggtaaatggcagcgcgaagctggtaaatatgcgttaggtgtgttcgctatcttcgttgtcacggtgatgttattcggtcacgtgccattctacctgccgcaaaaataacgtcctaactgaaaaatacaccgaaaagccaatcatgattggcttttccccgtactatataacttatcaacaagaaaatattgcgaggaggtgtccagatgtttaattggctgcggcgacgaaagcaaacaccgtctacaaaagaacaagtgccaccccaaatgtcagcaccggccgcgccggttgatgatgattggattgatgtcccaaactatttagctgttgatccggcatcagaactgcccgtcagtctgattgccgcagcagtcacagccgatacagctcctgatgcgcagttagtgctgaagcatctgtatgtcgaaaatcctgaagcaaaacgcgtcggcttgatcgccagcgccattgcggctggtgatggccaagccaattatgtggtcaagtcaatcaagaaaaaggtggaatgaagaagatgttgagaaaattcaagatcacgattgatgggaaaacctatttggtcgaaatggaagaaattggcggtgcgccagccgcccagcctgcgccggctgcaccagctacgccagcggcaacgccgacaccggcaccggccgcaccagctacaccagctacaccagcacctgcagctccggttgcgccgactggggaaggtgaagttgtcactgcaccaatgccaggcacggtcaccaagattttggttaaagacggtgatgcagtcacggaaaatcagccgctgatgattctggaagccatgaagatggaaaacgaaattgtggcgcctaaggcaggtaccatcggccaggtgtttgcaacacttaaccagaatgtcaattccggcgacaatctcatcagtattatttaaggaggagggatggcatggaagcgctcattcacggaatcaccacgatcacattaggtcaaatcgccatgatgctgatcggcgcgctcctgatgtatctgggaatcaaaaaagaatatgaaccaacccttttagttcccatgggcttgggcgccattctggtcaactttccaggaacaggcgtcttgacccaagttgttggcggcaccaaagcagagggggtgcttgatgttttattcaaagccggtatcaatacggaactgttcccactgctaattttcatcgggatcggcgccatgatcgactttggaccgttattacaaaacccattcatgctactgttcggtgcagcagcacagttcgggatctttgccaccgtttttgttgctgtcttcttcggtttcaatatcaaagaagcggcttcaattggcatcatcggtgccgcagacggcccgacttcgattttcgtttcgaaccaacttgcgccaaatctgttaggggccatcacagtcgctgcgtattcgtatatggcattggtgccgatcatccagccaatggccatcaaggcagtgaccacaaagcatgaacgccggattcggatgacttataaggcagaaggcgtttcaaagacgacaaaaattctgtttccaatcattatcacgattattgccgggtttattgccccgatttccttaccgttagttgggttcctgatgtttggtaacctgctgcgcgaatgtggggtgctcgatcggctgtctaacaccgcgcaaaacgaattggtcaatattgtgtcaattctgcttgggctaacgatttccgttaaattgcaagctgatcaattcttgaacattcaaacgttgatgatcattgcttttggattattcgccttcatcatggactctgtcgggggtgtattgttcgccaaattattgaatcttttccgtaaagataagattaacccaatgatcggggcggctggcatttccgctttcccaatgtcgagccgagtgattcaaaaaatggcaaccgatgaagatccacagaactttgttttgatgtatgccgttggcgctaatgtttccggtcaaatcggatctgtcattgccggcggactgttactatcattctttggcgcataaaagcgtgagctgacccggttagaaaccggagcataagtggcctcaagccaaactggctgggtcttggccagtttggcttgaggtccttatgtgcaggtttctgggctggagatcgcgtttagacccacgcatgttactgcgctggtgagcacgttaaaaagggaggtacttccatgaaaattgacccagttgctgttgaacaagcgggtgaattgatgctgatcggtatgggcggcgttttcatcgttttattcattatttatatcgtggcgaagttattactgaaatttgccccagctaaaaaagcggcgaagtaacatggcaactttaaaacgaatctggctggcattgaatccgcaagaagcagcagcatggcaagccttgctgacgactgccgggttagctgcagatcgtcaggttgactatacagttggtatttttgaaggagaaacgttactggcaactggttcgctttccggtaacatcatcaaggaagtggcagttacaccggcaacccagcatgaaaacttgttggcacaggtaattcaggcattactggatcggcttgacgatgatggtgtgacccacagctttgtctataccaaaccgaccaccgttaaatttttcctgtcattgggcttcaagcaactggcagcaaccgatgctgttgtcttacttgaacgcggttatcccaacttgaccgattatgttgcttcgttagaaaagcagcggcggccagaaaaaccagcggcagcgattgtcatgaatgccaatccgattacgcgtggccatgcctatttaattgaggcggcggccaaaaccaacccggtcgtttacgttttcgtcctatcagcggaacggtctctgttcacagccgatgagcggttggcgctagttagaaaagttgccgttcgctggccaaacgtcgtggtgttgccaaccaatgactatatggtctcaaatactacttttccgagttattttctcaaagaacgggcagatgccgatgtggctgctgtccaagctcggctggatgccgcgctttttaaacaagcaattgcacccgtattggggattactcgtcgttatgtcggtgaggaaccgctgtcgccggtaacggccatttacaatcgggaactagcggcaacatttggttcggcgattgaactgatcgtcgtgccgcggctcatgattgacggcgatgttgtcagtgctacccgtgttcgcgcggcaatggcacaacaagattggaaaaccgtgcagcaattggtttatccagaagtttatcaagaaataaaggagcgatcgacacatggaaattaagcatcctgcgactgctggtacgctggaatcaagtgatattcaaatcaccttgtcaccggctaccagtggggtcgccattcaactgcaaagcagtgtagaaaaacagtttggtcatcaaattcgatcagtcattgaggccaccttggctaagttagggatcgaaaatgttgccgttgacgcgaatgacaaaggcgccttggattgtaccatcaaggcgcggacgatcgccgctgtttatcgtgcgtctgacaataagacgtttgactgggaggagatcaacgcatggataaattaagaagaaccatgatgtttgtgcctggtgccaatccgggcatgttacgtgatgctccgatttatggtgctgatgcgatcatgtttgaccttgaagatgctgtttctttgaaggaaaaagacacggcacgaatgctggtttattcagccctgaagacctttgattacagtagcgtggaaacagttgtgcgggtgaatgcgttagatgcaggcggagatcaagatattgaagcgatggttcttggcggcattaatgtggtgcgcctgccaaagaccgaaactgctcaagacattattgatgttgatgctgtcatcacagcagttgaagagaagtacggcattcaaaatggcaccacgcacatgatggctgcaattgagtcggctgaaggggttttgaatgctcgcgaaatcgcacaagcttcatcacgtatgattgggattgcgttgggtgcagaagattatctgacgagtcaacatacccaccgctcgacggatggcgctgaattgtcttttgcccgtaactatatcctgcatgctgcgcgagaagctggcatagcggcgattgatacggtctatacacaagtggacaacgaagaaggtttgcgccacgaaaccgccttaatcaaacagcttggctttgatggcaagtccgtcatcaatccacggcaaattccagtcattaatggggtttttgcccctgctttggcggaagttcaaaaagcacgtgagattgttgctggcttgaaagaagccgaagctaagggcgcgggggttgtttctgtgaacgggcagatggttgataagccagttgtcgaacgggcacagtataccatcgcgctcgcaaaggcatcaggaatggaggtagactgatggtcaagaatacactcaaccgtgatatcccagaaccatatgcggatcaatacggtgtttatggcggcgagtttgccaacattaagccttatgatgaacatgcccgccacatcaacccggttaagccggatcacagcaaactcgtggcgtcaattcacgatgccattgtagcaactgggctgaaggacggcatgaccatttcttttcaccatcattttcgtgaaggggactatgtgatgaacatggtcctagctgagattgccaaaatggggatcaagaacctgtcaattgcgccaagttcgattgccaatgtacatgaaccattgattgagcacatcaaaaacggtgtggtgaccaacatcaccagttccggcttgcgcgacaaagtgggagcagcaatttcaagcggcatcatgaagaatccagttgtgattcgctcacatggcggccgggcccgagccattgctcgtggcgatattcatattgacgttgcctttcttggtgcccctagcagtgatgagtacggcaacattaacggcacaaaaggtaaggcgacctgtggctcgttaggttatgccatgattgacgcaaaatatgcggatcaagttgttgccattactgacagtttaatgccatatccgaatacgccaatcagcattccgcaaaccgacgttgactatgtcgtgcaagttgatgcgattggcgatccaactgggattgccaaaggtgcgacccgtttcacgaagaacccgaaggaattaaaaattgcggagtatgcggcagaggtcattaccaaatcggcctacttcaaaaatgggttctcattccagaccggtactggcggctcttcgctggctgttgcgcgttttctgcggcaagcgatgttggaccaagacatcaaagctagttttgcgttgggtggcattaccaattcaatggttgaattgttgaaggaaggccttgtcgaaaagattatcgatgtgcaggactttgaccatccctctgctgtttcattaggcgagaacgcagatcattacgagattgatgctaatatgtacgcgtcaccgttaagcaaaggtgcagttatcaatcagttagatattgcgattttatcggcactggaaattgatactaactttaacgttaacgtgatcacgggttctgacggcattatccgtggcgcttctggtggccatagtgacacaagtgctgcctgcaaaatgagcatggtgattgcgccactggttcgcggtcgaatcccaacgattgttgaaaatgtcaatactgttgtgacaccgggtgccagtgttgacgttgtcgtgaccgaagtcggcgtcgctattaatccagcacggactgatttgattgaaatgtttaaaaatctgaaagtgccgctgttttcaattgaagatctgaaaaagatggcctatcaaattactggtacaccggaagccatcgaatatggcgataaagtggtcgctttgatcgaatatcgcgatggcaccttgatcgatgtggttcacaatgtttaaattaaccattttagatggtccacaagttgatcttggtcaaatgctggctgccaaagatgctcgcgtggttaaagagcgagcgttgttggtggctgcaccaaccaatacgctcttgcacgtgactttgcgcattcctggaccggttaaaactggtactcgaattgaagccgttttttcggcggtcatgcagaccttgacgcagcaacttggcgaggtcgttcgatcttcggacattgacttattgccaactggaccggaagcttattttttgaccacgctgtcacctttgtcactcaagcgactcatggtcgcgtttgaaaatcagcaacggttctgtgacctgctggatcttgatgttatcacgttacgcgatgcggaactgtatcaagtttctcgcacggatcttgccttgccaccacgtgcctgtctggtttgcggcggcgacgccaaggcctgtgcgcgatcacggcggcacggtttgccagaggtacaacaagtggtggaaacaatcgtaaaagagagcgcgagctgacccggttagaaaccggcgtgtaagtggcctcaagtgcggtggccgggctttggccattgcgcttgaggtccttacacaaaggtttctgggtcagcgagcgcgtttaaagagagcgcgagccagaccgcttagaaaccggagcatatgtgggcacaagtgtgatggccgggctttgcccattgcacttgtggtccttatgtgcaggtttctgggtcagtgaatgcgttttaaaaggaggacaccccatgcctaaacagaaagtccaattcatggaaaccgttttgcgtgacggtcaacaaagcctgattgccacgcggatgccgctcagtgatattttgccgattctcgataaaatggatgctgccggctatgcatctttggaaatgtggggcggggcaacttttgatgcctgtctccgttatctgaatgaagatccgtgggaacggttgcgcaagattcgtaaggcggtcaagcacaccaaattgcaaatgcttttgcgcgggcaaaacttgctaggttacaagaactatgccgacgatgtggtcactgactttgtcacaaagtcagttgaaaacgggattgatatcattcgtattttcgatgcgttgaatgatacacgcaacttgcgaacggcgcttgaagcgacgaagcaagcaggcgggcatgcccaacttgctatttgttacacaaccagtgatttccatacgatcgactacttcatcaagttagccaaagacatggctgacatgggcgcggattcgattgcaatcaaagacatggcaggcattttaaccccacagaaggcgtttgatctggttaccggtattaagcaggaaatcagcgtgccactggaagtgcatacgcacgccaccgctggtatggctgagatgacctatctggaagcagttcgcgccggtgctgatatcattgataccgcggtttcgccatttgctggcggcaccagtcagccagcaacagaatccatgctggttgcgttgcaagatcttggctacccgactgatgttgatttaagcacggtcagtgacatcgccacttactttgcgccgattcgcgatcgattccgcgagtccggtcaactgaatccgcgcgtgaaagatgttgaacctaaatccttgatctatcaggtgccaggcgggatgttgtctaacctgttggcgcaactaaaagatcaaggacaagaagcgctttatggcgatgttttgaaggaagtgccgcgtgtccgagctgacttaggctatccgccgttggttacaccgctgtcgcagatggtaggcacacaaagtttgatgaatgtcatgagcggtgagcgttataagttgattccaaatgaaattaaggattacgtgcgcggcctttatggtcggccgccagtggcaattgcacccgaaatggtgaaaaagatcattggtgatgcaccggttgtcacacaacgtcccgcagatttaatcaagccgcaaatgcctgagttccgtcaagcgattgcgcaatatgcgcacgacgaagaggatgtcttaagctatgccttgttcccagatcaagctaaagattttcttggccggcgcgaagatccgttttatgatgtgccggagcagaaggtgtcgctaagttttgagccgacgcatgattgatctgatgttgaccgtcgttgcgtgagcctgctacactagttgccagttgttcctagcttcatttcccttaagccgttaacacccccgttaacggcttttttgctataataggccacgaagcgagggggaacgaccgatgaatcaagtggtgccagcagtcaaaaggaatctggatctttcggagaatcggccgattaaagaggcggtgtacgaagcgcttcgcaagacgattttgttaggggaaatacccagcggcgagcgtattaacgaaaagaatttgtccgaaaatctcaatatcagtcggacaccgattcggtatgcgcttgaacgattagatgaagaagatctggtcgaacgtaaaaccggtatcggtgtcattgtgaagggcatttcgatcaacgatgcctacgagatttttgatattcgcaaggaattagatgttttagcaacacgtaaggcaatgcggctaatgacgccggctcaatttaaacagatgcgggcgcttctggaagaaacggatcggttgaatgatgctggccgggtgcctgaagtcatggccaaatttaccgagtttaataattttatttacgatgccagccatatgttgcggctgaaaatgattgtcaaccaattacaaaattacttgatctattttcgtgatatcagtattaacggggatgatcggcgtaatcttgcgattcaggaacattggctgatttatcgggggatgttaaaccgcgatgatgatcaaatcaaactgatcacgcgtgagcatttgggccactcattgcaatatattctgaaagttatgaaggcaaagaacattgaatgaacaaacaatcgcccaagcagcggtcacgagtctgcgggcagaggttttgcttgcgccgaagccgggcttagttgatccggagtccaatggcgctcatcgcgatatgaacgtcaccacctttgaggccagcattcatgcgctggccccttattttggtcagtatctgcatgctggattaacggcggcaacggtaccacagttgtaccagcagttgcggacgatcggggtaaaggctgaaaaagcgatgatgacagctacagtaggtgtgaatacgcatcgcggggctaatttttcttttgggtttttactgggtgctttgggatggttgttgcaaaagcaaagtcttaagcagttagtcatgcatgattttgcgccgctttttccggcagtggcgcaaattgcacaaggcgtgagcggtgattttcgcgatctcagtgaaaaaaaacagttgagtcatggcgaggcgttgtatatgaagcatggtgtgactggcgtgcgtggtgaggcgttagccggctacccgacgatccgaacggttatcctgccttacttacggcaaaccacgacacgcggcgatctgcgctatctacagctgatggttcatctgatggcacaagttgaagatgctaatgtgttgcaccgtggggggccagctgggttacggtttgttcaggatgcggccaaagcgttgttacatgtaccggcgtcccggctacctaatgggttgcgcgctttaaacgccgaaatgattgcacgaaatttgagccccggcggaacggccgactaccttagtctggcgtatttttttgatgcgttgatgcagcaaacgggatgagttcgatgtgccgaattgatccgattgccatattttgatccgcaatattaaccacgtcactgtcagttaaaccgccaaccttgccgcgaatcggtggcagcatctgaccactaggtgtttgcaggttaagctgggctgttactgtttggccttctgcataggcttgtagcaagattgcgcgaatgaccgcttgatcctgaaggggcagcgggggataaaccagcgcttcgcttttagattgcttctttaaagcggctgtatgatcagaaagatagtagccttgccatttacgcatgccgcgatcaaagtaacgatttgcgaaaaaatccgccaccatggcatcgaatctttcggtgccgattttttcttcataagtcatgatgatcacctcaaatcgattatacgaacatatgtttgcttcggcaagagggaaccaccgctttttaaatgttacaaaaagatgacagtgagaatgccgcaattattaagatttacttgtgttgacatcgttttgtaacatttgattaggcagcatgataggctagagataataagaaaaacggacctgtcgacgacagtatgtctggttgggagtgaatgacatgaaaaagtggtttttgttggcaacagcgattttgaccttcagtggggtttccggtgctgcactttatcagcatcaggcaaatgccgggactgacacaaaaacagtcactgtcacaacgcctaaaaagcaaccagctgcaacagtaaaacctaaaaaagagaatgcgaccgcctcttcgacagtcgctgtaacaaattcctcagcggcaacaacacaaccttctgaagagaacagcagttcgagcacggttgcgactgtgcacaccgagaaagcttcgacagcaagtacgactcaagcaacgccttcggtcagtgctgaggatgtcagcaacactgcaccggtttatctcggcacatggcagaatgagcacgtgacgcttacaattacgacagaccagctgaccgttgttcaggctggcgtaacaacaaaaaccggctataaggtaacgccagaaggcaatggttttgtcttgattccgacagatgtcggcgctgatgccatttatttggtgccagttagtggtggccttgaatgggtcgcgcccggtgtcgcagcgccattgattctgcatcacgcatgaagttctttacttaagataaccgtgaaccgacctttgcacccggtgacggttgatgttttttaaaattgacgcataaaaatagcgttgcgatcaccattcgggatgaaggttgatcgcaacgctattttactggccgaatttgttgttaagctcagtctgtcgctttgttcaacgttttgtcttcaaccgtcgtaaacaagtgatgatcaaaaaagcgcttggtttctggcaaggcaaaacttgtgtagtcgcgggcatgaccggttccgggcacaacatgcagtccgatatcgcgaccaaacatggcagcttgttgtaaaaagtgcaaggcacttggcagcggcatcaattcatcagctgaattgaacaacaatgccggacctaattgatcggttaaatggttggtgggattgaccgcggtcaacaaacgcgggtctaagccgccaaggtaagtctgcacgaaatacttgtaaaatgaatcatgaatttcgtggatctcggtaagaccaagttcttttttcccatccacagaagcctttaccatttgatttttttgaacccagttggcaaaatcaacaacaggggaccatgcaacgagcggatagccggaagctaaactgttttgcagaaccatggtgccgcctgaacttgcccccaaaagtcccaaacgctcacgatcaaaatcataaggggaagcaagtaaccaattgatgaaatgatcgaaatcgttttgtgctgttggatataaatatttaggggctaagcgaaagttcggaatcgcaaatagatagccggcatcagcaaaatattcacctaaatcgctttcattttccttatcgccgcgaaaccagccaccgccgtgtgcatacacgatggcaccgccattggcttcgtcaggtacatagagatcggcggctaaattataggcgctatcgtagatcacgtctttttccacttgcatatttgcctgttcctccttattcttgtacattaaccatagtctaaccatagtcccaaaacccgtttaaatgcaaatctggattccgattcgttcggttttaagtgcggaagagggatggtgaaaggaaaaaggtatgcgatattcatttacgacaaaggtgacacggtcgacaacggtcaaacgctggctagcagagcaaggcgtcagtcatcgcttgttcaaaaaaatgctagtggatcatttgatctgggttgatgggcaagcatctgacaatggtccggttgaagctggccagattatccgctttgaaattccgactagcaaaacgctgacgccagagtttgcgcctttagaagtcatttatgaagatgcttattggctaattgtctcaaaaccagctggattgacaagcgttcccggaccccacacaccgaattcgagtttattgaatcgtattgcgggctatttggttgagcaaaaaattgacgcaccacaaccagccatcatgactcgacttgatcgcgatactgtcggactggtgctggctgcaaaacatccatatgcacaaggccggtttgatcaagcacatcaacgcacactgacgaagcattacttggcggttgtcagcggtaaattgccatccccaaaaggtgaaattgatgcacctctgaaattagcggcggatggcattcaccgaattgtggcagctgatggccagacggcggtgacaaaataccgggttttaaaagaaaaaaccaatactttggttgatgtccagttgctgaccggtcggacacatcaaattcgcgttcattttgcaagtttaggtcatcctttaattggcgatcacctttatggtcagccagatgcgcgaataccgtatcaagccttgcaggcgacgcggttgaattttacggatcctttttcggaaaagcggattacggctgaattgccggtgccggctttgtttaaccaactgctgacagaagcaccccaaattgagccaacaatctgacctagtatgacgtgcagtagattcagacgaagacatgaaaaaaagccgaagtgcaaaaacattttgcacttcggcttttattaaggttagtgaccaaacatcgtcaggcgtttgtatcgggatgcatcaggcgattttcaaccgtctgccagttgatgaccttgaagaaggcgtccacatattctggtcggcgattttgataatgcaagtaatacgcgtgctcccagacatccaagcctagcagcgggtactgatgatacgtgattggtgaatcttgatttgctgtcgtcacaatttttaaggtcgcgttgtctttgacaagccaggcccaacctgatccaaaaacagataaagctgcttgactgaattcggctttgaacttgtcaaatgaatcgaaggtactttcaagatctgctaataattggccgtccggtttgatggtgctttcaggactcagcatcgtccaaaacaatgagtgattatagtgtccgccgccattgttccggacggaaacgcgcacgctttctggcagcgcatcaagccctgtcaatagttgctcaatggatttgccggccgcctgagggacaccatctaaactggcattaagtttatcaatgtatgtctgatgatgcttgtcatggtgaaggtgcatcgttgttgcgtcaatgtaaggttcaagagctgcgtagtcaaaaggtaaatctggcaaaacaaatgtcataggaatcaacctttcttgtttgaggacagcgtcacacacttactataagtaactttagcatgttgaagaatggccagcctaataacttgctcatgttaataataatgttgtgccagtggtggctcatcagcagtcataaaaagacaaaaaatatcgcgtcccaccaatgataaacactgataggaggcgatatagactgatgaagtcattgaataattacttaacttcggtgaaaaccacgcgcttgcgcagcttcggtgaatacttcttgagttgcaaacgatcaggtgtattccgcttgttcttggaagtcaaatagatccgttcgccggtttcattgttgcctaagatgatgttattccgcatgttttagcacctcactttttcataatttaacctgtcaagcatacaggattgacagcctaaaatcaaggctgggcattaaacgctgcaaaaggtgtaacaccgtgattctgcgcaatttcagcgacaccttcaggatcagcatctgccaaaccggccaaatcaattgagtcgctttcgccagtgtcggcctgaacgacttggaataggggttctgctggatagacgaacaactgcgatgttgttttgacttcttgagtttcttgggtcaatagaggcacattttgcaatgaactcaacaatgcttgattcgcttccaaaaagtcatttaatgtatcccaactatcaagaattgcgataggtggttctagtggtgtgagataagcagcaaagcgatgcaaatcgtcttcccattgacgcacggcactttcggcgaaggttgtctgatccaattgttgaactaataactgagagacagactcacttttaaccgaatcgggcataccagtgattcgtgcagttaaatccgtaatgcactggaatgcctgcttgacattcgctaaaaattttaaaatatccgttccgccagcactttcatatgctgtttgaaactcatttccgagcatgcgattgtttgacatgggaagtcctcctttaaacgtgctcactgacgcctaaaccgtctcacaaggacctcgagcacaatgaccatggcggcgcatcattgcatttgaggccacttatatgccggtttctaaccgcgccaattcacgctctttttaaacgcgatcactggcgcaggaacctcctcataaggaccttggccacaatgaccaaagtgcagtcatcgcgtcccagcccacttatgttccggtttctaaccgcatcagttcacgctctccctttatcataagccaatcgtgagcaggcagcacgtttttctactggttatgccgccgatgccaagtgctccagccccatgtaccggtcaagatgaggagaagcgcaatggcgataccagtaatgatccaaggcagttgtggattgtcaggtgcttttgtctttggtttgttgacaacaggttgtagggtgttttttggtaaatgaccgctatagtgaaaggcaagtgtttttgtccaagaaaagtcgcctgatttagctgtccatttgagggaatagtcaccagccatgagtttgcggtcattgagcaggatgctttgggtgaaaaatgagtgcggagcgacggcttgccccacaaaatgaccggttatcaaggccttttttgttcctgttttgcttaaggcatagtcactcgtgatgtcaccgaactgattgccagaaggattgctgatggttgcttggacggcggcatagtggttaatcgtaccaatgcctgcttttgtcattgccagtagtggcggattaggcgtcttgaaatcttggcgcaaaatagtggtgatcccgatagcaaaacgatttgtgaagcgaacgccgcttaccgacttgttggtgctggagtcattttcaggagacacatagaaaccgccagaaataacgccaataaaatgctggctcggtgcttttaatatataattgaccaatttttctgttttggctggtacactgactttttccggcccgctaatgagcgtattcaaacggcgtgcatcttggttcaaaggcggcatagcgcgatcaaaggcgatggcaccgctatcggtggtataagcagggttcacggcaattgtataagtttgcacctgatcagataggttgctgatgcgaagttgcaaattttcttgttggccaggatcgacctgcaagtcaaaatagcctgcgtctgcctgtttttgattacttggcagcacaggcgtaacagcaaactctggtgttgttgcggtagtcttttgccctgctgcaatgagaaatggactgatgactagcaccattagtgcaaacaaagcgattcttttcatgacaaaccctccacagaccgctaataccgtcgtcgaagcggtatcggtggatgtttttatccaactttatgtagcagatagttgtcagtgactatctgcaggttgaattgctcaggttgatggtgatgaaccgacacaccagtgcagccattttaatgaagatcaccacatctggcgaaaatataagcatgaataaggtcgctagttttcggattcgattgttttaagtcgtttcatcaacttgacatatgtgcgtttcatttctggtcggtgcgtcctcctttcttataaaaaatcccagtccaagtgttggtcactagcttaaactgcattcaatatagtcggcgataacggacagtcacaagataacaactttattttaccgattatttcaataaacaaagcgttggaagcttgtgatggacgcatcatgaaaggagctagggcttgttatctggttgcgaatactcgataatatgaaaagaaaaatagtttcgtcactttaaaatatggcgaagaaaccaaaaaaaagctgcgacgatctcacaaagtagaaaaatctttccaattcatgagaccgttagtctgaaaggagctgctgatgctgaaaggatcgcgagtcgctgtccggccatttgaattgactgacgttgaggattatttcgcctatgcacatttaaaacaagccacattaccagctggcatgacccccttaaagtcacaagcagccgccttagaacacattcgacgatttgcccgtgaaaagcaggatttggcattggtgtatcggcagcatgttgtcggcaacatcggcgtctatccgcgtgatttatcgcctttgaccggggatgatatgacgcgggaaatcggctatatcctgcatccccatttttggcatcgtggtttcatgaccgaaggcttgcgactggtgatcgatgatcaatttcataacggcattcaagccgtctgggcaggtgtctttccagaaaatatcgcttctatcaacttgttacagcgtctcggctttgattttcagttcgaagtgccgctccctcgtgggttgacacctgatcaaccgcgcaatgagcgatactaccgattactccccaatcagtttgaaaaatgagaaattactatagctattttatgaaagccgggtgaattcatcccggtttttctcttttagataggcatcggtttgaaaaatgttataatgaaaacgagtaatagtctggaggtttcaagatgactgtgcaaacagagtatcagcaagcgtataacaagcggcttgcagcgatcgaggcagatccacggctaaccgtgctgtctagcatgaatcaaccgcaggacgcagcccaaaaaaaggtaagccaatatattgtgtttactgattttaaattcgatgagcaaaagcaaaaaacaaattcaatttacgtttatacgccttttgaaaatgttgataaatatggccattccaaagcggattatcagtcacaacttttgtttgaaaccaatcgttgggataacggcatgcacatcactgtcttggagacccttgggtcggagagccggctcgctttctacgattttgaaaatatgggcttggcccagcttgctttgaaagctttcattaatttggcaacgaaagctgacattgcccaagtcgacggtacgattagttcgtttgacaaggttaatttgacaaagctgcggcatattttcactaaatttggttttacaattaaactgactgatccgcagactggtattggcaaaatcagtcgtaagatgcaatgatctgtttatccagcttatgcagtgtatttaatgaacatcgtcttttagaggcggtgttttttttaactaatgtgttgcggctcagcgaagactaggcaaactattgggtcgtgatcaacttttgtggcatgatggcgttagcaaaccattcgtaagaaaagtacgccgcattgtcaatggaatgaaacagatttatggaaataatgtaacagcaatttgctgtttaattgctgtttttcaataaaaatagggttgaatcgaaacacaataagcgtaatatgaaacacatcaatcaggaggaagtggcaaaatggcagaagagaagcgctatggcgcggatttgatcgtcgaaagtttaacgaatcacggcattgactatgtttttgggattcctggagccaaaattgatcgggtttttgaaagtctggagcatcctaaatcagaaaagagtccgcagctaatcgttgcgcgacatgaacaaaatgcggcgtttatggccgctggcatcggtcgtttgaccggcaaaccaggggttgttctgacaacttcaggaccgggagcatcaaacttggcaaccggcttggtaaccgcaacggctgaaggtgatccggttttggctttatccggtcaggtcaaacgcgctgatttgctgcgaagttctcatcaaagcatgcgtaacgccgatctttttgccccgatcaccaaatatgcggctgaagttcaggaccccgataacgtgagtgaaataattgcgaacgcgtatcaagcggctgaatctggcaagcaaggcgcaagttttgtttctattccgcaagatgtcacagattcgccagtcaactcggaaccgataaaaccactggtcgcaccaaaacttggaccggctagtcccagtgatatgacgtatctggcgcacgccatcaaggaagcgtcattgccagtgttgttgttaggaatgcgggcatcgtcaagtgatgtaacagcagagattcgcgaattactttcagtaacggaactacctgttgtggaaactttccaaggtgctggcatcatttctcaccgtcagattgacaacttcttcggccgggttggcctgttccgcaatcaaccaggtgacatgttgttacaacatagtgatttggtcattgctattgggtacgatcccgttgaatatgaaccacgtaactggaatgcggatggcaaggcgcgcatcattgttattgatgatgttccagctgagattgatcataacttccagccggaaactgaactcattggtgatatttcgcaaacgttagatattttggtgccattgttacgtggctatcaagttgcacctggcagcaagcgctatttagaagaccttcaggcaaaactgcaggatagcgatgtaccaccggcaattgctgatcaaaaagtgcttcatccgctcagcattgttgccgccttacaggagcgggtcacggatgaaatgaccgttgctgttgacgttgggagtcattatatatggatggctcggcacttcagaagttatgaaccgcggcatttgctgttttccaatgggatgcaaacgctcggtgtcgccttaccatgggcgattgctgcaacgttggttcgcccaggaaaaaaggcggtctcagtttctggtgatggcggctttctcttttccggacaggaattagaaacagcagtgcgcttgcatgcagacttagtgcatattatttggaatgatggccattatgatatggtaaaatttcaagaggaaatgaagtacggtcgtgcagctggcgttgactttggtccggttgactttgtgaagtatgcagaagcatttggagcaaagggactgcgggtcaataaaccaagtgaattagggcaggttttggatgaggcgtttgctacaccaggcccagttttagttgatattccagttgattattctgataatgcggagcttggcgcggcgatgcttcctgaccaaatttactaagcttttgttcattcgtcagcattgcgcttggcgatcgcgtaataggaggagaccatctgtgaatactgatcggttatatcaacatggcacattggcaatgcttgtacccggattgtttgctggtacgcaaaagattgaagaactgctgcagcatggcaatactggtattggcactttgacggggctagatggcgaacttgtgatcattgatagcaaagtttatcaagtcaatgcacaaggcgctgttcgcgaagtcgggtcagaagaagaagtaccgtttgcaaacgtgcattatcaagctgataaatctgtaggcaaactacaaggacttgatttgtcaggctttcaaaaaacggttttggaacgccttcaaacggccaatctttttgctgcagtacgcgttgaggggcggtttacgcagatgcatacacgcgcggtgttgccacaacagccaccgtatccaacgcttactgaaacagcttcaggtcaaaaagaattcaacgctgagaatatcaagggtacattgattgggtattattcgcctgatctctatgcgggtgcggtgtcaccggggttccacttgcattttcttgacgctgatcatcacatgggtggccatattcttggcttcgaactcgacagtggcgaattgtttctgcaaaagtttagtgacttccagctacatctgccgacaaccaacgatgcttttttaaagcaaaaatttgacacggcaacactggtagccgatattcgcaaggctgagaattgagttaaagccttgtgagaggcagttgctgttgaaggccgaacatgttaacgtgtaaaccaataacgattagaggttgcatctgtcatgaatcctaaccgcaatggcctgaacgccagatgcgcggttgcaaaaggggtggatgccgaaatgccggatttgttcagaaatccgacattgggccagttggacaacatccgctggactgtcgcgaacatcgcggggcgctaatgaatcggatcacgtttagtcattgcaagaaaaatgataagctgatgggttgattctcgcccgttggctttttttgtgagcgcgagcaggagcgcttagaaaccggaacataagtggccttgaacctaaatggccgggctttggccatttaggctcaaggtccttatgtgtaggtttctgcgactgcgagcgcgttatagaaagctagcacagtatcagttacggccgccagtcgaaagatgccttaaatctaaacgggcggccgggttttgaccattgcgtccaaggtccttatgtgtaggtttctgggctggttcgcgcgttatagaaagctacccaagagccgattatgggccactcagtcgaaaaatgctgtgagaatctaaacgggccagccgttagggccgacgtccttatgtgtaggtttctgcgactgcgagcgcgttatagaaagctagcacagtatcagttacggccgccagtcgaaagatgccttaaatctaaacgggcggccgggttttgaccattgcgtccaaggtccttatgcgcaggtttctgggctggttcgtgcgttatagaaagctaacctcactccccgagcctcgcattctcaacctatcaaaaacttcaaaggagcaaactattggcacagtcagaatcaaatcaagtcaaacgtgaactcaaaactcgccatctctccatgattgccttaggcggcagcattggcactggtctctttgttgccagtgggagtgcgattgccaccgctggaccaggcggggccattgctgcgtatgtcggcatcgggttgatggtctttttcctaatgaccagtcttggtgaaatggctacctatgttcccgtttcggggtcgttctccgagtatgctagccgatttgttgatccggcatttgggttcgcacttggttggaattattggtttaattgggcaatcacggtggccgttgatgtgtccaccaccgcaatcgtgatgcatttttggctgccagatgtgcctggatggctgatttcaatggggttcttagcgttgatttttgtcatcaacattatttctgttaagtcctttggtgaaactgagtattggctttcattagtcaaaattgtcacagtgctggtctttctcgttgttggtctattgaccatcgttgggatcatgggcggcaatggcccgattggtttgaaaaattacacaaccggagcggcgccatttgttggtgggttgccagctaccctagccgttttcgtcgttgctggtttttcttttcaagggactgaactgattggcattaccgcgggagaaagtgccacgccggaaacgagtattcctaaagcgattaaacaggtgttttggcgaattttgctcttttatattttatctattgcgatcattgctgccatcattccctataccagcccgaatttattaggtgcgagtgtcgatcaagttgcgatttcgccattcactttggtatttgatcgcattgggttagcaggagcggccagtgtcatgaacgcggtcatcttgacatcggttttgtcctcggctaactcagggatgtatgcctcgacccgcatgttgtgggcaatgggtggttccggttttgcgccgcgcgttttccagaaaacgaataaccgggggattccagttgcggcactgctgttaacaaccttggttggtgctttcacctttttaaccagcattatgggaccgcatgtctatcaactactggttgcagcttctggtttgactggatttcttgcatggttaggcattgctgtctcacattttcgctttcggcgcgctttcgtgaagcaaggacacgatctgagtgaactcaagtatcatgcaaaatggtttccggttggcccaattctggcgattattatgagtctcattgtcatcgttggtcaggatttgcaggcagttcaaaattttgcctggggtcgattactggtttcctacatgtcaatcccgctttttattgtcttattcgtctggtacaaagtgaagcatcggacaaaaatgattccgttagaccaagttgatctgtccgctcaccgagatcaccgaaattaacgatgcaaaaaggcagtttccacacattgaactgagtgggaactgcctttttaggtgatgctatcaccacttgaaagtaccagtttctgatgagcgtgctgaagctgttttgccgagataaaggcggcgaatcaacatataaagttggaaaatagcactgtcgtcatcatcaataatccaagtggcaacctcgcctttgaaatccgatggtgctgctgctctaatggcggcttcattgtcgacactggtaatcaccaggtcagcttcctgacaaggcgcatcatctggcaacaaatcaacgacactaagatcgtccagaaagtttaccaaacggcgattgaggagatcatgtcctaggtaaaccagcttcacttgcacaactggtgtttctgagaagtatcgcaaataaggagccaaaagataatgaataatgcgcaaaaatcctgcatttttaccaagaaaacgacggtaggcaggggtgtctggcaaaccagcgatgaacgtttgcaaggtatggtacagcttagtctctgtgtatggcagcccttcaggttgatagtaatccacgatgtgcatgaaatcgccgcccagaaactcattgttcaacgcgatccgagctagattcagaactagctcgtgttcgtgataaacatcgaaatcactgtcaggtcgaacatgagcattcaaaaaagccaagagtcgcttagtgaaatctgtcgtcacggttttttgtcacttaggtagcggataaaagcatcactcgtggcgtcagttggtaaaaatgtaatggtgcgattttgctgagagtagaagaagtcgttttcgcttttcataaaccgtgtgtcgtaagcaggaaacatttctttcgtgtaaaccggatattgaaaaggtgaatactcatcgaaaattttgtcaaatggcgccgcgccgtcaacgaaatggttgccacttatgcgcacgcggctgatggcccaaaacaatacttcttcaagaatatcgaccggattctttttggcactgggtaaggcggtgtattcctgaacaattttttgttcatctaaaactttgaatggccaatcgacgccgtggtagccaatccaatagaaggcgaacaagaacaatctgatgcggctttcctgaccggcaaagcctaagtcgctaaaggacaacttaagctgataccgtttaagaagattacggagagcagacgtcttgcgaaccaacgtggaacggctgatataatgggcacgacagaacttgtctgtggacgggtgattagcttgcacaatgtaatcgacaaattggaaggcgatagcgtgctgcaacaaatacagatgataatcgtccactgtaatatcgatatcgaccagaagactgatttgtttccgtttcattttttctggatgttttgttaaaactgtcaagtcgcggaaaagttcctgcaagatgttatacccttgctgataggaaaggtctaggtgctgactgagggtattgatcgtgtatgtttgcacattggtatctttgatcgctgcgaacatttggaacttctgcagatcagcgcgatctaaaaaagtttgttcatacagcatggtacacccccttatctaaaagcaattcacccctacctacgtcaattataacaaaaaaagtaaaaatgatgacagtttgttagtgaaacattgaactttagggaaacccgctattttctaaagccgagtaaatgaacaataacaatttggtatagtttttagacccgacttgtacttgtaacaggggtgaatgcctgcgtcttgacaaagtatgacgtataataaaagacacaaaatcgtattttaggggtggggagtccatggaagccaatcacgacatctttttgtcgatgtccgatgctgaaaagctcaatttgtttcacgccattatctcggcacgaattgcgcagacgccggtgagaacgcagttggctggtgatcacgcacattattcggttgtcggcgatgtgaatttaaaacaaattgcggcgattactaatcgtaactatgggagtgtctataatacctacactgggttggttaactctctggaggagatactgggtcgcaagcatgcgtccactaaaatgttgtttgccattccaattgatgaatttcgctatgatctggtgaaaaagtcgaacccatatcgttttttggacgcagttttatataagcgctatcaaaactttgatgactttttaatggcgtccgatagttccaaagccaccattttgcgacatctgaaacctattcgtggttacgccaaaaccagtggggttcaattttcatatgagacattgtcgtttattgggtcagaattaaatatccgaatttttttggggttaacatattggttagcaacgaacggggcggattggccatttgaaaatatgacgcatgagcgtgccagcgaaattcttgatgccgttcttaaagcctttaaaggcggcgatgtgaatgtcgttacacgtgaattgttgctctattacattgcggtggcacatcaacgcattttgacagggcaggtgttgacgcatgatccggattcacagattttacggtatccaatgccaaatctgttttcaccaattgctgaagcgctgactgacggacatccagttttagatggcttatctgagcagcagcaacaaggggaaagcgatgcgctctattttctgtttaattttgcgccgctgtatattgtcagtgatggcccgcttgagcgacgtgtgatcgaacggtacaaccgctataatcccgaaatttatcagttgattcaagccttctttgcgtgttttccatataactttaagctacatctgcagttgccagaagagacgtataatctgttgttagccaatatgctgagtgtcaccgtcagcgtgctggtgttcaaaaaagacttcacaacaactttactcgctgagttcagttccaacatgcagcagaccaaagatgatccggctttctatgctcagatcaaagccacgcttgaaaaagtagtggatgaagaacatctcgaatcgtttgacgggtacattgatgttttggccgaagcgctgtatcgcaacttgcaccaactactcatccaatttcagccgccaaagaaaattgtggttgcgccagttgttgaacaaacgattaccggctatattgacttgctagcgtttttgcacgctatcccatttgtcgaattagcgtcgcccaatgctaatctgaaagatgccgatttggtcatcacgacttcggttgcgccagtcaaaaaagtagccggcaaggcacagatattcccatggcatatcaatgttagcaatgaccactacggccaactgtatgccttactccgtgaactttgggataaaaaggttttagaagatgcccggttcatttattaaaagacaaatagctgcttgcatttgggccaagaggactggctcccattatttttgaataaaaacactatgggcgcttgttaatcagtgctaaatgcggtaattttaagaacgaatagcaaacacgtctgaagcgtctattggatgatcaagagagacagcggttggtgaaagctgtcagccatccatattccagcgccttagtgggtagtgatgaactgcacggccactgaccgttatcagttattgagggtggcgcataggcgtcaaacttgggtggcaccgcggaatggcctttcgtcccaacgagatggaaggctttttgtgtgcactgagatttcagacgcatcatgaccatatgaggaggacaaaccatgttagatttaaaactgatccggcaaaaaccggaatgggccaaggaaaagttagctgcacgtgcgattaaaggtgaagagattgatgaattattagctttggatacgcgccggcgtcaggtgaccgttcaaactgaagagcttaaagccaagcgcaatgatgtttcaggccaaattgcggttatgaaacgtaacaaggaaaatgctgacgatcaaatcaaggccatgcgggaagtaggccaaaagattgcggctttagacaaagaactcgcccagctgaatgaaaaagtaacctacattctcgtccgattgccaaactttccggctgatgacgtgccaatgtcgttaaatgaagacgattcccgtgaagaatacaaatggggaaacatgccaacgtttgattttgaaccaaagcatcactgggatattggtgaaaaattaggcattctggattttgaacgcgcggcgaaggttgccggtagcagatttgtttactataagggtgctggtgcacgtcttgaacgcgccgtctataacttcttcttggatgagcaccaaaaagaagggtatgaagaaatcattcccccatacctcgttaacaatgattctatgttcggtactggtcaatttccaaagttcactgatgcgacctatacgatcacgaatgatggtgaaccactgactctgattccaacagcagaagtgcctttggtcaactattatcggaatgacattattgatgctgaaaaacttccagttaatttcaccgcacttacaccggcttttcgttctgaagctggcagtgccggtcgcgatactcgcggcttgatccggatgcatcaatttaataaggtcgaaatggtcaagttctgcaagcctgaagactcttggaaacaacttcaaaacttgattcacgatgccgaagatcttttgcaaaagctcggattgccttatcatgtcatcacgctggcaagtaatgacgctagcttcaccagtgcgaagacgaatgatctggaagtatggatgccagcgcaagatcgctatcgtgagatctcaagctgcagcaattgcactgatttccaagcgcgtcgtgcacaaattcgctatcgtgatgacgatggcaaattgcagtttgtccacacgctcaatggatcagggcttgctgtagggcgaacagtagcttctattttggaaaattatcagcaagctgatggttctgtgaaaattcctgatgtgattgtaccatacatgcaaggacaaaccgcaatcaccaaggaagattaattgtttcatgcatctttatgcagtgaatcgcaaatgattcactgcttttttaatgcaaacgttcggactttaaattcttagcaaaacctcatttaaaaagtgttgacgcgggttcgtaaagttgataatatattctccgttgtcaaattcataaccgattccgaaattcatatcggttgcatgtttattcaaaaagttgttgacatatttcaacagctagtgataatatatgaaagttgtcttttgacaaggtcgtcctttgaaaactgaacaaagtttcgtttaaatgtgcagggtccttggtacttcggtaccgaggcaaaaagtaacatttgcgaagtcaattcgctagaacaacaaatcgagctattcgaacagctcatatttatatgagagtttgatcctggctcag

SEQ ID NO: 18 - DNA, 4099 bp, Lactobacillus paracasei
gagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggcatagaagtatatcaaaaatcatagatcttggacagcttcttagaaagtcctgtatgcgagcagggctttctttttgtcttcattcaaatttttaacgtgcatttgattgttgggaaaagcgaagttgcgtacaattagtttagatgttttaattcctaatgaaaggcggtgacaatcttgaagtcgagtgctgaatggtcaaccaggtggcctgaacggatcagctatgggttaagcgatgccgctgacaacctgatttttcaaatgatgacgacttatttgctgtttttttacaccgatgtctatggtttgacacccagtgcggtcgccatcttgtttgtggtcgcccgagtagctgacgtcgtcgaaagttttatcatcggtatcatgattgaccacgtccattcaagatttggtaagagtcggccgttctttctgtggtattcggtgccttacgtggcctttgcgattctgacgtttgtcacaccgaatttctcctatggcggcaaaatgatttgggcttacgtgacctatcttggtctggggttcttatacaccgccgttaatctgccaatcacatcaattctgccgacgatgtcacagaatactcgtgagctgacactgcttggggttatccgccagttctttggcagttcagtccaaatcatcgtggcagttttcacactgcctttggtttggctattcggccacggcaaccagcagaaggggtttctgggaacgattatcgtgtttggaatcatttcactgtttttgattctcaacaccttcgtgcacgtgcgtgaacgcttctccaatccacacattgcccaccaaccggtcaaggttgttttgaacatgttagcccacaaccagccgtggattatcatgtcgattgtgatctttatgtattggctggtcacggcgattaagaatcagacgaccatctattacttcaagtatacccttggcgatgaaggtttggttccctgggcaaatggctttaccttggcggctttaattggcgtgttaatgattattcgactgaccgatcaccaaagtaagaagaaaacaatgttacatgggatattgattgctttaaccgggcaggcgattattgctgccggagtgtatggtaaatggctgctggttttatttgccggtgtctttattaactcaattggaaatggcattatcattggtctggtctcgattatgattgccgacaccatccgatacggtgccagcatggggattcaggcagaaggcatcttagcttcaaccgatgattttggcgttaactttggtctgggaattggcggcttgattacggccggcttgtttcacgtgtcgggttacgttgccaatcagtcacagaatgcggcgactttatcgatgatcaattggaactatgtttggattccactggtgatctatgccgggatgtatctggtgttgaatttatatgatgaacagcgaattattgatgccattgaaaaataaaattatggtgaaagtcgatttgataccccaatctaaccaagcaacgcacccatttccacgtcagaaatgggtgcgttgtttggttggatgacctgtttcggaaacatttatgaatgcggcgtcctcaactgcatattaccattgaaaaattgtggatacgccaaatagcacgatatcgtactgccaatactagtggctgccatgagcataaaggtgaccatgatctggtacataatcgccttcgtagggtcgacaccagcaaaaatcagaccagacatcataccagggaggctgacaattcccacggtttttgccgaatcaatcgtgggactcatacctgttcgaattgcttctcgtacgaccgtaatggcggtttggtaacgcgtcgctcccaaagccaacctttccaacaacccttggcgctgatcatggaactggctgttcaagcttcggtaggtcaaaccaatcgcaaccatcgcattgctggcaatcataccagaaaccggtacgatttgactgggaacaaaggcaatcgctttcgctaaaaccagcaagccaattgtgacccccgtggcaacggcaatggcaagcagactgatcacaaaagcatggggaatgcccctggcacgtcctctcgcattccaagcagcgttgaagacaatgatcgctaccatgagaagtgtcagccaagctcggttaactgagatgatataggtcaggacgtaaccaacaattgtcagttgaataacggcacggatgacgccgattaccaaatctttttcaagaccaattttttctttgaggctgataaaaaatgcgacagttactaaagcaactgcaaaaaataaagccgtcggggtaacaatcaggtgattcatgctgtcacctccattctgccgtcaacaatggtgatgagccgatcggctgccgccaattcagactcatcgtgcgtgacagtgataatcgtgacgccttgtttggtgaagttagccattacttgatggacagtatcttttgttgctgcatccagcccagttgtaatttcatctaataacagcacttttggcgtgaagatgagattgcgaatcaacgcgacacgctgtttttcaccaccagaaagttccgtaatgttctttgtcagcatatcggcagggagattcacatctgccaaagcttttaccattcgatcgtgattgaccggcttttggcgaatttgaaaaggaaaggccagattgtcttcaactgtctcaccaaaaagactgggttgctgataacaataagataccatgcgacggtacgccgtcgtttcatattcttgctgtggctgacccgaaaatataatttggccttctgtgggtgttagcaaggtggctaataataacagtaaggtgctcttacccgacccggaaggaccactaatggtcacaaattctcccggtgccaccttaaaagaaatattagccaatagtgttcgtcgtgagactgttaaaccaacgttttgtatgtcaaaaattgcatctgccatttttgattcccccattttcgttttctattatgggtcgcaaaatacttgaagaaattgctttcgaacgggtcatctgccgggagcaaaattgttttacctctaaaaacatctttatcatactcgatataggcattcacttctttttcaatatcagaccattgagtatagaattcgtcgtttttcacgttcttagctcgtgaaagcttctccttagtccttgccatagctccaccacatcctttatttagtcttaaaccttccctgtttagaagtaatcttcacaattataacattagaatttacgttcgttttgcttatccttttgtacaaaaatagacgcctgaactttcacggcggccatatttggtggtgatcttggtggggtacgtactaaatatctcaccaaatgacccatttcacttcaatcaaagcgtcgttaaatcaacgttctggtttcaacttcacctacttctttattcccaatggcaaattacaagtttaatccgaacaagcccggaatctttcaatggcagtcttttgatgatgtatttttaatggtcgttgattaattagttcaagtgctgctaggatctcatcagtcgttacttggctaaaattggtctttttcgggaagaaccagcgtaaccgtcttttaaaatattcattggaacctcgctcccatggtgaatatggatggcaaaaataaactttgatcggatctggtgcaaacagtctgagagatgaccatctaaccagctattgatcctatgttgaaggttatgcagctaacaatgcttctaattcgtccacgactgagaacccgatgagacttaactctcgtcgggttcttttgcgtattgcgtgaacaatttccacaccgctcaacgttgcacta

SEQ ID NO: 19 - DNA, 43429 bp, Lactobacillus paracasei
gagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggcaattatctttatggcactacaaaattaaacaagtttaatctctcagatttaggaaatctttctcagagaactgtttctagcaaaaaatttgcttatccatttctatctaatctcgcatatgtagctgccgcgtcaggcaaaaagacaatatttcttggtggagatcattcgattctatttgccgagttaacaggaatacaaaaagaatttcctgaattgggagttattcaacttgacgcccatgcagacttcgctggtaaaaggcaggttaagcttttagatatagatcatgcaaacttctggtctcagctagaagtcgattcttctattaatcccattctaaaattcggcgtacgtgaagtcgttccccaatctctccataatgattcacgggccggaatattcagtgttgatcaatttttggaaaacattgtatccactatcgcgaaaagtcctaaaatcccttacttcttgagcattgatgttgatgtcctcgatccatccatcatttcaagaacaggcacgcctgtacctaatggaattacgtttaaacaattaaatagagcaatttctttgataacatcaaaagttaacattatcggcgctgatattgtagagtttatgggtgaaaatcgggttgaaaatgggatcgtagcaaatattttgcttgatttgatcaacgatctagcgagtgatgatcatgaatgaaaaagaactctttcacgctatcgttgattattcctccttagagattaacgaaaaagacaaagcccatcattttttctcctccgttgagaacaatgatccatggtttgcgttacgaaaagcgatcattcacaatcatctgtctattcttgtagatcattttagatctcctatacaaactcagcatgaggtggagcagatccaacttctaacggatgccgattataactacgaacgaggcagcagttatcctgatctagaatcacgatttcaccgtctactaccctcatattctcagtcacagacatttttccacaaaagaacgctattattcagctctggtatggcggcaatttcaacagccttaaactttggcggtcactccttgattcctgcaaggaagaagaagttacttatctttggtacttattttgaaacaaaaatgttgattagaagcctaggatcttccttttttccgtacttctgtaatagttggcaagaattttccagtcaactagcccttgatttttatgacgtggcatatatagaacccttagcatggaatcacaaaattgtaaaatttgacgaaagcaacttacaacaaatgctaagttcattgaatcttaagaatcttcgtatccttatttttgacactacactttcgggtgtcagtgaatttgatacgttgaagctatttaaaaacgcaaacacaaacctaaactgtctcatattcacaatcagttcgatgataaagacaaatcaatttggcttggaatttaccaatgcaggtatcatgcaccttttcgcacagaaaagaacgttttacttatcaacttttgaaaaaataattgaacaccttcaaaaactacgatccacaacagatcaatcattaagttctctgtccatgtcaattttaaccgaaccgtttttgagcgagccggttctcgtttcgagctatacaaatcttataaaaacatctaatgcattgttctactcaatatttacagagtcactgaaagaatcattttgcaccgttgaaacctccctagatccaagaccagaactaacagcaccattctctctcattagcttgaaggactctgagtacagtaagtatcaggctctgctaaaaaaagtgtttttactcgtcaaagcaaacggactctgtgttgatcctggaactagttttggctttcagaaaaccagaatagaccttattcgttataatattgaaaatgatgttaactatttaagagtttctcctggtgcattcgtttccgatcacaaacaattagttgagattatacaagaaaaaataggaggaaatacctgatgtgggaaggcgaagtagtaaaagaaactttcttgaaatctttagattttaaaactagtcctgcgttaatctatgacattgactcaattaaaagtaaaagtctgcaaacactgaagattctgaataagtttccaacatggcaactgtatttttccatgaaagcatctcgatccccaatcatcttacaaaccattgcttcactagaggaaatcggaatagatgtttccagtgtttatgagttacagttcgctaaaactttccggttcaaagaaataagcgctactggaccatctttcaacaccacagcgattgagggtttatcccaaaactctcaactcaggttttactttgattctatggaacaaatacgagcggtgcccatttcgctaatgagacattggcattctggcattcgtataagtgttcctagtaacctttctagattcgactactctcgcttcggtctatcgagagaagatataaaatcaataaatcaaacccctaccctaagttgcttgttacggcatgtccacgttcattttgaaatgacgtcaattgacgagtggaagcgtgtagttaagcatatttcgtcggtcattccaaatccgagtaatgtgtacaccattgactttggtggtggtttaatcaacttagcaccaacgccagcgcatttagaacaaagcctatcagagatgaatgagtacatagtaaggctgtttcctaatatcaggaaaataatcatcgaacccggtgacttcttagtcatcaatgctggatttctaaaaactacagtagtaactatcaagcaagtttcctctaatgtatctttgctcggtgtcgattcttcgccatggtctctcgctccctggacaaaactgcatgtcataaacttaacatcaatttttaaacaagggctccccagaaaaacataccgtatttttggaaacactctttttgagggcgattggtttatggataattcacgtcaaagtccaagaacatttgaacttccaacagtaggtgtaggtgactcacttttgttttcacaatttggtgcctacactatgagtacttatcgtccctttcatttgcttcccgcaccgaaagagttctcataccaacacaattcaattaataacagcaaggagacaggttgtcatgaatgatatattgattaatgttgaagatttagtcatgaattacaaaattcgagatgattctaaaaaaaatcccctatcgtttttcaaaactagctattcagaagtccatgccttaaagaatgtcgctttccaagtccgtcagggggatattgttggttacgttggagaaaatggtgctggaaaatcaacgaccattaagattctattaggaattttaaaacccacaagtggatcagtatctgtgttcaatcaaaacccctttaaaaaaaggcaaagtattgcgcactcaatcggggcgttaatggggcaaaagtcacaattgtggtgggagcttcccttacaagactctttcaatcttctccaagagatatacaatgtcaagtcttcaagtgacaactcatggataaacaatatgattgatcttctcaatgtgggtgactttctgaaccagcctgttcgtgagctttcacttggtcaacgtatgaggggagaattcatagccacattcattcatcaacccaagttagtcatactagatgagccaacacttggtctagatgtatcaacaaagaaatcaatattggagtttttattagctgttaatcaagaatatcagacaactattttctatacatctcatgaaatgaaagaaatagagaatcttgctgatcgtgttttgcttcttgatggtggcacactgcaatataatggacaaatgaacactcttctagggatgttttcccagtttcgtatagttaaagctggaggtgtttcgaaaaacgcttcttttaaaatacttggactagatctttacagacgaaatcacgactccactgattttattctagatacggcaaagtcctcagaaaaccttgcattggcatcacttaagcagcactttccatcaactcctattactgtttatccgattgatcttgaagtgatactatcgttaaaggaggacaatacaaaatggacaaaatttggagtaggttaaccctcgttaaaacacagtttcgtagacaaacttattaccgttttaatacattaatgacaattgcaggagctttaatggccgctactgttcagtttttcgtgtggaagtccgtttctctttggggacacagcgatgttgaacacatttcgcaatacgctattttcgctacctcatacgcactgctcataccaactgctcccgtagccagacgcatttctcaatctgtcatgaaagggacggttgcttatgacatgatccgtcctatctctcttttcaacctcagtttgtttttacagatcggacattttcttttcaccttgttaacagtttcaattcctttgtcaatttcatatcattttttgttcggcgtcaaatttccattcacactctctattaattcgctatctattctatgcgcatcattttttgggctttttattgccttcgaaattgggtactcaataggccttctctctcttataacaacccgaactgggggcttcctttctatgtttgatggactgatgattttcctagggggtgcgtatttaccattgaatatttatccttcttttttaaaagatcttacgtccctcacgccgtttgcttccatacagtatttcccgcttcagggcctcagcaacggaagtgtaccaagttggcaattaataactcagcttttttggctagcattactaatatgtataaccaatattcaagaatctaaattgcgtcagcgtttaaaaattgcagggggataaacatgtttcgttatatcaagatctatctatttttctttcgaacagatataaaaaggataaagatgtatagaagcaatttaattgccagtagccttggttatctcactgaatctgtagcgacatttttctcgatttggctaatattctctcagactaatgttcttggacaatggaaatcatcggaaatgtttgctttatttgcctacacgctcttattaatgactatctgggaattttttcttgttaacaccttggaaataccttatttgatcaataatggcgaactggacgtatttcttctacgtcctgttagcctgctatatcaatttattatttttgagttggacgaggaagctctatttgaactcgtcacgtcattgggaatgctcctttttgcaataagtatatccggtccaaatatttcaataatgagttttgctttgtttatcggtggcactctctccgcaattctctcactgcaagccttatacttagcgatttcctcaagtgctttttggtttcaatctgctgatggattgcgtagtatagcctatcaagttctgcaatttaatagatatcctctgtctatctatccacgtctaatacagacgctaatgactattcttccattcggaatgtatggctattttcccttacacgtatttttgtttccaaatacttccatgtatgaaatactctattctctcctcgcaggccctgtctttcttttaatatcctataatctttgttggaaacagggattaaaaaaatattcaagttctgccggataactctagcagcggactgtgagcgtatgctatgaactaacccatcgatagacagatgtacacattgcgctatagacgtcatgagtatcaatgttcaggagatttcacacggtcatttatatatttcatcatgtagtaatcgactcaagcaaaataggtaaaatctttttcttcatgtaactgtattgacgagaaagtagtgtgtatccgttctttttcgttttgtcttcttgcttaccaaccctgaaaaacatttccagttttatggtataagtatcctcccctctttaggcagccaaaaataaacaaaaaaacaacttcaaaaagtgacgtcgtagagtggtcagcacaaccctcacatagtaaaattagtctgaattttactgtttatacacgccaccacatcatctttttcgaaagttatcgttaagtttgcttgtttttgcactcattgcctttcctcgctttcaagatcgccttgaatgactatttcatgtctaatctcagccattgcactcatcttactgattgactagctttctaaacagtcttttattgtgtaagcaaaagatttttacgatcttcaacaatatagctttaagtatcataagtgcccaagaaaaaagttctgaaagtccttgacaattcggaatttcagaacttctagttaccgactgatattaggcttcgaccctatcgtcgccaatttgattctggtcagcgattaaatcccagccgttttatccagctgatggccttcttcattgaagacgcgaatcgcatcattggctgctgcattggtcataagctgttggaaaatatcgtaactgatggtgacattttctgccccagctttgatggcagccatcacctgtgaagcggtcttgaagctggcgcccatgattttaatgtgcgtgtcagtgctcttgtagaatgaatgtgtctcagcaatcacactgtatgggtcaatgtccaactgctccatacgattgacgtaaggggcaatgtaatcacagtcaactacgcaggccatgaagccttggcgaacggaataaacagcggtgcctagcagacactcatcaggcttttcagcgcgaatagctgatactgctcgataacctggttcaaataatggaatcttaaaggccatgcgggtgtcgtcattgtccggaaagcgtttgcgtaattcgtgatagtcagctaacaattcttcctcagtatcgccaaccaattgcacaaacaagacacccggctttaagtcgcggatcttgcctaattgttcgaagcgcggatggccttccttcagcaacagcttaggattggtggtgaccccttcgaactgattgaaacttagcatttctttgacttgatcaagatttgctgtatcgataaacatggactattcctcctatattaaacgcggtcactggcccagcaacctgcacataagggccttgaagccaaatagccaaaccccagccactttgcttcaaggccgtttatgctccagtttctaactaggttggctcacgcttttgctattttaattgtagtcccgacatctaattctggatacgctttctcttccaaataaagcgatcctgcaagctcaggtgttgtcgaaccatcgaaaacgatcgctgtgtgcccgagattgcccagattggtgttcacctcattgccaacggccgtgatcttataaacttgatcaccgaatgtcattacatctccggcttcgattggttctaaaattttgttgacattaataatgaagcaagacgatcgtaatgcatcaggggcttcatctccaaaaagaatggccatgttgatatccttgaacccccgtgcttccgaaccaacttcaagaatttttgtctcgtattttactatttctgctattgacgacaccttactcacctctcaaataaactaacttatttcgcgtacaaaccaaaacttgctaaccaagcaacaacaacacgtggtaccccgtttagaaaacgggaatacaggactgagaccacgccgacttcaacagtcttagagtcggcttcttcaagtcctaacccaactggaatgaagtcagccgcgttttgcgtgttaatcgcaaacaatgcaggcaacgcatattgtggttggatattgccgcgaccaatttcaaccccgatcagcgtcccgataacctgagcaataacagctccgggtccaaggataggtgacagaaatggtagggagcagatgaaaccgatgacgataagtccgaacacattaccagcaagtggcgtcatgagcttggcgaaccagctgcctaagccagagccttgaataataccaatcagtaaggcaacaaaggccatgaatgggataacggtattcagcattgtctgaacggaatctttagccgcttggttaaaagtagcaatcactttcccggcgccaatcccgatacgcgcaatgaaattaggcttcttcatctgcgctgtgatcgttttgttcgtatcgaacttggcttcgcgagcttcagctgctgcttcatctttagcttcggtggtctgtgcttcagttgccgtcgcttgagaagctgccgatgctgccaatgcagcatgctgtttgccagcttcgccacgttggtcaaaaggtaccccatttaatgattgatctggcactgcatcatcaggtaaggctgtaatctgattcacatcaacatttgaaacatacaacttaggcacaatatattttgccagcggaccagacttcccagttggcaatacgttaatcgtcagaatgtttttcttcggataaattccgcaacgtagtgtgccgccacagtcaatgatcgcaactgccgtctcgtcttcagggatagatgtcttgaaaccgtcgactgcttccatcccagttaactcaacaatcttgtcaacgatggcaggtcgattgccgccagtcacgtagataaacttatgcttttgttctgtaggtgtaatggtcaaggggccgccatagccgcctgagcctttcacaacttgaatactatgccatttttgatcagccatgatagtaaatgcctcctttattcagacaattaggcttcttgaccattacgcgccgacagatcaactgtcttgctgagcgtaatgccagtttgtttagaaacatatgcggttgtgaagtcggtgacccaaccgccgataaagttcatcacaatcccgactaacatgtagcggattgcgagatccatttgatttaacccaagtttttggacaccttgggcaatgcccaaccagacgaacaattcacctggattaatatgcgggaacacgccattgctggtatggcagaactgtgcttgtgcagcatagtagcttggcttgtagtattccggcaagaagcgggcaagcgtgaagcacattggattacctaacatgaatgctgctaaaaatggcaataccagataacgcatcaacacatttcggctcgctttctgggcaaaccgttcgattcgttcttccccaataaaagcaataatcgtgttcatcaataccaacaatagcaagacaactggtacaatgctggtcatccagctaatgaatgtcttgccacctgtttggaacagcttcatgaagccggctgcaaaatcagaaacatattgcatggtctcatctcctaaatttaaattgtattcttcttaaagacattggttagcatctgcggaatcgctttcatttttatgccgatctcattaaagatcggcagtgaaaacatgctgacacgactcgtatcaaagtcttcaaaactgagattattcgttttatagttcacataattgcgatacgcattcagaaaacattcgcgttctgttcgactcagcttctgcagtgccgtgtaatcagcgccaacttcagcgaccagttcaccgtcaaattgattcacgtctcggaatcggctgaaaaccgtgaggcccttcatcacccgaatttcttgaatacgatcatcatggtctaaaccgatcaacatcaaactgccttggcgaaaacgccgaggatttttcccgatcagcacccgaccatcttgccgtacctcgtgataattgtgagcaaaattacgaatctgaaaatagcccattagtgcctgcagtaaaaacgccgctgcaataaagataccaagtatcaaaacgttcatttaaagtccctccgtgacaacggttaagggatcttgactgcctgaaatcttgcgcagattattcatcgccgcttcattcactgctagcaaaaacagcagatcatagagcatcgataaatcctccaaggcttttttccctaaaacacgtggaatcccaataacaaaaatataactaactgctttgccaccaactggaatggcatgtttcagtacacttagatgcaggaacaagcgattctcgtcaatatccgcaatagcatgagggatcgcgacaccgttatcaagcacaaacttggtagtcgattcgtgcttgatcaatcggtcaataaatccggggtcaaccaaacctgcatcactatctggcttgagtgctgctcgtaagacagcttcatacgacatacttgctcgattctcgaaaacctgtgggcgccagatgattctgccagcatcaatttcgtgttgaaccgctgaaactcgcactttggtttcaagcacgcgatcccggaagatatcaccaatcatgacgaccggaattcgcaatttatgagccaacggccgatctgtgaaaaccatgatcaactcatcttgatgttttagaatatcttcctcatcctgataagcagtgattgtcacctgcgactcgaacatcgtgttaagctgattttgcaaatactgcagcacgctttgccccatgtttgaataaaaaccaactcgtggttgatctggtacattgacatcggcatgctgcaacgccatttcgaagtaaaccgtcagataattgatctcaacatccgcaatatgaatccccattttttcttccaacttgtcaatcatcaagatcgccatatcggcagctagttgaaatcgttgtaacattttgtccgtcaaataatcagacggagaaatgtggaaaataccgcgattaatcaagaaaattaaatgatacttagtcgtctcataaaattggtcatagtcaatcttggcatcaaccaaagctcgaacttcactggcaatttggtcgaacattgctttgttttcgtgaacctttaccttcaacttagctggtgacaataacttgttcgcatacaagttgaagggaaaggcaaggaaatcatattcttcttggctaaatgacacatggcagcgatcttcaatatcaccaacaatgttaatgaaaagtggtgaatcgtccatcaagttcgtataatacggactaataccactgaatacataatgatgctttttcaggaagacgatgatttgcatgatcttctcaaaaatttgtgttgtgctcgtctttatcttggctgaattcagccgactgacgactgatgcaaccaaagttttatccgtaaaaattcgcgactgcacataatcaaagaggtgattgtaaatcaacatggttaagtcaacagttgaccccacttgtaacttaaccccgcgacttgtcgccccttcaatttggagatcataatttttcaaccaagcgcgacaagcttctaaatcttttaataaagtgccgcgactgaccgtcaattgatcagcgatttcatccataggaatgaattgccgttctttgataagacgaaaaagaatttccgcctgccgcttctgcttgtcgttattatcaatattttgtttgaagacacctgattgaattaaagaaaattggcgataatccaagatgtgcaagaagtacccatttttattaatgcgaatttctgcagcatccccaagtgattctcctagctcatgaatgtacttctgcatcgtacgcgttgagacgttttcgctttcggccaactcgtctaaatcagatgtgccatttgctaggagatagcgtagaagtcgataatccaaactattcaatcaggttacctccccaagcttatgaattaacctctggacttaccccccgcaacattggttgtcacacctgtaatatagctagcacgattggacaagaagtagttgaccaaatcacccacttcactcaacttgccactacgacctaatggtgtagtagacgttgaactgtagccggcacggattgcatcaacggtggtatcacgcgtataagccaaagcttcttcataactcggtgtccgtaagcctgttgcttccatgatgccaggtgcgacccccacaacccggatattgtacttgcctaactctttagcccaagaacgggtgaaaccgttgatggcacctttacttgctgaataaacactctgaccaacagaaccttcaaggccagcctcagaagacatattgacgacaaccccatgtccctgtttgaccatccgacgaacgactgcttgtgaaaccaagaagacacttttaacgttaacactgaagatttgttcaaatgtcttaacgtccaattcatatttaccatgtggatctttaggatcaaccaatacccgcggcttgttgatacctgcattattcacgacgccccagatttctccattgatcttctcggcggtggcggcaagattttcaacttcgtcaggatcagtcacatcagtatgcacatacttcaagttagggtccttaaagtcgccttccttgagatcgccgttaacaaccgtagcgccattattaatcaattccttgacgatcgcagcgccaattcctgatgaacctccagttacaacaattgtcttgccatctaaacctaaccaatcagacatattcaatctctccctttcatctttctgctctatggtagcgtttacgagagaaagacttaagacagtcattttccgacgtcggggaaaaaacgtgcacgatggttaacgaaaacaactggatatcgttaaatagtcaactatcacttgaaggtgaaactagtgaaggatcatgtaaaaagagccggttagcggtgcttgaccacttaaccagctcttatttttgaaaacagggatctcgcttgcttttaatatcacgccttagccgcatgccccaccgacttagcattatcctgcccataataagcatccttaccatgttttcgataataatgcttgtccaacaaatactgtggcaaatgcacatcttgatgcgtcaaggttaatgcgtgataatccatttctgcgacaacttccaagactttggcgttataaaccgccttagctggggtcgctccccagctgaatggaccatgttggctgaccagaactgcaggaactgcgttgtgatcaataccgcgatctttgaaggttttgacgatgactttgcccgtgttttcctcgtaagcatcttcaatttcttgttgcgtcaacgcttcggagatgggcacatccccataaaacgtgtcagcggcggttgtattcaggttggggatatccatgtgtgccgaagcgaacgcaactgcccatggtgaatgggtatggacaatcccaccgatgtcagggaactcattatagaggacggtgtgtgtcggcgtgtcgcttgaagggttcagttgcccttctacaacttcgccttgaaggttgacgacaaccatgtcatccggcgttaagtcttcgtaatcaacgccagatggtttaatgacgaacaatcccttttcccgatcaatgccggaaacattgccccaagtaaaagtaaccagatctaattttggcaactgcatatttgcttcgtagacttcttgttttaattgttcaagcatgaaagttcactcctgttcatttattgaatatcgttatttgtcaatcactgactgactgcgttgttttcccgataaatggtctatatcaataaacccaaatttaaaacttaatgtacacaatgacctgaaaacgcttttaacgccgccaactctgatataatgggttgtaaccacgtgaagttagaaaggaagtttacccatgcttaaagctattgcccttgatatggataacacgttacttaatagtcaaaaagaaattagtgtcacgaatcaagatgtgctccgctatcttagccgcaaaggtatacgtgtcattctctgttctggtcggccatttgccactttgaagccatttttggatcagcttcatttaactaaaaatgatgatgtctgcatttgtttcaacggcggcttagtccgattagtacgggatcacaccgtcatcaaatcttcaacgctgactaaatcacaaatccagccagtttatgatctcgttaaggaaaaaggtttccacttagatgtggttgctgaagatcaggtgtattcgttaactgaatttggtaaatccagctatgagtccatgattcctaaacaaatgccatttaccgatacgacatttgctaaggtaccagccaaattatcgatttttaaagtggtcatcgctggcgatccagaaatggttgatgcggcttcagaagctgcgcaatcacttgagggcgtcacggtgacaagatcacgacgtaccttactggaaatcatgccgcctaatgtgaataagaagaacggtttgaaagcagccctcaacttttatcgcattccgcgcgagcaattagccgcatttggcgatgaagaaaacgatcaagatatgcttgactacgctggtattggcatcgccatgggtaacgcgattcctgaaatcaagaaaatcgctgatattacgacgcaatccaatgatgaagatggcgttgcgaaattcttgattgattacttccagatcagtccaactgcgatccacccataactcgtctaaagccaccttccatgaggcggcttttttcgtgggcggcgtttgttcatccgttcgtctgttgtgatcaatagctttccatgactactaaactaccggttcctgctccaccccaacccgttcaaaaagatcatcaaaaaactgtttcgccttcttcacttctgccagcggatcatcggccttttccgtccacatctcaatagtgaaggccccgccataattcaggcgtttcaacgtacgcagacagccttcgaaatcaacggtgccatcgccaaacggtacatctcggaactgacctttactttcggcggtgactggcaaggtgtcttttaaatgaaccgaaacaatattatcaatgcctcgttctaactcttgaccgacattgttttccggccaagcagtcagattgccgacgtcagggtatgcctgcaaccacggactgcgaatttgcgccttgatgtccttaattttggtcaaggcgtttaggaaaggatcatccattgtttcaatatcaagcatgacttctttagccgcagcataagcgacgccgcgttttaagttctcaatgaagtattctcgcgaggtcaccgtctttgattcgtaataaacatcatagccagcaagctgaatgttacgaatgccgagatcaccggctaaatcgattgccttataaagcatttcaaggcttttttctcgaattgccggatcagccgagccaagtgggtagcgacgatggccactgagcattaaggtgtgcagtctcacaccggtttgccaacttgcatcccgtacttctgctcgctgtgctttcgtccaatcaagtcgggctaagcgttcatcgctttcatcaatcgacaattccaaaaagttgaaccctaaatcgtgagcctgttgcaacctctgctgccatgaatcagtttttgggagtgccttttcgtagattcctagtgaattcaatgttgtgcctccttaaatgcgtttgctgccccagaaacctgcgcacacgttttgtattcgctttcataaatacacaattgctattaaaaagacggtggccttagcaagcccgcgctccaacccttttttcaggctggacaccggctaagctaatggtcaccgccagcttgcttactgtcctatatcacgtttaattcgatacctgaatcacatcaataccttgccggcgcaagtcgcggacgaccttttcattcgcaaagttatctgtgatcaaaatatcaacgccggttaaatctgcgacatggtaattgcttgtgacgccaacttttcgataatcggccacgcagatcactttttgcttggttctggagatcatcgtgctgttgatctgcgcttcgtaaatattttgggttgtcacgccacctgcgacgctaatgccgtcacagccaatcaacgtataatctgactgcatcgtttccagaatctgcatcgcaactgtgccgaccaacgactcttttggatagcgaatttcgccgccagtcagaatgatggaggtttctggatgacgcacgcactcagttgccttgatattgtttgtgataatcgtcagcggcatgatcgctaactgattaattgcccgccaacacaatgagctggagttgacgaaaagcgtactatttttaacaatataagctggaaccgccgcaatcgtatctttaattaattcgatgcctgaacgcgatccgtgattactggcggtcaccacattggttctttcaaccaaaccatgatgccacttcacctgtcccatgtctgacaaagctttcaggtcacggcgaagcgtcgtgatcgaaacattgaatcgttgggccaagccctcaacagcaactggctcagactggtccaccgctgacaagatcttttcccggcgtgcctgcacattggccattgaatttttcactgtcatcacctctcagcaacgaattgcctacttgcttacttgccccagatgcggatgatttcgttttggaaatccgttgctgcttttgcaggatctggtgcctgcgtgattgcccgaccagcgatgaaggtataaacgttcacgccttcaaacagtttcaaggtatccacactcaaaccgccagtcacggaaactcggaagcccatatcaaccagcatcttaaccttagctaaatccttctcgccccatgagccgccggaaagcaaagcatctcgactctgatgataaatcgcctgcgtcacaccaatatccagccacgactgggcatcttctttggtccaattaccatacaattcaatttggatctctttaacttctttttgagctgcttgaatggtcggaatcgttgccgcacagatacaagtcatccagtctgcaccagcatcgcccatgttacgagcaacggttgtccctgcatcagcacatttcgtatccgcaatcacgattttatcaggaaaaagggctcgcaatgcgcgaacggcaatcgtgccttcctgcaaaatcaagatcgtcccggcttcaacaatatccacaatgttcccaactgcgcgaacatctgccaaagcactttccaacgtattattatccaatgccacttgcaaatttggtttagccaaaatgtttccctcctattatgcggcaatcacacgatctgttcatgtgtcgcacgcctttccttaacgtcaaaagcagaccggcccgtgccggcgtccgatctgcttaatgactcgctttatttcacaagatccgtatcttcacgaacatgctgttctacttctttatcactcataacgttcttgacgccaatcacttgcacgcctttactctgagcgtccttgaacatgtcgacaaagttggttgttgtgaacaccatgtcgtattgtttagccgtactcttgccttctgccaagttggtatgctcaatttgcgtaatcggaatattcaaccgtttaaatgctttttgaacactgcgcatcatcattaaactggtacctgaaccatttgcacacgatactaagatcttcatgggaaatttcctccttgtaagtcaaagccttatttagtaacctttttctttgccatattttctttatattgctcgtaatccgttaccatcaagaagtagttcttcggatcgtgacgatattcgagttgtgggatcaagacaaggatcagaacaacaaccacgatgccagcgatgccgagaatcttcatcaagacggtgaagaatggccatacagtgtcccagtcgaacatccccagatagccgccaaacttcgacaaaccaatccaagttgaaatcaatgctgcgccgaacacttgaatcaaaccactgaagaacggtaagatcatggctgctttggcaccagctcgccggtttgcgaagaccccgaatgcggcattatcaaagaacaatgggataaacccagcgataatgatagttggtgaatggaaaatcagtaaagcaccaatggctaggaactgacctaatgcaccaaacaggaagccgatggtaaccgcgtttggttcgccaaatgcgaaggttgcggccacatcgataccaggtacggaacctggcagcagacgatcggaaatcccggtaaaactttcagtcagttccccaacgaaggttcgtaccccaagttgcaggatggtcaagttaaccgcgaacccaagggaagtggtcataatatagaacaggaaactagcatttggtgctaaacctgaggcgccttttgttgctgcgaaaaccccaacgaagtacgatttacccagaatcaacatgatgatgccgaagaagaacagcatcagaatgccggtcgcaaccatgttttcgttaaagatcttgaggaaaccaggcaattcaatatcctcaagacgacgtgcctttttcttcgcttttacttcacgagccttaaacttgtcagccagccaagaaacaaaggcaatcccaaacatttgttgatgggcaacggcaaacccgccgccatcggtcaaatcctgcgtgtaacgaacggtcatgtttgaaccgactgcccagtacaggcctaaaacaacacccatgaccagcagcacttcaatccgacccatcttcgggaaacagaaaagtagaatccagaaagccgttgcagcttgttgcacttggacattaccagttgtgaagactgcccgcaacttcgtccatttctggaaccgaactagcaaaatgttgaagacgaacgcgaacagcagcaacagcatgacatcgccgaatgttcgaccaaacgtcttttccaaaccttcagtaaccgcgttttgcccaaaatatggatcaataacggtagcggttaaattaaagcgatctttcaagccggtcaggatcggtcggaagctgttaaccaagccgccagacccaaccatcaagatcatgtagccaataaccgcctttagaaacccagcgattgattcatataatggcttgcgttccaaaatatatccgagtaaaacgataaacccaatcatgtaggctggttgcgtcagaatattcgacgcaaagtagtcccatattttaactagaaaatctagaatttgctgcatgatttcttacctttccccttcaactccccgcatcgatgagtgctttaaaatcatcaacactattgacggccaacagtttatcgatcagaccttccgtcattaacatgtcggaaaggtcgccaatgttttgcaagtgttgcttcggatcttttgcagctaaggtaaagaacagctgtgcctgcttatcagggtcgtctgaatcgaaaatgacaggctcagggaatttcgcaaacccgatcgccgtccccaaaacattctcactttcagccatcgcatgcggcatggccacgccaggcacgatcacgatgtatggcccgttcttctcaacgttagcaataatttcgttaatataccccggcaggatatacttgtgttcgatcagctttcccgcggcttgttgcaaggcgtcacgccaatccttagcaggttccggtcgaatatcaacgagatctttctccaaaaagtctttcagtaacatagttgattcacctctcttaaacgcgttcgcagtcgcagaaacctccacataaggacctcagtcgcaatggccaaagcccggccatcacgcctgaggccgcttatgctccggtttctaagcgctcctgctcacgctctctataggaatgcagggaacggtgtgtcgtttggaattgagaaagcatcgtggaaaccgcgatcatacatgaattccatccggtctttgtcatctgggaaggtgaattcaccgccaacttgccaaatgaaaggcttaaacttgtattgcaaacgatccttgcgcatttgccagagcgcttcaatttccttagggtcagccataaagttggtccagatatcataatgaacaggaataatgactttggtgttcaaagattcagccatgcgcaaaatatcgatggaagttaccttgtccgtgataccgcgtgggttttcaccataagcacccaatgcaacgtcaatcttattttcattaccatgcttagcaaatagattggagtaatgagagtcagcagcatgataaagattgccgccggtggtttcaaacagatagttaaccgcaatcttgttcatatcttgcggcatcttgcctgccaacttcacattaggatcgtcttcggtgattaaagcggtccggtcaaacccttcaagtaccttaaccttcgtcttgccgatggtaaccacgtcgccaggtttaacaacaaccgtcttttctgccggaacaccccagccttgccaaatctcacaaactttttctgggccatagaacttcgcatccggacaattcttattaacagcagccgctgtattcacatccaaatgatcactatgaatatgactcacaaacaaagcatcaacatctttaatggcaaatggatcaatcacaaacggttgattacgcagattcggttgcatcttctgcacaccactcatccgcatcatctgatgacccttgcgcatcatgccattcccatgtgattgcttaccagtgccgcaccacatatcaaccaaaatgttggtatcttcagccgtcttcaaccaaataccggtacaacccaaccaccacattgaaaatgtgccaggtttcacctttttgtcagcaatctcctcattcaaccaagtcccccactctgggaatgtgctaagaatccatttttcccgagtgatgttattgatatttttgtctgccatgatatttcctccttaggctttgtttctgctttcaattaacatggtagatgaacttgaatgcgcttacaataccggtatatgaactatataggtcttatatgccattttatgaactttatatgcacttttaccaactatcaattccctattttatgaattagttcgtatttttttagtgcttaaacgcataaaaagcatagcaatatcaatcaacgttggaatcaaatccgacctcacttaaccctcgtcctgcccttattccaaaagtggctgtatcaaactgtctgaccaactgttcacattaagttttacttttccaacacgttaaacgcatatgtaactattaagaaaatagtttccattcgtcttcaaattaagctccattgtcacgtttcaaggcaggctttttttcacgcaaaaaaactcagtaacttcaaagttactgagcttaaaggaggtattaacattaactagtcacattaccttatcaactatgctttaagagcatgattcttggacttcgcgctgttttgtccatagtacgcattcttaccatgcttccgatagtaatgcttgtccaacaaatattgtggaacatggacatcttcatgtgtcagcgttaatgcgtggtaatcaatttctgctaccacttcaagcaccttggcattgtaaaccgccttttctggtgtagctgcccagctgaacggcccatgctgactaacaattacggcaggaactgcattatgatcgataccgcgatctttaaatgttttaacaataactttcccggtattctcttcgtaggcatcttctatttcctgcttagtgagagcttcagaaaccggaacatttccataaaaagtatcagcggccgttgtattcagatttggtacatccatatgcgctgaagcaaatgcgactgcccatggtgaatgtgtgtgaacaataccgccaatgtcagggaactcattgtaaagcacagtatgcgttggtgtatcgcttgaaggatttaaatcaccttcaacaacttcaccttgtagattaacaacaaccatatcgtctggcgttagatcttcgtaggcaaccccagatggtttaatgacaaacaatcctttttcacgatcaattcctgagacatttccccaagtaaaggtaaccagccctagttttggcagttccatattcgcatcgtaaacttctttttttaaagcctctaacattgaattttcttcctttctatgactgcttttcacttacaccaaggttcttaggcaatcgatgaatcaacttttacaatgaccttattgaattcaatttctttgttgtacattttcttcaatgtatctccgagttcgttcaaattaatttcctgagagatcattgacttaaagtccatttttcctttactcatcgcatcgatgacaatgctccaagctcgtcctgggtaaggcattgtataggacatccaagaaccgtgaatatttagaccgccgcgtaaaacatgctgctcaaaaacatctttttcaatcggcagattgtctccagaaataccgacaaagacaacattgccatcccgccgagtaatctccagtgcctcaatctcagtaaatcgagtaccggcacaatcaacagcaacatccacaccatgcttagtaattttttggacttcagcgacaacatcttgagttttaccattaatcgtgtaatctgctcctaatttctttgctagttcaagtttatcgtcaaagatatcaacagctatcacgttgcttgcgccgtacagctttgcattttgaatagcaaattggccaattgagccacaaccaagaatggctactgtatcacccgcttgaatatgacctcgagccagcccataaccgctgactgttgcaggttcaatgcccgcagccgttttcaaatcgaccgagtcaggcaaatgaagaacatgcccctttggtactcttacaaattcagcaaatccaccattactacctgttccaatcaagttatagtgttcgctgaatccatacaagcccatctttgtataaatggaatcagggtttggaagtagcggagcaactgcgacgtgctcgccttccttaaagcctttaatattggcacccattttcgctactgtgccactgaattcatgacccataatcagcggatacagtctggcgccattttctttttgacttctaggcaaatccgaaccacaaacacctgaataagcgactttgatcaagaaatcatcatcggaaatttctggtactggaacgtccttatactgaacatctccagcactcatcaaaacagcagctttcatcatatcaaccatggtaatattgaccacctttttaaaatcgtttctcttgttcaaaatcaatttgagaagtgaatactctctttataaatcatcaattatctgtggctgctgtggcattcttagcagcagcacgttctagataagcgcggaaggcatctttattcttctggaaggcagcccacagaattagataaagaacaattgttagccctatccaaaaaatgttttggcttaagaatgcgtagaaaatcaaaccaaagaatggcttacccaagatattgaaactcgtcaccatcaatgcagctgttggaattgcgacgccaatcccagagcttgcgatatgcgtaaacaatggcgctgttgcagtacacatatacaaccccaagctgaaccaaatgactgaattgatcatggttttaaccatattcccatttgaaagggcaattaagccttcaatccaatacggaatcgccagtaaatcaataactggtaatactttatttcctggtaacagaatagcaagaacgaccataatcggaatcaagagaatcccagtgatgagcgttgcagtttcgccaaaaccaactgcatcgttaacacccaagaaccaaagacgtggcttcttaccttctgcttgattttcagagccttttgctttgttactctttcggatagaacgactagccgcttgcgaaagaggtgcaaaggcttgagcaaaaataccagcaattttcgggaaaattgccataatggcactcgtagcaatggcaacttgcgtgatttggccccaagaggctaattcgccaagatgtttaaagttccccaatattcccaagagaaaacctaagaaaaagcctagggaaattggctctcccaagaatcccaacttctcttgtaagtattctgggctgagtttaattttgttgataccaagcttgttccaaacaggatccatcaaaataccgaaaattgccggttccaaattatgcaaggcaatgatggttgttcgcggatagccataataagttgaccagcgttgagcaattgaatctgagagaagcaggctatacatgttcaaaagacacattagaagtaaagagagccacatgttctttgtcacgtagaaacacatcgatccccataccatgtatgagtagttgttccacaaatctgaaggttgaaagacatctgtccaacgtattaaaaacagaaccgtttgtaaaatgaacgcaacgactaggaaaatcatgcccgcttgagttgagtaagcaaccagcgatgccccttgccatccgatatcaaataccggcaagttgacaccggtatcgctaaccatttttttaataaccttactaataatcggcgtataggagttcaataataacgtaaatccagtcaacccaacaccagcataaagcgctgaaagaaaagctttctgtgtcttgaccttcaatatcagagcaataaagaacagaattacgggaacgaagacattagctccaaaagtatcgaagaccagctttacagttgttagcattcttacatctccttctatattagattcaaaagcaaatcacaattgatcgtttacttattaccatcaataatctttgctacagtttttttaagttcatcccaaaattcatcttcaccgataccagtcaacagtcctgttccgtttatgacgggcacaccatattcggccttcggtaatgggcttgtgtacacgatcaaatcaaacttaccgccatcaattaactgttttgcctcagtcggacgagcttctgttgctctcactgagtatccttcatcacccaactcatcttgtatctcgccagcaatcatggaagaggtaacggtaccggaaccacagaccgccaacaaattgatatttttactcattagttttatccccctaggctcttaattattcggtttctttaacaatattggccgtcagcaattgatagatttcatttgcagaattctctgccataactttctgcatcaagtcttggttttgaaaaaggcgcattaactctcgtaaaatcttaacttgtccttttggatcactgactgcgatcataaacatcatgctaacctgcaatgtttcatccggatcaatcatgctgtgaacttcaacaggcttgtttaacgttgccaccgacacaactgtttgagaaacaaattcagcttcagtgtgcggaatgccaatgttcatatttgcaagaacaagtcccgttggaaagtccttctcgcgtgcgattacttgatcagggtattcgggactcacaaatcccgccttcaagagattcttagacattttgcgaattgcatcggcatagctttctgcgtcaagattcggataaataaactgttgctcgaatttcaaattcattggatcctctccttctctctaaggtttgaatcgctcttcccagtgactggcttagcttttaatgctgatgcaggcaaaaggaaacgctttcaacgagttcattgtattacctttgctttttgtttgcaatagcattgcatttatttttttagcaaaatatttgggctgttattgcttatatatagtttgcaaatttatgagcaagttaatataaaatttacaaaaaggttgttaatctccataaagtataagcttttccctttctttcggccatccacatagaatcataaaattagctatttattttgggatttagtcaattgtttggcaactcactaaccgcacgctgttttaaaacttttatgctcacttttgcgaattttatgtgcatcttcattgcaaacggtttcttttagctgtaatatacgatttgtaaataacattatgcaaatactttgcaaaggagaatgcaaatcatggaccagacaattgaaaaatcaacggactattcgtctgatgcttatttaaccgaagtcgataaatattggcgcgctgcaaactacctatcagttgggcaactttacctcaaggccaatccgttattgaagcaaccattaaagtcatccgacgtcaaggtacatcccatcggtcattggggtacgattgcgggacaaaacttcatctatgcacacttgaatcgaatcattaacaaatatggcctcaatatgttctatatcgaaggccctggtcatggcggacaagtcatggtgtccaattcatacttagacggcagttataccgaaatctatcctaaaattgaacaaaacgagcagggtttacagcgtctattcaaacaattctcttttcccgggggcgttgcatctcatgctgatccaaagactcctggctcaattcatgaaggcggcgagctaggttactcaatcttgcatggggctggcgctgttttagataatccagagttaattgcggcagtggttgttggcgatggggaagcagagactggcccattggcaacctcttggcaagtcaataagttcttaaacccgattactgatggaaccgtgcttccaatactcaatttgaacgggtttaagattgccaatccaactgttttagctcgcgagtcacatgaggaactcacagcctacttcaagggtctcggatgggatccccacttcgttgaaggcaatgatcccgataagatgcatattcttatggcaactgagatggataagattgtcgaagaaattcaaggtatccgtaacaatgccaaaaataatcacgatgagcatcggcccgcctggccaatgttagttttccgtgctcccaaaggttggacagggccaaaagaatgggacggagaaccaattgagggatcattccgggctcaccagattcctattccggttgatcaaaatgatatgcaacatgctgataaacttgttcaatggctccagtcttataagccaaatgaactgtttaatgacgatggcactttgaaagacgatatcaaagccatcattcctaaaggcaataagcgaatgtctatgaaccctgtaaccaacggtggctcgctagccaaacatctagaaaaacccaacccctctgactatgctttagacaataaagaccatggtgcaactgaaggtcaagatatgatggttcttggtgcatatattcgcgacctaatcaaattaaacagcaacaatcgaaacttccgtggatttggccctgatgaaacgctgtccaatcggttaaataaagtttttgaagccaccaaacgtcagtggatggaatcgacaaaccctccatatgacgcattactggctccacacggccgcattattgattccatgctatctgaacatatggatgaaggcttacttgaggggtatactctgaccggaagatatggcttttttgccagctatgaatccttcttgcgggtggttgactctatgcttactcagcatttcaagtggctgcgaaatgctcatgaagaagcatcatggcgggctgatgtcccttcattaaacgttattgcttcatcaacagcattccaacaagatcataatggctattcccatcaggatcctggcgtcattagtcatttggcagaaaagaagaccgaatatattcgcgcctatttacctgcagatgccaataccctagtccgcgttttcgataaaacggtagattcgaaacaaacgatcaatctcattgtttccagtaaacatccacgaccacaatggtttaccgataccgaggctagtaacttagtcgaaaaaggtttaggtattattgactgggcaagtactgaccaaggggtagaaccggacttagtcattgcttcagctggctcggaaccgactctcgaaagcttggcagcaatttcaatcttgcacaaatcgttacctgatttaaagattcgattcattaacgttgtcgacctcctaaagcttaagaaagatgacccccgcggattgagtgatgcagaatttgacatgtacttcactaagaataaacctgtgatctttgcttatcacggctacgatgatctcatcaaagatatcttctttgatcgtcataaccataatgttcatgttcatggctatcgtgaagaaggagacatcacaacacctttcgatatgcgtgttcgcaacgagttggatcgtttccatttggttaaggaagctatcttggatgtatcttcaatcgccgaaaaaggtgcacatcttgatcaacagatggacgatattttgcaaaaacaccacgattttattcgtgaagaaggcacggatcttcccgaagtagaacagtggcaatgggaaccattacgttagtcaaccttgagaattaaacttgaacacaaaataaaagaagctctttgtcattgaatgcaggcgtcttgaatgatcgcaacgatccccgccctgacaaagaagcttcttttttgtctcagtacattaaaaaaatacaaggtactttcgaaagaaaccaagttctattcaaatcaccagattgtctactcccatctgtctagctaaatctctattaattcctggatcagaaataataaagtcaacgtcatccagtttaaacatactaactaatgagctggctccaaacttgctgtgatctgccaagacaatacttgttcgacagtgttgtttcatcgctttagctgtttgagactcttctaaataacggttggtgataccggaaacatcattgatcccgccacaaccgaagaacccaacatcagcatagattgagtcaatggcctgaagcgctatgggaccagaaacagaaccctcatctcttcgaacgacccctccaagcaaaacaatttgaatgctttgcatgacaagcagtgtctgtgctacaaacgttgaactagtaataatggaaagatcatgtcgtggattttgtttaagggcttcagccacctcatatgaactagtccctgaatcaaggaaaatagttgcgccatccttgatataggagagtgcgcgttgtgccatcttttgcttagcttgctgattgatggctttgcgttgatcaaaccgagaagtcggatcgtcaacaatagcttcagcgccacccctaacagcactgactagtccctgtttcgccaagctatagatgtctttacgaatcgtctcgcgtgaaacatccatctgtttactcaaggttgagatcttcacattcctgttttgattgacttcgtttaaaatagaatgtctacgttcatcaatttccatggtttcacctctaagtcttttttgaaatcaattgtaaatcgtttgcaaactcattatatatgtttgcaaactaattgccaacttttaaaatgcaaacaacttgcattcacgtgtcatgcatgccataattgtctcgatgtaagggttttctaacgccaagataaaaggagtaatcgttatgagcaagcgtattaatttgttgtcagtctgtgggtctggcactgttacctcttccatgattgctggcgaaattacagataatctaaagggcgatggctaccatgtgattgccacagaagcgcgaccaacagaagcaaaacaattagttgacagcggcaattttgatttaattgttttcactagtccattgccaaaagcagaatatggtatccctgttattaacggaaccgggttgttaactggaataggtgaagatgagttttgggataagcttaaagcgaccttgaccgatatggaaaaggaaaaagcttgatctcatccgactatttagagcggtaccaactaccgctttttttgatgctctttccaatgaaaaagtggctagatatcaacctcaagaataatgtctccaaaaaaatactgatctcggttagaagtcgaaatcagcattttgcctatttaaaaagtcgcccattctaaagtcgtaatctataaattcaataattaccatagaaatgtcatctcaatctcgcaccaccaacggcgccaccgccccaatcaagttcgccgcattccgatacttcgccggttccaccactggtagacgaattgtgcgtgccgaaagcgaagttacctgctgatatgcttcgatgccgtcacggatttccttaatcacccatggttgggcgctgatgccgccgccaatgatgactttttcgagatcaagaacggtttgcatgttgtagatcatggcagccacaccgcgcgtgaaggtgcggagaatgacggcggcttcgctggtgttgtcagttagtgcttgaaaaacgcgctggccaatcggttcttcgtgcacacctaaggcatcggccatcgcattgatcgtcgccactgctgacaagcctgccgcggtttgctcgcgcgtgatcgggtttaggccattggtcaccatgaaactgggttcgccagcaacataatggctgccgtgatagagctggccgttaagaaaaagcgatgcaccaacgccggttcctaagacgaccatggcgctgttcattgttcctgctaaattgccgcgccaatgctccgccaatgccgccgcattaccgtcattttcgattaggatcggcaccgtaagatcggcggctgtagtcagttgtgtgcccaacaccaatccttctaaaaaaggcagtgtggcactagctttaacgagaccttgctgcgaatcaatgacccccggtaaagccaacccgatacccgcgacgtgtgctttatgcagtcgaatcaaaccggtcaaactggccatgaaatcagcgagactagcgcgcatggtcggctgctcaccttgttgcgatagtgcgcctgtcgctgacactagaccgtactttgtcgttgtgccaccaacatcaatcgctaaatactgcatagctaactccttttaaccgaagtatcttttgcaaaaagtccagaacgaaggcgcgcatcattcaatcggtgctttgatgcgtttttcataagcatcgagccattcctgcgtgatcggttcgatcgttgtggtctggttaggaccgggatgtgccatgaggatgaccggtgcctgatgggtcgtggccacactgaaagtgaattcgacattcgttgcgactccccagtgacctgcatgatccatggcgattagggaaaattcgcctgcttgaccataacgacgttgcaatttttcgataaatggataaacggcttcgtcgcaggcttgctgcggtgtgcgaccggtacccatcagacggacaatttcatatgaaagacaccccttcataatgtcctcgcccaatccggttgctgcggcaccgccgatttcactgtcgacataaaaccctgatcctgataacggcgaatcgccaactcggccaggccgcttcatgaaaagacctgacgttgacgtggccgccgccatggagccggttggcgttaacgtgatggcgccaactgtatcgtggccatcataaggtttgaccttggcatcagcgatttccgctcgtcgtttttcccagcgtttttttgcccgttccgtcaacatgttccgcatttcaaaaccgttgagttgggcgtattgcgtggcgccttcgccgacccgaaagctgttgtaatgctcgtgactgagtgctcgggccacagataccgcatgaaacacattgtgaatgccagcgaccgcgccttgtgccagcgtgtccccatccatgaaagctgcatccatctcgacgacgccattttcattcggcaacccgccataccccacggatttgtaatatggataagcctccaccattttgatcagttcttcgacagcatcggctgcactgcctttgttttgcaaaatttgactggctttcttcacgccgtcgtgggccattcgccaagttgcgatggcgccccatgtttcgttgctcatttgctcatccctcctaaacgtgttcgcaggcgcagaaacctgcacataaggaccttgggcacagtagtcaaaaatcgaccatagcaaccgagcccgcttatgctccggtttctaaccgggttggatcacgctctgtcaagccgatcattgcatccataaaaatcatcatatttaacttgagatcagcttcatccatccactcatcttctttatgcgcgattcctttttggcccggaaaagatgggccaaatgcgatgatgtttggcatttctcgggcataggttgcgccagtagtggtgaccggtgtgccatcatttccggtcattttttcatacgcctgcgtgagttgcgcaattcgtgggtcatgtttgtcatgcaacacgcttggcatgctacgcacaatcgtgatttggctgccagctggcacggcagccgccaatgccttgctgacatcggcttcgtgataggtcactggatagcgcattgctaagcctaaagtcatcgcatcatctgttttttgcaggctatagggggtcacgatcagccggccactgtcggcatcttcaaacgccatgcctagcccttcgccgaaatgtttttcagccagtgaatcaatgagccactggcaatagcttgctagttcgccgatgaccagttgttccgtcacgagctttttagccagttccgtgatcgcattgacgcctttttccggggcattagtcggcacgcggatgccgttagcggtgattggttggccattaacggccatcgtgagtttatcaggtacatggtcgcgcgcttggtctcctgtaatggcgccgatctgtttgattgaggcaggcgcaattggggtagtgatgcggtaattcacaatgccgcgttcaccataaacgacggggaacttacaatcgggcgtaaagccaaactcaggcggcgcttcactggcaaggtaaagtgggacatcatttgacccgctttcttcatcggaaccaaaaatcagacgaatggtctttttcggttgaaaaccggcatccttcagtaatttcataccgatcaaacaagccatactgggtcctttattgtccaacacgccgcgcccgtatagacgtccgtctttttccgatagtgcataaggcggaaagtgccagtctgcatcccctgcaggcacaacatctaagtgcccgacaattccgatatagtgctgatcgtcctcaccccattgcacgtatgccatggcatcattgacgaccgccgttttgaagccataggccgcgccgagctgcgcgaccgccgttaaaactgctcgcggccctgaaccaaacggcgcgtgctccgcttgttgaccgcggacacttttgacggccatcacttggcgtaaagccgcgaggaactcgtcgcggtgcgtatcgtacatggctgctaaggttgctttttccatcactctgcctcccaaacgcgttccctgatgcagaaacggccacataaacatctcaagtctaaatgaccacttagattccgctttctaaccgcaccagcgcaagcgctttgcgattagtgcgtatcgcgagttaacgtcgacttaaacgagtatttatcggctcgataatacgacgtgtcgaatagaattggcttggcatctgccgtataggtgaccgaatgaacgcgcaacaacggatcgccttttttgccatgcaagagtttggccatttttttatccatcaacatggcttcgacttcttgatgcgaatacgcaattgccacgcgtttttccagaagtgcaaatagcgatccttcaaaatcgtggggctttaatccggcgacatattcatggcagatcgccacatgttcgacggtcattggttcctcatcccagaagcggcgccgcactaacatgtcgatttctttgttaacacgggtatctagtgctaaaacgcggctgatttcttcaggaacggggtcaagcggtccgaagctgatgacttcggtgcgactttttttaccgtatgctttggccgcttctgtaaagccttgcaatcctagtcgaccgctttccaccttgtcagagtatgtcatgacatacgtgcctttacccggcgatttcaccagcaattgctgccgtatcaataagtcaatggctttgcgaaccgttaaccggctaacgtcaaactcttttgccagatcgtactcagatggcaagcgctggctcgttgtataaacgccatcacgaacgcggcggcttaactcgtttgcgacatcttcaaattttgccattcatttggcctccgtttcacatgccatttgtaagtgatcaaatagtgcaatgatccgcttaccaacttcagcgtaatcatgcgttggtagattggccagcgacacgcggactgaccaagtgtcactgccaaacggactcgtttttaataacatcaggtgttgctgctgcgctaaggcgactagcaagcgagtcgttgtccagtgttgctttaagtagcgggcaaaaacagcaccatatcgctgtgtgccccacgccagcaagtcaatatcacaataatacgctgtatcacgcgccggtgctggccgagtgagcccaagcgtcgaaaaaagctgctgttctctagcgcggcaagtcgcaactacttcgtctttataagcctgcccttcgtccatcaaaccataaaggctgaatagggcaatcatcacttgttgaacggttgacaatcccgcggcatggtttaaggcgatatcgcgagagtcggccacgatgcggtcaataaacgaaactgtcgtactttcgcttgcaatcgactgatagcgggcggaaacctttgctttaactgctttgggcagctgatcaatcaattcatcgaaaacgttgtccttcgctaacgcaatcgcgccgacccgccaaccggttgcaccaaaatattttgaaaatgaataaaggcaggctgtgttatgcggtagagcggcaaacaaggataagaagtgcggtacaaatgtcccataaacgtcatcggtaagaatcatcaggtctggccgatctgtattaacgatcgcttcgatctgcgaaatattttccaatcccattgcattggcagtcggattacttggattaaccacgaatgctgctttcacttttggatcgcgcagtttttcaatctcggcttgtgggtaaacataactggcgcggtcgccagtcgtcacgcgttgtgccttaatccgaaccacatcaaatgcatagtgaggtaactttggaatctcaaggtatggcgcgaatgttggcagcagcaaggcaatacgatcccctgctgctaataagccggtatgcatcaaggtatcgaacaggtagcaaatgcctgccgttccgccttccactggaaaaacatccagcggcacttgacgatcatcgaacaactctcgaatcatgtaagcttttagcggctgttcgcaaacagaaaggcaccggactggggcaggataattgtcaccaatcaccgcatcgcacgctgcactcacccaagcggctggcgtcatacctagtagctgttgatctgtctgacatatccagttcaagaaatcggctccggggccggggtgcgtcgtcaagaaagtttgtagtcgacccattcgttctggcgcggccttgatctgtttgccaactaaagccgaggacgacttccgagtttcctgaacggcgaactgtcctaatagaaagaatgcctcccgcggcactggggcggtccagtttggattgcctcgaccagcattgaggatcggggcatcaggtgctgactgaatttgcttttccaagtacaaactaagctcaaatgggctgagtgcatcgatcgagatggtcaaggctaatacgctcccttttgtgatctatactttttagtatatactattcgatctgctttcaaattgcaaccgatttccgcaatttcttttttgctaaatgccttgaaacatcagagttccagcacactaatcagaaaaatgtatgccctttcaaattttgcttgtttttccaacaactaccgtttatgatgtgtatgtaccaagtagtatatactaaatatctcgctgtcgataccagtttcttttcgtttttgttagcagaaaaaaggcagttgtcagctttacgatcggctgcttttccctgccaaaatatgtggcaataagcaaaattaaataaaggaagtgtgtcatcatgtcaccatctacccctgtccacgaagacaagcgttcgccaatgttagcgcttggcatcttgtcgatttcgttcctgatgtctgtcagcaacgccgtctctggtacgatcccgctgatggagaaatatttctctgatgtctcgcgccccaatgtcgaactgctgatcgtgattccgactggcggtgtgttgttgggtacggttatcagtggtctggtctccaatctactcggaaaaaagtacacggttattgctgggctatccatttcactcgtttttgggatcattcctgccttcatctttaattatccagcgattttgatttcgcgggcaatgttcggggttggcatggggattttcacgccactaagcgtttcctatatcacggatcttttccctgaagagacacgtaatcgcctgttaggctggcgtaattcagttggggcgatcggcgattccatcatgcttttcatcgctggctttctgatcaacatcagttggcacacaacctacttggttttcctgttcctattagtcccaatcctcttggtgatgttcttcgtaccaaagcattacgacaacattgtttctgaagatggcaaggaagttgaagaagacgttaaggtaaaaccgacgaccaatttcggtgttatccagctcgcgtttattttcctccttgtctgcttattctattccgcgatctcactaaaactggcgagctacgttgtcaacaatcacattggcagtgcggcagccgccacgcggatcttcggtttcctcgtcctttgctcaatcttctcagggctgatttttgaaaaaatcgctaaatggttcggcaagtatacggtcaccattttctatatcatcactgcgatttcgatgattgtcatggccttcaccacttccattccggtactgttggtactggtgctggcggcaggcttctgcaatggcatcatcaacccggcactaaccgcgcgaatggtgcactattcgccaaaaggttctatgaatttcacgacatccatcatcattattggcatcaacatcggctttctgatcgccccttatttcttccaattcttcggtgaaatgattggcaatgcaggcccagccaatatgattctgtggagcggcatcttctatgttctgttagctgtctatgaccttgtcgttgttaaaaaagacaaattgacaatctgatcagcgcgtgagtcaaatcggtcagaaacctgcgagcacttttaatagagcgtgacccatcataacgcgctccccggcgcagcaaccgcgctggctcgcgttcacttttcaaaggagaagaattcatgaatgacaatgtagcatggtttaaacaagcgaagtacggcatgatgatccattggggcctctattcactgctagctggtgaatatcgtggcgaatcttccagcgcttatgcagaatggattcagtcaaaatttcagattcctaatgctgagtatggcaacttggcaaccgccttcaatccgctgtacttcgatgccaaaaaaatcgtcgcactcgctaagcaatgcggcatgcagtatctggtggtaacaactaaacaccacgatggctttgccatgtatcactccaaggtcgatgcttataacgtttatgacgccacgccatttcaccgtgatatcatcggtgagctggcagaagcctgtcaaaaagccgggctcaagtttggcctgtattactcacaagacctcgactggcacgatccgaacggcggcggctacaagtcgaacgatgtcgaaaccgctggcacgacttgggataatagttgggacttccctgacgaagatcaaaaaaacttcgatctttgtttcgaaaataagatcctgccgcaaatcaaggaaatcatgtcgaattacggtgacattgcaacagcgtggttcgatgtcccaatgaccctgtctgaagcgcaaagtcagaccatttacgacaccgtccgcgagttgcaaccaaactgcttaatcaactcacgtttaggcaatggcaaatacgacttcgtttccctaggcgacaacgagatcccgaaaaacaaagaagacatgaacaagaccgacgttgactacaacgaaattactggcttcaagccttcgccactaggtctctacgaaactgccggcaccattaatgattcttggggcttctcgtaccacgaccagaattggaaaacaccacgtaccctttatcgctataagcaacacctcaacgattttggcatcaattatctgctgaacgttggtctcgatccactgggtcgtgtaccaatgatggcagaggagaatctgctggcggctaaggctttggaagatgacgctacccggtagaaaataaaaaagactgattcagcggaatggctaacctgaatcagtctttttttgcatactatagtctattattgtattttcttaaccaaaaactgatccatcaaactatgctgcgctgtgatcagtggtccaggcaactcattgaacccaaactcctgatacacatgcactgctgtcgccagtgtgtggtaagtttcgagataaactgattgatacccgacttgctgggcatatgccagtgcatgacgcaacaagcgtttgcccagcccatggccttgaagcttgccatggacataaaacttctggagttcagccaccttgtgagcgggatcatattccgcaataccaacaccgccaagaatttgaccctcgcgttctgcaacaaagtattggcgattgggcttggcggcatagaattcgcttagatgatcaagccctgtgtcaaaatagacagtgccaggcttatctaggttggccgccttcaagcattcgcgaatcaacgcagccacctgtgcatcatcggcaggcgtgattggccgaatttcttcattgttcgttgttgtcatggacataccgcccttcagaggtttagttgaaagcatagtattttgactaaaaaatgcaagtgttagttttgaggattctgattgactctgaaaaagagatgccacatgcacctttacaatatgcgatctacacacagtttgtcacattgtcgttagttgcctgacgcgtcttttcttgtctgccagtctgtgacctccgccattcatcacaaataagcatgttgtcagtagccattgtcgaagtttttaatttcgtgctccataactgattcggaagctagcaaaaacggtaatatttttaattgcaaaatatgtcgtcacgacctatactactatgtgtcgtttcgacatatggaggtcatgatgtacgagttatcaattttaggagcactcatgtcgcgtgacatgtctggctataaactgcgtcaagttcttggcagtaatctcgttccccgccgcgagatttccaatggggtgatgtatccagtgttgcaacagttacagcacaaggggtacatcaccatgtcgttggctgaaaacagtcctcgtcatgagaaagtcgctcacattacagacattggtcagaagcatttctatgcactaatggctgctccagtaccagtggatgcaaaacgagaatcagtttacctattcaaatttcggtcgttggccgctgtcgactttgcggaacagttgcagattctaactgagtatgaaaacgtcaatgaccaagacttgaatgtgtacacgaccctacaaaaacatttgcagcaacacaccaaaccggggaaaagcgatcccgcgttgctcaagagtacgatcaacacccttgaacttaacattgcactttgccagacgaaaaaacagtgggtagcacaaacacgcactcgcattttgcaacagcaaaccactgaaggaggcatgcatcatgcctaatgcaactatgatcacgacaccgaaaagacatcagtggctggcattgaccgcaatgagcatgggtgtctttatgggattacttgacgtcactgttgtcaatgtggcgttacccacgatggttaacgacttcaacacgaacttcacgaatctccagtgggtgctcaacgcctacacgctcgtttatgccgtgtcattgttaatcatgtctaaactcggtgacatgtacgggcgcaaaaaagtattccttggttcattgattttgttcgtgctggcttcggcggttaatggtatggccagtagcctaatcgtcttggatattggtcgaggcattcaggctattggcggcgccgggatgaattcactctccatggcgctcgtcgcctcgaacttttcaggcaataaacgaggtgttgcacttggtatccttggctccgttattggtatgtccaccgcatcaggtccactgatcggcggtttcctagtcgaaaatttcgggtggccgtctattttttatatcaatgtgcctgtcggtattgtcgctgtcatcatgacactgacgtttgttaatgaaacaccaagttatggtcaacacgaacgcattgattttgctggcatgcttttttccggtctcggtcttttttctttaatttacggtttgattatcaaggagggacatccccactggtcatggatggacatccggatcggtggttggatcattgcgggtttcattttgatagcacttttcatctggaccgaaagcagagtccaacagcccatgatgagtcttaacttcttcaaacagcgtcactttgtcggcaccatatttgtggcttttgcactcggcgcaagtctttactctttcaataccttcttgacagcgttgatgcaaaactacattggctactccgcactccagaccggtgttcggcaactaacgatcagtggctggtcattagtccttggcccgataagtggttatcttggtacgcgattctcaaaaaaacgtatgatcagcgcatcattattagttggcgcatgcggttttttggtcatgttgaatgcgatgggaccacgggtcagttttatggatctgatgcctggcatgctcatgattggattcactaacgggatcgttagcccattgatcaacacggttggaatggaaggcgtcgccccgcaacaaatggggatggcttcgggcttattgaatattttccgtcaactcgggatcgtgattggcgtcgttgggtttggtttgatgcaggcaacccaatacgaaaactatctgaatacgcatatccacaccgtggggatgccgagtcaaatgacaacaggtattcacgctgccctcattaaggcaggtccattctcagggcacacaatcgcatggtcaaaacgtctaacagaaacaccattcgcccagaaattacaaagcgttgtggtgcacgcctacgacaacggcatggctgcagtattgattgcagcgcttgtcgtgatattaattggcagtttggcggccgcagtgttgatgcgaaaagaatcacatgctgacgtgcacgcataggcatcactgaccacccccgcaccagacaaaaaaataagaaaaacaaaatgggatgccggcgaatacttgccagcatcccattttgtcgcaactaacggcttgggcaatgctttttggttatccggcacacatcgtctgccccagtctatacttcagacatggagcttcacaaatgccaatgtttcccgtgaaacattgacctttgtgaattgacggactgggcatgcttgcgccagttgattattcctccgctctcatgccctcgctcctagccaatatatttttcaacaatcgtagttcatcgcgaatcggaatcccattatcagcaactgcaggaatttgtggttttacttttcgagattgatcgaccgcttcgggaaaaagctgcgtcagccgatacccgcgccgttgataaaatcctaatgcatgcagattatcgtttgttgtgattaactcaacacctgttttgtgactaagcaccgcagtcgtttcaactttttgaagtaaagcggatccaatgccttgattcgcacgcaaactgtctagagaaatgacctcaagcgtgtttcctcgatcaagataggtgatcatgcctaagatgttttgctcatcaatcgccacaaatcccgcaagttcattcagatgatacacgatcccactcagaaccatatcatcgctgccccagagctctttaaataatttagttgtcgccgatcgccatcgatcaatcggttctagtttcatgaaatccccctatcatgaacgatcaagaaatttttaattgtgtcattgatctaactagatcacagcgtataattagcgcatcaataaagtcccgatgaaatgaggaaattgctatgttaaaagatggacttgtcgtgattgatgttcagtatgggttaagcgccgcccaccattacaagcaactgttagcaaatatcaatcagcgtttagacgcttatcacgctgcagatcatccaattatttttatgcaacatactgatgagagcatgccatataacagccatgattggcaactcgatacacagctacatcgtgcaccatctgatcgggtcattctaaagtatcattctgattcctttttccaaactggtttggctgccaccttacacggcctgcacgtgcaaaccattgaagtcgccggtctgcaaacggagtactgtatcgataccgcgatccgcgtcggccatgatcttggctccaaggcggcgacgatccatggcttgaattcgacctttgatacgcccgatctttcagcacagcaaatcatcgcgcatcacgaaggtatttgggatggttcgtttgctgaagttgttcgggatgaaggagtaaagctttaaatcatcaatattctcaaaactggttgcttttaacgtaattgtcattggagaggaaactgctggtctaaaataacgggtctacactttctggtgttgagaaataatcaacactgaacgtgtaggccctttttggataacgcaaaaagacacctactcagtgtccatgctatgcttgttagcgtcgaaaccaaaagcaagcgaggttatgagtaaatgtcccaatacgatcctacactgtccgtccttggaat

SEQ ID NO: 20 - DNA, 43651 bp, Lactobacillus paracasei
cggtaaagaagcctgaatgtcgtcaatccatttctgggaaacagccactggtggcaggtctggttcagggaagtaacgataatcatcggcgccttccttaacccgcatcagaagcgtttctttagcatctggatcccagcgccgggtttcctgacgcacttcaccgccactcaaaagtacagcctgctgccgtttttcttcaaatgcgaggccatcgcgaacatgcacgaaggagttcaggttcttgatttcggtcttggtaccaaaatgttcctgtccaattggtcgcactgacaaattggtatcaacccgcatagagccttcttccatcttaacgtccgaagcccctgtgaactgaacgatttggcgcaaggtttccagataagcataagcttcttctggactggtgatatccggtttggaaacaatttcgaccagcggtgtgccttgacggttcaaatcaacataggaataaccatcgtcttcgtgctggttcttcccggcatcttcttcaacatgcagttctgcgataccaatctttttcttcttaccgtcaacttcaatttccacccagccattggtgcccaaaggcttctcactttgggtgatttgataagctttagggttgtcaggatagaaatagtttttccgatcaaaatgagtcaaacgcgtgatgtcagcatgcaatgccagccccaccatgatgccaagttgataggccccgcgattgatgctcggcaaaacgcctgggaatccccagtcaatcacgtttgtctgggtgttgggttcctgaccataagtgacaggtgatggtgagaacattttcgatttggttttcaactcaacgtggacttcaagcccgattgttgtttcaaagttcatcttacttgccccccgggatctgtgctaagtagtcgttttgtgcttcaaaagccgcagcaacttggaagatcgtgctttcgtcaaaatgtttgccgatcagctgtaagccgactggcatgccatcaacgaaaccagctggcacggatgccgccggtaagccggcaagattgaccggaattgtcaaaatgtcgttcatgtacatggtaactggatcggtgactttttcgccaattttgaacgcaacggttggggttgtcggtccaataatcagatcataatctttgaagacatcttcaaagtcacgggtaatcaaagttcgaacctgccctgcctttttgaagtatgcatcataaaagccggctgacaaactgaaggtgcccagcatgatacgtcgcttgacttctgggccaaaaccttcggatcgagaacgaacataaacatcctcaatatttttgacatccttggcgcggaaaccataacgaatgccatcaaaacgctgcagattggagctggcttcggagctggcgatgatgtagtaagatggcaccgcatattgcgtatgtggcagtgacacttctgtcaccgtcgcgcccatgtcttcgaactgcttggcagctgctttaatcttgtccgcaaccgctgggtcaacccctttgcctaagtattcctttggcaaagcgatcttcatccccttgatatcccgaccgattttggcggtaaagtccggtacgggtgtgtccgctgtggtgctatcacgttcgtcatgaccagcaatcacattcagcaactgcgcagcgtctttaacatgtcgagtcagcgttccgatctgatcaaggctggaactaaaggcaatcaaaccccagcgagaaacgcggccgtatgtcggtttgaccccgacgatgccgttaaaagcagcaggctgacgaatggaaccgcctgtatcactgcccagtgcggcaatcacttcaccagctgcgacagctgccgcggagccgcctgacgacccaccgggaacgcgcgtgtgatcccaagcgtttttagtcgttttaaaagcggagttttctgttgacgagcccattgcgaattcgtccatgttggttttaccaacgttgatcgcaccggctgcatcaagcttttgcataacggtcgcatcataaatcggattgaagttggcaagcatcttggacgctgccgtcgtgacaacgcctttggtgacaatgttgtctttaatagcaattggcacaccggctagtggttgatcgtcagcaataccggctgcatctactgcagcagccttttccttggcgccatcagcattcagtgctaagaaggcatctacttcagcatccaactggttgatgccggccaatgtctcgtcaaccaattgactgctggtcacctcgccggagcgtaactgctcatgcaattgatcgatactggttttaaagtaatccacgcgctagtcctcctctttatcgatgatcgctggaacttggatcaacgtgcccttcttggtcggcacatttttcaacaagtccgctaccggctcgcctggcttagcgacatccgctcgcatcacattttccagatgaatactctgagtagttaccggcacatcttgtgtcggaacactttctagttgttcaaccatatcgagaatctcggagagctggctggtgtatttctccagttccgtttcagaaaattgcaacttggccaatcctgccacatgcgcaacactgtctttagaaatcatgctatccccgctttcagtttcattatcattcgtagtttaccatagattcggctaataactcccgaatacatgggtataaaagcctttgtcgccagaacttcgcgatacaaaggcctgcatgccttgcgtgctctgaatcgtgatctcaatcggcacgccagaaggtaaatacttgctagcggccgttgaaatatattgcgtaaagctctgaatttcggtcaacccataaaactgtgtgttaaccgtaatgttcatgccggctagattaccaccttcataatgcgcctgtgccgtaatcccagctaaagtcgggaagaagcccttcacttggttcgtaaaattcgaaaagtcattggccacggtactgttaatcgccttatgatcgctcaccactggcaacacttcattctgttggtcaagcttcttccaatcgcctaaattggtgccggttttactggttgtctgctcggtataaacaccgccaacgagactatcttgttcagcattcttgtagataccgacaatgatcggaatattattcggcactttactcatggcgcgtaaacgagcgacgaccttggcagcgattgcttcaccttgtttcttgatcgcctcatcggaaatttcggtttgatactgggcaccgtattccgtctttgtatagtaatcaaccttattcatcccaagcgcaattgcgattccgcccagcttcatactattaccgtcttgcaccatgaaatcctgctctaaaatctgctgcaaataaatcggattgcgggtatcaggatcagttttgccattatcaaccggattaagtccgtctttgttgtccttggcttcacgtttcagccaacttttagcggttgccgtacttaacaactgaccttcttcaaaactatatttgtcagttggaaactgtgctttggctaggttttcgagaccactttccatacttttaatattgaagttgttctcgccttgatcattctgctgcagcgtcaaaccacgggcgctgctcgtctgataacgtccgtttttgataacgccttgatacatactattatcaaccgtgccggtggtttggtaactaccggtttttgttccactagtactgctgctgccactgtcaaaattcaacttgccacaggctgctaacaacaccgcagccccagccagcaaagttaacgttaaaaatttcttcattgatgttcctcaatccttcaaattcgccagcaattccgtctcattcatgattgggacattcaagctttgtgcctttgccaacttactgccagccgcgtcgccagcgatcaggaggtccgttttctttgaaactgaacctgtgaccttggctcctaatccttctagctgcttcgtgagtgctggccgcgaaaactcggcaaacttaccggtaatcacaacggttttacctgcaacaaaactatttttgaccactggtttggtcggtccggtgtaacgcaggttaacatcagcttcgcgcaactgagtgatcaacttttgaaccgttgcggctttaaaatacgtcacgatcgcttccgcaatggtcggcccgatatttggcacatctgcgatcgcctcttgactggcggtcatcagatgatccaaatcgccgaaatgctcggccagaattcgggcggctttaccgccaacgtgccgaatgcccaacccaaagattaggcgttctaccgagttttgccgactgttgttgatcgcacttaacaaattattaattgatttttctttaaacttatctaatttcgccagatccgcagctgtgaggtgatacaaatcagcgacatcttttaccagatgcttggcttgcaactgtgccacaatcttcgggcctaagccatcgatattcatcgcgttgcgagacgcaaaatgggtgagctgctcttggacctgtgccggacacatcgggttgatgcaacgcaaagctacttcatcgtcgagatggaccagtttttggccacatgacgggcaggcctctggaatcggcgccggtggcgtatccactggacgtttagcaaccagtacccgcgaaacttcaggaataatgtcgcctgctttgtgcaacatgacggtgtcgccgatgcgaatatctttatcacgaatcatatccgcgttgtgcaacgtggcccgtgccactgtggttccagcaagctgaacggggtccatcacggcagtcggcgtgaccacaccggttcgaccaactgtccagacaatgtcatgaatgacggtctctgcttcttcaggtgggaatttgtaggcaatttcccagcgtggcactttaacggtgttacctagttgcgcttgcagcgccaaatcgttcactttcaaaacgatcccatcaattccgtaaggcaacgcatcacggtcggtggtgtacttcttaatgtaggtgtcaatcgcctgcatgtcaccagccacttctgaacttggatttgttgtaaatccaagtgcctgcataaacgcaatcgcctcatgctgcgtggtcacgttaaactgctctggttcaattaacgtataaatgaaggtatccagctctcgagcagcggtgacttttgcatctaactgtcggagtgatccagctgccgcgttacgtggattggcaaaaggcgtgccgccctcagtttcctgccgcgcatttagcttggcaaacgccgccttaggcatataacattcaccccgtacctcgagtgaaagtggctgctttaactgcttgggaactgacgcaatggtcaacacatttctggtcacatcttcaccgacattaccatcaccacgtgttgagccttgaacgagtttaccgttttcataaatcagagataaagccaacccgtcgattttcaactcaacattgtaatccaccggatggccgacattgctttgcatgcgagcatcccattcactcagcccttcgaacgaaaaaacatcgcccatcgacaacatcggaattgggtgttgcaccttggcaaagtccgaattaatgacatcgccgacttcttgagttggcgaatcaggcgtgactagcttgggataagcctcctcgagtgcctgtaaatcgcgataatgatcgtcatagacgttatcggtcacagttggcgcatccttggtgtaatactcaagacgccattgattcagttgcttccgaagcttttcgacttccgcctgagcttcttcaagtgtgaattgtgcagctggttttgttaacacagcgagcctcctctaaaaatatgcatcccgacatttctgagtcaaactgcgaacgcttatgatgccactttgacaatcggagcaaaggcagctagcagtcgtttgatgccgttgtctttaaaagcaatatcgagttcttgatcatcgccggtacccgtgactttcaccacggtaccagtcccccacttgcgatgcttcaccttgtcgccagcttcccaactggttttgcctgcacctgttgttggcgcggcttgcacagtaacaggtgttgctgttttttgatcagcgtgccggctatacggggagctgaatgcgcgatcagtacgattaataaatggaatgtcactttttggctgggtattgccaatgacttccaacaagtcaggattaatttcttcaatgaaacggctagcaggattgttttgccgctgaccatacagcatccggccataggcattggacagatacagcttctgtttggcacgggtaatgccgacataagctaagcgccgttcctcttcgagctcgctttcatccatagaagcccgactcaatggaaagagtccttcttccatccccactaaaaagacaaccggaaattccagtcctttagcagcgtgcaaggtcatcaaggtaacttcttgtgcatcttcttcaacgtcatcctgatccgataacagcgccagttcagccagaaaatcaacgaaaatgtcgctgtcttcattttccggctgataccgggaatcgaatccttgggtcaccgaaagcaattcttctaagttttcgatgcgggtatcggcttccagattgtgggccgctcgcagtgttgataaatagccactatcctcaagaattgcctgcatcatctcggtcacgtttagatcttttcgccgtgtacccagctgctggatcattttaccgaacttagctaactgtccgcgagctttaccagcaatcggactgagttcagcattcgccgctgcttccagcaaggaccagtcatgctcattggcaaaggcctctaacttctcaacgcttgtgttgccaataccgcgttttggttcattgacaattcgattaaaactcatatcgtcttccggattgaccactaatcggaaatacgctagcgcatcgcgaatttccttgcgatcatagaacttatgcccgccaaccattttatatggaatattggacttcacaaacgcttcttcaatcgcccgcgactgcgcattggttcggtacaaaatcgcaaaatcaccatatttgcgatgattatcagcgatctctgcttcaattcggcgaatgacaaaaatagcttcatcagtttcgctttgagcgcggtaataggtaatcttgtcgccttcgcgattttccgtccataacgttttggcttggcgattctgattgttctgaatcacatcattggccgcactcaaaatagttttagttgaccgataattctgctcaagcaaaatgacttgcgcctttggatagtcctttttgaaatccaaaatattctgcatattggcaccacgccagccataaatgctctggtcggcatcaccaaccacacataaattatggtagccttctgccaacatatgcacgagctggtattgcgcttcgttagtgtcctgatattcgtcaacatgaatgtagcggaacttacgctggtagaatgccagtgtttctttgtctttttcaaaaagcacgatggtctgcatgatgagatcatcaaagtccaatgcctgatcactgcgcagacgcttttgatattccgcataaacctgcgccacaactttggtgaaaggactgttagcctgctcattggcataagtttgtggatccacgagttcatttttagcgctcgaaatagcacctaaaatggatttaggatcgtagcgctttggatcaagattgaaatcagccaaaatatgcttcaccagcgtcagttgctcagccggatcagcaatcgtaaaggcacggttataacccaatttgtcaatgtcgcgtcgtaaaattcggacacagagcgcatggaacgttgagacccaaatatcgcgcgcaatctcagcatcaaccaacttgccgacccgctcgcgcatctcacgggcggccttatttgtaaacgtgatggcaaggatgttccatggattgacgtgcttttcttcaactaaataagcaatccgatgagtcaatacccgtgtcttgcctgaaccggcaccagccataatcagcactggcccttcagtcgccaacaccgcctcagattgcttatcattcataccctttaatgcggcatccattaccatttaacgaatcgtcctttcagaaaaaccaagtgaaaaattccttgacctattgtaccaaattttgggagggagcgtgagcgagtggtcaatcatgacctctttaaaatcagatgtacaaggtttctcgtcctatctgacgtgagtcttcacctgtggtccgagctggctccgcggcgattgggctggaacgtggtgggcacagctttgaacccgcaaagtgcgcggtttcaaagtctggccttgttctaaaacgggaagcccacccgtttaagaacaatgtcaccactgagcccatcgccgctccgccagctctctctttctattcaaatggcagtaaaacgcattgccaccggtctctgttgtggctgtaggcaataaatcaaaggctacaattcaagcatcctcctccaccctgcctatcagttctgctacactagagaaaacaagttggaggcagcaacgattatggagacgaaatatgggcggcactctttttttgatggtggcttgttggcttatgtcggctggacgattcttggcactttgatcacgatttttacactaggcatttgttatccatgggctttgaccatgctatatggttggaaaatcaatcataccgtgattgagggtcatcggatgcacttttttgggtcggccgtgagcttgttcggcaattggattaaatggttgttgctgacaattatcacgttggggatctatggcttctgggtttttattaaattagaagattggaaagctaagaacacgcggtttgttagctgacgcatcgtgattgcattggagaaggcatgttatgaaaaagttttggttgggttttggtcttttattgctcattttagcagctggctgcggggtacaacataaagtggctaaatcgagcagttcagcggcttcgcttcgcagccgcaagtcgcctagttcgcgatcctcagctgcgattaagcagacaagcatgctcgcccggctgaaggcaaaatcacaaacgacgctcgtgtatgcaccgtttggcgacagcctctctgttggtttgtttgcggatagtaaaacaagccggtttaccaccctttttgctgaccaattacaccgtttgactgacaagaaggtgacagaggaagggattgcagaggtgggaaaaaccgcgactaatcttggtgtccctgctctgccagcgttgattgcccagcatcctgatttgattactatcgagtttgggacgaacgatgcggttggcggcgccacaccaacggcgctggctgattaccgccaggcgttgacaactatcgtggcaaccttgcagaagcaaacaacagctgagttgatccttatgacgacctggtcgccaaaccatggtccttatgccgccgccgatttgcaatttgatgctgtggtcaaacaaatcggtcaaacttatcacgttccagttgccgatctggcgaccatctggcaaaaccatgatgacgtcacaggccctgccggtacagccatcaccgacttcgctggtaacggtccgcgcgatacttttcaccctaaccagcgcggtcatgatcagattgctgccttgctcaagaaaactttggaggaataacttatgcaagatgttttaaaattttgtcccaactgcggtcaaccaattaaaccaactgacgacttttgtcctaactgcgggtttgatttgcggaaagcccgacttgaagcccaatcaacccaagaaccagcatcaacgtcccctgccgaggcaccaaaagcaactcagtctgcgacagttgctgcttcaacccagccagcgcagcaacaagtacataaacgccggcgctggccatggatcgttgttggtgcggttgtcgttcttttaggtgcggcctatctcggcggatcaatgtactatggtcaaaatcgacaagtcgctgagttggctgatgaaatgactagtggagatgccgatgatatggctgaagttgccattgcaaacgatggcacaccattgaccgaaagtgatcttaagccgctcgcccgtttgactaagaatcggctttatcgcagcaccttgcgaaccatgatcatggacaagcaaaccaatggcatggttcaggtcgtcaaacaaggcagttacctgctgcttttcccgaaatacaaggttaagcttggtaccgccaacgtcacagtcaaaaccaaccttgacgccgctgctttcaccatggatggcaatcaaattcaacctgaaaatcgttctggcagttataccattgccagtcaattacctggtctgtacgccctcaagctgagcggtacgcacgaaggaagtacgaaagacttcaatcgtgaagtcatcgtcccgcttaaagggcaaccggaggcactgaccttggatgccgcaaccgctgctaagacagttacaccaacgcatgacgccacaagcggttcttcagcatctgaatctcatgatgatgacgacgatgatgattatgatgacaatggtgtgaccaaaacgaaccgccagtatccttctgatgcttcaaagcgcaatgataatcattcaacggatggcgtcgtcggtcgctgggaatcaggcgacactgccactttcaacttcaacagtgacggtacttatacggcgaccagcaatggcacgccaacaaatggcaagtgggaagttgtttatcgcgatggcaacatcttgaatatcaagttcaccaaagatgatggcagcagtgtcgtcgaacctttcgcattggacgatggtgatttgattgaaactaatctgaagattaagtgggatcgagactaatgctcgactgaggtgaacacccctttgttcagaaataagactggtgcttgctgccttattttctcccaattcccacatctaatggtgttatactacatgctgtcatgtgtttttagttgttaggaggtcgttgctatgttacattctgaaaaatggcggccattgatggtcaccttgatcgtgatcgcggcaatttttgcagccttctttgtcctagaggccttcagtggcatgggaatgggcttcttccacagcaatatgatgtccaacgtctcttcatggggcagtcatatcggcggttgcatgcgctaaccgaaacaattgcttaacgtcgattcaatcaaaccgttgcgttttttgacgcagcggtttttttctgggctgaaatcacgttatgcttgcttatacaaacgtatgttcgtataataattgcagaggtgattttgatggcctacgattattcccacgaaccgcatcgaacggttttcctgattgacaataaatccttttacgcttcagttgaaagcattgaacgcgggctgaatcctttaagaacccttctcgtggtcatgtccgaacaagagaatacaaatggcggcctcatcttggcaacttcgccaatggccaaaaaaatatatggccttaaaagtaacgttagccgtcaacgggacttacctgtggataagcatctgatcgtggtgccgccacgcatgaatctttacatcaaaaagaatctggccatcaatgatatttttcgtgagtttgttgccaatgaagacttgtggccttattccattgatgaatccattctcgatttaacgcacacatggcgactctttggcaaaacaccacgtgcagttgcgcaattaattcaacatactattcggcatcgacttggtctctacacaacagtcgggatcggtgacaatccgcttcaagccaaaattgcgctggatgtttatgcgaaacatgatcctaatttaattggtcaaatctcctatcaaactgtaccagataccatttggcagatcaccaatatgacagacgtttggagtatcggtcaacgaacagcagcgcatctcgcacgtatgggcatcacgacaatgaaacaacttgctcacgcaaatccgtatgccttaaagcaagaactgggcatcattggcacgcagttatttgcgctagcatggggcattgaccgcacaaaaatcagcgaacgcgtcatcacccgcgaaccaagcattggcaactcacaggttctgccgcgcgattatagcaatcaagttgaaatcgaaatcgttattaaagaaatcggcgaacaggttgccgcacggttgcggcatcatcacaaacgagctggtgaaatttccctaggtatcggcttttcctatgctgaaagtgaaaaagacggacgcggcgggtttcaccaaactaagcgaattttaccgacgaatcgggacggcgatcttgttgccacactgcaactgatttttcggcaaaactggcatggtgaggtcattcgtaacgttgccgtttataccggccgcttagccccagataccggcgaacaactcaatttctttgagccagttgatcaacaaattaaagcaactaatttagaacgcacgctagatactattcgcgatcgttttggctttaagggcttgatctacgctaaaagtgcgatgcatggcggaacggcgattcaacgggcatcactagtaggaggacataatggcggcaatagctatgactaaagatttgaagctaatgatggcgcgattaaccccccttttcaaacgacgccgtcaaacacgttactggctatcactggtcaatcaaacctatacaccggcatacaattttttcatgaacgttcaacctaaggatcagcgccaacgttccattcccttacacagcctgatcaactatgacctggcagacttagaaaccttcattggcctgcttcgtcagcacacgcaactcacgattgaatatgtcggctttgaagagatccgctggcctgaatcaaatcgggtgattcaatggcggccgcggcgtgatgaataaacgcgtcaatttcaaaaagtagccaagaaaaaagagcgctggcacagcactcttgcggatggtattttaaattcattttgttaatacgcaattgagtaggaatgccgctcatcaaccacaaaggactccgccatttcagggccgtgctgagcaagaatctgatcagcaagatacgcctgcaagtcttcgtggaagtaagtctcaaacccaaacccccaggctgataaaagatgccgcccgcgccgtcgacccgcacggaaattttcataaatcgcgtggtaaatcgtccgtcccgtcaacttgaccgtcaccggcaataccacccgttcaccatgatgttgaaaacgaacattcactgttcggaaagtcataaagcgaatcaccagcaataagcatggaatcatgatactgagacccaccaaggccacaaaaatgataccgagtaccagcccaacagcgctaattgccatggcaccagaaacgaccacgctcaacccaatgacaaacaaaatcaacagtagcgcgggaaataaaatcacaccggtcactaagacccagagtaatagtttaaatgctattttcatacagcctccaaataatcatggcgctcattcaacagaaaccagatgcacatcactgacaccgcgaatgtcgccaagtttggttacaagatcatctaacgttccctgcagtgccgaaatatcaaatgacatcacaacactagcccaattatggatcggaatattttggttgatggtcacgatactagcttgcgcttgcgacatggttgtcagaacttctgataaaatgccgcgatcgtgatgcaacatcaacgagatgaccgctttacgcgatgccatttctgggtcgggtaaaaaaacataatctttgtatttataataggttccacgggaaatgccgacctgtttgacggcctcgctcacctgcttaacctcgccattttggagaagtgcgcgcgccgctatgactttaccgacgacttccggaagcatcgaactgtcaacaatataaaactgcttcacgctaaaacctccaaaacgattgactaaaactaaatgtccttgaataatagacattcattcagatatgttcatattgtaacagtgattgtcatttctgcaaacccactgtcaacttgtaaaaggtttgcaataaaaaaagtcaagcaaaaagaccgtttttacggtcttttaaaaaaatagcagcgtttttgaccagatggatgatgacattttgatgagcctgaaagcgtttaagtgaagtgcctttaatcttgatcgtttttgcggtaggctaagactgtcattgcggggagtattagttaattcatacaaagcgtgcgcggacacgtttagaaacctgaacatccgtgacttgaagcttaaatgaatgggtctttgaccagttgggtttcaaatgtttatggacaggtttctgcgcctgcgaacgcatttataagggggccttcacatgaaggtacagcatacatatcatccacatcatttctcatggcattttgtggtagtcgcggtcatcgttggctttgtcgtcttcattgaatgctggccgcatgttagcgacaatacactcatgggaagtgctttagtcactggcggtctgtgtattgggtcaatccgcatggctcatcatcacgacaaggatcaagaaaaacaaaaataattaaaaaatgagtcgcgttttgaacaacgcggctcattttttaatgtggtggtctcaatgattaattcgctatctgggtcaaaaaaggtgctggataattgaccttgccgcgaacacttgccaaaacaccaggcacaagttctttaatcaaatggtcttcagtgacgactgggaaaggcggatcgagtttgtacttggctgctttttgaaagccaagtcggccaaagaattgtcgatcgccgacaacactgacaaaatcacgccgcaaatcagttgctcgcatgtcgagttcagtcacaatcgcgaccccaatgccaccgccttgatattcaggggcaactgctaacggtgccagcgccaccccttgcatatgggcatctggcgtaatgctggccgcggtcattagcccgtagccgaccaaatgaccgtccatcatcgccacaacttcaagggctgaatcataattaggatcacgccgcagtccggcaactagctctgcctcaccgttataaccgcgattgctggcattgaatgctgcatgtaacaaggcatctacatcagcaaaatcattttgttgtattcgtcgaatggtcatatgcgtctccttttagtttattaattctattatacacgtttccatgcaaagccgtcgttgtgaggatttggacgcaacccagtagccaaaattgttatataattttgggtaagcagctactgcattgtaaaagccctgccagccatcacacgcggcaaaacttttgcttaacaaaatcaggcaattcacgtgagcgtgatgatcatttcgaacggtcctaatggcctttttctggtgtatcttgacgctgcttgaacttgtctcttcttcatgatgaggtctgctgatcggctcctggctgcttttgcttaggcgctgtcgcttcatctgggaaggtcaacgtaaaggttgtacctttgcctagggtcgaatcaacatgaatggtgccaccgtgttgtcccattaactgatgcacaatcgccatgcccaaaccggactcaccatatttggtgtttttacgtgatggatcggccttgtaataccgctcccaaatattcttcatctgatccttggacataccaataccagtatcgctaatggcaaattcagtctgatgataccccacttttgcttttatggtgatttgaccatttttagtgaattggaccgcattttgaacaatgttgaaaagaatctgaacgaaccgatcatgatcagcatatgtcggcagatctgctggggcatcaattgtgatcttatcaccagcctcttcggatttctgcgccagctgttccgcgatgttatcaagatccgtgcgcgcgttaaacgtctgtttgctgagcaaaatttgatttgtccgaattttttcataatcaaggttctcgttgacaagccgaatcaagcggttcgtttcgttccgcattaattcgatactctttcccttactttcttcagggatggcatcataggccaagccttcaagtaagccattgattgttgtcagcggggtccgcatttcatgagccgcatcagccataaactgccggcgccgatcttcctgccgttgaatttcttgctgactagctttcagtgaggtcaccatgtcgcgaaaatcatcggccagttccgcaacttcatcatgactgcggcttttaatttttacttcaacatcataattgccttctgccacttgatgcgttgcgcgtcgtaattgattaatccgccgtacctgataggacgcaatgaaataactgatgatgaacgccgcaagcgttgacagtacgaacgcgataagcaaattatgctcagttttgctaattgaactttgaatttgctcaactggcgcaaaggcggcaatcacaaagagtaatttttcactcagaaaaaccggttgataataaatcgtcatgctttgtgcatggccgctgattggattcgtcatcatctccgggacggcaacagccgccccttgctttagctttttccaatagcttgccttgatcgctggcatctgacctttttgggacacaggatatttagcaacgttattggcatcataaataacaaaatgcacgtgttgatcgcttaaaatctcttcagcattttgaataaatctggcattgatgacgtaggtattttcatcaaccgcattattttttaaaacatccgtgtattgctctaactgtttaaagccattttcccaaaccgtgttcgtggtagaccgaataaacagaatcgagacaatcactaaggtcaccataatgaccgagaaaaagccaatcagctgctggtagagcattttcatcgatcaagccccgaatcatcaaacttgtagccgacaccccaaacagtttgaataatttgcggaccgactttttcgactttttggcgtagttttttaatatgggcatctacagttcgttcgtcaccgtaatactcataatcccaaaccaattgcagtaattgttcacgtgagaaaacctgcttcggacttttcgacaaggtatgcagtaaatcaaattcctttggtgttaagccttcaatttgcttaccatccaaataagcttcacgtgttttggtactgagcttgaagtgatcagtttcaacatcaaaaccgtcaggcggctcgcttgttgtctgctcagcacccacttcggcgcctacctcagcccgacgatgtagggccttgatacgtgcaatcaacgtaatcggtgaaaatggcttggtaacatagtcgtcggcaccaagttccagtcccaacacttgatcactttcagtatcgcgcgctgtgagcataatcaacggcacagtttgactgattttacgaatttcttttgcgacctgcatgccgtccatttttggcagattgaggtcaagcgtaataatatcaaagctgtccggtgcttccttaaacttagcaagaccttcttcaccatcataggcgttgacgacttcccatttctctttttgaaagaacatcgccatcatttcggcgacactcgtgttatcttcgatcattaataatttcatgatgtacccctcatttcacagatctttaaagccttttttgcgttgcggtttcggtgcatcgtctggtgacacatagtcataaggcagtgcatcatgggcttgcaaataatgctttaaccgcgtctcggtatagacaaatcctggcagaaacaacaggacggccaaaaatagccaaacaataaagaaattgtcccatgccagaaaatggatcaaccagcccgcaccggcttcaagtgcgcctgtgatgatcaatgcttggcaaaaccaacgttgtgccaagcgaaaactttcggcattcaccccggcaagataggacgtgtagccccaaaaaccagattgatgacgcggtcgaaaaacagcaagaaggatgcccatcagtaattgcatgcatccggcaataagtagaatcatagacatgcctccataaaaatagcttaaatccgaatttgatgccagtctaataccaaacattttgacaagcttaattataccgtggtatcataacgtttgcaccttaatcgggggtgtaatggtctcgacattgcttttcgcacatgcagtgcacctcggaggctcggctccgtcatcaacggaacagttaatataactgcaaagaacgaaaattcttacgctttagctgcttaataaccagctagcgtgatccttccgacttcgctcaagggtcgggtctgggtctcaaattattgagctacggttaatgttgccacctgaggcattaacaagagactagtaggttagccgccttgtgttagccttgccggctggcgcgacatcgcggcgaattttaaataagtcagctataggtgtagagctgcatgtagcaggggtgatggacaggagttcgattctcctcacctccattatgacattttcccttacttctagttagtcctaaaatgctggtacatcagcgttttggggctttttattttgggttgtttggaaaatgtgtccttgtcgtcacctagcagacaaaagcttaccttccgtaagtaaatatttgctacaatagtgccgtgagtctgaaaatgacaagtaggaggaaaatcatgaacgacaaagtaaaagcacttctcagcattttagaatctgctgggttttcgcacgacgatctagcaggtactgttgccgaactgaatgacgccgttaacgatggcaaatcaacgtccattcaattggtcagtcccggcgcagctgcgcgttacattaaacggattaatgacgaaactgtttttactgcacgctttcgtcatagcgatgaaccagatttattgaacaatgaatcgaacgatgaacggattgagaatcctaatcaagattcatgcattgttgttagttacgatcctgccaaacaatagaaaggtgttaatctcttgagcaaaattttttctcgatctgttggtgttgtgacacttgtcgctggtgctgttggcatcgttgccggtaccatgagcttggttactggtattttgctggtaagcaagcatcgtgactaaaaagggacaaacaagtccgatagatgagctgcaagtcaagaactgatacttgcaactcgtttatcgggctttttttactcatattcctgatctgaacagccattgtcaaaccaaagctgttcggcagcacttttaatgggcaactgtttgtttgtcggcatcggtctgctggctttcaatgtgatccaaacttgccacactatcaaaggtcaacagtgccgattgatagtcaccgattaactgagcctgtgcgcgattggcaccattgaattggactggtaagcgcacaccaacgcgctggaggacatcccccgaaattgggcctgtgtgctgattgacccaatacggtgtgtcagattttgccaatggcaccttcatatactgcacggtgcgactgtctgcatcagccaagactcggaaaaagccaagaacaaggtgcttgcgatcatgagcgctgagcaaccacgccacctgattctgcccattggactgtcgcggtaacaataggctaaagtcacctttcagtactagcggttgtaaggcgtggtaataggcaatttgagccttgatcgtagccaatgttcgcgcatcaagtttggtcagatccagttcataaccaagaatcccaaaggccgccacccgaaaccgcgtgaccagtggcgttgatcgaccaacctgttcattcggcacggctgtcacatgattgctcatgcagctcaatggataggccaaagccgtgcctgattgaatggccaagcgttcgatcgcatcggaatcatcactggtccaaatttgcggactgtagaacagaatgcccagatcaaagcggccaccaccgccggcacacccttcaatcaataaatgcgggaatgccgtcagcagcttctgatagagcgtgtacacgccttgtacgtaacgatggaagaactcgccttgcggatgaccgatcttttcgagatacggtgaaaaggcctctgtaatgctgcgattaagatcccacttcacataatccaagttggtttcagtgatgaccttttgcatctgttcaaaaatattgttgacgacagccgggttgctgaagtctaacacatattgattacgcgtgatcgagatacgacccttttttggtcgaacgacccaattcggatgggcttggaagaattgagatcgcggtgaaaccatctcgggttcaaaccaaaggccaaactgcaggcccatcgcatgaatttcctgagcaaaatggccgagaccgtcgggaaatttatgcttattagtaaaccaatcacccaaggaactcaaatcattgtcgcgcgtcccaaaccaaccatcatccagcacaaagcagtccacaccgacctgcttgccgagtgccgctagcttgagcaacttcttctcattcaaatcaaagtaagtcgcttcccagctgtttaagacgactgggcgctgcttttgacgccattgcggatcaataatatggcgagcaacaaagcgttgattggcctgagctaagccggcaagaccaccagagctataactaaacacggtttctggcgtggtaaaactggtttttggatccaaccgccaactaaacgatgcgggatgaatgccagttagcaatcgagtctgatcccattcgttgacctcggtgctgtccagaaagttgcccgaataaatcaagtttgccccataggtatcgcctgctgcaaacggctgtcccgctgtatgtaaggccacaaaaggattctgttcatgactggaggcaccacggagcgattcaactgaaaatgttccctgagttaacggttgcgtttgaatatgacgctccttcgcccaattaccagataaatgaacaacgtcataccgtccttgcggcaagttcaaaacgccactcagcatgcgttgaatcatcactggtgctgtcccttgattggttagtgtggcggaacgaacaattgccgcactgtcggcaaaaatcgtatattgcaacgttaacaacaattgggccgttttatcttcaagatgaatcgtcagcacatcggtcaatgccggattgccgaaactcgtcggatggtgcaagtcccgcgttttcgtatgtgtcaattgatcatctttaaaaacaaagttcggataaattggcatatcatcttgagtcacactcaggctgccttggcgaaaatcaccagtgccgtaaacgggatactcctgttgtgcatcacccaaggcaaattcctgatcgtccgaaaaattggccatccacgcaaacggacttgggccttgagacaaataggctaagtcgttcttagttaatgacaagcgcggaccaaaataaagatgcccgagctgaccattcggcagcaaagcgcaaatataactgatttgatcgttgtgaagatgaaaagcttgattatttataacatctatcaaagcgtagcctccttcaaatataacctcttacttccgttatagcataacaagcaagttggtgaaggacctgtgcgccactgtcaattgatcactatgaaggttacggttggcattcaccgcagcataccaagtggcaccgagacatttactgtcactttggcctcggttatttagtcgatccgttcatgctcaaaaaaatcggcacttggcggactgattgtccaacaagtgccgagcacattttctttttaaatgaaataaaaatatttcttgctagttactgcgggtcccaaccagctatatcctggtcgctgaatgcataagtcagcggcttgccataagcagcttcataagcctgccgcttttgagcatagtcgcgttgcatcatttgaaaactgttgtctctgacggataagttgcgatccgggtagatcggatcaagtacatgcaggacataactgacctcgcgtaattgatcattctcacgcgccttcaaatcacgaatctcagtgaaacacgagataatgggcaccccggcctcagccgcataaaaatatgatccgcgcttgggtggccgcggcttgcgataattgaaccacatttcttgctctgggtaaattaacacccaatgatgtccagaaaaggccttcgttagcatttgcataaatggtccgttaagaaaacttggacgaccggatagtggaatcgtatcgtcataattcatgacaaatcccagcaaccccttcatggccaagttggtgtcttgactcacgatatacatccggtggcggccagctaaacggacagctttgcgaatcgccatattttcaaacggactaaagtggttgctcgtgatgacaccaccacttttaatcgcccgaatcttttcaaccccaacgacttcaacatcgctggtgaccctcactgcataggcattcaccagcaatcggcaaatcaaagttttcactcggaatgtccagcgttgccgctgatgtaaataatgatcaataatagctgtttcttgtgcttccgagaaagtcgggtcgtgttcttccaccttaacgttgaatgccttagccgccaccgcgcgacgaatattttcgatcaccgcggctcggtctggtccaacaaacttgccggatttcatagcgccacctgttcgccatgcttgattgcgttcaagatcgtgttatcggtatggcaaacttgaacggcggtttttagcatcgccgccatgctgtcccgatccgattgttgatcagccggcgtaaacgccgccaactgctgcttcaaatccgtttcaaaaccagatgctggcgcataatgccaaaagtttgccgctaacttagcatcgcggtaatgccatggcttgccaaaaagattgtagtgaattaacttgccgcctgattcagcagcagtcgggacacctgtttgcatattccaagtttttggcaggtacttgattcgatgctgtgcgatcacattgatgtaatcttgatccgcagcaatcattgtaaaatgatacgtttttagcaaatgcagaaaccggtcggagaaatgttcctgccgcatctgggcgagattcaaaatcaataccccggaattgatgtattcacctggttgaacaccaaaatcacgctgaatgtattcaatggtttccgggtatgtcatcatcaccggatctgcaacaccagcgactaaattatcgcctaggtcagtcgtaaacaattctgccaaatcaccatcggcaaccgtatcggcatcaatataaattgctttatcatattgcgggaacatgtcagcaatgaatagccggaaataaatcgtcaacgtcacataatcgccgcgcagtttatttgtgtcgccactaatctgctgcgtgaccgcgtccatgtcgataaaattaatcgtaaaatgcggcgctgctaaagccgcaagccgcgtctgattcttttgaagtaaaccactgttaagaatgttgataacgaaatcagtttgcggatctttattcgttcgaatagatgtcaaagcaacagccagacacggtacgtaaccgtcatcgacagaaaagaaaatgggaaccgtagtttgttgaggcatttaagacacttctttcaattttggggccaactgacgataatcgtttaatagatcatcatattcatgaaggccaagttgttgatgaacagcactgatttgccatggcttgaccgtcacaatacgaaaccgcggccagaaacggaatgaggtggtgaaatgttggaagacagtatccgtttcgactttatgttgttcattatacttccgcggcaaaatctgctttgactttgcaatgatgttcagtgcactttgatctggcataaacagccaacgatggcggatcaggcgccgacagcgaaccagcaagccatcttgccgaatgctagcaaggttcatcagcaaaaccccggaattaatataatcaaaccaggttaatttatgatggaaccaccatttgccataatgatccaatacaccagcaatatcgacgtctttcattggttcttgatacaggttgctaaacgatcgacggcacacaatatcagtatcaagatacaacacacgatctggcaactcaggaatcaaatcagcatacaaacgcaacatgcaataaggggtaaacatcgtggtcatgtttgcttgcggcggattagccataaataaatcagtgatgtcaatccgcgtcaagcggtgctgcggattctcctgccgcatcaagtcagccatgcgctcagccgtcaccgcagagaatggctggtaagcatggccattgacgtttagcttggcggttaacacataaatatgcaatggttgatcggtatgccgcatcaatgacaaggtagcaatcaaaacgccatccgtcatcttctcatcaccgcaaaacatgatgttcatcgtcatgaatccgcctcctctcgctgctgatagtgaatatacgttgccgtactcaaggcggcgcgagtagtcatcgccgttcgaacttgcgcctctaactgctgctgacgcgctttgagcggtaactgttcatctggccaaaaagggccgtcgacatacaagatccggcgtggcttttgccgccaccgccgggcttgataagtcattgtggttgcaaatactggtgcattggttgtcaccggataatgaaaagcaccattttcaaacggccgaatgccggtatagtaaggccagacatgggcttcaggataaatcatgaccacatgtcgttgtttgataacgcgccgaatggcttgagcaaacgggcgcaattgatgtaacttgcttggcaccagcaaaccgccaccataaggcacgattcgtcctagaattggcacgctgagattagccggtgatgccaacgtaaaaacccggcgcgactgattcacgcgcatgggtgtgaaaacatccccaaaaggctgagtgtgattaccataaacaaaataaccgcgcccggcagcctggcgaagggccttgcgattgcgaacatgtaagacactgcggcaatacccttgggcaaaaagccaagaacccgcataaaccaaatttgctttgatccggaaccgccatgaaggctcccagcgataattatccgggatctcggtttcttgatcaggtgcagcaacaacatcgtctgtcaagtggcgatatgtcacgacttttgccattgtcgacccctctctctataaaccgccatcatgatgacggatgcgtgttgatctatgaaccatcaatagcataacgcgttgctaaagttagtcaaccctaaaataaataattttgagtgaacactcaaaattattttcacttttatatgagtcctcaagtatcttttccgttattgaagcgagtgctcactcaatcagattaaataccgtcttttgttttgtcttcgtgagctttatgatcagcgtgcaatcggcgcaaggtgaataacgttgcaatccagataaccgcaaagatcaatgcggacagcattgcccgatcaaaaatcataatcacagcagtcagccctaaaaacgccaaaataagataatttgaataaggataaaatggcattggaaaatccgttccgcgcggatgttgtttcttatagcgcaagtgagcgaggacaatcatgccccaaacaaataaaaagctgattgtagcaacacttgaaaccagtgcgaaaacagactccggtaaaaaaaggttcaaaatgacagccacagcaatggctcctgttgaaatcataatggcccgcgctggcacttgtcgccgagacagtttagcagtccaacgcgcggacttgcttttaccagttaatgtcagtgagaagagtaatctgccagtgctgaaaatagatgaattgcaggcagatgctgccgctgtcaacaccacaaaattaataatgtcggcggctgctggaatcccgacattacgaaaaacctcgacaaaaggactattaaccggtgacacatcgcgccatgggtagatgcacataatgacaaacaatgcgccaatgtaaaacagtaaaatccgcatcggaatctcattgatcgcttctggaatcactttatgcggatctttggtttcactagcagtcaacccgaccatttcgatcccgacgaaactaaacaccaccatttgcagcgacattagaaaaccgctcattccttttggaaaaaagccgccgtcattaacgaggttgcttaggctggcatagccaacaggcgttttatagtgcacaaacagcataaagacgccgagcgcaattaacccaataatggccacgatcttaatcaaggcaaaccagaactccgcctcaccaaacagcccaacgctaaccagattcattagcagcaacactgccagtgcaatcaggcccggcagccattgaggaactcctggcaaccagaatcgaatgtagagaccgatcgctgtcacttcggccatggcgaccgccacccaacaaatccagtaggtccagccagtcacccaaccagcatcttttcccatatatttgctaataaaatcaataaacgtatgtgaattcacatcggacattagcagttcacccaatgcccgcataattagaaaacaaatcccacctgtgatgagataagctagtaagatggaaggcccagcggtgtggatggattgaccagatcctagaaaaaggcctgtcccaatcgttccaccaatcgcaatcagttgcacgtgtcggcttttcaagtgacgcgctagttcgggcttgtcatctttcttggcttgcatgctcatcctcctataaacgtgttaacccgaaaaaaatcaggacataacaggttctgtctttgcaaatgcagaaatatcccagctctttgaatcgtatcagaaaaattatacaccattttcagaaaacgcccaactgatcaccctgtcacgatttgaatctgttctggtggcattttatcgaccaaaaagctttgtagatctgttggcgactggcgaaactgcagttttaaaaccgtcacttgaccggcttgcgccaatagcagcgtccccccagcatttgcctgtaaaacaacgccagaaagattctgatacaatcgaatgctaccaagcccgccaatcatcgcagcatcagcaagacccttctgccagcaggcaaaacagataaacataacgacaataaaggcgccgctgacaagatcgtcaaaatgttgactttgctgcaaggtcaacaccagagaaaaggctgccaccgcaagatacaaaagaatacgccagacttttggttgcgcatgtatccgaacttgaatgatatcaaagatggtcacaccgactgaaataattgcaatcagcaggtaggccacgcttaataatgacatattaattctccttaagtttgataacccattctaaccgattccagtttaaaaaggcagtggcgaccggatcagtaaagtctattctaacgtcctaaatcctgtgacagcagccataccaccttgctatcacaagatgaaaagtgttttgaaatgacaaaaaaagctgacaagacaagcgtttgtcagctctcctttttggttacttaaaaatcaatcaatcacgcaatattagcagctgcccaatccttcactttgtcaataaacgcggcaaaagcatcgcggtcatttagatctggaaattggcctaacaagatctgcttagcacgcttgacatccgaactcggtttctgtaaaatcagcaggctcttctccgccttttggtcagcaaagaaatcttccggcaaattcaataacccttggaagtaggtcgacttcgccagccaagctgtcagtcccgccgcttcttcagaacggaaaacctgactcggcacataaaataaacccaatcctcctggcttcaagacccgcatactttgctcgattaacaaatgatgcgcataagaatgtcccttggccgccgcggtctcaaattgcttggcgcgttcgtcaaccgggtagtaaccaactggcaaatcagaaacaacaacatcgatgtctttaaacaaaagattatctaaggcatcctgatgaaaaagatcaacatctaattgttgcaacgtactgctcatgcctgcaactgctaataaggtttcgtcattatcaatgccgtagcctttgactgccacctgacgcgcattgtggagctgattcatcacagcaaataaaagattccccgtcccaacggccagatcggcgacttgcatcttttttggcagatgttgcgcaaaaaccgtcaccataaatgtcgcaagactggccatggcatcaggcgtgacttgcttattgggttcaatgccatctaccttgattgccttaacaagcactaattgaatggcttgacgaatctcttccggctcataggtggcgagtttgatctgatcaaacaacgctgttagcttctttttagcttcatcgttgggaacaccatcttcttgcatgacgttgcccgacgcaagatcctctcccgcctcaataacagcagcaataaaagatgttttcaattgttgatgcaaaattgtcgtgctttcatccaaaacattgtacagcttctctagatgttcgtgggccaagatgcttccccctatcaatacggtttcaggcctaaaaaacgatgcgtgcaggtgctggtcatcgccgacactccgcttaccagtgtaccgattgagaaaagcttattcaagcgcgtgaatccctgatctagttgcctcaagctgttccttagtcgcttctttggtctcaccaatcgctggcggcgctgatcgaatagctgatgtatcagattccttgccagctgaagtcgaggaatcagcctcgcttttcgatttatcagacatctgttctcgccaatggttgtatgcctccgtaaattggcgcttttctacctgttcaagcacctgataactttcctgccagtcacgaaaacgttgcatcgcgccaacagtcagcattagaagtaaagcaaacagtatcagtgtgttgatcaaaacactaccgcgtatcttcatcgatttgcaccccaccgtcaatcttctgcgaagtcgtcaaatacagacgatagcgaaagccttgagctaccttgctaaaattgaccccggttagatgcgtaaataatggcatatgcccattttcagatcccatcacacgaaccataccgcgaaaatgtttggtctgataaaaattgatcgtgtaagctttctcgggacttctcacccttaccgacattaaggccacagaccgcaactttttatctcgtacaaacatttgcaagtcatgctctgcttgcaatgacgtgattagtacatggtcttgaagcgtgaaccgcgtgacatgcaataaaaccggtcgccataacagcatgaccgccgcaagtaaaatcaggctgaccaccacttcaattaaagtaaagcctttaaggcgtgaacgtatatgttgatcgacccttttgggcatgcgcctttacctcctgcgtattgacggttacttgccacacatcaggtccgacttgaaccgtcgtctctccgcctggtactggcaaatgaacaagcgccacccgtgccgcataataggccgtcgttcgctgtctggattcaaccacaactcggtcatataaccgcactaacaccattaaccaaccaaccgccagcaagagcacccccagagctgcaagatgttcaattaacaaagaacctgttaatgttttggtactttttggaataagaaccgcccccattcaaactgtagggttatatgccagtaatagccgtcttgactgagaaaatttacgctgcggttgcctttcaatttacctgatggttctctcgtcgtttttgtaggaattttatcgtcatatttcaaggatggcggaaatggcaaaattcgttttgaaccattaaaaagactaaatgtcacctgacgtgcctcatcattgacagacatggtgccaattttatgcgtggcatatgccttcatccctaataattcccattgttcccgcatggtttcgagaaacttggtttcctgatttcggcgaatcacgctttgccctaagggaacggccgccagtgtcaatcctgccagcacaaccacaacagccaccacttcaagcatcacaaagccacgcagccgtttcatggaactttaaatttcggcggattgtcaccgctcatcgtcgccttgcctttttccaagtccttcgcctgcgcatcggtaatcacgccttctctgactaaatcaggaattgttttaagtgattttttgtcagcatccggctcgttataggccatttcaatttgtgaattcacagttgccaccgtagcttttagattctgactttcaacacgtttcatttgcccttggattgtcaaaaccaaagctaacgtcaataaaataatgaccccaagtgctgcaatcacttcaatcaatgtaaaagcccgtaatcgtttgcgtcgcatggtcatcccccgaaagattgatagagtggtaagagaatttgcaaataaaccagtaaaatttcgccaccaataagcaaaaacagcaatggctgtaccaagttcaccagtcgttctaaacgttgctgcaactgtaaaaatagttgttcaccaaaaagttttaagccggtcgccactaagtgatgtgtctggcccattgtcaataaacgggcaacttcaggtggcacaaaggcttcgtgtaacgcatcggccaactcagccccttgttgaatcttttgttgaatgcgtgctcctaaatcacccaacggaccgccaacggttatcaagtgtcggcaaaagtcggcaatctcagcacctgccagtaagaagtgggcggctccggctgtgaactgaaactgatagtacacttgcatgacgccacggacaccaggtaatcgttgtaagagttgcaagcgttgagccaacgtcagtcgatgccacccgagccatattagcaacccggcggctaagcccccacccatggtcattaactgcgtatgcactaaatgcgattgtggtaacgccaaggctggcaacacgccaaacacaacgaccacttgcaaggtaacaagcatacccagtaacacaagtgggtaaattaacagttgaccaatccgctgacgattccgcactcgcaagcctaagtaatcaccagccacggccaatgcttttgccaaatccccatgaacctgtgctagttgcagttgttgaaagaggatgggagccaatgcctgatggccaactgcttctggcaatccgatgccagaagccaaatccgtttcgattcgttcccaaattggccggtatttcggtaaactcacacgcaaataagcaaacacatccggcaaactaaaaccagcagcaattaacgcagcgctttgacggcaaaaccgttcctgaatcaccagcggcatgctcacgaaaccacctcctgatcagcttgtcctacttgcttgaaaaccacgacttccgccactgggtgaatcattggccgatactgcaaactgatcgccgcactcgccgtcaatgccgccgctactaactcatccggcaagccaaaactgctcagccttaatggtgtatccgccgctgatcgggcatgcacggtcgctaggacaatatgaccgctaatcgccgcttcgcaagcactttgcgctgtttgtcgatcacgaatttctccaatcagcaagacgtctggtcgatggcgcagcgccgccttcagtaattgcggataggtcatgtctgcctccggattgacttgcaactgtaagaattgcggctgattgatctcaactggatcctcgatcgacaagaccattcgtgattccgccaaacgcgtcgctaactgatagagtaatgtcgtttttcctgacccagtcggcccagctagggtcagcatgccgcgtttctgcagtaaaatacccaacagacgatctaacagatgacgcgcgcctgcagcatctggaatgcctttgattatgcgaactaccagtgattcaccaccgcgaaagtcagccactgaacttaaccgtaaaaaagctgctgattccttttgataaaaggctcccaattgaacgcggcgatgttcggcaacattcatgcccgccataaatttcaagtaattaatttcttgctgcccacgtttgctgtctcgctcggcgattgttaccaagcccgtcggtacccgtaggcgaatcaaataaccttgcggactaggcaaatagtaaatatcgctagcacccttttccagcgcaattgtcaaaagctcattcaccgattgcatcgtttttccccctgtattaaaagagttcgcgagcgtcatatatcaccccgtcctctttactattttgggcaaaaaaagacgaggattttccctcgtcttgatcactagctatcaatcaatgcattaatcgtctggccagtcgccggctgtgtaaacttcctgcacatcatcgtcgtcttccaattgatcaatcatagcttggaattgttcaactttatcttctggaatcggggtcaagttttgcggaaccattgtcagttcgttttggacaaacttgtaccctttttcctcaagcgcgtcgcgaacctgagcaaattctttaggatcggtgtagatttcaaatgcctcatctgaagtctgcatatcttctgcaccggcttcaagcgcatcttctagcatctgatcttcgtcaacatcaaggtcatcacggctaatcaccagataaccttttcgatcaaacatgtatgaaaccgcaccagcagctgccatgttcccaccgtgtcgggtgatagccactcgtacggtactggaagtccggttgcgattatcggtcaaagcttcaaccaaaatcgccacaccacctggcccatagccttcataggtcacttcgtcatagttggccgcatcacgatcacttgctttatctaaagcacgcttaatattgtcttttggcatattggcagctttagctttgtccatgactaaacgaagggaaggattaccactggggtcaggaccaccttgctttgctgccatgtataattcacgtgataatttctggaaaattttaccacgtttcgaatcctgagcatttttacggccctgaatgttatgccatttggaatgtcctgacatgataaaccctcttttcgtaagtttaggagcatatgaatcgctaaaattatagcaaagatcggcactttattcaatgacgcttctgccgccataaccataaccacattaaggtcacggccacagccgcagcagcagtatcgagcatcacatcttggaaaagcggtgtccgcccgcctgtcagcatttgatgaaactcgtcaaatgccgcaacaccggtacaacttaagaccatcagcggccaatgcagccaacgatttttctgatacataaacgtgccttgtgtcagaccaagacctaataggaaaaagatgctgacatgcgcacctttgcgaatgaaaaattcaacaaatttaaaatagcctacctcagcaattgattgctgttcacccgcataattaaaatgaataccacttaaggcttgcttaaacggttcattgtgtaacaagcgttccaataacggcaccgttgtttgctctttgtaagtcatactggaactaaagaacaagacaaacaaaaggactgccgccagccacaacccccaatgttttttaaaagacgtcacaaacttctacctgctttcactcagacttttctcatctacggtataataaagctatttcgaaaggaagtgccaatatgtcttatccaattaactggaacctcgattcgattttcccgggtggtattgactcaccgcaacttgccgaccgaattagcgatgtgacggccaaattgcctcaactggagtcaaaagtagccgcttgggcccctgaccacgatgctcctgagtttaccgatttcatcacactttggcaactgctggaagacattggcaaaggcctcgctactactagcagcttcgtcgagatgattgccagcgctgatacagctaatctgaaaaccggacctgttcaaggtcagctcacgacactttatacccgttttcaaaacattaacaacccgctggccaaaaaactcgcagccatgtcacaagcagctttcgatcagctaacaaccacatcagctttaagcgctagtcgttttggcttgcaagagatgcgcgaccaggcaaaggaactgttagatgatcaaaccgaaacgatgattaacgatctggcagtcgatggttttactggctggagcgatcattacaccaccttgagtggcagtcttaagtttccaatcacacaagatggcaaaaccacagagcttagtgctggccaaacccagaataaattcgaaggcgatcctgacactaaaacgcgtgaacaagtctttaacgtttgggaacaaacgtgggacgatcatgccagtctgtttggtgagaccctgaatcacattgccggcttccggcttacgaattatcggttgcatcattatccggattatcttttcaagccgttgcaatacaatcgcatgcaacgtgccacgctggatcaaatgtggcacaccatcagcgccaacaaacagccttttgctgcttacctcacgcgcaaggccgaattaactggcaagccaacaatgccatggtatgaccaatgggcgccagtcatcgtgggcgattttcagccaaagacctataccttcgatgaggccgccgaatttattgtgaacaactttgccaagttctcacctaaaatggctgcctttgccaaacaggcatttgaaaacggctggatcgaagctgaggatcggccaggcaagcgcgctggcggttacatgaccagcgtcccagatgtcaaagaaagtcgtattttcatgaccttcgatggttcagcatctggtgtttccaccattgcccacgaattgggccatgctttccacagcagtattttgaaagatatgccgctattgcgtcaagattatgcaatgaatgttgccgaaactgcatcaacttttgcagaattaatcgttgcagatgccacagtcaaagcagcaacctcaccggctgagaaacttaatttgttagacgctaaaatggctaatccattggcgatgctgctaaatatccatgctcgcttcctgtttgaagacagtttctatcaggaacgggaaaaaggaattgtcagtgtgccacgactgaaagaactcatgacgactgcgcaacaacaggcctatgcaggtggtctaagttcttttgatcccatgtattgggcagacaagctgcatttctacttcgacaacccaccgttctacaacttcccttacacttttggttatctgttctctagcggtatttacgcaaaggcccaagcatctgataattttgaagatgattacattgctttgttgcgggatacggcgaatatgacaacagaagcactagcgaaaaaacatctcggggttgacttaacgcaaccggatttctggcagcaaggcattgatttagccgccaaagatgcgcaacagtttatgactttgagtgaaggttacttgaaataaagttcttcccgatttgcagcgtgtcacttagcgcacaaatacttaatttgtgcttattaaaaaagtgttgcatcacgagcatacccgtgatgcaacacttttttatatacatggatcacgatccgctacgacgtcagacaccaagctggggattgaatccacagcttgacatgaatgacaccgatcaccaaatgaaattcttagcgattattcaacggtcactgacttagccagattacgcggacggtcaacatcgtaaccacgatccgcactagtaaagtaagccaagagctgtgccgggataatcgtcaaaagcggtgcaagtaatggattgatttcatcgacaacgatttggtcaccatcttgggcttgactagccattgcgatatgaagcaccttggcaccgcgagcttgcacctcgtccgcattgctgcgagtgcgcgctgctgtaaccggatcagaaatgattgcaaccactggcgtattcttttcaatcaaagcaatcgtaccatgcttcaattcaccagccgcaaagccttctgcctgaacataactgatttccttgagtttcaatgctgcttccatgctggcatagtaatcatcgccacggccaatgtagaaagcattgcgcgtggtcttgaacatgtcagttgctagttcatggatgcgatccttctggtcaatcaaagcctgctgaccagttgctgccaacccaagttcatggatcacatcgaagtccttagcagcctgcaatcctttagcctcgccgactgctttcgatacaagcgcttcaacggcgatttgtgccgtgtaagctttggtagaagcaaccgcaatttctgggccgccatgcaactgcaacataaaggttgcttcacgagcaagcgttgagctggcaacgtttgtgatcgttaatgtctgataaccgcgttccttgactgaaacaaggacctgacggatatcagcagtttccccactttgggttaggaaaatgaacagtgggtgcttggacaacagtggttgatgataggcaaactcagaagcaacatgcacttctgtcggaatacctgccaattgttcgaacaaaggtgcaccgactaaaccggcatgataactggtaccagccgcaacgatatacaaacgatcagcttgctgtaaagctttcagcaaatcttctggcaaaacgatgttgccatgatcatcggtatacttttcgaccaaacgccgcatcacgattggctgttcgtcgatttctttaagcatgaagaatgggtacgtacctttagaaacttcaccatcatcaactttaacggtgaatggcttacgttcctcaactttaccgtcaatcgtttcaatgtggatggcatcagccgtcaaggtcacgatttcctgatccttcagttcaacaaactgatcggtttcactaagcattgccaaggcatcagaagccaccacattaaagcctttaccacggccaatcagtaatggactcttgtttttagcaacatacagcactgttgggtcaaggcgatcaaccatcgagaaagcataagaaccttggatcattttcaaggttttgcgcagtgcttccttagcagacagaccttcgcgggcaaacaaggcaatcagctgaacaacaacttcggtatccgtatcactctgtaattcaatgtcttgcaagtactgctgcttcagttcgttagcattggtcacaacgccgttatgcaccagataaaaccgttcgtcattggaaacatgcggatgggcgttggcttcggtagggccgccattagttgcccagcgtgtatggccaatccccataacgccttgaacatcaggcgtaaccgcttcttcaagattggaaatatggccgacgcgcttaatcaaatgatcatggccggcttggtcattcacgtaaatgccggctgaatcatagccgcggtattccaacttctctaatcccttaagcaagatctgcgttgcattctttttaccgataacgccaacgattccacacatagtcaacatccttttcatttttgtctaaaaattggtttagacagatttttttattggtattgttaaaagcaaagctaactatagtttttaataggctatatgtcaacaccattttttcactggtatacttgaaacatatatattggtctatattaatttacccaattcttatgcacactggttttggaattttatgaacgcgctttcaaaaagtgccaattgcgaatgctatcaccagacaaaaaaaccgagttgtcgatgagacccgtgacaactcggttaaaataaagtttaaatttttgataaagacagcagctaatcttccttgctgcccatttcttgcttcaccacatccacaatttgatccacataacgggaaaccaaatcttcggttttggcttcggccatgacccgcaacaaaggttcagtgcctgaagggcgaaccagaacacggccatcaccggccatttctttttcgacggtatcaatggcactttggatttctggataagcttgccaattttccttgtccgcaactttcacattaaccagtttctgcggatagtcttgaacaggtgcggctaattcagacaacttcttgccggttttcttcatgacatttaacaagtgaatgcctgttagcatgccatccccggtattgtgataatcaaacaaaatgacgtggccagactgttcgccgccaatattatagccatctttgcgcatggcctcgacaacgtggcgatcaccgacgtccgtttgcacggacttcatgccattcgcttctaatgccttatataacccaagattactcataacagtggtgacgacagtatcctgtttcagccggccctgtgacttcatataactaccgagaatgaacataatcttgtcgccatcaacgatattgccttgttcatcaactgcgatacagcgatcaccgtcaccgtcaaacgcgaggccaacatcagcacctttttcgacgacaaatttcgataatgcctgaggatgcgttgaaccaacgttagcattgatattaagcccatctggactgattgccattgtatcaaaatcggtctcaagatcagcaaaaattcgactgactaacccactcgttgcaccatttgcgccatccaagcacacatgaatgccactcagatcatctgccaaggtttgctcaagaaattgggtgtacttgagtgcgccttcaggataatcgtctactgtgcctaatccttcagcagccggccgtggaagtttgtcttctggcgcatccagtaaggcttcaatttcttcttcagtatcgtcagacaatttgtagccgtccgctccaaagaacttgatgccattatcggcaaccggattatgcgacgccgaaatctggataccagcatcggcgccttgaatcttgattaaataagcaacagcaggcgttgtgatcacgcctaaatccagcacttcaatcccaacagaaagcaagccagcaattaaagcatcagccaacatctgccctgagattcgtgtatcgcgagcaaccaaaaccaatgggcgtcgactcgcatcttctttgtgctgcgtcaaaacatagccgcctgtccgccctagccggaaagccatctccggacttagttccttgtttgcaataccacgaacgccatcagtaccaaaatactttgtcatcttaattcttcctcatttctttcagccattattgtcgcttgttgatgtacttgagtctgattcactggcactcgaggtgcttgcggcactcgaactcgaagtactggcgctcgctgttgaaccgccattgttgttattattatcatcattaccagtgttgccaacactaaccgtcactttaagtgatttcggactagcagcagaaatgccatcattcaaatcagttacgttgtaagtccgagttgtcgtcgtgctaataccgctgacatcgacgtccacggttaatttactcagcttgtccaaactactttggtctccgtatacggtaacctgttttgtgtcagaggacaagacatacgtgcgtcctgacacggcagtaccagtttgttttagctccacggtaagtttcttgctaggttgagaaatcggtaaggttacatgaacagtctgcggtgccaacacaacattcatcgtattgccgttctcatcaagcgcctgtaacaacacctcttggtcaaccgtactccgggtattgtgcgacagcgagacatttgccacaacttgtgcgatcgagtcaatcacggatcgtgcgccagtgacatccactgttcgcgtcgacagctttggctcaccagctgcatacccggatgcgatactggctttattatagcgaacctgaatcggcatcgtcttattgtcccgaacctgaatgtcaacggtcacggatttaggcgaaatcgaataactcaaatccttattcaaaccctctgccttcaaccgaacacgatgcttgccaacaccgagtttggtaagatcagcaatgatccgaaaattttgggtgttggcggtcatcgtgactaatgaagccgttcctgtcaatgcaactgaaacttttgacggataaccggtaataaaatacttgtccgtgttggcatttacctgtaacggcactttcacggtctgggttttgttggcaaccaaggttgtatcatcatttgcactttgtctggtattgttgatgctttcaacgttgacataagcaaaaagcccaatcgcgagaagcagagccaacaaccgattaacccatggattatcccataagcgattcattgcttgccctccttctttttacgtgacttaaaccggcgcgaaaagaaactgacaactgggttcggattcggcgcctcttcttttggcactaactgcgccgtcagaaacttcatatagtcatcacgcgtcaaattacgaatcaggttgttgttatttgtgatcgtcacttccccagtttcttcagagacaacgatcgtcaacgcatcggtcacttcactgatcccgacagcagcacgatggcgcgtaccaagttctttaggaatgagattgctgtcagataaaggtaagtatgcagccgcaaccgcaattcgattgtcccgaatgatcaccgccccatcatgcaacggcgtattcggtatgaaaatgttgatcagcagctctccactaatatcagcatccaagggaatacctgtctcaatgtaatcctccagcccggtactcttctggatcgtcattaaggccccgatccggcgcttgctcatatattgaatagccttatcaagttctttgaccatccgtacttcgacttcgtgctggttattattcgaccgaaaaatcaaggaaccgcgacctaggtgctcaaggccacgccgaatttccggctgaaaaataataaccagtgctggcacactccaagtaataaccaaatcagttaaataaccgaccgtcttcaactgaaggaaccaagaaataatcttgatcgcagcaatgacaaaaacgcctttcagaagctgaaccgcttttgtaccgcgaacaagcatgatcaaacgataaatgacataccagacgacgaggatgtcaaccagattgatcaaggtggaccaagttaataaatttgtcagataggtgcgcatccgcgttcctccattatggtttagaatcaaacttctgaataattataccacgaggtgtgcgcaggcgcggccagaaacgggagcataagcggtttcagtcgctataacacagcttgaagcagcttttagatgccatccttttgacaacaatccgattgatttggctgatgacttttaaacttttagttgcttttaccccaaaattggcgataatggcaggtgagtgagcactcactatattattgagaaagtgacgcgataatatgcaaacaaatcaagctgttcaggtcagcgccctcacccaaggctatggtaaacagatcgtgcttaaggacatcaacttgaccttaaatcatggtcaaattcttgctttaatcggtcctagcggtgctggcaaaaccactttagtcagtaccattatgggtatgttgcgcccacgcaccggacaagtcagcgttttagggcaagccgtgccgaatcgtcccctactcgcgaaaatcggcttcatggctcagactgatgctttatatgaaagtttaaccggtgccgagaacctgacattttttgccaaaatgcaaggcgtcccacacgcgcagattaccaaacaaatggcttatgctgctaatgtcgtcaatctgcaaccggccttaaagcaaccagttaaggattattcaggcgggatgaagcgccgattatcgctcgccatcgccctcatcagtcaaccgcagctgttgattttagatgaaccgaccgttggcattgaccctgagctgcgccaacaaatctggcatgaattgcatcgtctggcggatcagggtgtcgccattattttaacgacccacgtcatggctgacgccgaagaagcggacacgttattgatgattcgcaacgggactgccattgcccatgggacaccggcacaattaaaggcagattatcaaacggactcgattgaagcggtctttttagccgcagggaggcagcaagatgcgcattgaagcgttgattaatcggattttaaaagaaatgctccgcgataagcgcacgttagccctgatgtttatcgcgcctttatttatcatgacgttgatcttttttctttttcaatccaatacggacaccaaggctgatttagcagttcatgctgttgattcggcactaacaaaggcgatcgataccaaacacgttcgattgcatcaggtcaaaaatgaccaacccatcgcattaatcaaggctcatgattatgccggtgtactcacgcaggatggcgataagctgaccctgacgttggccaacgctgatcaaggaaaaagcgcgattctgaaacaaaccttgcaagccgcttctatcaaactaaaaatgcaagccgcagccacagcgcttaagatccaagcaaccaccttacaaaagcttgcgacagctctcaaacaggccacgcgcggcgcagcccagattccagaaccccatcagccaaaaacaccgagttacacgttaacaacccattaccgatatggctctgccgactcaacttactttgacaccctgttgccgattttaatgggattcattgtcttcttctttgtctttttgatttcgggcatcgctttgttgcgcgagcggaccacaggcaccttataccgtttactggcaacgccggttcgccgcggtgaaatcattagcggttacctactaggttatggtattttcgccattattcagacattgctaatcgttggttattccttgatcgtattcaaaattcaaattcttggcagcatccccgccatctttttgatcaatttactattagcgttcactgccttggcactgggcttgttgatttcaacctttgctaacactgaatttcagatgctgcaattcattccaattgtggttattccccaaattttctttacgggattaattccaattcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatac

SEQ ID NO: 21 - DNA, 6028 bp, Lactobacillus paracasei
ctcccatgacagtctttgtaaagtatagatatgtagcctatctgatgtatttagcttatggataacagcctttccttgaacttttatttttttaagttgctatgctgtaatgatcgcataaatttctgttcgtaattccagcataggagtctttattaaaaaagtttgttatgaagtctgcccaaaagatcacacccttacgaatttaaaagactatgactctatttatcgattttcttcacttttaatctatagtaatcagaatactaactgcattgtaaaacttaactactgggtcgagtttttttagtctcttgagtaattaccggatcagatggatcaagtggctctttactcaaagaatttttgatctttttattaaaagtaagctttccagcgaaggtgttcactccagacgaaactaatttgattcctttcataacagggattatgcgatcttgattatccacccgcgttctgcttctcatgccctgtttttttgatgcttgatcatctgctagctgcctgcttatcgcaatcacattatcatctgcgtaaaagacacgaataaatgatccgggagtaacttttgtattctccttgggggaagttttgataataacgttagggcgctgctgtgcaagcttaatatcaggtgtaactaggactagagaaaagttaattggataaagtgccaatatccgcttggcttcagcaacacttatttgagataagccaggcattttaaaatcatctttatgtttttctaggtgagagtcaatcaccttcactccctcgtcaacaatcttaggagtgactttattaacggtgtctgctacagagtgcaaagtatttaatacctcaccaaatactcccagccctttgttactcaacgctgttaaggtcttcttttttgatttagaattcaccatcatttaccctccatcaattttttgatttcaaaaattgccctaagttaactgatcaatttactcagaattgatcagcaaaacatcttttgcaaatagccctttttgagtttcttcaacaaatctaacttacactgagttgcagcgataaggttgtcgatgcttgtgaacaatgcgctaatctctttctgctcatcaagattcacgattggaactggaacatctttcaattgcttaattggtaattgttttaaagcagttcctgtatttcgagataatagttctttttgacctctccaggaaagaagaaactgagccaaaaattttccacttaactccgacttatcagttcgaataactgctagttgagaattgatattccagtcgatgttctcttccttaacgtatcctaacgctcctaaggacccacgaactgccaaaacaatatcgtcttcaactaaatgacctgacgtcaactcagcgtgtttttcctttgtaatgtaatttgcattatcttcgataagttcaccatttctaagattactccctcttaaaaatggaactccattctccttgtcactaagttcagattctttcggatatgactcgccataatttccatcagtaaaatatgagtttgtctcccccaacttacgcttttcccaagcgtcagaatatcccttgaatctaaactcaggtaccttctcactattttgagggaataatttctgcaaatagccctttttaagttctttaagcttagctagcttacgctgatgaagagtgatcgtcatatcaaggttttggaaaagcacaccaattttagcttgttcatcaatcgtaggagtataaatatttgtattccgaatcgctttcaaccctaaattctttatggtcgttccggttaaactgttcaaataataatctttgactggccgagtttgaaggtaagtatagatgaattttttgtcaaaatctgaaacttcgatgtaagcagcagacttcccaagcatcaaattttcaccacgataccaagctaaatttccaatcgtaccattgattgacatcaagatagtgttttcatttaatgctttatcgtctttagattgttcgtttgatgtaacccttttcgtctcggacgttatgacaatctgaccgttgaccaagttgtttccgtttacgaaataaacatcaccatcttctgagtactttggtgtgccgtggagcccatctccaattttattcgtaccatcagaaagcttatgctgttcccaagaatcagaaaagcccttaaacctaaactgaggcacatgttgttctgcattcatcagtcaaattctccacgagtaatttttgaaaagccatttagcatcgtttcgattttaacagaaagcacagcgctatactttctaaaagaaaaatggcgtgcactcgacaaagcttgtgacatcaaactcgacacaacttagcaagaacacctcacacaaacacaaaaagaacacgacgaagaagtctccaagcaagaagcgctcaaacagcttagaaatagttgacgcccaaagcaataagttgctcgcactatatttcataaaagtgttatgtttgagcgccacggcgttgcaatcgcagcctaaacaaaaagcaagatcagccattcaccgattttacttttttgacgattttctactgtcgcgagatttgcaagtggacgtccacttgcgagaaattgacagaatctcagctgcgctgatcgtcaattttgtttgggggcacgcccccaatccccctgttattttgaaggaaggtgagtccccccttcaaaatcaaaattcaaacagcttctgacgacatttttcgctgacctccgcacgatgttacacacggtgtttatatctttttacattagcagtttcattcaagctgatcattgtgtaatatatgagttgcatttgagaaacagctcagttgatatttgtgcaactttaaatatacggataatgcaatattttattgcgttacaagcatctcgatagtttatgttaaagcaacctttatgtttcaatttgagtaactcgctatacacatctcatgttgcagacaagccactatagagttgtgtacgctgcaacgccaaaaacgtgctcattcgatcggacaagtgccattttgactaaatgttgaatattgcaaaaaaatccaacactgatctctgtaagtcaactgtccctaaggaatatggcctgtcgtcaaatgttgaatttccttctaaaattcaacattgcctattttgctaatgttggatttcgcgtcaatattcaacattttgaccccagcgtgctatcacgacaaaccaaaccgcactgcggtttaccccaattttggggtcagttttgccttatgctcttgcttaattttaagtgtgttccaaacggcctcaaaaagtgatcgatccagccgaaccgatttttgagatggattggatcgcaactcactttgttttgatcttttacccggagaaaaacgtgcacgttttgaccagggtagtcgcaactgtttaccaaaaaccgtccggcaacgtgacacagttttaacgtcgtgttgatttgccagacgaccgttcatcatcaccctttaggaggtttttgaaatgacaaagcaagacgaaactcaccgggtcatgttcaccttgaccgatcaggcgattgcaaaattgaatcagctggtagcgaaaaagcagcaggaagtgaatcaaaatccggacctggctaagtaccatgttaaagtgaccaaatcaaatattgttgaggattggttatcaaaacagtgagttttaaaaagcgctaaagggcccgtgctagcgtttcttactctgacgggtacaattaatgctctttacatcaaaaacggcttagaacgcaaatataagcgttctaagccgtttttatcagcatatgggcatggcacaaatgaaaagccttagtgatgaatcaaatttagtcaacgtgctgttggcggtgaatggcgaaagccctgccgaagcttcagctgaggctcttctgagccacgcaagcgaagcgcgctagggcaagccaaaggcgcgcaggcgaagccggagttaaatgtggcaaagccacacctttttagggagcgaagcgaccaggggttggtatggggtttggggagagggtctccccaaaggtttcgcgtgcggtttaatttctatattatcaatactatcaatactataaaggtttttgggccttactctgccaagggattcagagcagatgcatactaaaaattccgcagatgcatactaaaaattccgcagatgcatactaaaaattccgcagatgcatactaaaaattccgcaaactcacaaaaatgtaatatactatttttgtgctagattgcttaaaatggtatatgaatagtgaggttgcttatgaaatctggaggacgcatcatttttaatccaattggaactgatctgttaattagtcaagacagcattgacaaacaacagggctatcccgtgattaaagcaagtcaattagtgcaaaaagcaagacaccaattgacagccaaagaacttaagcttattgacttcatggtgtctaaagtcagacgtgatgattctggtttccgtcctttacaaacaacgatcaaagaaattaatcaggtaatggagtttggtcgaggaacaaaaagtttaaccgaaacatcaaaatccttgcttagcttaagtaataagggcttttggtttcaaaaggatgaagatacgatcacaattgctcgctggcttcaaacagcggaaatcaaaaaggatggttctgctactctagagcttgacgagaaattagcaccctggcttttgaaactggttggttcaagagcacaatacagtttatctgacatcgtggctttgcgtagtaaatacagcctaatgttatatcaactactgatgagttggcgtggctccatgggagttaatggaacacccgatgagtttctagagttttttggtcacaccaacatgaaatggtggcaatttaatggtcgttacttacaaccagccattgatgaaatcaatcaaaaaactggaattaaggtacactatgctgctcgaaaaagtggtcgaacaatttcagaagtcgaaattgattttactggagacgcaagttaaaaataacctaacccatagtgaaatagccatcgttccaacggtggctatttcttattttccaacaccaaacaatcgatgccaaaaagatcctttattttctggactgttttcggaccttctgggaaattctgaatcttgttcgtgtatttggctgtccacaggtttagattcactatcaggctcattttggggcactgacaacttttttagcttgttctccgccattagttgtaactgctgtgattgatctgcaattttctgagcctgttccagtaaagaatgaagcctctttatttcttcatcttttttcgctaattgttcaaccaagatatttctctgatcatcatatttttctttaccggtaaatttgctatctttatcggtatatttaccggtattcttgtggcggttatttaccaccttattgcgtataatcccttctgctataggatcaattcggattacaccgtctttcccctttaccacatatttagccggtatattgcggtaatgatatctgatggtttgcttactaacacctagctcatccgcaagctctttgactgttttgctcatatggctgtcctcatctcgtgcaatctaatgtcaattatagcaatggctacacacgactacccataaaaatacccgaaacgatcttagaaatcgtttcgggtcacttatttgaatcgaattttaagccttatttcaagatgtttctggacgatccgttagggtacaccctattgtgctcttagtggtgtctcttttttagtcactctttggtaatcaacgattccatatgttttattaacagtaattttaatgatttgccctgatttaaacgggcctatatcgtgctcatctgtttttaacttgagattctttatttttccctgtgcgttcttagca

SEQ ID NO: 22 - DNA, 129183 bp, Lactobacillus paracasei
agaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggtaggttacttattcttttctgccatccgcgaaggtgtcggttttgggtcatcatcagtggtttcctttttaggggccattgttgcttctgctggcggctttggtgcagctgcatgttgatccttgatggcatcgacaacgggttgattcccagcttgatgcatcaaggcgccgttcagcatcccgcgaatatcaattccggcaacttcttgcaacatgtccaattgtttgaccagactgccgctggtttgaccggtcagatcaccgtcaccataaagcttgatcgaatcgacattggcatatggactcatcgcggcttcgataatctttggcattgcctcaatggtcatcttaaaccgaccggattcgtctaactgacgggctgcttctgcttgcttggcaatggcttccgcttgcgccagcccaattgcccgcgttttgccagcttctgcttccccgatggccttagtggcattagcgttggcttcggcggctaattctacctgcttggctgatgcctcagctgccgcgatctgcgtagctttttgcgcttcagctgcacgctgcgccttatacagatcggcgtcggcttgtttacgcacgctggcattcaattcttgctcttgtaattcagcgtctttttgggcaagttcaatatctttttctttttgaacttgcttggccttcatttgctcaacaatagcagcctgatctgcctgcgcttgggcgatttcttgctgtttcttgaaatcagccattttgacttgctgttcgcgttcggcatcagccacctgtgtctgccgctcaatttcttgttgcttagcttcttgatccgcctgcgcttgctgaattcgagtatcacgacttgccgccgcttcagccaccgctgcatttttcttaacttcagcgatttgctttttacccagcgaatccagataaccgtttttatcggcaatatccttgatcgtgaatgaaatgatctgcaagcccatttttgccaagtctgagctagccacatcctggactttctccgcgaaggcatcgcgattttggtacgtgtcttccacggttaaggtgcctaaaatagcgcgcagatggccttcaaggatttcggttgcttccgaattgatttgttcgtcattcttgcccagaaattgttctgccgcagtcgcgacctcttcttgactggaaccaattttcaaaataacggttccgttaacgatgattggcaccccttgttgtgtgtacacttctggggttgcgacttcaatcgtgcgcgtattcagactcaaaacatcccagcgctgcaggattggcagaatgaacgaaccgccattcgtaatcagcttaactcgattgccgttaacatctctaaaactgtgcttgcccgaaatcatggctccagagataattaacacttcgttgggcagtgcggttttacgatgggtcgccaagaaaataaaaatcaaaatcaagacgatggccgcaatgatccacggcatataatcagttagaatttccataagtcccctcctctaaatgcgatggctaaccgcgccagttcacgctctcctaaatgcatcaacatatgcgatgccttgcttgagttcaatgatgacgaccttggtgccttgagccagtgtttgatgcgtgccggaccacaatttggcgggataggtttgccgcgccaaaccaccgccggtcaccatcacttcaccagtgtgaccatcagaaacagctaatgtaacagtccccaacaaataatcgcgatcactgacggatgtcgtgttctcaacgggtgccagtaatcgttgcaagaacgcgatcagcggcagtaagactaaagaaaaaagcatccacaataagccaatcgccaaaagcatggcaccaatgatcacaagaatttgtaaccaaaaaacttgttgggtcagccatgccaccatcgtcatcacctcactttttaatcacattaaatccctttcattttatcatgcaagccgtccataacctataccattatcgacaaaacgtgcgttttttattttagcttagcgaattcttcatcccgaaccaatttagttatcaaaaaataaattttcgcaaaaaatgtgcttttagacgttacaaattttactgatagcattgagcgttaaacctacagaacttcttttgttgatccaagattatgtccattcacaaccaggctttaggcgggattgatagaaacctatcagttgtaattcaaagcatagtcttcagggtcttgataatgcagcgtcttggtgaacaagacatgactcgcataggccaacgcaatcggcaagataaagaataacaaggtcaattcaaggacattgccaactgtgacactgcccatagcatcaagcgctgccaagggaccgactaagccagaaaaaccaaaaccggcactggccggggtgccttgaatgttcaacgccgccccaaaaccgcctagaatgccagcattaatcgccatcggcaaaaagagctttggccgagaaagaatgttagccatctgcatttttggcgaaccgaggaagtgagccagcgacgtgccaaaagagtttgccttccagccataggtcgccaaggcaaaacctgcccccacaatcccgaggttagcagaacccgcaccgataccggtcaacgagattgccgtggcaataccgaccgtactgatcgggctcacaatcaacacggcgaaaatgatccccatgagcacacccatcacgattggctgcaaggccgtcacatcatggacaacgacaccaatatacttcgtgatgcttgaaaccggcccaagcgttaacatgccaatcccgccagcaatgaccagcaccagtgatggaatgagcaaaatcgtataagctttcaaggcgtcaccaagcagcactatcaacaaataaccaatggctaaggtgatcgcaaggttaatgacatcgccagtaccagcaaccttcaatcctgttttagtcagatggtagttgcccgccccgacgatcgcagccaaagctaacgaactggtttgaatcggcgtaaatttggccaacatgccgacacagacagccgacagtgccggcaacaaagtcattgcagcccctgtcatgtaggtaaccaccgccaattgcggaaagcttggcaacaacagtttgacaattgcgttcaaaatagcgccgggtaccaaggcgacaataattcccacggataatccgttcaaaatgttcatagtaatggttttagcatcttgtttcattgacttgtcctccaagttagttgacttgatgcgctgacttgccgccttcaagaatggttttaacatcgtccagtgaaatatcaatcatatttttgaccgccgcatcggtataaaaaccgatatgtggtgaaatttcaacattcggcatagccttcaaagtttcaagtgtctgattatcaacgagcgtttgactgcggtcttctccgaaaataccggcttcgccttcaatcgtatccaaggctgctccggcaatcgtgtgatcattaagtgcttttatcagcgcctccgtatccacaattggcccgcgggccgcattgatcagatatgcggtcgatttcattttacgtaacgcatccgcatcaatgagatgggtggtcaagccgtccaacggtgtatggaccgtcacgacatcagatgtggtgagtaaggtgtttagatccacataactgaccgtatccgccaattcaggccgcttcactggatcactgacgatcacagtcgctcccaatgcccgaaaaatacgggccacagcactgccgattttaccagcaccaataataccgaccgtcaagttatgaatttcaggtgcttcaaggccggtccaactataatcatccttcgcttcgcgggcgcttgcttcccctaaatgccgaatcaaccgcatgacttgggctaaaaccagttcggaaaccgatcgtggcgaataggccggtacattggtcacaactaatccgtttgcagtggcggcatcaaggttcacaatatcgtagccggtaatgcgcaatgtcagctgtttgatgccaaatgccttcagtttttggtaaaccatttcctcaggaatcgcaccatgctgttgaatcacgacaccgtcataccccttggctaaatcaacggtgtccggtccaaattcaaccgtgttggtatcaacttgaatatcattagcagcgacccaagcatcaatcgcagcccgctcatcaggtcggacggtatacattagaatttttgtcatatttgcctccagattgtaagcccagcatttttcaatcggcccattaatgcgttgccatatacttggcgatgcgctcggctgccaacttgagatccgccattgaagctgcataagaaatccgcacgtacccttcaccgccggggccaaaactagcgccaggaattacagcaaccttcgcctcgcgtgccaaagcgtagacgaacttccaactatcatgcattcgctctgggagcttagcaaaaatatagaaagcgccatctgggttcggcacagtcaaccctgcggcagttaaggctttgatcaagaagtcacggcgtttcatataagcttccttcattggctgcgtatcatccatgccgtttttcaaggcttcttcagcggcgcgctgcgcattggtggtgacactcgtgatcgtgaattcacttactttgccaatctgctgaatcacatcagctggtcctgcggtgattccgacccgccaaccggtcatggcatgggactttgagaccccattcaatacaaccgcttgatcaggtaaaatttcacccatcgacacatgtttgcctgtatacgtcagctcggagtatatttcatcgctcaatacgaagatttcatattgcttgatcaccgccgccaaagcttccaaatccgcgcgatcgtatgtcacacctgtcggattcgtcggatagttcaaaacaacggcttttaccgtgtctttgtttgcctcaattgccttctgcaacttctccggtttcaaaatgaaaccatcttctgacgtatcaataaaaatcggcttggcaccatttaacaacacaattggaatatacaacggaaaaattggcgtcgggataatgacggtatcgcctttattcagcatcgccgtcaaactcgaatagatgccgcctgtcgcgccggcagtgatcaaaatttggctttccgggtcatatttggtgttgtatttcgtcgccagataatggctggcagcagcccgcaatcctggaagtcctttgctttgcgtgtaatgactctcattgttttcaatcgatgcaataccggccgccttcacatgttcaggtgtcggaaaatccggctcgccaagtgtcagcttgacaataccttcaatcccgctgatcgcagcattaaattgcaaaatatcgctgggcttgagctgcttaacttcctgattcatccgatcaactaatgccatattattttcctccaatatttttccttatagttctatcataacttgtttcatggggaagacctaggcgtccgaactttgccgccacggtcaattgtcccccttctcgagaccattttgattagcgagtcactcgttctgctgcttgaaatcaaacaaaaccccacagtcacaagccgactgtggggtaagataatgggaatgattctcctgatctcagccacacagtcaattgcttgatctgtgtgactgctcactcaaaggtaactggtctcacagatcgtgtctgaaaaaccagaaataaaaggattgttcgctttgagtcagcttgttgatcattatgagaacctcctaagaattagattagttacaggttactgggttgtgaagcatttgtcaaatgatttataaatctgcttactttagaaactgatgctacaagttatttgaataaacttttccacgcttttttgttaaaaacagccaccaaataacagctatggccagaagcttataaagaggtcaaaactacctaaaaaaatgtttttaatgaagtttcggcgtttctgttttggggggatgtcccgctgtgtttgttttcgataatcaagtacagcaatgacaagattactagcgattaaaatccctaggagtacaaagaatactaaatactcaatcatagtcacccccacaaaatcataaagtttaaatagcatgcgttgctgcggcttcttttaccaatccaaggtgttaggtgcttaacgcgacgattggagcttgctttaaaaaggaatgattctagacaatgctaggccgggctggaactttctttcaatatctagtgccttactttccatatcaagaagaacagtctgttgctctaatgtgagttgataatgatgttcgcgcatctcatctctgataaagtaaccgattgaccgcacttgcggaccaatgttcatcccttgtgttcgtttacttgctagtttatcaattgcctgttttatttttaggacaatcatttgggcggtgccatctgtttgttctccaaaaaggtgttgtagttctaacatcttaacaatgatcgcttgcttttcatccattcaaaatcgctcctttattcatgcacgcgttgttaaatcctgactatatacaaaactagccttttgaatgcttgccgtcgtgctatcgcagaatcccttccaacatctaccagctaccaattttggttatcttgtccaaaatatacgcctgaggaacagttcggggttcatttaaatttaaacgtcggtattttcaggtttttcgtcgttctttcctttaattcgtataaggacaccacgaaaaatgcagttttgccaaacgacaacaaccaacacataccctgcagaataggctacaatgaccttaattaagagaggagcatttagtcatgaattattcaatcacacctaacagcaccttcccggttgtcaacattacgatgggccaagatgaaacgattcaaattgaatccgggtccatgatttatcacaatggcttggtcgaactcagcggtcatatgaatagtaatggtaagaagggccttggcggtatcatgagtgctatcggccgctcagtcaccagcggcgaacgttttttcatcacaaccgccactggcactgccccggatgctgaattggccatcgcccccggtaatcctggcgttattaaagagttaacacttgatgacacccatcaatatcgtttgaacacgggtgcttttctggccatggacaccagcgccagctatcacatggtgagtcaaaaagtcagcggtgctttgtttggtgggactggcgggttcttcattatggaaactgccggaactgggacaatgctcgtatctgcttatggtgacatcattccgatcgccttggatggcagtcatgaatatgtgattgataacagtcatgtcgttgcatgggacagcaagctaaattacaacattcaacctgccagcggtgtcattggcttcacaactggcgaaggtttggtcaaccgctttagtgggtctgggatcgtgtatattcaaacgcggaacattgaggctttggcagatctggttcggccatttattccaagtagcaaggactgattgaattgccctgatttaaggcaagccaatgcacatcaaaaacccgtcaatttttggcgggtttttgatgtatgcaaggaatatcaagcaaaaattgacgacactcgtgtcttgtttgccgaaaatacatgatttgactgtctacatctaaattaggcaaattcttggccattcggtagcattttccgaataccgccagcagggttaggatcatccccacggtatcgcgggatcaaatgcaggtggcaatgcatcactgtttgaccgccatacaggccgacattagcgccaacattataaccatcaggatgatattgctggtcaatcaacgttttgcctgcatgaatgagacgattgatggctaacagctcctcctcgcttaggtcgaagaagttgcttcgatgcgtccgcggaatcacaagcaagtgaccctggctcacaggatgaatatcccaaaaggccactgcgagatcattttcaagaacgatactggtttggggaagatggcaaaagatacagtcggcttgtggcatcatgatttcctttctaattaagtcttaaatcaaaaacaagcacaaggcgcttgcagatctgaactgctgcatttgccttgtgcttattattcaatacgatggattatgcttcaagtttctctttacttgaatctgcaatataatgcggcacttcatcatcgatgaaatagaccttgtaccaaacaaggaaggtgtaaatcgtccaaactttccgacgatcatcgctttcctgccgatacgtacgatccaagatatcgagaatggcatcctgatcgaagaattccttgacccagtcttgttcaaacattttgcggaccgtcttgtagaacggttcgtcttccaaccactgcttgaccggcactgggaaaccgagcttttcacgactcgcccattcttccggtaagtgacggttagcagcttcacgcaatgcatacttcgagttgtgcgaattgatcagatacttggttgggataccagccgcgaccttagccacttccttatcaaggaacggtacccgcaattccatcgagttggccatcgacaacttgtcagctttcaaaagaatatcttttggcatgaactggtggatgtcgagatactgcatcttcttaacttcatcatcgtaatgacgtacctttttgtacgaagcggtcacgatgtcacgaacactctcactttgccgaaattccggttgtaagatcttgtcagcctggccctcatgaaaaaccagtgcttcgccgatgaagaattcttcggcaggggctgttgattcataaagatgcaagcggccatggaaattcggcatctttttcaggccatgggcgatcgtatacttaacaccttttggcaacttgcgtaaaccgtccgcaaagactcgaatggcgtggctgcgcgtatggaagccatagttcgcataaccagcaaagagttcatcggcaccttccccagacaaaataacggtcacgtctttgtgtgccagtttcgttaggaagtatagcggtacacaggaaggattggaatccggttcatccaaatgatattgaatcaacgggaagttatctaacgcttctttttcagtaacaatatcactagtgttatccaaaccgagcttgtcactgagttccttagcggcaacgccttcgtgatactttttgttgtcaaaaccaattgagaaggtatgctctggccgcaacaaggcggtgatataagaggaatcgacccctgatgaaagtaaagacccaacttcgacatcggaaatccggtgagcatcaactgactcagaaacactcttgtcaatagctgcaacagtatcttcaaagctcaaattgttcgccttgaaatccatgtcccaatacttcttaatggttaacttgttatccttcaaggtaaaatagtgcccttcaggaatcctgtaaactcctttaaagaaagtctcatccaaagccgaatattggaaagtcaaataaggcttcagtgcttccttgttcaattgtttcttaaacttaggatgcttcaaaaatgctttgatttcactacccacaataaaggtatcgccatcgtgatagtaatacattggcttgatcccaaagaaatcacgcgcgccaaacatttccttcttattatcatcccagataaggaaggcgaacatcccgcgaatcttcttgagaagttcgtccatcccatattcctcataaccgtgaagcagaacctcggtatcggaatgggtcttgaacacatgcccagcagcaatcaaatctttgcgaatgctctggaagttataaatttcgccattaaagatgatcgcaactgtgccatcctcattcaggatcggctgcgaaccaccttttaagtcaatgatcgacaaccggcggaatccgagggcaacgttatcattgatatattcgccgctggaattaggaccccggtgtttgatcatgtccatcatgttattaataactggctttttatttaaaattgtcttgtccgcaaacgcgatgattccgcacatacagttaaccccttttcgcgtgaatgacgatcattacttgtttcagtataaagatttagcgtcgcaagtcaattcaagagcgtgagccaccccggttagaaaccggagtgtaagtggccttgaccgtgatggcccgggtttggccattgcggtcaaggtccttacacgcaggtttctggggtggcgatcgcgtttaaatcagagcgcgagcaggcccggttagaaaccggagcataagtggcctcgggcataaatggctgggctttggccatttatgtccgaggtccttatgtgcaggtttctgggcctgcgagcgcgtttcggaaaacagccggaatcagtggttcagttgggctgtatcacagccgcgatgatcattcaccctcctacattccaaaaaaacgcaaaaaaacagagatccaagttcctacaggtgaacttggatctcctaagttaaggatttgaccgatgcaataatctcaaaacttttcttggtactaattgtaaaaccttcttcgataaccttaatactgcgacaccttctaaaaaatacttattcacttgtacggaacgacgagtgttgaaatgatgttgccctataactaggcgttgtttggtggtcctattgacacaccctattgaacatctatgggaagctcattgccccgcttggattactgagtctttttattagcctcgtacctccatgtgtgttcatctttggtcagttggaacgtgaatcgtacgactggtggcgcagatacttactgcaccaacgctctatttgtctattcgtgctttgcgacacacacatcactttcgagctggttcgtcttggtaatgctagacaaggatcgtaatgctcggttcctgcatcgacctttttggttcttccttaacttcaattaaagtgtatcatgtaagcgctaactttgcaagctaatcacgcaatttatttaaaaaaatcgtaccatccgcgatcaatactgaaaacgccgaacacggctcgcagcaccgtagccatacaagctaagcagccgctgttgtgtatccacactcaccacataaccggcatattcgctcggcaaaccaaaacgtcgatcataccggcgattgaacttggttgttagaccgtgatgacggcccatcaacgcgcttgtattctgcaggctgtaatgaatgccattaacaatgtaatctgcctctaaatgatagtgcccagctaaataaccaaccactcggccgcttgactgcctaaagtcaaaccgcagacgaccgccaaacgctggtgcctcgcccgtatgcaacaccccgctcgcgtggaagttaaatgctcgcaataactcatggacagcgcggccattaaatttcagtgccggctggccattttccttcaaagccggggcatggctcaacaacaagacatctcgcttaccagcaccttttaatgccaatgcaaaattccgtagctgagcgaatgagaccgcaagtgttttcttgacatcaaaagccttgtgaccatcaatcaaagggacatctgccgtattcaaaacaatgatccgcaagttaggaaagtcttgaaccattagcccttcttgcgaaacagccacccctgtctgctcagcatttggtttaaaaatcagcgtctggttcacttctggcaaaaaactgccgcgatgccctgcacgcttttcggcaaacttgtcattatcgtcatgattgccttttgtcacaagaaacgggacagaaccgctttgataatcagccatgatgttccgtaatcgcagtcgagtcagccatggtgcctcggacccatccaccaagtcgccaagatggacccggagtgccagtggtaattggccacttaaccattgctgttcgcgtacatgccagtaaccagtaggtccataataagtggtggcaaattttgccttatcgtgagtatccgtgatcaacgcaaagtttacggctgaaggcgacagcaacggcgagattgcggaaacaaatctggtcagatcttttttgacaaatggtcgaattgcaatgctcatgaaaacctccatcgtgatattcgggtcagatattcaagaagacgcctaatgcgagaaagacaacctgggccaacgtcgtgataaaaagattcttgatagcattcggaaaagtcagttttttaaccggattggctgcaaaaccgcgtgcgttcttcaccaccatgggtacggtgatcagggtcaacaaggttaattttggcagtaaccccagcgcaacagcagcaatcagcatcaaaaagccaaccgtatataatccatagaagaagatgatgctgcgaaaacggccgagataatgcacaatcgttcggcgcttgagcgtttcgtcctcttcttgatcggcaatattattggccagcaacaaggccgcaatcgtacactgtgccaatccgctggcaagataaaccgatccgattaacggccatgagaaggcggcaacattaaagacgttgacataaacggcaattaggaaaatcacgaaacccatcgtaaatcctgagaaaaattccccatacggcgtggccgaaattggtcgcggaccgccagcataaccatagccgactgcaaagctaaacaatcccatcaccagcaagggccaccccgtgcggctcaccatccagaggcccaacacaccgctggttaccatcataccgacaaccatccacccaatcatactcgggttgagatgatgaaccccaataatgttagtcttctcgcgaaaacgcaacgcttctgtgcgctctgatcgtttgtaatcttgataattatcgttcgcgtcaaccgccatgttaaacagcaacatggccacgaagaaaaccagtaattcagcgatatgtaacgtatgataatgataccaggcaaacaatgtacctaataaaaacggaaaaactgaagccgttttggccttgatctcaaccaactcaagaaaaacagataaagacatgacaacctccaacaattgacttttaagaatcacatacagtagagtgaatatgtctataggaaagagagaaaatgcatgattcatccactgtggcaccgattccccatggtctatcaacaactcgaacagattcagcaacggcttgaacacgtcgctgttttgcgtgagccgcaagtccacgcattgatccagcaacagatcaacgctggcggcaaaatgctgcgcagcgggctaatgcttatgctagcgcgtttaggcaaccctgacaacgacgatctcataaccgccggcgctgcgattgaggccttacatctcgcgaccttggttcacgatgatgtacttgaccacgccgacctgcgccgcggttccgataccgtctcagctaaatcaggcaatcgtgaggcaatctatgctggcgatttcctctttgccatctattttcaattattaagcgaacaaaatccagcaacaaccgatttagcgaccaatgcgcgcgtcatgaagcacatctttatgggagaagttgaccaaaatggtcccagcgcgccactcattccaagtgtttccgaatacttgaaagccatcgccggcaaaacggcagcactttttgctttggcaacttacactggtgcgacgatcggccaactagactttactgaaaaaaaagccgcatatcgttttggccgccaactaggcatggcctttcagatgattgatgacttgttggattacacccaaacaactgctacgctgaataaaccggtgctcgaagatttacataatggcattgtcacacttccgttaatttatgcctatcaaaacgtccccgaacaactcgccccactggtcgggaccgcagcaaaaatcgctgccaacagcgaccgaattgcggcaattgtcagtgaacacggcttgccccaagcccgtcaactcgccactcgctacactgataaggctatcaacgccctcgcgccattgcctgatgcgcgcattaagcaagagctacgcaagctcactcagcaattattgcgacgagatcattgatcgtctggacttcatatatgcctatgctttttgatagaaaagtaagtaccggcggataaagttcggctaacaagagaaccagcaaatctagactcagtcggttttctttgtgatcttcctaacgaaaaattaagtattaaatagcccgccacacttgttacatacgaattctgcatcataccgactttttaaaaattgaaattgtaatatttcagcccgacgttttcacaaacattgggctttttcagtggtatgatgtatgtaaagcaaaagtgaaagagtgatcaaacatggcaaaagttctctccatcaacgctggcagctcctcactcaaatggaagctgttcgagatgccaagtgagcgccagcttgcagaaggcgcgactgacatcctgaaacaatcaaccgtcaagatcaagtatggtactgatcaagcttacgaaagcgctaccccaatttgcaattatcgtgacgctgttgccaacctgctctctaacctgcaaacactcggactcgttcaaaatttggatgaaattaccggcattggccatcgcgtggtagctggcggggaattattttccgccccaattgtcattgatgatcgtgttctggcgcagattcgtgctctgcgtgattatgctccgctccacaatccggttgaagccgactgtatcgccatctttcgcaaaatgatgccttgggcacttgaagtcgcagtatttgataccgcatttcatcaaaccatgaaaccagtcaattatctttacagtattccgtatgagtattatcaaaagtatggtgtccgtaaatacggtgcgcatggaaccagcgttcgctatgtgagtgctcacgctgccaaaatgcttcgcaaaccattggcacaaatgcgaatgattgtgatgcatcttggggcgggttcaagcatcacggccatccaaaacgggcaatcggttgacacatcaatgggctttacccctttgtccggtgtcacgatgggcacgcgttcaggcgatgttgatgtgtcactcatcggctatctgatgaagaaacttgccatcaccgatgtcgatcaaatgattgatatcttaaacacagagtcaggcctacgcgggatctccggcattagtcatgacgttcgcgaccttgaagccgctgcgccgactaacccgcgagccaaactggcgcttgatatctttgtgaaccgcattgttaaatatgtcggtgcttatgccgccttgatggacggtgtcgatgtcctagtcttcacagctggcatcggcgaacacagcagtgacattcgggcacgcgtcatgcaatctttagattatctcggcgcgcggattgatgcgagcttaaacactcaaatccacgataacgcaggtgacattactgcagctgattcaaaggtcaaaacactggtcatccccacaaatgaagaattgatgatcgtccgcgacgtcatgtccttaagccaagcagtggcgcaagcggaatagtggtaggcgttcgctagcccggtttctgggctggcgaacaccttttgatcgagcctgagccagacccgtcgaaaataaaattttatagtcagttctgctggcaccagcagcaaaggatcggcaatgttgtcgatcgttttttttgtccaaaaataaccatgttcaactacttgccttttcttcatctgctgtctatactgtgcatatatcacatatacagtatagacacaccaaaggagatgttcgccatgctcactgtcacaggcttaacgaaacgatttggttcagcaactgctgttcacgatgtttccttcacgatccaacccggtgaaattcttggcttgattggccaaaacggcgctggtaaaacgaccacttttcgcatgctactcaatttgcttcaagctgatcacggtaatatgacttggaacgatcaaccgctatctttgctcagccgtgagacgattggttatctccccgaagaacgtggtctttatcccaaaatgaccgttgttgatcagatttgttttttcggagaattacatggcatgaaacgcgctgcggtgatggctgttctggatcaatggctagatcaatttcaggtcaaaggtaagccaaccgatttggtcaaagatctctctaaaggtaatcagcaaaaagttcaactcattgcggccatgattcacaacccgcagttcatcattttagatgagcccttttcaggcttagatccggtgaatgctggcttgcttgaagctggtattcggcggttgcgggatgctggaagtgccattatttattctagccacgacatgggcaatgttgaggccatttccgataaattggtgatgttgaaaaatggcgaagtcgttttatcaggtgccctcaatgatattcgcgatcaattcggccaaactcgcctctacattcaatctcctctcacccaagaacaattgctatccttccccggcgtggtcggtgtcgcccaacgctcccgaggatttctcgttaaattggctgagccacaagccggtcatgacattttcacagcggccacccaacaaggttatattcctgaattcagtcagcaagcaccttccctagatgaaatcttccgaatgaaagttgaggcctagtcatgaaaaaaatggatgtgattttccgccaagtcttcttcaagaatcttaaaagtaaaacctggttgtggatcgtgctcggtccgttggtgctggccgctgttttcggcggggttttttggctgatgaatcaaactaatcaaactagcaaaatcggtgtcgtgacgtccagcccggcattgaccagcacgctgaaagcaagcagtgatgatgatcaacgctacatcagctattcgtcaacggcagcggccaagcgcgcgatggctgatgaagatcttgatggggtcttgaccatcagtacgcaaccaaccacccatgccagcctcattgaacgaactgatggcaatggtatcaaccaaacccaactgcaaagcgtcttagcacaggcacatactaaagaagttgcggctcagttgaaattatcgaccacgcaactgcaaagtcttttcgcgacaccccagctggccaccaccagtgtctccgttgataaaggcaaacttgtcagccggtctgccaagactcaaaaatcaggcgccatggtcgggtttattctcggcatgctgatatatacctttgtcattagctacgcttccatgatggcacaagaaatcggcactgaaaaaggctcccgcattgaggaatccatcctcactgccatcacgccgcaagcacagttttttggtaaactgctgggtattttagccttgatggccgtccaaatggcgatctacggcgttgtgacgcttgccggtggtctcttactgcaacgtttaccaaaaaatccgctatccagtttgatgacgaacattgatctcagcggtatcagcttaaatatgctgcttttcagtctcgctttcttttttgtcggcacgctcacttacaccgttttagctgctttaactggctcattggttgctaatcaagaacaaatcggccaagccacgaccccaatcgttatgctgggaatgctaggctatttcggcgctttgattgttgctggcggaacctcaccgatccttaacatcgccagctacatccccttcctatcgaccatgatgatgccggttcgcctaggcgcaggacaggtcactgctgttgccgggtggtcagcattaggcatcaatctcgttttcctaatcttattcacttggctcaccgtcaaattttaccagaccaatgtgttaagctattcagatggcggcatgttgaaagctttcaaacgctcatggcaactacaacgcgccgcccgcaaacctaaacctgttaaatcatgaaacgaggttaaccatgcggatcgttatttcgaatcaatccggcaaaccgatttatgagcaaattgaagaccagatcaagactgcgattctttctggtcaattaaaggtgaatgaacaactgccatcaattcgcagtctggcaaaagatttacggatcagtgtgatcaccaccacccgcgcttatcacgaactcgaagcagccggattcattacgaatgtgcaaggcaaaggcgcctatgttttgggtcaagacagtgcacttgtgaaggaaaacgctttgcgtgaaattgagacctatctgaatcaagccatcgatactgccaaaatggcacgcattgcacctgaagaactacacacgatgttggatacattgatgcacacggagggagacactgacaatgacaactgatctgctaaccgttacgaacttgaccaaacgctatgccgattatcaacttgctaatgtcagttttagtttacccgctggctacatcatgggcttcattggtcccaatggtgcaggcaaaacgaccacaatcaaagccattttggatatgatcaaaccagactcaggtaacatttcggtacttggtcaaaccacgccacaagcccgcgaagcgattcgcgatcaacttgggattgttttagatggcgcggtttatcctgactcatggccagcagaagctgtcaatcgatatgttggaccgttttttcctaattgggacacggcttatttccagcaactgctgcgtgactttgatattccaaccaagcctaaatatcacgatttgtcgatgggcaccaaaatcaagttacagttagcggccgctttggcacatcatcctaagctcttgatcctagatgagcccacttctggcttagatccgattgcgcgtgatgaattgattgccattctgcaagattttattcgcgatgagcaacacagcgttcttatttcgacacacagcatcatggagctcgctaaagtggcggattatgtcacttatctgttggctggtaaaatcacgttcactggtccactcagcgatctccttgaccgctatcttttgattaaaggcggaccgaacgatttgactgctgcaatcaaagccaccttaattggtttgcaggaaagtccggtcggtttctccggtgtgtggccagccgaccaagcagcaatgttgcccgacaacatgattcaggaacctgtcgatttagaaacattgatgatcgcgtttggtaaaggagggcatccccatgcgtaatgttgccaaacttgtcgccttagacatgggtgcgctttactccggcacgcataaataccgcgggtggtcatatctggttgcttttctgatcgtactcattgccttcttgaatggtgatgccgccacaccacttgctggcgctatcaccggtactagcgttggtatcttgatgatgccgtttgccagtgttgatcgacatggcttggaacagttgtacacgatgctgcctatccgccgccgagagattgtcgccagtcactacctatttggcttgctcgtcatgctgatgattgatctttatgccgcattcatcgttgcagtcggcatgatcgctcgcttcaacccgatacatgactaccatgccattatctggatggtatttttcgcaaccggccttgtcttattacaaatgacattgtcgtttcctctaatgattgggcttggcttccaacgtgccccgttagctgcttatttaccaattggcattgtgttactcgccgtttttattgaggccagcttagatcttgacttagcaggcttgcggccctggctcacggcgttctccatacttttgatcgtcgcctttgcgttttcttggtggctgagtacctatctatataaaaggcgcgaattttaacctgtaaaaaccaaaaagccgtcaccttgctgcttagagcaagatgacggctttttggttgctttattcagttggcaaacaagcaaggctcgtgcatgaatcacgcctcaaccttgaccatctttaaatgccggatataaagtcatcccgccatcaatgaataaggtaatgccagtcacataactggattcgctggatgccagccatgctgcaccagctgacacatcttcaggtttgccaattcgattcatcggtaccattgaaactgtctggtcatactgcgccttgtcagcaaatttctcggcgttaatcggcgtttcaatcgcaccagggccaatcgcattgacccggatcccttgcttagcatattccatcgcaatcgtctgggtaaaaagtttgactgcacctttggccgccgcataactcgcgaaggttggccacggaatttgttcatgcaccgaggtgatattaataatgttgcctgcctgatggtgttcaagaaaatagttcagtgcagcccgcgctcctaaaaagacgccggtttgattaatggcaatgactttgttccagtcctccaaagagacttgatgcgttggttccttgatttccatgccagcgttattcacccagacatcaagtccgccaaaatgcgccgttgctgtctcaactaagctagcaatgccatcttctgtggaaacatcagcatggatgctcaccgcctgcccgccgtttttgatcacggtgtcggcgacttgctttgcaccttcatgatcacctaaataattgatcacgactgacatgtgctctttgccaaatcgttctgcaatggcagcgccgatgccttttgaaccacccgtcacaattgcaatctttccgttcaagtcttgatacatgctcgctcttcctctcatgcgtgtggtcacgcagcggtcacctagaaggtaggccctaaattcagtgtaggggtatggtattagattgtaaaacattgtgctgcactaggatgccttttcaaaagaaatctcaaattccgtctaaaaaagccaaaaaaaaaagccaaaataaatcaaaaacgatttatgagaatcatccatcatttgtaaacacgtgtcttttaggcatttgggattaaatacgcgcaaatattatttagaaacaataaaaaaggctctgtatctttctcttctcaaaaaaaccttatcaagaccgattaaagttcccccgaattattgagattttagtacttagaattaaagagttctaaaatcattattcaaagttcacttggtcacaagtcttttatgcctcttttgcgtcaacaatgtttgatatttaagaccaatattcttctttatacatgttctttaactaccggcgtatagaggatgaattaagtatccggtgagaaataatcggtaaaactgtaagcgggtacattttatatgtgagaaatatcacacagttgttgtgctacttgttgtgaaggccttaacattgctggtggaaagaaaggactgattgttgtgaaagttggcgttgtgaaagagcaaaaagctggcgaaggtcgtgtggctgtcacaccagaaaatgttaaaaagctggttgatgcaggagcgactgttttggttgaaaaatcagctggagtcggtgcaggttttcctgatgctgattacgctgcggctggcggcactatcgtcagtcacgctcagagttgggatagtgatctcgttgtcaaagtcaaagaacctgacgaggaagaatatcagtatttcaaaccaggtcaggtcgtctggggattccaacatttggcctcctcacctgccactgtgaaagccatgcaagctgccggcacgacagcgatcggcggtgaaaccatcgttgaaaatggcgagttggcattgctaaaaccgatgagcgctatcgcaggtcgccggtccgtcatcatgggcgcttattatcttgaagcacagcatggcggtgaaggcattttattgccaggcacaccggaagttgcttcaggcacggttgttattttcggtggtgggaacgctgcttttaacgccgccagtttggcattagccatgggctgtcgcgtcacaatcatcgaacttaaaaaggaccgccgtgactggttagcgaagcagtttacaggtgaagccttgacgctcctgccatcgacgccagagaatctcgccgcggctatcaagaccgccgatgtcttcatctcaaccattctgattccgggcgcaaagccgccgaagttagtcacaacagcgatggtgcagtcgatgaaaccgggcagtgtccttgtagatgtagccattgatcaaggcggcacggttgaaactattgatgcaccaacctctattgatgatccggttttcaccaaatacggcgtcatccattacgccgtgccaaatcaacctggcgcggtgccacgcacagcgacgatggcactggcagttggcaacatcaaatatcttttagcaatcgcaaaatctgggattgatggcgccattaaaaatgatcctgcgctggcttcaggcgtcaatctttatcacggccaaatcaccaataagggccttgctgaatcattaaacttaccgattgtttcattagaaacagcgctcaaaacgcaacattaggaggtggataagatgatgaccgcaacgcaaaccgtgagtataaaagatgttcaagaggcaagccatctcattcatgaggttggccgagtcacaccgctcattcaatccatgtttcttagtcgcaccgttacccacggtgatgtgtatctcaaactggaaaacatgcagctcacaggttcatttaagtttcgcggtgcttataacaaaatccgccatctcagtgacgtcgaaaaagctcgtggtgtcatcacggccagtgctggcaatcatgcccaaggcgttgcattgacggctcacttactcgacattgatgcgacagttgtgatgcctaaaacagcgccattagccaaacaacaagccactagcggctatggtgcaaaagttgtccttgccggtgatacttttgacgagtctcgtgccttcatggaacaaaaggccaaggaagatggcctaaccatcgttgacccctacaatgatccattggtcattgccggacaaggttccatcggcttagagattttagaccagctgtgggatgttgataccgtcatcgtaccagttggcggtggtggcctgattacggggattgccaccgttctgaaacattttaatccctatattcacatcgttggtgtccaatcagaaaatgtccacggtatgacggcctcgttgcaagcacgcaagttgacccgacaatgtactggcccaaccctagctgacggcacagcggtcgccatgcccggcgatatcacctttggcctagctgaggaattagttgatgagatggtactcgtctcagaagaagaaattgctgaagcgatgaaagaccttctccaacgcaccaaaaccgtggcagaaggcgccggtgcattaccaacagcagccctcgaggctcacaaaatcgcaccgcaatggctagtaggcaagaaagttgttgcacttgtctctggtggcaacgtcgatttggaacgggtagcagataacattgatcatttctttaaaagtgatccgactgggcacttcatcggataaaaacagagcgtgagctagcgcggtttctgaactagctcatgctctcaccataacgcgctcgccagcgctgaaacccgcgctggctcgcgctcactttcaaaaggggggaagcaccatggaaaagacgttttcgaagcataccgttgccaagacacattatgtgccatacgcaacggatggtgccaaggaaaatagcggcggcagcacagcgatcatgatcatgggcgccattttggcaacgatcttcgcagcatctaccgcctattcaggcatgaaagccggcctaactgttgctgctgggattcccggttcgattatcggttccggcatggtcggtgtctttgccaaaaagaaaggtatttttggcaaaaatcttttgcaaggcatgagttcaggtggtgagtccatcgccagcggcatgatctatgtcttgccagccattatcattattggtggaaaagtcaacttcttcgcaggcgtcgcagttggcgctttggccgtattgtttgctgtcggtgttgcgagtttagttgaaaactacttacttgtcgaagaaaacggcaagctgatgtacccagaatcgacggctatctccgaagccttagatgccagtgaagcaggcggcgattcgcttaaacatatgggcatcggctttggcatcggcggtatcatcactttgttgaccactcaagttttcggctgggtgaacagtgtgatgaccttcgtcggcaactcgtcgtatcgctggaaaatttcaacagaggtcaatcccatgctagccggcatcggctttgtcgttggcttggatgtttcgctcaccatgtttgccggctccattttagcgaacttcgggatcaccccgctcatcgcttatttcactcaaatggctggtggcggtgcccatgtttggaatgacacccatatgttgatgtctcaaatgaacatcgacatggtcgctggctcctataccaagtacatcggcgccggaatgatgctctgcggtgggatcattggcgccattaaattaattcccgtcattgtcacttccattaaaaaaacattgaatgcacgcaatgatgtcggcgaagagaagaattcgctcggtgtggtctccctacttgttgctgccatcgcgatcttcatcgtcggtgctttcttagctggcaacatcgtgatcgctatcatcgccggtattttgtcactcgttttagccttgctgtttgtcatcgtttcggcgcgactggctggcacaattggttgttccaatgcgcctgtatcggggatgaccattgcaagtctcgtggtcatgaccctcgtgtttgccttaatgggctggaccgccaacgcgcataatgaaatccttttgctctttggtgtcttcattgtcaccgccatttcagtcggcggggcctatacccaaacgcaaaaagttaattatttggtcggtggccgccgctccgaaatgatgaagtatttcatgattgctgccttgatcggtgttgttgttgtcgttggtacaaccgtcatcctcgccccgcaactggccattaagagtgccaacccaccattcggtttaccacaagctaacctgattgcgaccctaaccactgggattctctccggtaatctaccgtggatcatgatcatcgtcggtattatcatcgcgattgtctgctggatgcttggtctctccatcatgaccgttgccttaggtttctacctgccaatctccacgacatccattatcctcgtgggggccttgctcaaattattgatcgaaaaactgacgaaagacaaggccttacgcgaaacccggttatcctccggtgtctcgctttccagcggtttaatcgcgggcggttccatcattggtctgatcgggattatcctgcatgtcactggtgtgttatccaatcgtgttcctgcaggctttgctggcagtaatggcatggctgtcatcttgctcatcatcatggcggcaaccatcgtcatcccactgatgcgaatcaaacaaccagcgcgcaaggctcaaaagcaataaagaggtgtgacacatgactgcgactgacacattacaacatttgatttatgaaaaaaatccagcaattcagtacactaaaaaaggcggaaaaatcacgattatccgtccgcagaatcacccaatccaaaaattctgtcggcattatctgcacatgaagattcctgccgtcagttacctacacttagatgcatacggtagttttgtattcagcaagatcaatggtcatcgcagcgccgccgttattggcaaagaactagccaagaaattccctgaagcagacgatcaccgcgatgaccgcctgatgatctatttgaaccaaattgccaaaaatgaccaccttattcagcgtctcaacgcaaatacacgataacacgctcgcagtcgcacaaaactgtacataaggaacttgaatccaatggccaagttcgggccatttggattcaagcccgcttatgctccggtttctaaacgctcctgctcgcgctcaactattggaggaaatcaacatgattgatcgtattgaaatttcagcttgcacatccatgatggtcggtaaaaaagcatcccttgatggtgcgacctacatttcccgcaacgaggatcgcttagtcgcaatctatccaaaacgttttgtggttcaaccagctgtaactggccgcaaggaaacttatgtatcgccatataacaacctgactgtgccactccccgaatccgggtatcgttacacatccacgcccgatgctgaccaaagcgccggaccaaatgaagaagacggttttaatgaaaagaatgtcggcgaaagtgctaccgaaagtgtttatgccaacgaacgggtacttgcttatgatcccttcatcaaaaatggactcgcggaagactccatgacaactttagtgttaccgtttatcaacagtgcccgcgatggcgtccggtatctcggcgaactggtcaaaaagtacggttcagctgaaggcaatggtgtccaatttaacgatcaagacgaagtttggtatatggaaattgtcaccggtcatcaatgggtggcggttcgcattcctgacgattgttacgcagttgctgccaaccaaatcgcgattcaggacattgatttcaatgatccggacaactatatgtgggcagatggcattcaagatttcgtcaaagatcacaacttgaatcctgacgccgatcactggaacttccggcacatttttggcaccgacactgaaaaggatcaccactacaatacaccacgggtttggttcgcccaacgctaccttaatccagaaattgagcaggatccggaatcagctgaattgccattcattcgcaaggccaaccgcaaaatttccgttgaagatattcagtacattatgaaatcccacttcaatgaaaccaagtttgatccgttgggtcatggcaatgaacacgaccgcaagacttatcgcgctatctcactttcgcgcacggccaactcgcatattctgcaaatgcgcaatgccaatcaaaatggcgcagccggcgtccaatgggtcggcttcggtatcccggccttttgcccgcacgtaccgtttttcaccaatgcaaccgatacggataagagttatagcgagttcccaaagaagatggatctgagctcagcttattggctctatgaagcgctcgcgatggttgtcgaatcgcattatgctgagttcatcgaagacgacttagcttatcaaaaagatctcaatgaatgggcacgtcgtaaaattgctgaagttgatcaagctgccgccgggatgagtggcgatgacttaaccacgtatctgactgaacaaaatcatgccattgccaagcactacaatgacacaacccgtgatttcctgttcaagctcatcacaatgggcactaacttatcgaagctcaccttcaagatggatccaaatctatagtcaaatttaccaacattcaaaaagacatcgccgcagcagttcctgctaaagcgatgtctttttgaatgccgcttatttgttaaaaaattgccgctacagcctcaccgaattttatgccaagccgcagcactttcagaagggaaaatatgggccatttgccacatttgttgcttactgaagtggaagacaattgctggtaataaggtgttgatcgcatcttccgcttgggcactgaattcagttgcgccaaccaaatgatgatcccgatcaaagatgaggatgctatcgcccatcgtttcctgatcggtttgatggtaccagtcatccggaatatgattgcgaacaacttggtaatcgccatcagcagcttcttctggcatcacacctacttttgcaattcgcggagttgtgtacacagtcgatggtatcgctggatagtcaatggggtcggttgtctggccgctgagcaactgatacaggtaataggattcgaaagtggccgttggggtcaacttgggttgtggcttgtcgagcacatccccagacgcgaaaatgttcggcacattcgtctgcaaatgatcgtcaaccgggatgccgcgttgattaaaggtgacacctgcagcttctaacccaatttgatcatcattaggaatccgaccggttgcatctaacacccagtcaacttgttgttcctgatgatcgccatattggatcgcaatgccttgcgccgtctgtttcaatgcctgcacatctgcacttgagataaacttgacgcctcttttggtcatgtctgccatcaccgctttgacaaatggctggtgaaattcgcgcaacgctttgtctgcatgcatgaagacgctgacttcagctccggcagcattggcaatcgtcgcaaattccatactgatgtaacctgatcccaaaatgccgattcgttttggcaatgttttcaagtccatgaacgcgcggctatcatgtgctaattcagttccggggatgtcgaggtgatgcggacggcgcccagtagcgatgaccgtgttttcggccgtataagttttgccagcaactgtgatgctatgcggatcaatgaatttcccatgcccgtgaatgatcgtcacgccggtttgtttgaggttactgccgatatttgtcggcagcggtttgatcactgcttgtttatgtgccactagctccgaccagttaatcgtgatgctgccggacacgatgccttgcatgcgttcggccatacgttgcaacacgactggtgtgtccagcgtgatttttgcgttacacccataattagggcaagtgccgccaatcatgtcgctttcgatcacgccaactttctttcctgaagccgctaacggtccagcaccatcgaacgcgccgtgaccactacctaagtacaagacatcaaaatcgtattcactcatattgatcctccttgtgcagtgcgtctgtgacaacggcttaagcataacagattgacgacgactcggtcacggacaatgaactttattttctgataaactgctcctagctcataagccaaaaagaccaacaatttctcgctgtacagggaaattgttggcttggttgatggctattaatgaagtcccgttctgtttctgatactaattaaaggtcgcgacttgcctgtggttttttgacttggaaggcaacgatgagtccgataatggctaggatcaaaacgaacataaagccaaaatgcgaaccaattgtcaggccagtttgtccagcggctttggccgaaccgagcgcgagcatacttgtggcaacagcagttgaaacggcgccgacaatttgctgcagtgtgttcagcaaggcactgccgtctgcgctttcggcaccgctcaaactattcagcccatatgtctgggcaggtgacatcgctaacggcgcgccgatcattaaaacaacatgccctaaaataatccaccataacggactttgtgcaccactattaagcaatatcaacacgcctaggatagcaatgacaaaaccaccgcgggataaccatttagcaccgtggctgtcatacatccgacctgcaatcgcagaaacagcagcgttcacaatcccgcctggtaacatgacaagtccggtcatggcaactggcaggcccatcacccgttgcagatacatcggcagtaaatacatcgaggccagaatcaccccaaaatcaagcatgacgagtaacgttccgacagtaaactgtttattagcaaaaacgcgtaaattcagcatcgggtttgttaacgataattgacgccgggcataaagaactaaaccgataaccccaacgagcaaagcaagtccgacttccagcgaaagccagccagcatcactcgccatcgttgtcccaaccacaatcccagcaaagccaatcgacgattcaacaattgacaaccagtcgactggtgtttgcgtttgctgataaacattttccatcgaagttaatgtgaaaatgaaagccaaaaccaagaatggcacgaatagccaaaaaatgtagtgccaagtgaatttggcaagcaccagcccggtaatcgttgggccaatagcaggcgcaaacataatcaccaaagcagccatccccatgactgtccctaatttatatggcgggaaaatctgcatggcgactgaaaacatcagcggcaaaatcagccccgtgccaatgccttgaatcaatcgcccaataagcacaaccggaaaaacagcgcccatcgcagacacaaccgagcccagaataaaggcgccaagtgcaaaaagaatgatctttttagtgttaaaccattttgataaaaggctggataacggcatgcagatcccgataaccaacatataacctgtgactagccactgaatagtgccttgtgacacattcaacgccgtcattaaactaggcaacgcaatattaagcgacgtctctgaaaacataccgacaaacgccccaatcatcaagccgatcatggccattgctggatgagctacgtgaacgcgagcttgcggcatttcttttgtttgtgataattgcatgataacttcctttttagtgagcgcgagccagcgcggttagcaaccggagtgtaagtggccttgggcgtgatggtcgcactttgaccattgcgaccaaggtccttacacgcaggttgctgcgctggcgaacgcgttaaatgataaaaacaaacaactggcattggctttatgcggccaatgccagcttgatcaagcgggtcagttgatccgcggtctgtcgcaacaagtcaggattgtctttggttgcggcaagaataatggcgccctcaatgctggcttgaataaattggccaagtggctgggcacggtcaggcggaataccggctgacgtgagctttttgatgtacagcgtttctaactgggtaaaaacagcgctgcaagcggcctgcaactcaggatcatcgcctgtttctaaggctatcaagctaattgaattgccaccaagatgccccttttcctgcatttcggtcgccatactttctagttgtccagccagcgcagcgtcaggcgccttgtaccgatcaaggtcccgttgcacatgctcaagaatgtgctggccagcataagtaatcgcggcttcaatcaattgcgctttaccgtttggaaaataataataaagtgagccctttggtgtaccactgaccgttaaaatctgcgccaaaccagtagctctgaccccttctttttgaaagagactggcagccgttgccaccagtttttcgcgtgtatccatttgctacctccactattataacaaccggtctatataatactgcttattttctgaaaatgtcaattttatttttttatgcatgaaaaaatgaccttctcatcagaaggtcactttgcaaaacgattattaacctaaatccgttccattggaagcaatcacccgctgataccagttaaacgattgctttttgtaacggtttaaactgccttgcccagcatcgtccagatcgacatagatgaagccgtaacgtttcgacatttggcctgaagaagcactgaccagatcaatgcagccccatggcgtatagcccatcagatccacgccatcatgaatggccgcgcccatttgttcaatatgctgcttcaagtaatcaatccgataatcatccttgattttgccatcagcatccggtttatcaacggcgccaagtccattttcaacaatgaaaagtggtttacggtaacgttcatataattgatttaacgcgatgcgcaggccaatcggatcaatctgccagccccattcactcgccttcaaaaacggatttttgacgccactaagcaggttgcccccgacttcagcatgttctttttcaactgtttcgactacggcggacatatagtagctaaaaccaatgtaatcaaccggatgatttttcagcagtgttaattcctcggctgaaaaattaagatctgtgaatttaaacccgttgtccgccatcaacgcgtcggtataggctgggtactcgccgcgaacctgcacatcgccgcaaaagaaattaaatgcctgattttgctgcaaggtcgccaattgattcactgggttggcatcatagctgtaagtggtggcataaagcaacatgcagccaacttgaagtttaggatcaagcgcatgtccgattttcacggcccaagcgctggcaacaaactgattgtgccatgcttgaaaaattgtttgcttgtcattgccgccattattggcaaccaatccttggctcatcaccggaaatgcccatgcactgttaatttcattaaacgtcatccaatactttacttgcttaaagtagcgagtcaaaactgtttccgcaaaatgcttataaaactcgataagacgtttatttttccagccgccatatttggtcaccagatgcaacggcatttcgtaatgtgaaatcgtgacaactggttcgatatcgtatttcaagcatgtcgcaataacctcatcataaaatttcaagcccgaggcatttggtgttttctcatcaccttctgggaaaatccgtgaccacgcaatcgaaaaacgatagcatttaaatcccatctcgctgaaaagtttgatgtcttctttaaaacgatgataatgatcaatgccttgatggtttgggtagcgatacttgcttttgtcgatggtccagttgaaatctggccgattcacaattgcaaaacgatccttgccttgtggtagcacatcggcgactgaaaggcctttgccatcttcctgataagctccttcaagttgattggctgccgtagcaccgccccataaaaaattcttcggaaaatttaggtatgtcattggtctgctctccttaaacacgctcccagccgcagaaaccgcgtctgctcacgctcttttaaaacgccttcactggcgcagcgcggctatgtgaagaacattaaaggcaaccagccgatcacccttaatgccgcttcgctacgccgcgcttaccgcgccagttcacgctctttacgctaatgtcatgaccggccgatcatcggtggctccttgtccaagcgtcgcgatttgatactggtcggaattggtcacaatcatcatcacggtactttcatacccttctttttcaatggcttcgtgatcgaattgcaccaatggcattccaatttcaacgtgctgtccttgtgccacaagtggttgaaaatgtttgccttttagattaaccgtatcgataccgatatgaatcaaaatttccgagcctttgtccgactgaatcccaatcgcatgaccggttggataaagcagtctaatcacgccagcaacaggcgccttcactatgccgttttcaggaacgattgccacacctttgcccatggtctcagatgcaaagacctcatctgccaagccggttaacggcacaagcacccctttgactggtgctgctaacgcttcgcctagttcgctgttggcagaaggcgctgttttggtttttgcgcctgcgttgataccgccaaaaaagtaagtgagcaccgttccgagcgcaaacgcaaccacatcgccaaccacagaaagtccaaagcctttgccaataaaagttggcagtgaaagcacactggccaaagcagcggcatttgccccggcaccggaaatcgcaacgatcataccgccgactgctcctgctacacaagcaaggtaaaatggctttttcaacttcaatgtaatcccataaattgtcggttctgtgatcccgaatagtgcggtaatggtactggaaccggcaagacttttcattttggcatcacgcgttctaagaaataccgccagtgctgcaccagcttgagacagcactgctggcagcagaatcggcatcatcaaatcggttccattctgagcaatattgttcatcatcaccggtaccagtgcccagtgaacgccaaaaatcacgatcacttgccagaaaccgccgagcactaaaccagccaaaattggcacactcttgttcaacgacacaatcgctgttgccaaccaactgctgaccgtcgcactgatgggccccaccacgattaacgtcaagggcacaataacgaccaacaggcagagcggtgccataatgttacgaacggattcgtgccacaacttgttgaaaactggttctaagaatttttgaacaacaacaaccaacagaattggcaagactgtcgcggtataattcgccggcacgactggaataccgaaaaagtcaatagttgttgcctttgcgcccaacgcgacaatgcccggcgacaccatcgccgccgcaatcgccatggacacaaactgattaaccttgagttgtttagcagcggtaaatgctaaggcaattggcaggaaatagaaaataccatctgctgcggcccaccaaatttgatacgcgccgcttttcgctgttaaccagcccatgaccacggccaaagatagcaagcctttcaaaatccctgcgccggccatcgcgcccaagaatggcgtaaatacaccggaaatgaacgttagcaggctgttaaaagcgcttttgaacgtcatttttccttgtgcggctgtttcaccgctagtttcgccttcgcttaaagatggttccagtttcacgacttcatggtaaacatcaccgacattgttaccaatcacgacttgaaactgaccactggcttcaaccacggtgatcacaccatccaacgcctcgattttatctttgggtacttttgcacgatccttcaatgtaaaacgcagacgagtggcacagtgccagacctgattgatgttttgtttgccaccaatcagatttaataattgctgagctaatcctgattcattcattcggccttccccctttagctacacatagctacacttgcaattcccacagcgagtgatacggttcagtatcttgcatcacgatgactgcacttcgctgtcaggtgttgcattctttcttaaacgcgatcgctagcctacttacactccggtttctaaccgcgctagctcacgttctttctcaaaacgcgttcgctggcgcagaaacctgcacataaggacctgaagcctaaatggtccaagcccaaccatttaggcttcaggccgcttatgctccggtttctaaccgcgccagctcacgctccacaaaaaaagccagaaagaccggacttgtggtgtacaagtcgtgtctttctggttttgcctaatccaatagttacaagccagatggttctgtattcgctttcaacgacaccatcttatcgtacgcattagcacgcgtcaacaacttttttcactccgccaaactttttgctaagcgcgcaatatgcatggtgagatagatttgctcgtttttaggaatcgcaatcgctaacttctgttgcatgaatcggtcaacgtcttccatacagtgataagcacgggcataatcttgttgaagatgtttcaacaagacatagtcatagttttccatctttaacgacaaaggcgacggcgcagcagcatacatgcgttgtaagaaaaatttgaggtgaataactagtcgctgataatcaggtgttttgacgttcatgtccagccctagattgtaaaagattattttcgtgagactcgctagggtttgggtaaaggcgagtgagttgacggtttgctgatggttcagatcgttgctcacaaactttaacgcgatgaatcccgcctcatcttccggcaattgttcatgcaattgcgcggcgatttgatgcaatgcccattcgcccatctcgtattcttgggtgtaggcaacctgaatctcccatagcaatttgttgtgcaatacaatcttctcatgcagccgttgcaccgcaaaatgaacatgatcggctagctcaatcaacagataactgttgaacgtggtttgcaatcgcttttctgcctcctgaatgattccagcggccaaatccaaataagcactgggcagactggcaatcgtcgccgtcgcgattttcagctttgcttgatcctctggcacatagactttcatactgtcgcgcaaggccatcttggcgtcttttttagcgcggaaaccgatcccacgctcgaccacgatcacctcgcgttgttgatgtctggccacgacagcattgttgttcagcacgttttgaataatcatggcgaccctcccccaaaggtattcgaatcttcactttgtcgtattctcaaaatagcgtaacaatgattttaaaaattgacaacgtgaacgactcagccgccgaaaatatcgacattcaggtgggatctttatgcctgttatttaggcgcggtgctggcagctgaaacccgatgatccgcaaatcggtacagccgatcagcataagccgccgactctgcacgatgcgaaatcatgatcacgatgccgtgatagtaagccttgatagcgtccaaaattaatcgttcgttttcagtatcaagattgctcgttggttcatccagcaccaaaacgctgcttgggtgtaacaaggctctggccaattccagccgttgttgttccccactagaaaattgcaattgtcctgatacgacattttcatcaagccccttttcggcctgacgcaaccgcgacgtcagcttgacttgatcaagcacggtccagatttgcgcatctgtgatcgtcgaatcgtgcaacgtgagattgtcacgcaccgactcagagaaaaagactggcgtttgtggcaaataattcacctgcgcgcgcagtgatgctggatcaattttggtcaggtcaatgccatcaattaaaattcggccttgggtgagcggataccaacccatgatcaatttggccaatgtacttttcccagatccactggcgccaacaaaaccgacaatctcgccggcatgcaaggacaacgacacttgccgcaaaacggtctcgtcacggctaggatacttaaaggtgacgtgatcaacttgaatggtcgcgatttgatccagtgtttgggtagcgtcaatcgccgctgatgttgctggcgcctcttgcaaaagattcaacaaattgcgagccgccgcaaaaccattcaatagcgaggctggcaaattggttaaagctaataacggtccgaacgtgagcggaaacacggccaataacgcttgctgcaatggctgcggctgagtccaaccgctcaaccacacaatgaatagccacgctaccagaatcaccaacgtagcactcatatttttcaataattgaccaaactgggattgttgaaaggcggtcgcctcatgatcaaatccctcattgcctgttttcatgcgcgcatcagcaacctctaactgacgcaaaaccgccatgccgcgaacggattcaagcaggtactgctgattaaccgctttttgacgatccgcagcctgagccttcgccgtcatctgctcgtgccgataatacggaattaacagcccgacagccgcatagctcaccaacacaacggccgccgccggaccatttaagctgctataaacggcaaccatcaggacaccataaataaggccaatcgcaaccggaacaatcgtatgtgcgtagaaaatttccattgcctcaatgtcactgccaatcagtttaagcaacttgccgctgccttggctatcaagtttagcaggcgccaactgcaccaattttcgataaaccgcaccgcgcaattcggccaagacgtgaaacgccacaaaatggccagcatattgttcaccaaaactacccagaccaacaatcaccaccgcgatgatgccggggattaaaaggtgtgaggcattctggggatcgaacaacatcatcgcagccaaaactaaaacgacgacttttgttaattcggcaaccaagccaatcagaaaactgatgataatagcccccgttaagtggtgggtgtaacgcagtaaacttctgatcatgatggctgaccttctttcaacattgcctcgggattatcaactaagtgacgatacgctggctgatcgcggtatagctgtgcatgatccgcgctgattaactgatgatcgtgaataaaccaaacaacgtcagcttcggccattgctgacagatcatgggaaataaacagcacaattttctgacggctcagtcgcttgatcgccgctaaaataatggcagcattcgcagcatcaatacttgatgtcatttcatcgagcaaatacaccgttttgtctgccagtaacatgcgcgcaaaggccaactgctgccgttgtcccggcgacagcaaccgcccaccttctccaacttcagtggcatagccatcttgcaaatcagtcacaaagtgcatcaatcccaattcatcaagatgttgctgccactgatcaccaaattgattgcctaaaagcagattttccttgatagtgccggaaaaaatatagtcattagcagccacatacccaaacaccgccgcgcgttgtgcgttgctcaacgcagtgacgggcgtgttgtcagccataatcgtcccggataatggtgtcagttgccccaacaatgcctgtgtcaacgtactttttcctgtaccattttcgcctgctaacccatataacttacccggaacaagggtcgcattaatgtcggatacaagcggtgcgtccgcttcgtaaccgatagcaacatcttgcaaaaccaactgcttcagcggtcgattatccgtgattttgactgttgcaggtgtcgtcttagacttcgcaatggttgccaaaataccggctagtgccggaccattcgacttaaccacatggaaaaagtagccaagttgacgggcattcaccatcatcatggccaatgcaaaccaagtggcaaatgccccggcagcaggcagttgacccgcagcaagttgcagtgccgtcacaaatccgccagcaaacactgtcaaataaacaaaaccattgataacaaacaatacttgcaattgcgtgcgcagcaaattcatggttgcctgccgaaaatactcactatcatcggcgaactttttagcataccgatccgctgcattgtacatcaccagtgtgttcatgccgctcaaatcattcataaagcgaccacccatccgcagaaagccggcaagatgcgccttgttttgcgctgacatctttttccccaaaaacatcatcgcaaagccgattaaaaaaacgcaggcaagtggcaaaaaagccagccatgaaccataccaaaccgacaagccaatcaacagcaaaaaggtaagacctgcttggattaaggttggaaataaggtgctataaaacatatctaaattattcaagccgccaagatcgcgctgaatcaccgcattatctgcagccgttgcatcccctgcattgttacgctgatacagcgcctcgaaatagtgatctcgcaactcacgcttagcactcatagcccatgcatgacgatgatggcgctcatagccaatcacatatcccagccaaatcaacactaggatcactgtgatgatcagggcattccccggtcgctttgccgcaaagttcaacgctatcatgattggcaacagtgttggcaaccagtcaaaaacagtttcaatcaccccggcccaacgctggtcacggccatactttagtaatcctaacaatgatctgcctctttcttccttgcctcgacacatgttgactttcatccgcaaatacggcaataatctttaaaaatttaaattgtttttttagtttaccacgagaactcaatcgtcttgcaaacatttttcgacaaccttcatcacataaaagaccgtcaccagctgacaacaggctagtgacggcccgggactctcattatgggtgaaccaagccaccagtgtcaccgctcgttcccgtacctgcttgtgctggcttgatctcaatcagcagtttatgcggcagacaaatactttgctgaccaacctgactgatccatcctgtatgaacagcgatttgatcaggtgaattgtcttccttatcccgaatgcgcgccccttgcacttcaatgatgttgtattggccctttgccggatacaacgtgaactgctgatgacgcgtatgagtagtgagttgaatacgccgtttaacatgaccgttgatcgaaattacagccactttttgatttgtattcacgttcgcttccgtcaacgaaaaaatgccaaccggaagaaaacatgccacaaataagacgatgacaatcacataatcaaacggtcgaacatactttttcaaccagcgcactcgaatccccccttgtcgccgtctattttacacgtcatcaacatgcatcgtatgcacaggtgttgctattttttcggctaataaaaagcaaaaaagctacgaatctcataggactcgtagcctttttgaggttatcttcatcaacctgacttacttagcggcttttgcggcactgataatcgcggtcaaataacccgacgtatcagtaaacgttgcaccagaaacgacatcgctgactttctttttgcccttcaagtcactaacagctgtttcaagttcagcaatcgtctttcctttagcaaattcgtcaatcgcatttgagttttcttgccaagtctgggttgccttgccttttgacttcataattgctgaataagcttcggaattggcccgcttggaagctaacacggtgccagatttgattcccttgccaaaatcggcattggaattaggcacaccgccaaaatctttacttggcatatactggaattcatccaagaagacattcgcgatcttatccccttgcatggcgaccgtcacgattccaaatgattgggtaccatgcggcgcagcaagcacttgcccttccgtgatcgtgttgtctgttgtctgaatcccttcagctaccatcccggttgttgcggcgtcatagatagcctgtaagtaaccagccgtgtcagcaaaagttgcaccagaaactacatcgctaaccttcttagtatctttaaccttggcaacatccgccttcaaatcttcaatctttttaccttttacaaaattcgtgatggctgtttcgttttcctcccaagtatgggtcgccttggcctctttcttcatcaacgcagagtacggcttgctattttccgccttggcaatcaaaaactggcctttaggataactcttgccaaagtccttgtttgaattcgggacaccagtccaatcagaactctttttgacatactggaattcatcaattttggctgaaacaatcgtgtcgccattcagcgtcacattcacagccgcaaaggattgcttgccgtgcggtgcagcataaagctgacgcatcactaaggtaccggctgccggcaccttggcactcgcatcagcgccggtattgatcttcaccttagcgttactcgtctgactggtcgtactactgctcttgctcgaactagagctcgatccactactacatgcggccaaccccatgctgaccaaaagtgtggcactgagcactattagttttttcatgtcgttcttcctcctcgttgtgtaagcgatttcatatataatgaattctatcacaaggtattcaacttagcacccaatttctattgggtcagttcctctgatacgtctctcaactcaggttgcgactgacacagaagaacttcgttaattaagcactgatcgaaaaaagtttagacaggtatgcctgctgtttcacaataatcgatgatgttcgcagtcatcaaacattttgaaggacatgagcactcgcatatgttttcccttgaagaaacttgaatgttaaatcatattgttacaggcgtcactgcctatattcccactacagaggcagttgtgtagtcagcaaatcggcaatattaattgagtagcagatgtcatagtcaacaccagcaggtacgttaaagacatccctaactttgaagcatggctgacggcataataaagatgttagcggtccacgaaaaccgcaccggcaattacctgagttgctagagccatcaatattgcgaacgctaaccagaccgaagacgttaaagttgcggaattggttatttctagcatgagattgactctaaaatccgccaattcattttctcggaattatgggtcatttaaatgattgattcgacatctacctgagaccgcatatcactgagcatgtgcgagatcgtcgctcttgaactgattgattcgacatctacctgagacggactgtgcggcatggtgtacgtttaacgtgctcttgaactgattgattcgacatctacctgagacccgtgcgcaaagagaaacgatacaaagttcgctcttgaactgattgattcgacatctacctgagacccagtttcgtgagacagagcggtcaacgttgctcttgaactgattgattcgacatctacctgagactttctagaaggacatgagatacttgacagcgctcttgaactgattgattcgacatctacctgagacagtaaaaaatgtgccttcgctggctttcatgctcttgaactgattgattcgacatctacctgagacaaatacccgtgccaacgctgctatgaacaagctcttgaactgattgattcggcatctacctgagacggaccaactggtaaagacggggtaagcctcgctcttgaactgattgattcgacatctacctgagacaaggggcgtctttctttatatcatcggcttgctcttgaactgattgattcgacatctacctgagacaaatcgattaaggaattcaagccagatagcgctcttgaactgattgattcgacatctacctgagaccgtgggcgatcaaagatggcggcgaaaggggctcttgaactgattgattcgacatctacctgagacggcgtgtccaagcgttcggcgtccagttctgctcttgaactgattgattcgacatctacctgagactcagtatacgccatgccaccgccttggtatgctcttgaactgattgattcgacatctacctgagaccggggcaacatccacatctaagtctaacacgctcttgaactgattgattcgacatctacctgagacgggccactgtcgatcaaatgcatcatccatgctcttgaactgattgattcgacatctacctgagacttagcttgaatgaggttcgcgaacgtttaggctcttgaactgattgattcgacatctacctgagacgctgaaccacgcttttgaacttttgtttttgctcttgaactgattgattcgacatctacctgagacgcaccccagccatgcgccgaggcaatgccggctcttgaactgattgattcgacatctacctgagacaaatgcttgggatggcgtgagcatcaagtggctcttgaactgattgattcgacatctacctgagacgtgatgcaggctgtatgattttttttgtatgctcttgaactgattgattcgacatctacctgagactgtgccgcatgttgaatccgtgccgactcggctcttgaactgattgattcgacatctacctgagaaggctggtcagtgctgatgacaaaacttaaggctcttgaactgattgattcgacatctacctgagactggcttagggatcactcaaaacacattcaggctcttgaactgattgattcgacatctacctgagactacagataacgctgaatgaatgtaacggaggctcttgaactgattgattcgacatctacctgagactggtgttttcacacaatctcctaatcaatctagttcgcgactatcaacgaagtcctcgtcaatatagatatactggcatttctcaaagtatttccttcggttcacttttgagaactcaatgagaacaacctgaagttctgtatcgccgatctgttcagtcaccgcaaagaaatctctggcacttaaataatgactgacatttgtaagaatgacaagtttcatttcctccaatttagttaacgtctgaataagcgcctcaatcttcgaggttgactctgtcgtgacagtctcatcaaaatgaacgttgcagtatttcatgatttgttcgagcttaccgcctggttcaaccgtgactggcaagtcgctcaagaatggatcttgaattaaatccatcgccatttgttgcgattgatcgctcagttcgacaagccgctgattctcaatcagcaactccatcctcttatagattagacgttgaaaaagtttatctagatcaagctctagccttggatcgcctatccacaaactagctttgcgaatctcttgtggctcaagttgatcattgctaagcacaactttatcaagatcattgcgcagcgcttcaattaaatccgtcaacaccttgggcgatgctgtgtcgataacagttacttcagaaggttttgttgttatcagttggaacggatagtaggcaagattcaaataatcaccgtcctatctgccgaattgcgaatgtcttgttttgcttcaccaaccaagaagtgcatcgcctgatattgagcctctgttaccattagcgtctgcacagtcccaatcggcggtttcatggcagctattcgatgttccaaaaattctgctgatttttttgtcgaacacactctaacgtagattgaatactgcatcatcaaaaatccttcgttgatcaacgcttttcgaaattttcggtaatttcgtcgattctcagaagtcaaaactggcagatcaaacatgatcattaaacgcatcactcgatacctcattcggaaattccacctcaattcgacaattgttacgcttgccgtctaaataggctagacagttttcaacgtgctcgtccaatgcgttttgaagaagggctttcttgccattaaatgtcacttctagattcagaagtgctatcaaaccatacttaatgtttggcgtcaggtcagtgaacttttgattagcaacccagtaatcaattgctggtctaaatggttccattagatctgagccaaggttatattgattggcaacgctgctatggtgcatccctatttctgtgatatggccagcacttacgattgctcgattcgttgtagaaagcaagatcgaatacccgtaattaagagcagcatttgttgcacagatatcagagcgtgaaaagtcatctccgaatatgagtttgaaatactttcgagctgcagtcgcttcacgatttgaatgatcattgatttctaacgtatcaaggtcatctaacaatgattggttgtcgtaaccacacagttttgtcacttgagcttgaatgctcaccttggccgcaacaatcttcgtccacaaattttcgaccaagctttttggccaattgacttgtaagcgaaccaagtcagcttttcttcgatcagaatacagattcgttgtttccgtcaccggctgaccatctcttccagaaaagataaccttagcattagcttctgctagtgttgtgatcgcatcagctgatagtagcgctcgagttgttgtgaaaacaacctgattgatatcttcaatcggcacattattcacttcactatcagtttgaacaaccagcgttcggtttttggtcgtcaccttacaatgctgcgtcacgatcaatgatcgccatcccattctgcatgcccccttgtaatcgcttccccaatatgatttaatacaggtgttgggacgacatccccaacgttttgaactgattgattcgacatctacacgttgagatcaaacaaagcctcggctgagtttcaatttctgagcccatgttgggccatacataccgccatccgggaaaacccggatggtttttttacaggtcagttaggcgaacagaccgttcaaaaagccctgttggtgactgatagatgatggaactatcttttgtaagaacaccacttttatcttgcgtaaatccaaatggggtacttatctttaaaacttttaggcttcccgtcatgccattagcttgtgctccctttaacaattcattaatgaccgttatcttacctacactctggtcagtatcatcaaccgccaaatcattgaaagtattttgactttgactgattttctctttaaaccctgcaatagaatacaaatcaaaatatttgacaatttgatcggctaaattgtgaaaaagattgtctaaatcttgatcaacattaggatagtcaatcttggcttttctaatttgttgaagaattttttggtctgaacgagacacccaaatttcttggaaattgtgaaacatggtatctgagttaaccataaagaaaccatactttgcattatagaaaagttgttcacgcggaactcgcggaagcacaacctcgaatggtgtatcagtgatcttaccatttttcccgaccttgctaaattttggctttaggagttcagtaagtactgaaagctcctcagcagttgaccgtgatcttgctttattcaaagctgcaacctgggaagttgcaattttgacaactttaaagattgtctctgtctttttggtcactttcacaacggcaagataggccgtgttctctctgaaatagcccccataaatatcaactggatatccttttttctttggaatgagctgcttcgacccgccagcctccttcgaatccctggccccataaaccgtctgcttaaacaaatccgccgtttcaaagcggacttcatgcgtaattaacatccgcttaaagttatagattcgatccagctcatcaacatcccgttgtttgtcccatacaacctcgccggtatcctttgccacaattttatcttcagcatgtgtgatatcacggataaagttgaacccgcgaagctttttgacgtcggcttttgtaaacttgccgtacgtgaagaaagcctgtaaattagggaatcgcttgagtaaataggtaccaatccgagcggctaggaaggcatcaaaagcatggtggtagtgattaacatcacgattcttagggaattcgagttcttcccgcaattgatgtgaaagacctgctttaacggcgataattttggtatcagggtactgcgctgctacaatttgttccgtcagcttgatgatttgtcgagtttccaccaattgtcgggcaacaaagccgctcgcgtacttatcgatttgatctggacgcatttgcagattacgcagtttgcgaccgctaatcagccctgcctcatgccattgacgccatgtcgcgttcatcttttgagcatagatggttgatgcaaatgttgcgtttttctctcggttgataatagcgtgcactaatacacgattatctaaagagttatctttgattagcgattgtggcagaatatggtcgatatcataactacttagttgatcaatatttagtggcgcaccagtgtagatatcacgcccaccttgcatgaaatacagcactagtcgatcattgaaatcggccttatctgaaatcttatcttccaattcaccgcggactgccgtatcaatcagctcgtgggccgcattcgcgtatatttcctgaagttgatgttgacgcgcacgagtgcgcttgcctggtgtaccaccgccatccgcggtttcaacgtacaaccaactaggatcttgaccatccgcagcgcgtttaatatcatcaacaacccgaagaacctgacgcaatgcctttttattgcttggtgatgtatacgcattatcaatcgcatcattgatattcgctgttttcaatttatcagcgttcagctcggtcattttcttttgtagcgtttcatctgttagtatctgcatcaagttgttagtggacaggagcaattcttgaatgatagtatgcccgttgccaagggtcagaccatttaaaaacttgcgcgaaaactggccccacccccgatatcgaatgttgcttagtttcgtgatggcttcgctgccgagccaactgatctctttcaatttcgttttaaagatcgctgcgtcttcaaaaacggtcgaccacgcaatgatattttcaatatcggcttgtttggctggatcatcaattgcctcgggtaaaagacttttcagttgacggtacgtagaaagtgaacttaaaaaacgtttctcatcagctaaaccacgaatttcaggaatgtgggcgtaatcaccatgcgctcgcagattttcggcaaattgtttaattgtcacactattatgccgttcaaacagttctcgaataacttgttgtttttgttcgatgctaagcttctcgttattaacacgaacattattcagttcattcaacacctcatagcgttgatacagcaaactttgcttaggcaacacgtcttcaccaatcaagtaagtgtcggtcgtcttcatccgctgaataaaggtattagccgaagcttcgcgatctaccttttcgtcaaaattataaggcgtgatattaccttcaggatctttccgaaccatccaagcaaaaaccccgccttgtgctgctttttgctctttagccgtcaccaatggtccaacataatatggaattcgaaaattcagcaattcatccaactgataaggcatacttttccgatgcttttccaccggatttggcgcagccagccagtcgtaataaacagcttgatttttgatgatctgatccaattcccgctgttgcatttggactggaatagccccgttcgctttgttgcgctgcttgagcatgaagtccggttgcgccaaacgttcaagcagttcaggagacttggtgtttggatgagccgtcacgtctttagttaacgctttaacaaaattttctcgcaaaaatggcgcagcatcgtcaccgtctatatagcgatcgtaaagctgtcggattgctttagccgttccatcatcttcaagttgttttaaataggctttaaacaactggagatcttcatgatgttgtgtataatcatcaaccttagcttgagaaagcgtctttcctgtgggcacaataccattaaggagccgggctcgatacagatcccgaatctggtccagaatttccgttccttcatcggtcatagccgattcaatgccagcccatttatcgtcaagctgccctaatgaaaagttccaagcagtggcttcagaactatcaacttcagttcctaacgctagattaagtttggttttcaacccgaccacagctttagcaaactcggttaaaacctgcttctgctgcttcaagatgtccttgtcgtcttcttcagccagtaacagtttgactaaagctcgttgcgtatcaattgacgttgctatttcattcagcaaaattgttttaaactcattcgctttgtcctcatcaaaagtaatgccaagatctgggtaaacttgggcgtaggcatcctgcaatgcaggaaaaatctcgtctaacgccacatcgtttgtattgaaatccttggcatctcccggcgtcaaaaaatgcccgcgacttttcaaaatatgatgaatggcaaaataaatctcgcgaacatccgctctgcttggatcagtcataagccgattgcgcaaatgatacattgtcgaatattgctgataaaactcagcatccgtccgatcattaaaaagccgcttctcatacttgtaacgggccttatccttcggcgagatttccgagtacttttgccgcataaagaaattcgggtcagtaggcgtaatatgcgattcaaaaaaatcacgcaaaaaactgagtcgccaacgatttcggctcaaacgacggcgagtggtacgacctgctcggcgtttcgctgctgcttttccttcttcaaacagtcttgccccaataaccgtttttcccttcaatcgaataagatgactgttctcatccacagccgcaaatccaatcgagtttgagccgatatcgactccaatgccatatggtttacctaactttgtcatgcttagacctccagtcaatagttgaaacatctttagtatggcgattgttgtaatcgttttcaattcataagttctaataatcacctatttatcataaaaatcagtcaaaaaaaccgtcatcaccagtcaataccggtcgataacatcactaccctaacatcactgccaaccctatcatgacgtgcatcaaaataaatgcactcagcgtcaccaccaaaatgttacgcgaacgtcgatagacccagtatagtggcagctgtgcgaccaatccgctggcgatattgacaaagacatgcggtgcaagcggtgtagttgtcacaacagccgttacggccagcgccaagagataagttaaaaacaatgcccaacgccgatgtttaatcgccaatcgactaaataactgttgactagctaggaaaatcatcaccgccgttaattgcgttgcaagcgtcatgaaaaaggcacggaaactaatgaggctaaaagcacctaagttaccaaactgggcggcctccagcgtattgacaaaatcaacgccaaaccgaattggcaccaagtcgccaagaatcctgccaagtgtggacgcaatcaggtacaaaacgccataagcgaaaacataccagatatcccgccaacgaaaacttgcaaaaagctgactcaagccatcccagccggctgcccatacagcgccagcaaaaatgatggcacagtaaagaacgccgccgaacacgacaacggctcgagtccagccattagcaacattcaaaaaagtggtgccggacatgttgaaaaatccgccaatcggattgcgtgtataaaagagcagataggtaaacaaaacaaccgagaagaacttcagccagttattgaacgtaaaatgtggttcagtttgactaaaaggaactggccattgtttgcgtttagctaattttgttgcttccaattatttctcctcctttaacacaagttgaacgaagccttccaagttcattgagaggacccggtctaattgattggtactgcgatgacgataagcatacgccgccgattcaaacatcatgtacatccgcccatcatgcgtgctgatctgttctaagtgcgaaggcatatcaaacgtgtcaatcgcatcactagcgcggaagatggtcttcttaggatcggttttaaagatatataacgtcgagttgccaccaccataagattgcgacagaatcgtataatccccataaaaggccatcccttggattttcgataaaatgtcttgatgcaaaacggattgtgttaacacgtcaaattgattcgagatgctggaggtgaggcttttcccaacaacctgccccttatcatttaaaggatagcgttgaatgttaccttttccagttggattaaagaagccgacgaacagcgcattttcgtaataagtgacaaaagaagctcggctaatattgccaagttgggcgcgctgcgaataagccacagccttggctttcttatcaacattgtaagtcaaggctgtttttagcttgattgcaaaaacttcagccgcattgttccggcgtccgcagatccaaatgttatcgttcttggcatcataagttaacccaccaacatggggacggccattcaataccactgtgttaagcaacttaccggttttcaaatcctgaatatacatcactgagttatgaaaaccgtcatgatcatatgctgtggttaataagtaatcaccggccaccgtaacgccttgtggggtcatggttgtacaaacttcaacttcgccggtttcagcattgagtgttttcgttgcctttagaccagatactatcggctgactgctatatttaacattgaattcgtctggcgtatagttaaatgttttagcgtctttaaccgggcctaatcgaaccattaaatccaagcgtttaaacttttgcagcgttttttcgaagcgactttctgaatataagctgtcagtgttggtctctgtccgtgacgtgttcggctcaacttggtaacgtttaaccgtcccaatcccccagccaaagccgccaataaaaatgataatgagtaccaaatcgacaatcaaaatcatgagattttggcgactcaattttttcttcccatccctattcaaaatacgttcacccttcacgttctataatcgttatatcaatgtcatcattatagcaaaccttgcttctgatccgcatcacatgaccttttgtttaacaaggtttccttataaggtaatcgagtcattttaatgttcgaatgaatgatattattgttataatttatacaataagttgcatatacaccgtttgggaggggatatgaatatgaaaaaaatcttgattggtattggcatcttcattggcctcgtcattcttggcggtgcagggttttacgcttggtatactcaaagcaccccttattacacccagattacgacgacaggcaagaagtttgatgttatcgatgatgagaccggtgctgcgcgggatattgattatgcctatactcagatggcctatgatgaaaaaggccacggtacagaggttgatttcaacggtcacaaatctcggcctttgaaaatgcaagcttatctccgcctcgattacagcacgcgtcgaaaccaagtgattagttgggaagtcgttccaaaggaaaaggttcctaaagcagctttagcaaaattaaatcgctaattaaaaaaggtgcgctggcgcagtttgaaacctgcgccagcgaacacatttacaaacagagtatgagctggagcggttagaaaccggagcataagcgggcgcaagtgcgatgacccggttttggtcattgtgcttgtggcccttatgtgcagatttctgcgccagcgaacacatttacaaggagatgtctattatgacgaatgaacacaaagttttacgcgggttgtcttatatttcggtcatttttgcccccattctctttccaattctcgtttggattttcaccccgcaaggttccgtcacacgggacacagctaaacacgcactttggctgcatattattcccaccctattgagcatctttatctttatgatcattggcggtgtcggtttcttcacgaacagcatcaacgcaacatccgccgtttcacttatcttgctacttgttgccatggtcgttgacattgggatggtagtctacaacatctacacaggcatcaaaattatcacctcctgattaaccactcaatatcgccaaaaaagggcgcctctcgtcatgagaagcaccctttttggtttatcaaaatttcaccgtagccccgcatccaaagcatacaagttctgataccgctcgtcgttcttagccaagtgactaggggtatcattcatcgtcaaacggccatcttcaagaaaaatgacgcgatcagtttgattgacgccttgcaaatgatgcgtcacccaaagaatggttttgccttgcaatactgtgaacatcgtctccagcaaagcctgttccgtaattggatcaaggccgactgtcggttcatccaacagcacaatcggcgcatcctgtaaaagaattcgagctagcgacaaacgttgccgttcaccacctgaaaagccgaaacctgcttcctcgacactgctgttaataccattcggcaattgggctacgagctggtctagcttgactgccttaagagcagcggcaacatcagcatcgctggcctgctcattgcctaagcggacattgttgacaatcgacgtgttgaataaaaacggactttgatccaacaccgcaaaaagattggtgcgatgctgctgataagtcaggacatcttgaccgtcgaccaacacgtttccagttgtcggcgttaggtcaccaagtacaagttgcaacaacgtggttttgcccatgccactaggtccgagaatcgcaattttctcgccgctgtgaacggttagatcaatatcggtaatcaattcaggatcttttggcgtgtattgaaaactgagatgctgcaatgtcatctctttgaactgagtcggtactgcttgttgttgcggtaattgtcgcgtgaccggctgcaaatcgttgagatgacgaatcgcatctcggtatgtcggccattcgccaaccccttgtgcgatgccggagaacgcctgatcgagtgggaaaacaaccagtacaaacgccccaacccagttagcactcgcttgattaccggtccactcaaggtttgtccagatcaacatactaatgacaattaagacaaacagcagttggccgacaaagtctcggcgccattgaaatcgcttggacttcaccgtcgatgcggctaattttttaggggccgccagactttgagacataaaatccttttcacgatgagtaataacccaatcggacaaaccgagcactgaatccgtcaatgagacataggcatcatgattcaattgcttttgttctgcctttcgaaaacgctcaactaccagtccccaccaaggcagaatcaatacttgaaacaacagcaacaacataatccatagtgcaaagccccagttgaaccagcctagcaacaaagtggcaataaccgttagaccagcgccgaccacagttgggaaaatcatccgcaagtatagattctgaatgtgaccaatgtcatcggcgagcaagcctagaatatcgccggtttgatgatgttcggacacaaaggcagcatcagtttccaacactttgtacaattttcgccgcatgtggctagtaatgcgcaacacccagttgtgactggtcaaccgttcaatgtattgaaacaccggtcgcccaatcccaaaagcgcgggtcaagacaaccgtgacataaatagctgcaaacaatggcttcgtggcacttttatcaatcagaaaacctgacgtgaacatcaaggcaccagcaaagacaaaggtcataacccccagaattaacgaccagacgagtaagccgcgatagcgtttcaagtctgggcgaacccagtgctcatttttcaaccaatgcattgaattcacctcgcatttcgtgcacaagggcctgatacggcttggaatgtgccgccagctcacttggggtcccttcagcaatgatcttgccgccatcaaccacaatcacgcgatccatttgattgagccagtgtagccgatgggtcgcaaaaatcacgagccggtttttgaacagcggcacaagcgtttcttttaactcggcttcagtttcaatatccaaatgggcagttggttcgtcaaacaaccaaatcgagcgattcgtatcaatcaaagtccgcgccaacgcaattcgctgggcctgaccgccggaaataccacgaccgccttccccgattctcgttgcatagccgtctgccaaagtttcgatccaatgactcaaccccgccgcctcagctgcctgtttcacatcttcatctgacgcatccggccgataaaaccggatattggcagcgatcgtatcagcaaatagatacggatcttgtgggatatagctcaaatgatcttgccaagctgcttgggtcatatgcggtaccttcgttcctcgaaccgtcatggcagctttttgcggctgcaagaaaccgccaatcaaattgagtaatgttgatttacctgacccgctagcaccgataatcgctactttttccgtgccggtaaactgcagattagcatcttgaatgcccgcgcgttcatttggataggtgaaatcgaggtggttaatggttaccgtgtcctgagcctgccaccttgaaaaagccggtaacacattggtatcagtaggtaatggctgatcaatcacttgccaaatcgccttcatcgcatttttgccattcaaggtggcatggtagtcagtcccaaaatcacgaatcggcatgaaatattccggtgccaagatcagcgcaaccattgctggatagagtggaatcgcgccatccatcaacttgatcccgaggaaaaccgcaacaactgcaatcgacaaggtggtgaagaagtctagcgcaaacgttgagagcatcgcgatgcgcaagacgcccatggtttgttttcgatagtcttccgacacatcgtacacattattcgcgtattgccgactaatccccatcaactgcaaagtttttaaaccacgcaaggagtcaatgaaatgattgctcatcttttgaaacccagcatattggctttcagatttatcctgtgctgccaagccaagaatcaccatgaacaaaatgataattggaaacatgatcagcaaggtgaagccagttagccagttttcgtaccaaatataggcaactaaaacccacggaataatactcatgttcaggattttgttcaaaatcagttcaatataattttcggcttcgggaatgccatccagcgccatcgtgaccaaattaccggttccttccttggcaacggcagccggccccaaggcatacaagtgcttgagcaattgggcttgtagccaggccgaactagtcatggcaaatcttgccccgatgcgattgcgcacccaaacaatgagctgacgaatcacaaaggcagtcgcaaaaagtcctaacggaagccataagccagctaaactttgccggttccaagaatgaacgatcccttcagcaagaaattttccttgtaataaaataacaaaagcttgcacgagcgcaaacccggcaagcattgtcataattcgtttcattcccgaaaggcgcatgagcgtcttatcgatcattcactaaccgctccttttgcttgaattcgcttgtggaagaccacatagctccagatgaagtatgccaaggcaattggcagcagaatcacagcgacaatcgtcataatggtcagcgtcaacggactagcactggcgtcttttgccaaaatggacatagccgcatcttggccaatcataacgcgtgggaacaagccgttgaaaatcacaccgacaaccccgacaagccctagggcactgccaacaaatgacaacacttcattatctttaagcacgccaacatgagcggcaactgtcgagccgacaatcacaaccaaaatcaacaaagtgctgattgggcgttctttgaagaagtcggtcataaagaatagaaggacagcgaagacaacttcaccagcatacaacaagtagtacaacttgctgttccagtcacgcgcacgcttgcgcaagtcgccagtcgttttcagacgaataaagtttaaaccgtgcatgagcatcatcaaagtgaccgcaactccgccgacaattgtcaaaaggttgatttgattacctaaagtaggataaacatcgccagccttggtaattggtaacggttgaatgatcgcggtaaaaatcatccctaagatgaacggtgggattaaactgccgcaagctaaagcccaacgccagatattccgacctcttttggtctcggcatgtgcagcaaattcaaacgacacgccgcgaacaatcaaaccgaacaacacaaggaagaacatgatgtaaaaccccgagaagaggctggcataccacattggataagaggcaaacatcgcgccaccagctgtgatcagccaaacttcgttcccatcccaatgtgggccgattgtggcaacgagttgatcttcttcgtcagagttacgcgccaatagcttggttgacataccaaccccgaagtcaaagccttcaaggacgaagaagccgctgaaaaggacaaacaataagaagaaccacaaaatctgtaaccagctcattttgcgaacgcctccttagcaaacggatcactgttgaccccgtagtcagtgttcagatcgccttcaggacccttcttaagcacgcgatgtgagtaataaatcatgacaccgccgagcaaggtgaagatcaagaagtagcaaatgttagtgaacagtaactgtccagctgtcgttgtcggcgaaaccgcatcggcaattgaatacaggccgtaaacaacccatggataccgaccaagttcagtgataaaccaaccagccgtattaatgatgaatgggagccacagcgcaaagccgagaatatacaatagccaacgctgattaagcaaggtatctttcttcttccggctaaaccagagacctagaacgcctagcaggaacagaagaacgccaccaccagccatgacccggaagctccagaacaaggttttaaccggcacataatagtccctgtctttgccatatttagcttgaagctccttattagctgtctccatgcctttgactgcgccgttcattttatgatacgacagcaaacttaatagatatggcacttcaatattgccactggtcgtatgatctttagtattgattaattcgacaagcgtccatggtgctggatcactagtatctttataaattccttcagttgccgcaaacttcatcggctgatctttaatgatgaattgtgtctgcaaatcaccaaaaccgattgcgcatgcagaagcgatggtgccaacaatcaagccaactctaagagacttcttgtaaaagtcaacttgatcttttttaagcaaacgccatgcggccatgccggctacagcaaagccagccgtcgtaaaggcaccgaaaataacatgcggaaattcaacccacagttgcggattcgtgatcacggccccaaagtcgactaacttaacccgacccgttgcctgattaattgcaaaaccggttggatgctgcatgaaggcattcgccgacagaatccaaatggctgatagcgtggtacctagccatgtcatccaaataaagatagcgtgaacagccggtttgaaacgatcccatgtgaacatccacagaccaatgaaagtcgattccatgaagaatgccagtaacgcttcaatcgccagtggcaccccaaagatgtcacccatgaaccgtgaataattagaccagttcatgccaaactgaaattcttgaataatacctgtaacgaccccaaccgcaaagctgagtaagaagatcttgccccagaacttggccatcttcttatatgtttcattctttttgcgcacatacattgtttccataatggcggtaacaagccccataccaattgaaaacggcacaaagaagaaatggaaaacggtcgtcatcgcgaactgaaaacgagctagcgataatacgtccattgccaatagcatatgtttttcctcccttactagattgattccaatctaagtatacccctgtgttttattttttaaaaaccaaaaacccaaaaaatagcattgaaataatgcttttcagcatcaacatcaaatcaaagctgttatgatatgcagctgtatgcttaattgacggcgtttcggccaccaaacaaatattagctaaaaccattttgaaaacacctttgaaaacgatggaagaatgaaaacgtatttaggggcgaatcacttcttgaatcagcggcgtttttttcggcgctttatcgccaatatgataagcgcttctgaccatgttgctgatagcgtcaacgttttcggtgtcggcatgcagcgtaaccaacgtatcgcctttggtcacaggtgtccccagttttttatgcaggacaagccctactgccaagtctaaaatatcatcttttttcgctcgaccgccaccaagttgcatcgctgccaaaccgagagcatttgtgtcaatttggtcaacaatgccagattcggcagctttcacagcaattcgatacttagcttgtggcagtttgcgtggatcatccactactgaagcatccccgccttgtgctgtgatcaattgcttgaaggcattcaacgcacgcccgtcacgcagcgcatcttcggctaagccgctggcaatctccagacttgccgccttgccgccaagcaccagcatctgtgctgccaacgccacggtgagatcatggacgtctttcggaccgcgatttttaagaatgccaatagattccgcaatttctagactattaccaatcgtaatgcccagcggctggctcatgtctgtcaacaaagccacacttttaaccccagcggttttgctgatacccaccaaggctttggccaacgcccgcgcatcttcggtggtcttcataaatgcgccattgccgacttttacatcaaagaccaaggcattcgtaccactggctaactttttactcatgatcgaccccgcaatcaacggaatcgattcaaccgtacctgtgacatcgcgcaaagcgtaaatccgtcgatctgctggcgcaacctcgccgctcgcactgataatggcttcattgatttgctgtacttgctgcttgaattgggtttcgctttccgcaacattgaagccaggaatgctctcaagtttgtccaatgtaccgcccgtgtgcccaagaccgcgtccggaaatcatcggcaccggcacacctagacacgcaaccagcggcgccaacggaatactaattttgtcaccgacaccgccagtactgtgtttatcgactttaatacccggaatatcgctcaaatcaagtacgtcaccggaatgcagcattgcaaaagcaaaatggctgcgttcctctggcgtcataccattaaaataaaccgccatcagaaaagcactcatctgataatccggaattgcttttgccgtatactgttcaatcatccaagtgagctcttcattggttaaagctttgtgatcacgttttttcgtgattaaatcgaccatgcgcatctctcatcacccttttcccagttattcattccattgtaccgcgtcacgcgccgcctatgttaaactctaaacaatcagagcgtgaaccagcccggtcagaaatcggagtgtaagcgggcctgaacgtgatgaccgggtttgggtcattgcgttcagggtccttacacgcaggtttctgggctggtgaacgcatttaaaagagcgtgaactggcgcgtttagaaaccgaagcataagtggcctcaagcctaaatagctgggctttggctatttaggcttgaggtccttatgtgcaggtttctgcgccagtgaacgcgtttaaaaagacgcgaaccaatcacccctcggtcatgccgaccactctttattgcctgcgaacttgtttaggaggaaaacttgatggactttcaaacattacatcaactaagcaaaaccgaactacattgtcatttagacggctcattgtcgttaagttgcattcgtcagctcgcgaaaatgatcgaccgaaaattaccggcgactgacgacgaactgcggcgactggttcaggcaccagcagattccgagaatttaggtgattatctcaaagccttcgacttcgtggcccccttgctgcaaaccaaaaaggccttgcaactcgcggcctacgatgtcgttgaacaagcggctgaagaaaacgtccgctatatcgaaattcgcttcgcgcccgtattttccctagcaggcggattatcgctggtcgaagcaacgcaagccgtcatcgaaggcttgcaccaaggcatggcaacatatgacatcatggcgaaggccttagtctgtggcatgcgacagttgcccaacaccgataaccaaacaatgtttaaaaccaccgccccgctacttggttcaacactcgtcggcggtgactttgccggcaacgaggctgattttccaacgaacgtgtgcgcgccggccattaaaactgctcaatcccttggcgtgccgcttacgtttcatgccggcgaatgtcattgcccgcaaaacattgctgaagcggtacgactcggcattccgcggattggccatgccaccgcttgttttgatcaaccggcactcattgagaaaattgttgaaactggcaccacagttgaactttgcctcacgagcaacctccaaacgaaagccgctcgtacactcgctgagtttccgtatcaggcgcttaaaaaagctggtgccaaaatcaccattaacactgataatcgaacagtctcgaataccacgttaacccaggaatatcagcgttatcagcaagcttttggtacaacagcagctgactttttagcattcaatttaaacgccattgatgcagctttcattcctgatgccgataagaaatcattacgcgatcggttacatcaagattacgcaacttattgttaattttccccaattaaaagacaagccatgatcacgactattgcttgtcttttttaatgcagttaaccaaggccttgctgatcaggcgcttaatcattgcttaatgaaagcgccacaacttcgtcacgaataaagcccaaattcaccgcacattcatcccgccaacgccacagccccttgttatgctggttttatcaacaaacgaaagaaggatgatgcatatgttgattaatcaaaccgatgtcatcgcaacccaattacaacaaattgcttacccatatattaacgccattactgaaaccggcgtcccgatcacaattacaaccaatcaaaaacagcgcgatgaccccgccttttggcagagcatcagcgctatcctgaaagctcgtttatgggtacccgtttcaaagaagtaccatgagttaaccgaccatgactggctggcgacaccagaaatgccctaactaagcttgataacttgaaaaggccgtcgcagcaagcaccaaggtcaacacagcatctggtgaaagtgccgcactgactgtctcaatatggccgctggttgcgactgcgccaatcacttcaagcccgtacttaacaatattcaagtcacgctgcggggtatacccaccgtcaaaaacgggttcatgattgtatgtaaaattcaactgatcatttttgatcgagccatccacatggttgaccatgatacggtcatgggtggcggtcaatggcgcattgtcatctggcaagtttaacttgtgatcagattcagttgtataataatcggcctgcttcatatgcaagtatttctcagctggcttcttgagcaccttcaaataatccacaattgcgtatactttgttggggtcaagctgggttttcttggccatcaggtcatcattatgcgcctcaagccagtctgctaaattactgatactaaattgatccatgttgtgcctccatattcgttgctaattcttacgccagtatagcatggacttcaagtctggcgaagcgggattgtcataaatttgttacacatactgttatataatagtagtgggagatgaggatgatgctgagcaatcgcgagccatatccaattatcgattatttaggccgacctatcaagctgtcactgtttgtgacctatcgattacgcattaaaaacggctatatccttgcactgcgccgaaatcaacatcagcaagtgatcccgaacctcatggccaagaatgcgagctgattcggttgctgcaacagccactgatgaacggttactaattggctaggatggtgtgtatcaatacaccatccttttttgatggcgccagatgcggcatgatcgctcagtccggggagcgatcttccagcttcggtccatgcggcgtcgccattgccatcatggcgactgtcaaaataataataacgccacccaagatttccgcaaatcccatatgcatgtgtaagaaaacgactgaaacaaccgttgcacccaacggctcaaaggcgtctagcaacgtggctgccgtcggagaaatgaactgcaagctcgcaaggtaaaccgaataagcaatgatggtgccaaaaatcacaatgaaccagtaaccagcccaacctgcgtgatctaaatgcggtatttccttccaaaaaggatcaaatacgtcaatcaacaaaccaccaatcagttgcgcccatgccgtgacgacaatcggcgagtggcggtgcaacaagcctgcaggcaataaggtatacgccgctgccgccaatgctgccatgataccccagaaaaaagcattcggcgaaatggccagatgagtaaaatgccctttggtaacaaccaaagccgtccccatcatggcaaagcaaatcgtcacaatatcaattcgtcgcggcttttcgcgcaaacgcagcgctaaaaatatcaacacaaccaccggtgacaaatattgcaaaatcgtggcagttgcagcattggctactgcaactgccttaaagtaaatatactgcatcccgatcatgccaaacagaataaatagaattagctgcaaggcatcacgagtattccgccaaggtgctagaatcgctttacgctctttccaaaaagccacgagcatcaaaacaattccggcgataatcatcttcgaactaatcagccatgaaactttaatgccttgatcaaataaggcctcgctaattgggccagagattccccaaaagcttgaccctaaaattgctagaaaaattccccacagtcggacgcgcttcaccagtcttgctccctcttgggccgattcggatcagtcctgcatcacaacatgatcatcaattaatccggcgccttgcaaataattatacacgattaccggccctacgaacgcaaagccgttatttttcaaatccttggcgattttgaccgataaggcacttttggtcggaatttccgcacgcgacttaggtcgattgaccaacggcttgccgttcacaaaatgccataaatagtgatcaaggctgccatactttgcctgaatttttaacacagctctggcattggtaattgttgcctcaagtttcttacgattgcgaatgatgtcttgccgctgcaataactgctcgacgtcttcttcatccatagcagctacttgtttaatcgcaaaattatgaaaagcatcgttaaaaggagcgcgcttgccaatgactagttcccaattcaacccagcttggaaaatctcaagggataacaactcaaataacttttgatcatcatgaaccggcacgccccattcatgatcgtggtacgcgcgcatagctggtgacattttggcaacccaatccgtataacgcttacgttcctgataccgctgcaatgctgcttctgtcttggcttcttcagcgtgatcatttgattttaccattgtccagcacctccatagacttgcataggcttctcttttacggatacattacgccgcgctggcagggattgccagtgaagatgcttgcaaggcaagatcatgcgttcacctgtgcaacgctggacaggattgcattcattttaacgcgttcgcagccacagatgcctacatataagggccttgaaccgaactggccacttacactctgttttctagccgctcctgttcgcgcttaacaaaaaaaccgataacaagttttgtcatcggctcacaaacaatcacttacctatttagttttaacgatcaggacatcgcaaggtgccgtgcggttgacatattccgtgacagatccgacaaggacgcgttctacagcgttcaagccagttgcaccgatcacaatgagatcattgtgatggtcgtgcggaaaatcagttgcaattaccgtcttgggattgccaaaccgaatgtgaatatcaagatcatccagacctgcacttttggcttgatctttcaaattatctaagtattcctgtgcatcttgcgtcaactgataaaccgcatcgccggaaatcatgccgccgtaactgccaataaactgtttggtatcaagcacattcaaaacatccaagtgggctcggttggccagtgcaaccttaatggccttgttaaaagctaattctgcttccttcgagccatccaccggtacgagcaagcgatcatattcttgatccattccgctcacatccttactttctgattaacttaagcatagaacgccgaggaaacgaatacaagaaataaatttgaacacttaacatagtaatctatcccaagaccctgtaaaataagactcaacggcaggctttactgatgcgcgtactgaatctgatcgaacccggttattatttattaaaatatgttttatttccgtgggtttatgattgatttaatacgcattaatgctatattaaagttagtgagcttgcattcttgaatttaaggattcggcgccaaaaaaattgaaagaaatgtggtggaaatatgattacaaatggtgttggcagcgtgctgcgacagatccgaaagggtcgcggcgaatcaatcgtcgaagttgcaaaagcaacccatacttccccagctagttttactaagtgggaaaacgatcaaacaattccgagtgaacggagtattcgcaaacttgcggaatactataatacagatccgctcgaattattgagtgtggcttatccggataaatatgctcagaagcaagaaaacgaacaaccggtcggtgatggtccatcaatccgtgttgaggacttgttaggcaacaactcagttctgacatacaatggtgttccgcttgcggcgggcaccaagtcgctggtagcggctttcattgccggattaattatcgctcagcctgagtaaagttattcttcaaaaaaagccgttatttgacggctttttttgtcccttctgatacgctcagtcgacatgccttatacacgtataacccttgaaagcaatgcattctcgctcactcataaaagcacagcctaatgcccaactagctggaaaacttaaggatgcattgccggtaccaacaactttcgcgtatactggagtcaaacgttttcacgatggaggaattaaatttggaacccaatgttcttgacattaaaaatggacttaactttcgcgacctcggcggctataagacaaaatccggacaattagtcaaacctaagaaagtcattcgctctgctaagttgagcgagttatctgaccaggatttgcaatacctttccgattacgggctcatcgccgatgtcgactttcgctcacccgaagaacaagcagctgaacccgatcgatacccagaacacgcgacctaccattttgtgccggttttcccaacagacgaaaccaagagtagtgaacaggcggatgccttgcaaaagagcttctcacgtgatccgcacgcaggttttgaaaacatggttaaaacctacgccgacatcgtcaaaatgccttctgcacaaaaggcttatcgtcaattcttcgacatcctcttaagtaacgatgacgaaaatggtgctgttcttttccattgcacagccggtaaagatcgaaccgggatgggcgcggtatatctactttcagccctcggtgttgatggtcataccattcaccaagactacctcgcgacaaacgatctcattcagccgatggtcgaaaagaatttggcagctgctcgtaagcatggcgcaactgatgctcttcttgccaacattcaagatctcggcacggtttcgggtgcctttcttgacagcgccttagccacgatcgatgctgaatatggtagcatgcgcgactatttgcaagatgaattaaagctgacccccgctgaaaaacgggatctccgcgaactttatctacagtaaaaagctacgcgaatgagttacaacagttgatggctcaatcagacaatatctttgagcacatctattaagaaactgggaaaacacctctgttgagtcccgcaagcgcggtgttctttgacaggcgatgtttcagtcccggtttcttttttaattatgcgtgatcactttctgcgttcttaacgatactgataacaacaaaaaatagctaaatttaatcggcatctttgcgttcctactctaacttggctagaataatgacatcaatgacgttaagaggtgaccgggatggatttaaaaatgatgattaaagctcatgctaaagagttgggaatcgacaaaatcggctttacgaccgctgataattttgccgcgcttaaacctagcttgctcgcacaaaaagcggccggtcacacgactggctttgaacatcaaaatatcgatgaacgcctatatcctgataaaatttttgaccagccacaaagtataatcgcaattgcgttagcgtatccggctaaaatccatgaacgaccgccgcgaacaggacccaaacgtggccgatttgcgcgggccagctggggcattgattatcacactgtgcttgatcgaaaaatggcgtcacttatcaagtttattaaacgaacggcagaaaatgatcctaacttgcgtttcaaacccatggtcgatacaggtgaattaatcgatgttgtcgttgcgcaacgcgccggcgtcggctttatcggcaaaaacggtctactcatcacccctgaatttggttcgtatgtgtacctcggtgagatcattaccaatattaagtttgcccctgacgaaccgatgacctcacagtgcggtgattgtactcgctgtattgatttttgcccgccaaaagccttgcttggtgacggtcgcatgaatggccaacgctgtctttcctatcaaacccagactaaaggctacatggatccagaatttcggcccatgattcgcaacgtcctatacggctgcgatatctgccagcaggtttgtccgtttaataaaggcaaggattttcatatccatccagaaatggaacccgacccggaaacggtattaccggaactgattccaatgttaacgctgaccaacaaggactttaaaacgcgctttggcaaactggctggtgcttggcgcggcaaaaaaccactgcaacgtaatgccattatcgcactggtcaacctgcatgaccgcagcgccattcctcacttgctcgaggtcattgagcatgatccgcgaccaatgattcgagcaactgcagcttgggccgttggtaaattacagtcatcgtctaatcctgaaatcgagacttttcttaaaacggccttggcaaaagaaacgacgccagaagcgcaagtcgcctttcaggatgcacttgatcacctaacccaacattgagcatgttataatgactcttaagaatacgaggtgcctatattgaaactatatcaaggactcactcaggtgcaggtcaatgaagaaatggccgatgatacacctgacttcaccattaccaccgatctaaccaaaccgttgcactactcaccatcggaactttaccactacttggatgcggtcttaaaacccggtagccggcacgatcagaataatctgaagtatgtcacggatgccgccttcatcggcgaaaattttgatttcaactcaatcccttacactgctaagttaaaggattttgaagaaaaaatggcatttgctcgcaaccttgtcagtgatctcaatcgtcacgtcagcgtcaatctgaatacaaaaaatcatacgtttgaacttttattcgttgattaagaaaaaataaaaaccgttgttcgggaagttttccccgacagcggttttttgtactttcaatttaagcaggaatctgctatctagcgcaaggccgggatcacagctgtcaattgttgaacaaccaacacactgagcgccatcttgagcaagtcaccaggaatataaatcaagacactcgcaagcgctgggacaaagcccaaactggtagtcgcagctaaccacgcggcacccagaaattccgtcaaaaggaccccaccaaatgtcatccccagtactttggttaaccaaaaatcaggtttcagatagtgcgttatggccgcatatgctatcggtgtcaacaaccagccgtacatgaaaccagcagtcggtcctaagaaaatagcaataccgcctcgaccgcctgtcaatactggcaagcctaatgctgccaatgccaataacataccaattgtgatcgttgctggccgcgttggtaacaacattgcaaccaacataacacccatgttctgcaagacaatcggcacaccaagaaagccaacagtgatcggtggcgcaaaggccaagccaatcaaaactgccaacaatagtcccatccgtgtcaaagtttttgtttgcatgaagtcaccattcccatcttatgtttcacttaggataccatatcgtgacgccatgcagtaccaaaaatcgttcagggcatgtctcttttgtgttcttttgccgaaaaatcgcctttttgtggctaaaatacccgatttttacttttcttcggtcaatttaccttcataggccagtttctcgttttcgtagcccagcatgtgatcttcaaaatgatcaattttatagtctaggtagcgaagggtcttgttaatattatcgcgccgttcaatcaaagcatcgcgttgttcaataaacaaagactttcgggctgcaattgtttgatcgccttcccgtaaaagcttaacaaactcggaaagcgattcaatcgacatcccagccttacggagaaccatgatgtaataaacccagttgaccgcatgttcatcgtagtcacgataaccactctgattccgttgaatttcaggcaataacccaattctttcccagtaacgtaatgtatcctttgtcagattaaactttttactaacttcatcaattgtcacgcttatcgctccttcaacagtctcagcagatcaacgacatgattatctggcattcacccgcaaactaagttcagtggtctaataccgatcacaacggatttctgactcagatagtcaaatgatcctttgcatgatgtgactcaccatgagctccaatcaatacctgataaacctttgtccaagcatctcaaaatttttagcacaccaagacgtttctacaacgttgtcagccatgcagagatttcggccttcttttgggcgacattgtcacccgccataccaaatccttgtttgacttgcagttgcccagctgcctgtttaaacgcctgttcataggcgccgggtgtgcaagcatcggtataaaaaggcctgaatacagctcgactgccttgctcctgttttagaaaactcaaaactggtgttgatggcgctgccgaccaaaccggaccaccaaccaagatcgtttcataaccggtcagatcaggaataaccgttgtcagatgcggtaaatttccggacgctacttggtgttttgcccgaccagaggtgtcatacatatctgacgaaaaagtttgctcaggaacacgtagagctaacaggtctgcatctgtcgcctgttgtaaatatttcgccaatgtagcagtatgccctgaccatgaataatacacaatcagtactttacttgccatgacagtctcctttaaccttcaaccacgattagtgacttaatggccttccgctgatccatcgcatcataagcgtcttgaatatgttcaagatcaaagcgttgcgtgaagactttgcctgggtgaatctcgccattcaagacggctttgagtagcaattgtttgtcatctgtcgtgaccgaagcgatccccccacgcagaccaatatttcgccagaacagattattcgtgttcatctctggcttttgaggtacgccgacacgacccacaactgcgcctggacgacctactttagtggcagtatcgactgactgttcagtgccaacacattcaagcacagcatcagcacctgcgccgttcgtcattgctaagactttctgaaccgcttcatccccacgttcgggtacaatatcagttgcgccaaaagcaatcgccattttttgccggtcttcatgccgactcatcgcaatgatgcgcttagcaccgcgtaacttggcagcaatgacgccgcaaaggccaactgccccgtcgcccatgacaacaactgtatcgccttgtttaacctcggcgcttgcagcagcatgataacctgtcgccatgacatcagccagtgtgacaaatgaattcaacatctcatctgaataatcgctcggctgacccggaattttaaccaaggcccagtttgcattcgtgaaacgtaaatactgcccctgatagccaccattgccgcctgcttcctgattcatgcaatcaccatcaaaaccggcaagacaagccgcacagtgaccgcaaccatgtgtaaacggcgcaatgacaaaatcaccgacatgaatatcatgaacttcagcaccaacttcttccacaatgccaatcgcctcatgaccaacaagactattagcgtctcgatgtgagatgccgcggaaccaccataagtctgatccgcacacactggctcgaacaatcttgatgattgcatcagttggcttttgaagctgcggttttggtacatcttgtgtttcgactttacctggtcctaaaaaaacagctgctttcatttgaaatacctcctaaatgtgagcacgagccagcacgattaccaaccggcgtgtaagtgaccttgggcgcgatggtcgcactttgaccattacaaccaaggtccttacacgcagattgctgcgctggcgagcgcgttatcgtgagcgcttttccccagttaataaaccggtcgatctgatccggccgtatcaggatcggcaatcccgacactgtcgtttttcaaataatcaggatccgcaatgatcttaagcaccacgtcggccacactcttgcgtgagcccgaaactccgacataagtttcatctctatgcgtcagttgatacttaacgtcacgatcatttagccaaggtaggcgtaaggttgtgtagtcgagacccgactgttcaagaagttgatccgacttcagagctgatggtaacccattgccgatagtcgccttgttccacttgccaaaggtgcctggaacttcgtcatagatcccgagaacattcgtataaatcacccgctgcacgtgaccagccttcatccccgcaatgacattttgggtttgttggctgcctttgctatgatcaaccacgccgacaaatacaagatcctggtcaaccattgcttttttgacatcatccaaccgatcaagactgccctcaaccagtgtgacccgcggatttttcgccaactgcgccaagcgtgattgatggcgtaagaacaaggttaaatgtacattggcgaattgatcatcgttgagaatttgattttcaatcagtcgtgaaatctggccgtttgcagccattatcaaaatattctttatcaaaacatcgcctccatgtagatgtgcatcgcttgcttgagttttccccgtaaactgatatcgcagtcatcactgctgaatcagctataggggggatcaccccagtcaagaaaaacgttatctgtatctaattcgtttatggctgaatcaataaagatgccatgatcgtggacaagttgcgttatctaaaccttacttcttacgaacaaaggctatattaaacctttgtgtgcactccaacgcaaccacaatcgtcatcttttcttttgtcggcaaacaaaccccgctctggtcctaaaaacagaacgcgtataatgaatagcaaattcagtcatgaagtggcggcatacttatgggaaaagaacggccggtggcttttgaagatgcagttttggccatcattatgacaattctagtattggaattgaaaaaacctgaaactatgaactggtccggcttatgggcattaagggcaaacttttttgcttacgccctatctttcttctggatcggtctaatgtgggcatcacatcacaataactggcacctcgtcaaaaaattgatagacaaacagttggtctaaccttgctgctgctatttttctcgtcactgtttccatataccaccagcctagttgcggagcacttcaacaatgcaacagcgcaggttttgtatggatcaatcatcatcattatttcgctaatgaatgtgttgttgtcgctcaatttacgcaaactcaatccagaggctaactttggcctgttgtatggcacacctaccgtaatcgtcgcccttgatttattgttcaagctagtcggtctccttatttctatgaccattttcccagccgcaatggtgctgtcaatctgattggccagccttctattgattttctttccaaaatcagcatgaaacaacatggcattttatgaaaatttgcaaaaaaatagctgtgaacgaaatttcgttcacagctttcgactgcccaggctggattcgaaccagcgaccctttgattaacagtcaagcattctaccactgaactactgggcaatgagtatgtatagtatattctcatgtttcttagaaaaatgcaatatttttcgtctttcttttttgccatttccctttaaaaatttaaaaatagttttgacgtgcgcagtatgaccacaaaaacgctgacagtctttggttatcgctcgatgaacctgcatagtgcccgtgaaatggccgcacgctgacaagcagtttcatctataataaaggtgaaaggtcgtgaacctatggatgctccttacccgaatatgcaagatctgcctgatttgccgtctgaatccggcaacgatcaaccaatatggcaagcacttgccaaaaaaataccttcagttgctgatcgccgtgttctcgtcattcattgcggcgatggttggttttgtcgtcatgccctcaacggcggtgccaccgcggttctcggtattgacaccgatgcggttgccattcaagatgcccgcgctgttgccagctccgatcgcttacgttatcgcatcatgccggataaatggctaaaactgttaactggaccatatgatctcatcgtcggctcatttgatcaatcaccagaggagctacgtgccatgactcatgttttaagtgcgctgcttagtcctaaaggccaacttatcgccgctgttgcaccatcaaagcagcccattggcgatgatctcgcagttgatgaactgatcagctcacaacttgtgatcaatcgttggtaccaagtgacggataagcggctcacccaaacggaacaattatatctgttgcttagctcgcgggtttcgcactgacatctcaaggtgagcaacggtcattgaccactacaattaaaatgagcacaaaaaaagccgaagcacttgctccgacttttttgatgcattcatttaattactgaagtacttcaacggttgcagacagaatccctgctgcaggaatctggccactcggcattgcaacatctaactgattaggattgcctgcagcaaaactaccagtatcattaactgtccgagtcaatgtttgaccattggacatggtgatgcgtaatacggtgcctttagggaagacgctcaagttagcagcaacgccactgtagcccatgttgctacctagaacagccggatcatagaagctgatcttgaaggtgcctttgttagttgcactttgggttggttgtgtcgtctgagttgtctgagcaactggctggctaaccgcctgctgttgtacttgttgttgctgcttttgttgcgcagctgcctgctgagcctgttgctgttgaacttgttgctgttgaacttgttgctgttgaacttgttgctgttgtgcttgctgagcttgttgcgcctgttcagcagcctgttgttgtgcttgctggttagcggccgattcagcagcagcttgaactgacgcagctgattcagcggcagcactttgcgcggcagcactttcagcggcgctttgcgctgctgcggacgcagcggcactctgagcagcagcgcttgatgctgcttgcgcattagctgacgcagttgcggcctgagcagcttgttcggctggtgacgttgtctgagtcggtgcggcagccgcatcagcctttttcgtcaatggtgccaactgctgcaaagtattaatactcagatagcgttctggaatccagccgtggtcttcagtttcataccaaatttctgcgaagacttttttactattcacaaatttaacgtgttcaccagttgtcacataacgcttaacttgttgacccgctgtcggtgaggtccaaacagtcgtagcaccaccgttgtaggtaacatcagcttcggttttgtcgctagctggtgcactgacggtcgcggtttcagtattcttcgtatcagcgctgacgtgacttggcttggacaatgccacggcagacagtgcaactgctgagaataatactgtacttaaaagctttttcatgttcgtattcctcctgggtttgtgtggtgatttaactaactgagacttagtatagctatccagtgttacgaacatgtattctgtgtgttgcgattgggttaagttctatgacaaaagattacattagatgacatccttaacaaactgacactgtctttttgttaaaccaaactaaaacggcatctctgtcaaacagatgccgtttcacttctataggaagagtcgatccaatgttgccgccaaaacctgatgtccgtgatccagtatccccggattgacggggccttgcggtttgcctgctgccgcaccaatttcagcaatcatgtctggggtcacttccagatggaactggaagccaacgatatggtcatgataagcgaagccttgcaccgcatgctcattttcgtaaagtaatgtacttcctggtaagcggctcatcgcttccccatgccagtggaaaacattgagtaacgtgccatcggtaccgcgcacggtgccgatgccttcttctggttgcggcattcgataaacattggcaccaaatgctttggtaatctgctgggcacctagacaaatccccaacaccgggcggcccaatttattgaggctgcggatcaaaattcgttctacggcgagccaatcaaagtcatcattgacgctcatgggtccacctagcaaaatcaacccatccatctctgctgggttcagttgtgcaattggatccccttgatcagggcggtaagtgaccatgttaacttgcttgtctgcggcccagtctttaatcgtgccaagatcctctgtatcagtatgctgcatgactgtcagcttcatgctgtcgtgctcctttcgtggccgcttaatcttggcctttcaacgctgctgcaaatggcttgattgtggtcattgcgggatcataaatcgcaaagtaaacccgcttaaacgccccttcaaattcgggcaataataacgcttttcgaaacaacttggcgactggtgcaactggattgccaaatacgccggttccaaacgcgcctaaaatgacctgatcgacatcatgcgccttaaacgcccgaagcgtctgcagaattttaaacgcgatatcgttcatggcagtggcatcatctagcgttgcatcaattcggcgattaggtgctgcgacggtgacaatgtcgacatatttgtctgttaatcgccgcccttgatcatcgaaaagctggcgaacatgttctgcatagatcaacttctgactaaaaagcccgcgatttggcttgcgacgattaagctcataataatctgccatgtgctgctcaagggctggaaccaaataagtccccttggcaatggcttcttcctgcgcacgtgcgccaactgcaaccccgccgcctggatcgaccggacttgcaaaattcatgacgccgattttgcccgtcagttcactcatcaattggaaaacatcaacattacgcaaggcaatttgcggcggttctgtccctttcgctggcgtttgcggcaatggttcgctaatgacctgtgttttgggcatttctggtcgtgccttaaatgctgccattgtctcttggtacatcttgacttgttccattcctgccaccttcaattaaatattttcgattgacccaagcataacatagaagcaaagtgatggaattatcggtcatctttgtcattcaatgttaaaattaactttgtacgatacatgaaatgaggaatggaatacatggaaagtggccaaatcgtccccaatttattggtgatgctcgtcacctttttattcgcggcattttttgtcgcgtgtgaatttgctctggtgcaaagtcgtccaagtgccttggaagaaatgattgataatggtactggccgtaaagctaaagtcgagcgggctttacgaatggtgcataatctaaacgagtatctctcaacgacacaggttggtgtttcgctggctggcattatccttggttggatcggggaaacaaccgttgagtttttgttggttgatctttttggcttgacccacctgagcttgcctaatggtagtctgcacgcggttggcgcgattttaggcgtgattattttaacctatttagaagtcgtgttaaccgaaattgttccaaagaacatctcgattgattatccgatcaaaaccttaatgctggttgtaacaccgctacattatttccatattttgttctatccttttgtttggctgctgaatgtcagtgccaccgggattgtcaaaatgatggggatgaagcccgcagacgaaggcaacgaagccttttcgcaagctgagattctgagtctgagtaaaaatgccgtcacaactggtgacatggaacaaaatgatgttatctacatgcagcgggcatttgaactgaatgacaagaccgccaaagacatcatggtggatcgaaccagcttgtttgtcattgatatcaccaccaccgtcaaagaagctttgcgggattacttaacgcaaggttacagccgattcccggttgttgcgaatggcgataaggataagattctcgggtatgtttacatctatgacttggtcaagcaaggtcaagtcgacccgtctgtgaaagtctctaagctgttacgttccatcattaatgtgcctgaagtaacaccgattcatagtattctggcacaaatgatcaagaaacagacgccaattgttgtggtcgttgacgaatatggtggtactagtgggattgtcaccgacaaggatatttacgaagaactatttggtaccgtcaaggatgaaattgatgatgtctctgatgaatacattcggcaaacggatgatccaaaggtcttccgagtcagtggcaaaacaaccttgtgggattttgaacgttacttccacaccaatattaaagccttcactgattcagaaatcatcaccattgctggctttatcatggaagatcatcccgatttgaaactgcacgataaggtcaagattgatcatttcaacttcaccgttgcagatttttcccgcggctttgctaactggtttgatgtcacacaagatccaaaaccagttaaacaaacggttgctgaagaggttaaagaagctaaaaacgacgataacaagcattaatcaggatcaagctaaactttcaaaaacgtggtactcgttgaggggatcacgtttttttatcgtaatctatttttgtgcaataccgctaggcgcacctaccagccgataaactaaaccctaatgacagcaacgatttcattatttacccaaagccgttgaggacgtgctagactggattataacgattttaagaaaggacacgatattgttgacaacaacagacgttaatggtcatccatataatcgcttgctgcttgtgattaccttgttgatcggtacttttacaacattcttgacgcaaacgattttgaccacggcttacccgacgctgatggcggattttcacatcagcgcgagtgcagtccaatggctgaccactggcttcatgctgattatgggtattatgatcccggtttccgcatggctgctggataaattcaatgttaagtatctctacttaacagctatgacaatctttttccttggttccttgatttgttggttagcaccagattttcaagttctgctggctggtcggctcacgcaggcgattggcgttggtatgtcaatgccgactttccaaacagtcatgttcacgattttcccacctggcaaacgtggtagtgccatgggcctagctgggattgttattggcctagctcctgccatcggcccgacgctttctggttggattctgcttaatcatacttggcgggctttatttgccgttattatgccaattgctgctggggtcgtgctgctggccatctatagcatgcgaaaagttttgccgacctcgaatccaaaaattgatattccttccattattgcttcgactttgggttttggcggcttgctttatggcttctccacagttggtgatgctggttggaccgatttccaagtactgattagcttagccatcggcattattttcgttgccttattctgcgtgcgccagttacgcctcgaaacgcctctgctagaactgcgcgttttcaaatcacgcacgtatacattgagcgtcattttaacagcggtggcgtttatgtcgatggttggtgtagaaatggtcttgccaatgtacatccaaacgatccgtggtgaatctgcctttcactctgggatgatcctttttcccggagccatcatgatggggattatgagtccaattaccggccggattttcgacaaaattggggccaagcggctggctgttgccggtctgttcttgctagttgccggatcgctgccgctggtcaccctaactgctaacacgccgattatctatattacgaccatttacacagtgcgcatgttcggcattaccatggtcacgatgccggtcaccactgctggtatgaacgccttgccaacacacctgatcaatcacgggacggcggtcaataacacggttcggcaagtcgccgcctcaattggcaccgcaatactggtgtcagtattatcagtagtcactaaagatgcaacgccagccgctagtggtcgactgcttgacccgatccattacaccaacgctatgaacaatgcagtcattgccggttatcgcgcggcttttgccgtctcactagtcatggcagcgcttggtctcgttctcagcttatttttgaaaacagacgtcattgatcggagggacgcctcatgattatcttgttattgatcgtcggtgcgcttgcctttttctgggctgttgtgttaatgcaaccaagtcggcgccgtcaattaacgatctgggtaagcgcgggacttgtcttggcccccatcctattgttaagcgtgaatgacctttatcacgttggcttcaacattgacgaaaccactgaactgcagccattagcaccgatggacgaccagttgcaaatttcgcggcggcccattggcacagcaaaaaagcatttcagctatcgttaccttatcatttccgatgcaaccgttcataccgctacacctagtaccacggtctcaactcgcatcgaacatggcaccattccgcaagttgcagtgacaactcagaagctgacttatagcaatgcgctgaccgctattttgtttgctggatcaggcgaacaaggtaaagcaattggcaaaatttacaccttcacactgccagcaaattggcagattgttgatcagtaaacgccatcttgcactcgcagaaaccgattcacgttccgtcatcacgcactcgccagcacaaaaatttgaagctgagccatacacttatgatttgttagatctcaattgatctgagtaatgggtctggcaaaaagtttcttaccgtgccaaactccgcaatctccggccagctggggtggcgacgcgaagctagagcggagacggcgcttcgagcccaaagaccggtctcgaagtcgcctaacaacatcagcgccaaagcccgtcgctgtgctgtttgcacggctgagccccatctggcctacgattgctacgctttggcactgaaatctttaaagcccaccctgcgctttctatcaaactacttagcgctaaaaaaagtctgacgttcagcgaaacacttcatctcgctgaggatcgtcagacttttttgattgcccgtatttattgcggttcggccaacagcatgcggtacaaggtgctgatgggcaggcccatgacattgtagaaatcaccctgaattgacttgaccagtagtgctccagcatcctgaatgccataggcgcctgccttgtcttggtaggcgtcttccgccagatacgattcaacatccgcttcacttagcggccagaaggtaacatcagtcgtcacgacctgctgccgtacgctaccattgtccaagcgcacccacaaaccggtataaacctgatgtgtctgaccacccaatgccgtgatcatctgtttggcttcggcgcggtcatgtggtttgcctaataacttgccttgaaacgccaccatggtatcggcggcgataatcgttgccccggggtaacttggtacaagtgattgtcccttagctgtcgccaagctctgaacatatgctggcggatccaacactggcaaagcgcgttcattgatactggcaggatggctttcaaagtcaggcacaatccgctttaacaattcctgtcgccgtggtgaatgactggccaaaatgatcatgcttgcatttccccgctttcgtgactgtcttgaatccgtttgaacattttctcaagatcggtgtttgaaaagtgaaccaaaaccggccgaccatgcgggcaattgaagggattctcacattccggcaacttctgcaataatgctcgagcctgtctgtcgtccaaatggtgattggccttaatggcacgcttacagctcatcatgatagcagttttctcccgaaacgctgcgactgtcatgcgaccatcacgcaaaacccaatccaccatttctttaatggtatcttcttcctgcccagctttaaaccaagtcggatgatgttcaacaacaaagctgttttggccaaaatcttccagatatagtccaaccgactcaagcacgtcccgatgatcacgaatgctaatggcatcagccgcggaatagtctaacacaatcggtacgagtaaatgttgttggtcgttgctgacttcgccaatagcttgccgataatactcatagttcacccgttcttgtgcagcatgctggtccaaaatatataacccatcgcctgattccgctagcaaataagtgccgtggacttgcgccaagtacgtgagatttggaaaacgctcagctgattcgacatgcgaaatatcaggttccggctcatctgccatcaaggttgggaccacattcgaagctagccgctgataccgctgatcccatgcagccagacgttgcggttcgttaaaaatcggctgatcatccaaatcgccaatctcaagatctggtgaagttggtgccggtgtcggctcctcagcagccgtgtctgccaagttagtagttgtgttttcgcgcaactgctgcccttgctgcggctgaactgagggcatcgtcttggggctgatcttattcaatgtcagttccagttgatccagatcataccgttctctttttggcagattatcgagcgcatcgggaatcaggttttccttcgccaatcgtgttcgaatcgcctcgctgagcaaatgactaagctgatcttccttgctcagacgcacctcggcctttgtcgggtgaacgttgacatcgaccaacgcagcatccatctcaatgttgatgacgcccattggataacgccccaccattaacttcgagccgtaaccggcaataaccgccttagtcagttggaagttcttaatataacggccattgacaactaaactcaagtaattacgcgaagctcgggtcgtttcaggcaaacttgttaacccgctaacccgaaaatcaagatcttgtgctttgaagtcaaccattgagcgcgccacagacaagccataaattccggccagcgtctggcgcaaatcgccttgaccagctgtgcgcaccaccatattgccatcatgtgaaaccgtgaaggcaatatcaggatttgccatcgccaatcggctgacgatatccacaatttttcccagttcagtttgctgcgacttcatatacttcagccgcgccggtgtgttgaagaataaatcattcacttcaacatccgtaccgcgtcggtgagccgctgtcgactgcgcttcaacctcaccgcctttgacgtgaatctgggtgccaatccctgaatccgttgccgttgtcaactttacgtcggcaaccgcggcaatacttgccaacgcttcgccacggaagcccaatgaatgcacattaaataaatcacgcgtcgtcagaattttactggtggcgtgccgcaaaaacgctgttgcaacgtcatccggggcaatcccgatgccgttatcgctaacccgaatctcctgcaaaccagccgcggaaatcaggacgtcaatttgcgttgcttgtgcatcgatactattttcaaccagttctttgacaacactggcagggcgttcaatgacctccccagcagcgatctggttgcttaatgttgccgatagttggtgaatctttggcataaaatcacttcttctttaaatgcttctgcaggtcaaatatgaaattcatcgcgtccatcggtgtggccgccatcaagtcaaatttcgcaagtttcgtcagaatcggactattctttggcgtcggttttggttcttcaaacaacgacaattgttgctcttcaacttgcggcgctggtgctggcgccgttttattgggtgcatcggcttcaagctgtttcaaaatcgtatcagcacgcgctaacaaatctgccggtaaaccggcgagcttggcgacgtgaatcccataactcttgtcggcagggccaggcatcattttgtgcaagaaaaccagattgccatgctcctcaacggcaccaacatggacattctttaacttcgccaaggaatctgacaaactagttagctcatgataatgcgttgagaacagcgttttggcgtggacatgatcatgcaaaaactcaataattgcctgtgccagcgccatcccatcatacgttgccgtgccgcggccgatctcatcaaaaagaatcaggctggaagccgtcgcgtggcttaatgcagcattggcctccagcatttcaaccatgaaagtactttcgccattggcaagatcatcagctgctccgattcgggtaaagatctgatcaaaaatcggtaagtcagctacatctgccgggacaaacgaacccgcttgcgccatgataacaatcaaggctaattggcgcatgtaggtacttttccctgacatgttaggcccggtgatcagcaacatatcggtgtcgtgattcatgatgacatcgttaggaatataactgtctcggccaagtacatgttccacgactgggtggcgaccacccttaacattgatatcatgagtcccggcatgcatcgttggtcggacataatgactgttttcagccactgttgcaaagctttgcaacacgtccaaagatgaaatttgggcggctaaagcttgtagtcgtttgatctgggctttgaccttgtcgcgaatgtcttggaaaagatcatactcgagcgctgttgagctttcctgcgcttcaagaatcaaggtctccttttctttcagctctggggtgataaaccgttcagcgtttgtcagtgtctgtttgcgttcatagcgcccttccggtattttgtccaaattggacttagtcacttcgataaagtaaccaaaaaccttgttgtaacgaattttaagtgtgtgaatgccagttgctttgcgttccgatgcttctagttcagcgatccattgtttggaattcttcatggcatcacgatagctgtccagtttttgattgtaccctcggaggatcaagccaccgtctgtcactgaaatcggcggttcgggttcaatcgcacggcgaatcaatccggcgacatcgctgactgggtccattttactgcgaagtgccttaaaactgccatcatcaagcttacccagcacatcctgaatagccgggatctgatccaaagaggtttgcaactgaattaaatcacgaccattaacggtaccaaaagcaactcggccagctaaccgctcaagatcatagactttagtcagtcgttcctgcaactcactgcgttcaaaaaagtgatccaataaatcctgaacctgattttgccgcacactgatcgcatcaatatccagtaatggtcgatccagccattgtttcaataagcggccacccatcgctgttttggtcgaatcaagcaacgacaacaaagtgtcacctttgcgtcccgttctgctgttttgcaaaatgtcgaggttactacgggcgtcctgatccatttccagataggcggaaggttgataagcaaccgctttttgaatatgggccaagctgcgtttctgcgtgttcaataaataggccattagcatctgcacaacggcagcctctgcaggatcagttagcgcctgtgacacataactgccttcactcgtcggctcggcatcaggttggactgacagaagccgttccccttgcttgagcattcccgcgtcgtcatcggtcaattcctcaggcacaacgatttctttggtggccagcgcactcagttcgttttgcagagcaaatttgctttttagatccgtcactttgagctcaccggtcgatacatcggcatacgcaaacgcataacctgctgcatgcggcatcacagcggtaatatagttattcgacttggctgcaccggctttgatgtcaacatttgtccctggcgttaccaactgaatgacggctcgtttaaccatcccgacagcttttttagggtcctccatctgttcacagatcgcaactttgtaaccgtggtcaattaaaatatcaacgtaactttggacagcgtggtgcgggacaccagccattgggataggatcgtcagcactcttgtttcgtgcagttaatgttagttcgagcaactgagcacctttgatggcatcatcattgaataattcataaaaatctccgatgcggtaaaacaaaaacgcatccggatattgcgccttgatttcgttgtactgctgcatcataggcgtttcactggttttttgcggcacgaaattcacccttcgtcctttgactttctttgacgttctatatgatccattttaacaggtgcgtcaactttgagcgaccccctggcaagtgcaaagagtgagttgttgcggttagaaatcgaagcatcggtaaacttgaagttaaatggctggttttgagccatttagcttcaagtttcttatgtacagatttccgcggctacgtatacgttcaaaccaaaaaacgatcagatcatcatgatctaaccgttttgcaagtagtctccctacttcttcaaatgataactgtaagtggcaatgatgacattctcgcggcttgcaaaggcggcgcgcaggcggaagttggtttggttgtgaagaatattctgccattttttacgtggtacgaactgcggaatgagtaccgtggttgtaaagttccgtttggcggcgttgcgcgcgacgatgtcaacgaagcgaatagttggggcttcgatggaacggtatgatgagtggatatcaacaaatcgcacctctggaaaatccgcgcggaattcgctttgggtttctttttccttattgggattctcgtccatcgaaacgtgcatagcaatgacatagtcgccaattgactgagcataatttaaggccgcgcgcgtaacccgagtgacattaccgaccaaaacaatgacggtgctgccatcgtaatcatgttgtgccacttcgaccggcaagcgtaattgctcagcaactttgtcataatgatcgcgaattttataaaacatgaaaatggcgagtggcatcacaataaagaatggccagatatcaagcaatcggtaagcaaacaggatgacgagaattgcaaaggaaatcaacgcgccagagaagttagcaatcgttttgccaatccaaccttttccgcgatgacggaaccaatggataatcatcccactttgcgacaaggtaaatggaatgaacacaccaaccgcgtacaacggaatcagccgttcagttgatccttggaaaatcgtaatcagcgccgcggctcctaacgccagtgtcaaaatcccgttagagtaacccaagcgatcgccacgatccagatacatatgcggcataaacttatctttggccaagttaaaagccaaaactggaaaagctgaaaatccggtattagctgccacagccaagatcaaggcggtcgcaaattgaacaacgtagtacatgatacctgctccgccaaaggtctctttggccacctgcgaaagcaccgtcactttggccaccggcacaataccgtaccaatagttcaaaaatgtaataccagcaaagaagaagccaaggatggcagccatgatggccaacgttttagccgcattcttttctttaggtattttaaagaacggcaccgcattactaattgcttcaaccccagtcagtgaactggacccactggaaaatgcccggaagatcaaggccatcgagactcccggaatcgctgcaccgacaaaggaagttgccttgtacggaatagcgcctgttgccacttggtaaagtccccagatgatcatacccgtcatgacgacaacgaataagtaaaccgggaccatcaaaaaattggccgattcactcatgccacgtaaattcatgctcatcaagatgaaaatgatgatcagtgaaatgatcacctgcttgccataaagcgcaggaattgcactggtaatcgcttcagcacccgcggaaactgagactgaaaccgttagcatataatcaatcagtaatgaagcgcctgcggttagaccggcatttttacctagattttcgctagcgacaacatacgcgccgccgccactaggataggcgtgaataatctggcgataggatagtgtcaatgaaatcaagagcactaaaacaaaggcagcgatcggcaatgagtaccaaatcgcagccgctgacaatgtcgtcagaactaagacaatttgttcagtcccgtaagccacacttgaaagcgcatctgacgataacatcgccagtgccttgaaaatgttaagcttttgaccgccttcctcagaagatttcagtggtcgcccaataaacaggcgctttaaatgcatcattttcattactcctatatgaaccgaatgtatcgggaaaatttaaccaaaacacaaacaatcatcagtgtaacctaaatagacgctcaagcctaccttatctaacgcaacatgacaacttggtgagattccctgacgaaaagccccaacaatatcgtcctaactagcatgatgtgcaaaaaagcaaaaacggccaccttctcggtgatgcccgggaaagtggtcgttttcgttacgccttttcgataatcacaacatcatggaccttcaacttgcgatgaacctcgtgctcgatctcgcttttagcagcgtggtcaattttaaggtcagctttaggcgtatcaggcaacagtttttccaagacaaaatcaatctcagcatctttaatggtgcgtttgtcgtgggtcaagacgacatcgacttggtcaaatccttcaacgtaataaacatgaacagatcctaacgtatataattcaaaaaacttaaccggctttcgattataaagataccgcattgtgttcggtaacattttgtgcaagctggcgttaagccgaatgggattttgaatcagcttcatcaaatcgccccttttttttgtgtgagcgtgagccagcgcgcttagcgaccggagtgtaagtggacctgaatgtgatggccgggtttgggccattgcattcagggtccttacacgcaggtcgctgcgctggcgaacgcgttatgactgagcgtgagccagcgcgcttagtgacagaagtgtaagtggccttggacgtgatggtcggtctttgaccattgcgttcaaggtccttacacgcaggttgctgcgctggcgaacgcgttatgaccgcgacatcgctttgatgtccacggctgatgatcttactaattaaccatcatacaacatgaaactatctttattttaccaatgaatgccccttagtgactaatgattaggcacagaaatgttaattaacttcataaagtgaccttgaaaacttgaaaagcacactatgtaaacaacaaaagcaccggcgcataagccagtgcttttgttgaacgaataggcagaaattacatcataccgcccatgcctgctgctgggttagcaccagcggcagcattattatttgcatttggatctggcttgtcagcaacaacggcttcagtcgtcagcatcaaagcagcaacggaagcggcgttttgcaatgcagaacgggtcactttggttgggtcaataatacctgacttagccatatcttcccattcatcagtagcggcattgtaaccaacgccttgcttttccttcttcagctgttcaacgatgacagaaccttctttgccggcgttctcagcaatctggcgaacaggttcctcaagcgcacgtagcacgatgttgatcccggtttgaacgtcgccttcttctttcaaagcagcaactgcaggcaaaacatctaccagagctgtaccgccgccagcaacataaccttcttcaaccgcggcacgggtcgcattcaaagcatcttcgatccgatacttgcgttccttcaattcagtttcagtagcggcaccaaccttgacaaccgcaacaccgccagctaacttagccaaacgctcttgcaacttttcacggtcaaagtcactggtcgtgtcatcaatttgcttcttgatgatattaacccgttcagcaatggcatccttagagccagcgccatcaacaatcgtggtgttgtccttggtaaccgttaccttgccggcacgacccaattgttcaagcttggtgtctttaagatccaagccaaggtcagaactgatcacggtaccaccagtcaaggtagcgatatcttcaagttgagccttacgccgatcaccaaagccaggggccttaaccgcaacaacattgaaggtaccacgaatcttgttcagaactaaggttggcaatgcttcaccagcaacgtcatcagcaatgatcaacagtgccttaccttgttgaacgatttcttgtaacagcggcaaaatgtcctgaatattggaaatctttttgtcggtgatcaagatataaggatcgtcaaggtcagcttccatcttatcattatcggtgaccatgtattggctcagatagccgcgatcaaactgcatcccttcaacaacagagagttcagtgtcaatccctttgctttcttcaatggtaatcacaccatcgtggccaactttttccatggcgtcagcaatcagactaccaacttctgtatttgaggaagaaacggacgcaacctgcgcgatttctttcttaccattaactttgtggctaatcttgtgcaattcgtcaacggcagccttagttgctttttcaatccctgtgcgaatgccaacaggattagcaccggctgtaacgttcttcatgccttcgcggataatactttgtgccaaaaccgttgcggttgtggtaccatcaccagcaatgtcatttgtcttggaagcaacttcggcaaccaacttggcgcccatgttttcgtagtgatcttccaagtcaatggacttcgcaattgtgacaccgtcattggtaatttccggtgagccatagctcttgtccaaaacaacgttgcggccttttggtcctaaggttgtcttaactgtgtttgccaactgatcaacgccgcgcagcattgcagcacgtgcgtcttcagagaatttaatttcttttgccattgtttttattcacctcaaaattgatcgattatttagttacgcaattgccatgatgtctttttcatgcaatacaaggtagtcttgaccttcatacttcacttcagagccggcgtatttgtcgtataatacagtatcgccaactttgacggccattggcaaacgcttgccttctggtgtcaaagcgccttcacctactgcaacaactttgccggtttgcggcttttgttttgcgttgttggctaaaacgatgccgccaactgtctgctcctcttcttcaacgacctcgacaatcacgcgatctcctaatggttttaacaaggcaatccctccacattacattttttgatttagcactcgttatgtctaagtgctaactacagaagtaactataacgagttttgcggttgaatgcaaccccaaaccgtggaatgttatacttattccagacatttttttaaaggagctctttatgtcactacaaaaacatggactttccattattggtgcctatttagtggcgctgattggtaacttgctgattttccaaatcttacccgttggccgactcagcttaggtcttgctactgtgatcagtgtgctggcgatgattgccgctggtttcagtgagcgacagttagtcattgccaacgccatcgaagaacctggggttgccgccccacaacaacgggttttctggggactaatcggtatcgttggcgttttggtcgctcagcttgtgggttcatggctagaaacatttttattcaaaataccgcaaactagcagcctaattcatcagcagctgtccagtatggcaactaatccgtggtatttcctagtgatcggattggctattcctgtgttggaagagctaacctatcgcaaagttctattcggtaatcttgtgaatgtcaccggtatctttggcggtgccttgatcactagtctcctgtttgctttaacgcaaccgggcggacactggttaagcgccacattggttggacttgttcttgcatatgattatcgacacactggcgcagtcagcacggctattatcgcccgccttggatctttgtgggtggtttggctttactatctcgcccacaccctataatcgtaatcgaatattaaccttgacccctgctttcatcccttataatagaaataatgattttgtgaaggagcagttcaaacatggagacccgttctaatcgccgccaacaacaacagaagccgaggcgttttcgctggggcaaattgatcagcctaatcgttgtggttggtctgttcacaacaggtgcgtatgccttgcggttatacagtcaggcaaaatatgccatcaataatacatatcatgcgaccaaacatgtcagtaccgacattgctaacaagaagccgttcgccgttttgctactaggcgtcgatactggtgctgatggtcggattgaaaaaggcaactctgataccatgattgttgctgtcgttaatcctaaaaccaagaaaacaaccatggtcagtatcccgcgtgacaccgctgcagagttaattggcacaaaggaattcaacatgcagaagatcaatgccgcgtacaacgttggcggttcggacatggcgatcaacactgtttccaagctggtcaatgtcccgatttcttactacctaacaatcaacatgggggcgcttgaaaaagtcgtcaatgctgtcggcggtattgatgtcgtcgtaccgttttcctttcaggatccatacactggcaaccagaagttcacgaaaggccccatgcatctcaatggcaatatggcgttggcatattcacggatgcgtcactctgacccagagggcgattatggccgacagaagcggcagcaacaagtcatcaaggccattctcaaaaaagcaatttctgttggatcacttggcaattttaccaagctcatggacactatctcaaaaaatattgccacgaatatgagttttgatgatatgcaaagtattttcttgaattaccgtgacgccgcaaaaacagtttcgactgatcatttgcaaggtgtcaacgcatgggtcggcgatggtgcttaccagattgcttccgacgctgagatgcaacgaatctccaacaaacttcggacagctctggggctgcaaaccgaaaccatcagcaatgaagagacaaaacaaaatgcgaagaacacgcagtttgactttaaggcaaccacggaccaaaactacattatctttaccccgtatgattgatcattcaaaaacacccgcagatttcactgtctgcgggtgtttttgcgcttaaattcaagcctcaagcaagtttcttctggggtcgttcccgataccaccaccagaaaccaagagcaagaatggctatgattgaaacggtataagaaagcagctcattgtttaacagccactgaccaagcccgtatggtatgacagccaatgcatatatcatgaccacccagcgtaattttggcagtaagagaacattgcccgcattttccagcgaaatgtggtcaaataaccacctcgtcgcaaaatagccgataatactgataaccatcgcggcaataaagtaggcaaaaaataagttgttgcctgataaccggactggattcgaacgcatcgttgaatagatcagtcgatctgctgcagttgccccaaaccacgtaccgaacagcccgaagacccccatccaaaacggtgacgcgaaaatcgtaccaatggcggtgccgattgtatacatgaaactaacgaccgctatattcatgagcaaaacacctaaaagattcatcccactcaatccgacatacatagcaggaatggcaacataataacctatgatggtgatccctgagccaagcatcatcacaccaagaagactcagaaaaccataccaataacgtgttgcaaatacccttcttcggcgaaacccactactgaaaatggctgcattaaaaccactcgcttggtcaatactggctattgctaaaccgactattagcggaatcaaatacgagacaaccgtgaaaaagcgaccactaataaggtcagacaaaagttgccctttttgatttggaataaaaagatgacgctggtcttcccgatactcttcataacttttattgttataaaaagtaaggtgatttttcttggcctcttgtttactttcttcaaactgcgctaagtccatgacgtatttttgctcgttatgatagttttgtatgctttgacccaaattcaccgctgacagcaacagtgcaaagactacgatcacccgcaacaaaactttatgtcgcgatcttaccagtttcaataaacgatcttcacccatttatttcacctccgcgtttttggcgcgaaactcaactttaaataaatcagatagcgataacggcaagctctcattcagcacgggttcttcggcggcaatcgcggccttgacttcaggtgtgaaatgcgggaaaaccgcttcgatcacgcgtccacgaatggtcagaatccgaccttgttccctgatcacatcaggaatcgccttggttttgaaaactaactgcagcttgatcgcctgctgtctgacgtcctctagcgtcaagtcctgactgatccgaccggctttaacgaacaaaacgcgatctgacaagccgtctaattcgactagattatgtgaggcgatgagaaaggttcgtttaccatcagcaacagcatctaccaccaaattgacaatccgctcgcgaatcagcaaatccaacccatcaaatggttcatccagaaaaacatacggtgccccgctcgccagcgccaacgccaccatcaccaatgcctggaaaccttttgaaaggctctgaaaacgttgtgatccttgcaggccgaactttttgatcagcgccataaaccgcgcttgatcaaacgtcgcatagagcaattgataatcgccggcgattttatccaaccggtatttacggaagaagagatgttgattatcaaggtaaaaaaggttttcgcgttgttccggatggtcggtcaagtcctgttcatccaactcaatggtgcccccgtccgcacgatattgatgcgtcactgttcggaagatggtcgttttcccaataccgttaggcccgacaagcccgaccacctgccctagtgataaggaaaatgtgatgttattcagtacagcctgatcggcaatctttttttgcaattttgtgatcgttaaactcatgcttgtccctccttctcattgagccatgcctgcagaatgggaatgctgatccccaaactctgcgcttcaaccactaaggcatcaaatttaggccgaaatgccgcaatatcttttgtattggcctgccttaacggttcggcaatgaacgagccgcgtcctggttcaacatagatcacgccatctgcttcaagctgcttataggcctttgcaatcgtgttgggattgagctgctcttgttttgccatctctcgcaccgatggcaatttgtcacctggcagcaacacgccttgcaccacttgtgctttaatttgcaacacaaggcgctcgtagtaagccaaatgggcatacggatcggtcgccatgaccacgccccctttcgtattatgcgtactattatacgtagtacacttaaaaaggcaagcgaaaagagcaagtcttatcgaacgacttgctctcacgttttttccaaacaaaaaacgccgactagtggcgttttcgacaaattatgcttctggttcttttaaagtcggcccgtaatgttccaagaaataaatgagcgtctgtaattctgttgctaggtcaacgttttgcacgcgaacataacttggtacagagatgcgaatcggggtgaagttcatgatgcccttgatccctgctttaaccaaatcatccgtaatgtgttgcgcagcatcaatcggcaccgtcaaaatcacaatttcgatttgctgatccttgatctgtttgatcatttcatccatgggatagattgggacaccgctttggatggtaccagctaattcgggattaatatcaaagccagcactaatccgaatgttgtttgcctgccgaaagttgtaattcaacagcgcgtgaccaagattgccgacaccgactaacccgacattggttaaccgatcctgattcagaatctttttaaagaaattaagtagatcgacgacatcatagccgtaaccgcgtttacccaatgcaccaaagtatgaaaaatcacgccgaatagttgccgaatcaaccttcactgcgtccgacaattcagtcgaactgatcttggttgttccggaattggctagaaaattcagataacggtagtacacgggcaggcgttttgccgttgctttggggatgattgtttccgccatataagcaagcctcctgtagaagtattcccacgcagaacatgtgaactgtccaacatagtatctcttgcttatattagctggtttatagtgtgaaggcaagcggatacatcttcacaagcaaattttttattatccagggaccatcggggaacgcgcgccgatgaacgaaactatggtatattaggttctaacgattattgtgaaagaaggtatccctgtgatcattttgcaggcgcaacaagttggccgcagttttaacggcaatgaattatttgctaacgtcaacttagaaattcaaaacggcgcgcgcattggcttagtcgggcccaacggcattggcaagacgaccctgctggagatcctgactggtattgccccacccgatgctggtcaggtcacaaccatgaagaacctgtcaattggttatttagcacaaaactcaggacttgattctgacaaaacgatttttaaagaaatgctgacggtctttgcaccattacaagcgatggctcggcaaatacatgacttagaagttaaactcggtgatccgcaactcatcgccgacaaagaagcttttgcggcaacgatgaaacaatacgatcaattgcaacatgactttaacgaacaaaatggttatggctatgaagccgaaattcgttccgttttacatggttttcagttcggcgaaacgacttatgacaagccggttggcactttatctggcggtgagcggtctcgattggcgctggcgaagctgctactcgaaaaacacgacttgatcatccttgacgaacccaccaaccatcttgacattgaaaccttgagttggcttgaagggtacttaaaaacctatccgggcgctattttaactgtcagtcatgaccaatatttcctcgatcacgtggtcactgagatctatgaattagatcatcaccacgcgacacattacaaaactaactatagcggctatctcaagcaaaaagctgatcgtcaagctcaagcttggaaggcttacaataagcagcaggaagaaattgccaagctgcaggattttgtcgacaagaatattgtccgcgctagcaccaccaaacaggctcaagctcgacgtaaacaattagaaaaaatggatgtgcttgaaaaacctgctggcgataataaaacggtgcattttaactttaccccaacgcgaccaagcggtaatgaagttttaaaagtcgagcaggcgacagttggttatgagccggacaaacccatggctggcccgattgactttcaagtgaataagtttgaccgaattgcgatcatcggaccaaatggtgtcggtaaatctactttactgaaaagtgttttgggaaaaattccttttcttaaaggaaatgccaagtttggcgccaatgtcgacgtaggctattacgatcaggaaattcaacagcttaaccctaaaaacactgtcattgacgaaatctgggacgatcacccgatgatgcctgaaaaggatgtccgatccgtgctcgcggccttcctttttttggcggacgacattcaaaaaccggtcagtgccttatctggcggccaaaaagcgcggctggaactcactaaattagcgttgaaacacgataatttcttagtgcttgatgaaccgaccaaccatttggacatcaacagcaaagaagtcctagaacaggccttaaaagacttcagcgggactgtcttatttgtttcgcatgaccggtacttcatcaacgagttggcaacaaatgtggtcgctattgccccgaccggcagcactacttatctgggcaactgggattactatcaagaaaaactcaccgaaactcaggcagaagcagccgccgcagccgctgctcagccaacggcaaaaactgaaactgctggtgcgacctcttaccagcagtccaaagaagacgcccgcgctgaacgcaaacttcagcgggaagtggatgatttagagcagcaacttcaagatcttagccaacaagaggccaaaattcaaaaagcgatgactgcaccagacgtcctcagtgattatgtcaaaatgcaaacattgcagacagaactcgaaacagttcaaaaacaaacagctaaagttgaagacgcttgggaagaaaagggcattcaactggaagatatgcatgctgataacaattaaaactgctgttctttaaattcaaaataggcacggccaaagatggtccttggtcgtgccaaactccgcaatctccggccagatggggtggcgacgcgtagctagagctgtgacggcgcttcgagcccatctggcctacgattgctccttggcactggtatctttgagccttaaaaaatatctccgagaaaataataggcgaatgattttccttttacggaaaaatcattcgcctattgttaactgtcaatgatgttccaacaccatttttgttgtctacttactcgaagccttctcatcaatcaacgccaaggcttgccgcaaaaccttttcaccgtccatcatcccataggctcgcatgtcgataacggccataggaatattagtaccagcaactttagcggcaaactgactttccataaagcgtacttgcggtccgagcatcagaacagatacgggttcagatgcaagtttattatcagcatctgctgctgccgttgcgaaaacatcaacatcaaggccatctgcctctgctgcttttttcatccgttgtaccagcattgaggttgacataccggcggaacagaccaacataatcgttttttcagccatgggaatcatcctttcgttaacaaacttatctataagataagtctaaccaaaacagttaggcggcgtcaacgaaatcgctgtcggccttgcatttattatgaagcgtgggtaaagctcaatcctggatcagcattcaagctttctgaagcaagatgctgcttcgcccattcaatatgagcagctgcgccaatcattgcgccattatcacccgtcaagcgaagtggcggcacaatcacatcgacatctggaaaattcacagccaagctttcgttcatggcttctttaagcccttgattggctgcaacaccaccggccacaatgagttgtttaaccggatactgatgcagtgccttttgcgttttgtgaaccaaaacatcgacaaccgccgcttgaaaactagcggctagatcttctcgactgagctcttggcctaactgatgggcgtgatgaaccgtgttgataacagccgatttcaagccactgaagctaaagtcaagattgtcttctttatccatcgcccgtggaaaatggaaagtgtcttgaccaagatgtgccaaccgatcaacttctttaccggccggatatggaatgcccagaatccgaccaactttatcgtaagcctcaccggcggcatcatcacgtgtatcgccaatgatttcgaattccccagctgattgcatataaaccaactcagtatgaccgcctgaaaccgccagtgccagtaatggatacgcaagcggcttcacaaaacgggcggcataaatgtggcctgccatgtgattaaccggaattaatggtaaatgatgagcgtaggcaatggttttggcagccgtcaccccaattaacaatgcgcctactagccctgggccgtatgtgactgccaccgcagtcaaatcatcataagtgacgcccgcttctttcaacgctgcatctgtaaccaacgtaatttgttccacatgatgacgactggctacctccggaacaacaccgccaaatcgttgatgacttttaatttgtgtggcgatgatgttcgataagattgtgtcaccattttcaacgacagccacactggtttcgtcgcagctgctttcaaacgctaaaattaattcccttgctgccacattgttctcctctacaacgacgataatgatcgattacggcaatggccgatacatatcgagtgcatcatcgtgattgctgacataataaccttttttaattttcccgtcctgaaaaccgagcgaccgatacagatgcttagcaatgtcgttattcgtccgcacttcaagcgtcattttttgactgccataatcaatcgcccggccaatcatgaactgcatcaaaaaacgtcccagacccatgtgctggtatgctgggtccaccgcgatgttggtcacatgggcctcacttaaggtaaaccaggtgccaattaatgcgactaactgaccagcatcttcaacagccaaatacaacgaatgccgaactttacgcaactcagagaaaaaagcgtaacgatcccacggtgtatcatgataaatccgtcgctcaatcgctaatgctgcatcgacatcgtcttctgtcatacgccgcagtaaatactctttattgcgaaccgtgatcgtttgtggcttaaagctcaattcatcaggtgtcgtgcgatcgaaccacgatttaaactttctcaacataaacatcatgtcctctgccggggtgtgcttccaaccagttgtgttccgcctcggtcagccgcagataacgcggcacaaaatcataaacagacacaggcggcagatctttccctaattgtcctaaacgtaatgcttgtggcaagtttagccaactcggtgcaaattgcgctaatccgcccaaggtctcaataatctgagcccgaaacatagccgcatcactgcccacaaagatcaccggctggtgcaaagtggctaattcagtgagcagtagttttaatggcacgtgccgatctgtaaccacattgatcagccggcccttgttccattggtagacacctgtaaacacattgttgcggcgcgcattcataattggcacaatcatcgcttttgtatctgtgatgttggcggcaagcaccgccagactggaaacgccagctagggcaatgtttaatgtgtaagctaatgttttccctgtcgtcacggcaattcgaatgccagtataggatcccggtccatctgcgacaataatcttatccaagtcctccggctgcaggccactagcagccactaaatcatcaatcgctggcagtagttgctcactatgcgtccgttttcgattaatcgtcgtctgcgccaacaacttatcattatctaacacagcaactgacatcgcttcgtttgaagtatcaagcgctaataatcgcatcaatagaccctcccttctcatggcataatcatggcaatattctatcacaaataagagcagagcgtgagctggcgcgtttagaaaccggaacataagcggcctaaagcctaaatggtcgggtttggaccatttaggctttaggtccttatgtgcaggttgctgcgccagcgaacgcgtttcagtcaagagcgtgagccagaccgctcagaaaccggagtgtaagtgggcctgaacgtgatggccgcgctttggccattgcgttcagggtccttacacgcaagttgctggtctggcgaacgcgtttatgcccgcgcttcagatccaagcctctcccggattaggtaacgcacctgtcatggccgcaatgagtaaaagcacaccaccaacaacgagtaagccttgcaaggtgatttttaaccataaccgttgatggatgatctcgtctggcgtccagtagagatcggtggcgctttgaacaccagttgttttatttgccgccagcaaagcatcatggagccacttggctagccatgaccaagcaacacctgcaatcatggtagccacggccagcacccatagtgcatgatcacgttcagttaaatagtctgtcggaaagacgtagaagttgccgatgatgggtaattgaccaaattcgctataaaactgattgccaatggcatatgcaagcgtcaagccaccaacaatactgcctatcagtcccaatcgccgcacccattttgcaattgtattctcacgatacaaattacgaatgtaagtcttgcgtccgctgcgcacctggttcggaaacatcatcttgtgtgttgctaattgcatcgtcacgattcgccgttccagttgcagtgcccaaattcctgtccctaccaacgccaacacaaccacaatgattaatccagcaaacatagcagccagcccttctgttttttttgagttttcttattctatcagttaggtttcatgttgaccactttggggcacatactcgatatggcagattgccaacaattaaaaaccccagacaagccgaccatcgtgaaagcattcagaaggtcaatctgtctggggctatttttaatgtaaaaatacgatctatgactggcttgttcaaagcgcttgcttttatagcaaatcaatcaaaggtggggacgaattcgctcaatggcttttaacgttccataagacagtgccgtttggattggcaacatgaccacgttcttgatcgttcgcggccagataatgccttgccatggcgtacccatgatgtttaaccatagtgttgtcaaaatgatattgctaatcaacaaaaccatgccgacagcgagcaatgtccgaagaaccgttaccttcttgccgtggaaaaacatgccgtaaagcattgccgcaatggctgcactgatggtaaaacccgggaagttggctcccggactgaagatcataattgacaactgatcgttcagcgcagcagcgccggccgccaaccatgggccaaaataatatcccatgaggatcgtggcaaagaacgctggactaatcttgagccaaggggttccgaacgagaaacggcccagaacgatttgcatcgccatcaacatggccatatacaccatgttccgggtggaaagcttgggactactaaacgataatacttgcataagctgcaatctccttttttcggagacgcctaaatatcaggcgaatgcggcacctgcaccgcgacacttgtcttcgtctgccgttcacattccgttccggcagcacttaacgcgcaggttcctactcctagattttgtcacgagacatatcgtacaccgaaaattgtagaaagggaacccccgaaatgttcgcattcgcattttttgtgatcacacgtgaaaaatatctcacgattttctcggtattttcttggtttttaccaagttagctgccagattgattcactaaaatagattctcgtaatcatatctttctggttgctcatactccctgaaaggggattccctcaacacttcattttagaagtgtttttttacacctaattatgggtgttcgcgccattgactttagctgttcgcggctgcataaagagccgtataatgaaatgcgacaacgtttgaaaggaagatatgaccgtgactaaacatattctcgttttgcatacgggtggtaccatttcgatgactgaaaatagcgaaggtgacattatgcccagccaacataacccgttacttggtgctgacagttttgtccctgctgacgtcgaactcaccactgaagaaattttcaacctcccatccccgcacatgaccccagaacggatgctagaactcgttaaacgcatccgccaagcggaaaaagaaggcagcgatggcgtcgtgatcactcacgggacggatacgctggaagaaaccgcctattttcttgatctgacccttgattcggcgatgccagtggtcgtgacaggcgctatgcgctctagtaacgaaatcggcagcgatggtctggagaaccttcaaagcgccattaaaacggctgccagcgacgactcacgcaataagggaacgctcgttgtcatgaatgacgaaattcataccgctcggttcgtgaccaagacgcacacgaccaatgtggctactttccgaacaccaacattcggtccagtcggtttggtcaccaaagatggcgtccgattctttcaagaactgattaatcaagaaatctgtgcgattgatcacctcgtcgacaaggtcttcctcatcaaagcatatgctggcatggatggcaccttgttcgatgcactgcctgaagatacccacggcttgacgattgaagcgctcggtgccggcaatctaccgccgaccaccttacctgccattcaacggctgctggatcgcaacatcccgattgttctcgtttcccgctgttttaatggtgttgcgcaagccgtttacaattacgaaggcggtggtgtgcaacttaagaaaatgggcatcattttctgtcaaggcttgaatggccaaaaggcacgaattaagttgcaagtcggcctcagtgacggcaaacaggggcaggatctagccgacttcgtggataatgctgttagctgacaattaacaaatagctgggattatcctcgatttcgaagaccgcaacgcaaaaacggcactaagcaaacgtctcttttttgcttagtgccgctttactatgctttaaaatcctgccaaatcatctgcgcttctgcgttgacctgctcgccggttacgacgcggtgcaaggttttggtgggatcatccggatcatgctgatattgggcaacaggcgtcgtgccatacgcgacttcacgttcataccgaatatccgccccgcgtaacgtatgggtactcaaaaaatcatagccaagactattttccatccattccaagtaatgagcattgttgacgtgtccgttactgtcaatatcaaaatagcggacatgaaaatcttcttgaccatctggggtggtgatctttttaagccgcggaaatcgcttgattttgcgatcactgaccgcgccgacacgctccaccagttccggaatcacgtccacaattttgcgtgtgcgcagatccatgatgacccagttgctattcactgttaccaagcgctgcccttgcgcatcgtcaatccaataatcccggtaagtaaagaatttattgtaagtcgtcgcctcggtccccacgcgcaatggttcctcaattcgcggcatccgctgaatatccatatgatactgcgtgatcacccaaccagcctgaaattcattaattgcatccatcccggcatgcaacgtctctaactggcgctccgaaatttctaacatgacattcatcatatttgccaatccggcgcgaccataccgatcacccgcaaaaccgggaatccggtaatcatcttcgtagacctttcccattaggatgactcctccttaaatcacacttgctggcacagaatccggttggcttcgcataagcctgtttctaaacgcaccagatctcacgctttgcttatttttccaactcatgataagcatcatacaccacttgcttcgctaagccattttgtttggcgactaatttaatcgctgcatttggtttggcaccagtggccacaattgcctcaacttgcatttttaaaggcaccgtcacatcaactgctggcttatcagccgcaccttctaccataatcacaaattcgccttttaggtcaccagcggcataagtttgtaatgccgacaatgaaccgcgaatgaaggtttcgaattttttcgtcaactcacgggccaaagccgcctgtcgatcaccaaaagcagtctgcattgctgccagcgttttgccaacccgatgtgggctttcataaaaaagcaaggtggctgattcatgggctaacttctccaattcgcgatttttctccccagctttacgcggtaaaaagccgtagaacaaaaacggctgcggcggcaagccggaagcaatcagcgcagttgtcgcggcgttggctcctggtaatggcaccactggcacaccggcatcaatggctgtgcgtaccaattccttgcctggatcagaaatcgacggcataccggcatcgctgacttgagcaattgtctcgccgtttgccaacttcgccaacaactcaggaatgcgcatctgtgtgttatgctcatgaaacgaaatcgttttagttttaatctcaaaatgatttagtaacatttgcgtgtgccgcgtgtcttctgctgcaatcaaatcgactgttttcagaatttcaatcgcacgaattgtcatatcgcccaagttgccaatcggcgttggcaccagataaagtgtgcctgttgtatgtgaaccgaagcttcgttgttgctccaagtcaattctccccgtaaataatctcagtacaaaaagcgcatggctcatcattgacccggcgctggccatagaacatcgggcaaacatggaagccttcattatacagactttcaagattttgcttcgacttagacaattcaaccccaccatcactggttttattgtcatctttttctaattctgccaaatgttgacgcaaatgtttgttttcgatctcaagttcagcattgcgttcaagcgtttctgccatatcgtccttcatagcggcgatttctctgagcatctgctgggcatgtttttcaagggtcaagaagccatcatataattctttcttttccacaagatcacccttctaatagtttaagcattaactgttctgttgcggattgaaacgtaacattctggctcaatcgcacctgcgccgttaaaatagcctgcagcgccgtggttagttgcgcacttgatcgctgagccaagacgccgatcgccggcaagtcaagttgttgcattgatgttacctgaaaatgttgattcaatgcatcagcataggccaagccgatcagcgccaacacttgacgctgactatcagcatctttagcaatcggcagcagttgcgtctgcacccgaacaaaactttccggatcgtgatccgccaaacgctccagtaactggaaaaccttcgtcacccggtcttgaaatgttgcagacgccaacaaggcctgcgcatcagccacattgccagtcaatcggcctgcgactcgtgccatttgcgaggttgctccgccttcttctagctttgcaatcacggctgagcgatcagggctttggaatgtaataacctgcgcccgcgacaaaatggtcggtaaaagttgatttttcgaggttgcagtcaaaatcacggtcatcccaggcactggttcctcaaaaaatttcaataaggagtttgccgcgcctgctgtcattttatcagcatcttcaacaacaaacacacgttgattgccttcgaccccggttttgctcatttcttgcttcaacccgcgaatatcgtcaaccttgatgctttgcgtttctgttttgaccaccatcacatccgggtgattatgattcaaaattcgctcgcactcaggacactggccacatggcgcaccatcctgcacattttggcaaaataggcgcaaggcgatccactcagccaaggccagcttgccagccccttttggccccacaaacaaatacgactgtgccaattgcttgcggtcaatgattcgcgcaaactgagccacgagtttaggctgaagcgaatcaattaaaaatttggtcatcagaagcgatgaaaggcttcgatcggtaggacaaagacggtggcaccgccgacttgaacctcaaccggataggccatcgaactgtcagacgtagcgtcaagattgactggcggtgtcatgaattgttggcgggtttgcgaagtctctttgataatcttcagaacttcatcgacccgatcatcagcaatcccgataatgaaggttgtattaccggctttcaaaaagccaccagtcgttgataatttagttgcctggatattagcatcaataaattgactgctaagcaagttgctatctttatcttgaacaattgcgagaattaatttcatgcgtgccctccttgaccgcgatgacggttatcacttagttaaatagttccggaaaacgacgagtaatggtctgaaaacaagcggcaacaaccttttccagtggctcagttgcatcaatcgacacgattcgctgaggattatccactatcagtgtcatgtatgcatcatgaacgcgttcatgaaaagccagactttcctgatcaagtcgatcatattgacgctcgttttgatgggacttgatacggtcaagtcccatctgaactggcacatctagatacaatgtcaaagccggctccagtcctgcagtggcaaattggttcattttcaaaacggcatctggcccaatttctcgaccaccaccttgataggcaactgaactgtcgacaaatcgatcacagacaacaatgtcgccttgtgctagcgctggttgaatcacttcaaccaagtgctgtcgacgcgacgccgcgtataaaagtgcttcagtccgcgcatccatagcagtgttggcagggtcgagaatgacctcgcgaatggtctcggaaatctttgcgccgcctggttctctggtcaaatgcaatggcacccgcacgtgctgttcgagttgcgggatcaacgtcttcaaaacgctggtcttgcctgcaccgtctggaccttcgaatgtgataaatgtgcctgtcactatatgccgctccttctctaaacgcgttctctggtgcagaagcctacacataaggaccttggccgcaataaccaaagtgcggccatcacgcccaagcctgcttatgttccggtttctaaccgcaccagttcacgctctttttggaattaagtccattttacttgatatgtttcacaattaaaaacttatctgcaaattcacgagactaataagtcgttatacataggcaaaaaagcggcaaatgccatgatcctgaaatggcagtcatgggcatttgccgctttagtgaatgttgattggtatcgggtagctgcacgatgccctaatggtgaatgagttatgcttggcattgaggtttttgcatgcctcctaggaaggcgaaaaaagatgccactcggcgtagcaaatgattggcgcgttgaacgttctcttgttggtacgtggaaaagctctgttaccgcttcacgactctctgaaccgcgcaaaaaagcgcagaaacctccgtgtaaggactttgaaccaaaagagccacgcccagcccttttggttcaaggccacttacattccggtttctaaccgcgcttttttgcgctctataaatctctatactccgcaatttgctccgcagccactcgggccacaagttcgcccttgatttggcgggtgcgcgcttcgcggtagagaaagtcgaataggcctgtctgtaaggctacttgcgctttggtttgttcgtcgacttctcgaaaagtagcaacgagcttgcgttgtgccgacatctggtcgcggacgcgatagacgagcatcattaattcttcgtctttttcttccttgacctttacctgtttgcgtccaaacattacagctcagtccttccttcaaccgccttcatcaaggtcatttcatcagcatactcaatatcactgccgaccgacagcccatgggctaagcgagtgaccttaataccagctggtttaatcagccgagccaggtattgggcggtggcttcaccttcaggcgtggcattagtggcgataatgacttctttgactgccttatttgccttaagccgttttaacaaactctcaatattcagatcttcaggaccgcggccttcgattggtgataaaacgccatgtaatacatgatacaagccatgataatcctgagcccgatcaatgatcatgacgtctttaggttgttcaacgaccaatatcgtgctttggtcgcgacttttatcgcgacaaatagcacacggatcctcatcggtaatgttgccacaaatggaacaataatgcagatcctcttttgccgcgacaagacttttagcgaacgccgtcacatcgtccttattcatatcaatggtgtaaaaagccagccgtgttgcggtttttgccccgatacccgggaggcgcatataactgtcgatcaatttactgatcggttctggatattgcatagtgtcccctcttgttgtgaaaacgtactgagtgatgatctttgctgtcatgagaacagctttggtttcaaaatgatgcttatttgcttatgttgctgaaactttgggtgcgaacttgggttgttgtaaaagttcggtttatgcggtgaagacttcttgatgatacttgtggtccattgttgttctccgaaacgcgcaaaaaggcgcagaaacctccatgtaaggaccttgaaccaaaagggccaaagccccagcccttttggttcaaggccgcttacactccggtttctaaccgcgcctttttgcgctctgttgttacattggcaatccgcgtgtatacttgcccatcttatcttgagtttccttatcaatggttcccatggcttgattaaccgcttcgataatcaagtcttggagcatgtccggatcgtctggatcgatggcttctggtttgatttgaatgtctttcatgatcttttcaccagtaaacttaacggtgaccatatcggaagctgacttgccttcaaattccgttgcatacagttccttttgtgctgcctgcatttccttttgcattttctgcatctgcttcatcatgccttgcatattacccattccacgcatgtttcatcatccttttctagtcatttttgattgttacgttaggtgcatctttaccaaatagttctgttaatttgctaacaactggcggtatctgcggtttagtgtcagctttctgttccttgttttcaggggccttcaattcttgaatataatcttgtcgaatggttggccagacatcactttgaaccaaaacaatttttggctgcttgccggttaatttttgcagaccactttccaattccgtcatcagcgcggcatcattcatggcgcgttcaacgtagatatcataatcgaaactcacgatcacaccgttaggactggcagcaaccggttcactgactttcatcatggcgcgtttcgtgatactaagcagacccagcagattcggccaaacatcctttaaattggtcaggtcctgtttggttgcggcacctaaaatcggataaatagctttacgattgacatggttggctttggccttcacatgtttccgggttctggttggtggcggaatggtgccgccgttcgcctcgacccgtttcagttgatcactcagctgtttgacttttgccgtcaatttttcaaattgcggattttctgcctgtgctggtgctgccgtaacctgtggcgttgtcgtttcgcttaatcgaaccgttgccacttctagataaatttccggatgattggtcatccgcagttgttgctgcgtgctattcaacacgtcaatcatgtggtagatctgctctggcttgaagttctcgctcagaattttgaattgatcatcaagtaagcttttttctaaatcacccaagagtgtcggtgcttgttgattaaccaacagatcccgcaagtattcaatcagatcttcgattaaccgcccaggatctttacctgacgctaacaaatcctcgatcattttcaatgcctgcgcatgatccttggcgaggaccgcggctaaatacttgcccaaaacagcagtggtcacaccgcctgtgacatcaagtgcatcttccgttgtgacgtgattatcgccaaaactcaacacttgatcaagaatcgataaggcatcccgcatgccgccttcagctgctttggcaatcactttcaacgcagcatcgtcgtatgtgatttgcttatcatccaaaataaaacgcattcgcttaacgatatcttccggcgtgatccggcgaaaatcaaatcgttgtgttcgcgaaataatcgttgctgggattttatgtggctccgtcgtggctaaaataaacaccacatgcgccggcggttcttccagcgttttcaacagagcattgaaggccccgctcgataacatatgcacttcatcgatgatatacactttgacgcgagcttgtgttggcgcatattttgccttgtcccgaatgtcacgaatctcatccacgccgttgttagaagcggcatcaatttcgataacatcggtcaaactgccattattaatagcctgacaaatttcacaagtattatctggctcaccatcctccaagtgtagacagttcagtgccttggccagaatcttggcgaccgatgttttaccggtaccgcgggggccggtaaaaagataggcgtggcttgtctggccagtaatcagcgcatttttcagcgtcttggtgatggcttcttggccaatcacatctttaaattgctgcgggcgccacacccgatataacgcttgataactcaccatgccgcctcctttaaacgcacccgttcacgctcttcttagtgaaatattcgctgtgttctagtttaccatagctgcctcatgagtagacagaatctgcgacaacaaaaacggccgctccaattacaagcgaccggtcaatttctcaataacaaaaggcacatgacgaacctaccttagtgctgcttccttccggacctgacacgattcggaaagccatcattgccttaaggcctttcggcagttttcattataactgattttcactggtttgaccagcccgcttggcggcttttcttttggctcggatcgttcggaaaaacgtttgcagcaacgtggcgctttcatcggctttgatgccgctgaccacaacaacttgatgattaaagcgggtgtccgccaataaattataaaaagtgccagcaacgcctgctttaggatcagtggcaccaaagtaacacgtcgccacgcgcgcattgatcatagcgccggcacacattggacatggttctaacgtgacaaataagctgcaatcttccagccgccatgtaccaagcgttttgcatgcagcctgaatcgccagcatctcggcatgatgcgtcgcgtcttgagttgtttcacgcagattataaccacgaccgataatctcgccttgatggacgatcactgcgccaatcggcacttcgccgattgcagcggcttttttggcctcggttagagccgcatccataaattgattgatgtcgtgttcgtccatgattgccaagcactccttgttttatcattctgatgccaataaatagccgtccatcaggaaaatcctcatggacggctattttgatcacgcagccagtttatttacctgacgtgtgataagccacttgtcgctaaactaacggctagtgactcagtgctgcctttaagcgatcaatggctgccatgccttggtcgcgagccgatccggcatattcgctagcactgtcttttagactgcgcagcttatcgctaacccggagcagactggcaacatcatcatcgctcaatttatctaaaacggtttgaacccgatcactgtcgccaaaaatctttttcacgaagccttcaacctgacgccgctggtgctgccgttcaaaatattcagtcaaacttttggcacacacaaatgcccctgctgcgattgcggcagcggccactgcaccacctaatgcgagatatttcgattttgtcatgtcatattgctcctttctgtcctgacctgagtgtaccacgcctagtataaaaacacttattttgtcgctttaagaatatagtacccgtgttccttttttacaatgctggcatctggataaattgttttcatcagtttcaatgcagatggcgcaccttgtttcttttgaatcaccgcatataactgaccatgcggcaacaaatgctcggcagcgccggcaagaataccggaaacgatggttttaccagcacgaatcggcggattcgtcacaatcacgccaaattggccatctatctgatcatacatggaactttcgacaatcgtgacattgctgatagcgttatccgttgcattgcgctgtgccaaagcaagtgcacgttcattcacatcactcatcgttacttggcgatcaggaaagtgcttcgccaaagcaagcccaatcggcccgtaacccgttccaacatcaagtatcggtcccgttggcaattcttctgccagtatggttgcgatcaaaacccgactgccaaaatccactgtgtgtttcgaaaacacgccattatcgctggtaaagcggagcgaatgcccacctaactcaaagtcaaagctgtgctcatcatgggccaaatcaggatcattcgtataatagtgattcaatattggtgcctccttgttttgcgcagcgctaaaaattatctgctagccctcagccatgaaaaaggactgtcaaagaccatactctaataacacctaacatccggttatttgtcaatgccttgaccgagtcggctcacccaggctaaccgctttggccaccacttgttcggcgttgcaaaagtgaccttctgattcacgaccatcatgatctgcagcaacgtgaatagcaatgacgtccgtttacgataagcaacgtacttcggtacccactcagtcacatatttatttttatacgagcgcaatccttggaatccataaaaccgataaccgtattcatacacaaggtgagcaatcttttcttcaataaaagaataactagacgtaccgacattcgccagcggggccatccccatattgaaatacttaaagccacgatccttggccaattcaaacagatgaataaacacttcatccataataccagaaggcgcatcggcactggaacgcatcaaatcaatgctagtgacttcattattacccgtcggcatatcggtcgcaaacgccacaatcttgccatccggcgctcgcacaaccgcaatcggtgcctgattcaggtaatggcgatcaaagaaccccaagctgaaccctttctcactgcgcccgtccaaccatgaatcagacacggtttgaaggtcgtctagcaaagcatcatcaaacggcggcttgagcagctcgacactgtagccttcacgctcaaacttgtgcataagcgcccgctcaccttttcgcttcgtgccagccaatgtaaaggttgtcacatccacataaccttcttcaccaaacttcatgaagtcaaagccaaattcatgcaacttcatcgtcaggctttcattaatttcataaaagactaacgacatatcctgatcgtctgcctgtttcataaagtcagcaatcgcggctggaatttgggtctcatctccaaccggttcacccatgacaatgagtttatcggccttctttttaaacaggaagaacacgcgatcttcaccgtccacttgataaaaatgcagcgatttatcacgcatcagtcccagatggctcacttcattcccgccaaatttagccacaaccgccttcaaacgcgcctcatcgtaaggatcggccagcgattttgtcggcgccgacaaatatcggaagatgagatacaccgtcagcgcggccagcatgaccccgatcaaggtagtgaagaacatccgctcagacgggaaaaggaaaacatctggcacatgccggtgatgaatggcaggcgcattatagaacacagcaaatgcataaaagataaatgtcaagccaaagacggcaccatcaatcagcttgttgccccacgacagcgccaaccggtctctggtcaattcacgacgcgtcaagataagcgcaatgacgaccaaaataagaaacacgataaagcgcagatgattatcctcgcgcaatgacgccaccatcgccacaatcaacacaatcacagtcggccagtaagcgcgcttcacgcggctggcaatgccacggccaaagccaagaattaagaaagccacaatgacatttgtgacccgatcaaggaataggaaggtgtagggataaaggcgctgatacaaggtgttttgaaaagcaagatcaggcgcaacaccgcgcaagagcaacataatcccagaaaaatacaggaaaaccactagaaagccgaatgctgctttgcgaatcaattgcactggtaagccttcaaggtaagcattcaatcgtttgccagcatcttgcgcaaacaaaccggcaccaatcaggaacggaatgacatagtagaaaagccgatagaaaagcaaccaaacaacggcggcactactgtccagacccaactggccgagttcaacaatcattaacacatcaaaagaacccaagccgccgggcaccattgaaataaccccgatgacattcgccaccatgaacaacggcaagacagacgatagcggaatgggcgcctcaagaaaataaccaatcaaaagaaagaaagcagcacaaccgccccactcaagaaatgatcccagcgtcaggcgcaactggcgtttgagtggcatatcggcaaaaaattcactatcacgcacatgggagatgatcatgagcaatgggaaataagccgcaccgcccacaagccagacccaatagttagcaaactccgccccaataccaaaaacaaaaatgacgacaatcccgatcatggaccaaagcgacaacccagccaacaaaaacatcgcgatttttgaaatcgcaaatagcacctgcttttgagacgctttttcatggtaaaagtttgcccgcaaactagcacccagtaaccccccaaagccggcaatattggtgaaggtgttgacaatccagcctgatttaatgacataagccggtttgtagtgccctggtaacaattcagtaatcacaaaatcataagttagcatcggtgtaacggcgatcagccccacaactaacaaaatcaagagcgaaacagggctttgcgtggcgaggctcgcccgcatttgttccccattcaaatcttggctgatccggccaacctcaaaaatcacaaacactaggactgctagcacaaacagtactttaagtgtggtgagatgtttctttaaaaacgatccggtttctcggaatagttttttcattgctgcgtcctccgtgtctatattcctattcattataggaaatctacaagcccctcgcaccctttctgacctttttgtaaggtgatgtaagtttgcgagatgattgaaaaaattttttaacttttttagttgaaaacgcttgacctgaaacgcgttacagaaattacactcagtctagagtcaagagcgtgaacaggagcgcttagaaaccacatttaggtaatgatctcaatcaagtcagcagttattttcaatcaactcataggaggtaaacatcatgttaatgcaaacacatctttatcaggaacttcctgtttatcaggatacgcaaattggcgccttgaaggccatcgctctaaagttgaccaatgatttcaattttgattatcaagaggttctaagttccttgttagccagcgcgggtgagcaaacgcaaaccatcaacgatcaggcaatcttaacgtatggtcatgtcaccagtttgacagaacctgttgttattggctttgattttggcaaggctttaccttgggccgctggtcaccaaatcagtcaggcgattgtcttgttagtccctgtcgacacagctgaggcaaccattcaggatcggcttcagacaatctccgcggcaattgcacaagatcaggatttgaaaacaatgacccaaacggcaacagctgcaatcgcttagtcatgctcacaatgagctactgcattaagatcaacgtttatgtcacaaaagtcggcatatcagggtctaaaacaaaatgaccactgacacgtcggctttttgtacgcttggctttaactgcttgttatactggaactggaggtgcttttatggcgaatattcatgacattgctcgactatccggtttctcaacggcaacggtttcgcgcgtcatcaatcagcaacattatgtagcgccttcaacccgcgcagcgattcaagcagtgatcgatcaacttgattacgtaccaagcacaatggcacaaaaccttagcgcaggcaaaacgcggacaatcggggtcatcttgccgcacactgatcatccctattttgaacagcttgtgaccggcattttgaatgcagcaatggccggcaattatcatgcggtgatcctgccatctcgctatgatcagtcactcgaacaagactatttagaagacttacgccgtcatgcatatgatggcttgatcttcacgtctcatggtcttggcctgcgcacaattgctaagtatcaaaaatatggccctattgtggtttgcgaaaatccgggaaaaatcaaactcgccgccgcttacgccgaccgaacacctgcttatcaagaggcattccagtggatgggtaaccaaggctacagcaaaatcgccttgctgctaagtcggccctatgcccaaagtgcgactagtaaacttaccatcaacagctatgtggatgtgttcggtaaacgtcctgctgacgaaatgattgtctatcacatgcgaaccttcgaagatggctatcaagctggtgcgcggttagtcaatgagcatccagactttatcctcggcaatggggacgatatcacggccggtcttcgccagtatttcgtcgaccatcacctgcccatccctcctttaatgggtcaagagaatcagctttccagtcgattactgcaaatgagtacgatcgatcatcatgttacagccatcggtgcagcagcgttaaaactggccttgcgcgatgacattgctcagacggtgattcaatccgatttgattttacggtaagtatatgacaataaaaaagcagcaacctgccatggcttcaaagccatgataggttgctgctttactttttgccgatacgctgctgccctaaacgtaacgcatggacaggctattcttcacgttgtttccgtttcaatcctaatacccccatcagactgaccacaatgacacccaagaagccaaacgctggccgctcagttgtctctgctgtcttgggtaatgctcccttaccggatgtatgttgaccattacgatcagtcgtatcatccgtgctcgttgacgtcgttgtggctggctttgttgggatattaccgccagaactaggctggctgccctcatcgcctttgttcttacctgtgtcgcctggagcgggcgccggggtaccttgaccgccgcctttgtcgctagtaccgcttgtatcgtcgcctttaccagctgtcttggccgcttcaacggcagctgccaccttcgttttcagactttgcaaagcttgtaaatgtgcaagcttgtcagacgcatcagcactggcttgaccagacgtcaatgtgtcagcaatgtcggcataccaagttttgccagttgcagcatctttagcattgccaacctcagccggtgttgccgctttaataccctccgcaagttttgctaatactgcatcaagtaccttggcaagactcgcttgaagctggtcggccgtttgcgtgcctgcttgagcttgtgccactaggtcgtctaacgctgccgtaaatgttttgccagtgcttggatcagtttgattgcccaagtccgttcccagcgcagccttcacagattgcaactggttaagcagcgaagtcttcttatctgcaggtaatttggcagctaattgattgatcgcagtttgcaggtctcgattggcaccagtaagtgaatcaactgaggcgtccgtctgatcaagcgccatttgtgccttctgcgttgccgctgctaaagcagtcgttgtggcatcatcatacttaccgctggcacttagcgttttggcggaagcaatcagattagtcagtgcctgcttagctgcctgcaattgtgcaggatcatcagtcttgatattggtcacaacatagtcgacggctggtgattcattaccgtataaatcagtcgacttaaacttgaaggtgccatttgccgtgaccgtgacaccggctgccggcacatcctgatatgtcttgccaccatcagcactatactgaaccgtttcacccgttgcggcagcgtttgccgtcagagtcaccgttttggctggttcagtagtacttggcgtcacagttggtgctgccagtgttttctttggttcgtagtaaactgtgatcttcttggtcgtggtgttgttttcgctatctgtaacagcaacagtcagcacgtttttgccttcgagcaatttaacgggctgatcaatagccatatgacccggtttgccgctattgatgttgatgtctgcgtattggctggcgacatgactgccgttaattgccagactcagatattgtgcattgtcagtggccgttccggtaatctggaagttcggatcgttggtataaaccggtgcatctgtcgagctgtccaatgacaatgttggcgccactgcatccaaaatgaaggtcaacgcttcttggaaggtcttgttttgagtggtgtcacccacaacaaccccaaacggtttttgtccaagagtacctaaatctaaagtgaaactgaaagtcagatcatccttgattggaatttgcttaccatcaacctgcaacgttgtcgttgggtgcttgaccttaccagtaatcgtcgcaatcccggtcttagggtcatagaacttagccgaggtggcattgaattcattggcaccaaatgtcacaccttgatcgaacgtcacagcattcttcaacacatcaggatcataagacgaagtaatcgtcttttgttccgtcgtggtgttgccgtcttcatcggtggcggtcaccttgatggtattgtcaccataattaaccggtacatcaacactaaagtgatgttgtgcatcaagtgctgctacggtgtcgccaacattaactgtcttggtgtcagcactaaccgtccctgtaaccttgatggtcgcttcggaggtctgatccgagccattgttgaatttcaaatcagtaaaggttggcgccgtcagccgaactttggtgtcaaaatgtttaagcaactgggtgtgcgccttatcggcatatagatccacttgcgcggcgtaatcagcattcgtgaccgccattgaggcagtgaaactgttagtcgcagcatcgtaggttgtgttcaaatcatgtttctttccttgtgcatcagtgtaagtaccgtcaaccgctgctggatacgtcccactaaacgtatacgtcccgccaccttgagtattggcttcgtagccagttgtggtgcttgagatcttgtctgggataccgccgccgttcacaattaaatcaaacgatgtagaccccggcttctgaacgctggcatcttgatcagtggcattggatgcattatcagtcaagtacagctcagccgaattgtcgccattgccaagtgcttgggcctgttcatcagataatggcgtttcaattttggtgtacccatcagccgttgtcccagcatcggtaaaggtagcatcaagattcgtcacttcattaattgcagttttaacgctcttggtggcatcaagaccactcaaatcatccttggcttcagctgtcaaataatactgggttttcccattttccgttttggctgacaaagcgacatgacgaactgtcggcgccttagagtcgagcttgaaaggcacatcaaacacttgacgtttgtcgccgccttccggtacaccggaaatacgataagtataactgccatcatcagccgtcttgatgttgccatcacgttgatcataataggtgccatcccacgctggagcattgtagtagatgtactgctgcgaatgagcatcataataggtcttcgtctgattggtggaactgctgagagtcgtaactttattgccctgaccatcaagaatatcaacttggacgttgctgatattgcgcaatagataatactgcatgctgatgtcattatataaggcattcttgtcactcgaaaaagcaatcgcctgatcgtcaactgtctggttgccatcagcgtctgtgaccatgccgccataatattgattgcctgtatttttgttcgtcaatagtggcacggtgccataattaccaccagcaggactataagtgatcccattgagactatcgacaatcttaccgtcattccagtcaccaaaaaagcccatgtatggcaagttcaagcgcgaaccatcgctacccttaaagttcagaaaaccttcaacaaattgctgttggtcaaaagacctcggcaaagatagtgtgaattcaatctgcgccgttttcccagcaggcacagttatgtcactgccggctttaatggctgctccatcaatcttcttatcatacaaaaccccagaattagggtcagtcgctgatgtataaacggcattagtatccgtattactgtccatttgataggttagttcatgggtcgtgcggttcgtgaaggtcagtttaaaagtcttgtccgtactcgtgaagtctttcaattcaactgccgggtagccgttttcggcgacaaccgttgacggattcttttctaatgcatcaatggctgccttcacatcaacaagaccggccccttgccgccgcggcgatacgataacattattgtagttaatatcgttgattggctgggcagtattcatctcaactgtcttaagaaaatcggtgagcgctgtccctttaagttgtttgtagtcagcataaaatgggttgtttttgttattcaatgcttgtttcaacaatgcttgtgaaccggcaataaatggcgaggccattgacgtaccagacatatttgtgtagccattgttgttttgcgttgaccagatgttgccgcctggtgcggtaatatctggtttgaaggaaagattggaaactggcccataggatgtgaagtcagacatcttgtcttcagtatatttctgatttggtaacagcgtcagggcaatcttgacaccgagactatcatccgggtgtgctgtgacccagtcaaccagcttttgaccggttacactggagagcccaaatgttgggaaggtggtggttaacgcaatagaagtcaacggtgttgctgtgccatcgttgttgacaatgatcaagccagcagcaccagcggcttgggcgtatttttgtttgtcagcaaagttaagttcgccacgtttaacgatggcaattttgcctttagcgtcagcagtatagtcggctgctgcccctttgctgaggttgccactagcatctttgacaacataaaacttcttttggtcaaagctaccagtgaaatcgttgcttgaaagctgaatggtttccggtccaagctgtaaacctgtaccatctgtaatggtcactgcctgactgatgacatccgtgttctcagcggaagcaactgtggtcgctcctcgtgatgtccctggcgttcccaccatttcattgtcttgcaaaccgtaataatctttgttgacaccttcagttgctgaaccggatgttcctgagttcccagcagaaatgacggcggctgttcctgattcgttggcattttgcaccgcagcaatttctggatcctccaaggtttggttgcctgaatcagatcctaaggacatgttgaggacatcggcaccgatttttgccgagtcttcaatggcagaaaccaaggtagctgacccagttgttgcagaagtgtcagagttggtgaaaactttcattgccagtagctgtgcttctggcgcaactccgacaacagacttggttggatcgtcacctgtcccgttagcaccgatgatcccagcaacatgcatgccgtgttgttcgtcaaccgtatcatctgtaatggtgtcgttattatcagcgtaattaaacccatatggcacttttgaagtaaaatagcggccatgcttggcggtatcagtgaatttttcaacatcagatttggttagtttaacgtctttatcatcgcttagccgcatgtctttatgtgttggatcaatgccagtgtcaataaccgagaccactgtgccttcacctttatatttgtaattggaccatacggcttgcacattcgccatcgagtttgccctagcatcagtcggataataaactttcgccaatgtgactgttttaactccggcaatttgtttcagtttagggatatcaacaaccctaactttagttgaaaagccgttaacgacatagccataactttcaccggcagtttgttgggtgacttgttcaacagctgccttaacgcttgcctgagccgcgatcactttattggtctcctgctgaatctccgccgtgctggagtaatcagttcttaaagtgccgttttcagaggcaggcgctgcgctcatttgaacaatgacgtcaacataaatatcttgctgctgaactttattcagcttattgtaatcaatacctttagccgccaactgtgtagcaatcgcttgattcgttgtcgctgcggttgtgtcagtggccgcttgcttagcagtcgcggccttaaccgtatttgcgagtgatgatcccttagtttgctgcgagatagccgcctttgcttggatttcgccgactggcaagacagccagcgcccctaaagcgactgtaccggctaacaagatcgatagccctttctttttcctttgcatccaataccctccacttcccaaaagtttcagaaccaaatcaaaccctacgcttgatgtagttaagattatatactctcgaagaacagattcaacgaaaattttaatcttttattaattttcctatctgtaaattagcttttagcgttattatttagccgtttacagactatagatgttttgaaatttttagtattattagaaaatgagtatttgcattgaaattctcaattgccaacgctagaataaatacacaacgtttactgtaagcatttcagaggagaccgagtcgatgaagaaaaaaatgcgccttaaagtattattggcaagtaccgcaactgcttttctgctgctaagcggttgtcagtcaaatcaggccgaccaaacagttgcgacctattcaggtggcaaggtgactgaaagtagcttttacaaggaactcaaacagtcaccaacgacaaagaccatgcttgctaacatgctcatttatcgtgcattgaatcatgcctatggaaaatcggttagcactaaaacagttaatgacgcctatgatagctacaaacaacaatacggcgaaaatttcgatgctttcttaagtcaaaacggtttcagtcgcagtagcttcaaggaaagcctacgaaccaactttttaagtgaagttgcactgaaaaagttaaaaaaggtttctgaaagccagctcaaggccgcttggaagacctatcagcccaaagtgactgtccaacatattctaactagcgacgaggacactgctaagcaagttatcagtgatttagcagctggcaaggattttgccacgcttgcgaaaactgattccattgatactgcgactaaagataacggcgggaagattagttttgaatcaaacaataaaacgctcgatgccacatttaaggatgctgcctacaaattaaaaaatggtgactacacgcagaccccagtcaaagtgacagacgggtatgaagttattaaaatgattaaccatcccgccaaaggcacctttactagcagtaaaaaggcgctaactgccagcgtttacgctaaatggtctcgcgattcaagcatcatgcaacgcgttatcagtcaggtattgaagaaccagcatgtgacgattaaagacaaggatcttgcggatgcgctagataattataagaagcttgcgacaacgaattaaggcttaaccgagtaagatgaaataacagccagttcttttagaaattggatatcaacgccccgaaagtcatagcaacatgactttcgggcgttttatgtataaaaaaagcatctcgcctttcgcggtatcaccacgattgagcgagatgcttttatttgaagatggggctaggttatttgagggtagtaacatcaccctttgatacgcaaggaatattaaacgaatgtaccatatttgtaccggaaatccatgaaaactacgctttcatgattcaaacttaagtagcaaatacaaacatacgtttgtataatgttgctgaggtgatcatcttgaataaagacgctaaaattatatgtgaccgaattgatcagcacttccaccccagaagaaaccaccagtatcatattgacgttgtaaatgttccctttttgggaaagttcaacttcttttataaagatatgtccaaaacggaacggcaacgttcaattccccttcactctgtcgaaagtcaggacattgaatacttgcaacaaatattacggggtattcgtgagcacaccaatttgagcttcgagtttcacgggtttattaatggagaacggtgggccagcaatgaccgaataattgaacgtcagccttctgaaatggagctttcagatgggaacctgttctgatgttcataaacaattttctcatagtaagttacctaagccggcgtatgtaaaccttttgcctttttgtggtacttttgtcaactttatatacttgaatttacattttcagtactacgctgagaaatattcgctctaacattgacaatcaataagttactagataatgtaaacttaaatgttaactttggaggaagtataattgaagttgaatttacgtgatctctttctacaaatcgggattgtcattataattttgggcttgggtctatttgtctataatctcagtaatcctgtagataaatctagtactacaaattcaaaccattccactaaaaaatcagcgataattgaaagcagtgcagacgactgggtcccaaataagtcactattcaagaagaacagagggaaccttgtctatgcacccatgggcgatagcttgactgagggattttttgcgacccaagatgaaacgaggtacgtttcatcttttgctgattatctcaatgaaggactaggatacaatgtaagtgttggcggaattagcggatatggtggaatctcgaaaaatggtgttgctggcgttggctcaattatccggcaagctccagacctggtatcactagagtatggcacaaacgatgcggaccaaaaacgtggtattagccctgcaacattagcagaaaatttaacgaccattatcgaagatcttaacagtagccaaaagccgccaaaaatatttttaatgactacatggaagaacgactctgatgggtcatatgacaaagctattaagaaagttgccgacaaatatggatacccagttgtcgatattcgtaatatatgggaagatccagataattctggccctgccgggaaaactacttttaaaggtaaaagtgatgacttccatccgaacgataagggtatggagcttatcgcgcaaaagatgtataccgatacttataaatatatttcaggaaattaaatcgtcctccatttttatgtaaaagaagcacaaaaaggcctcccgccaatactggtaggaggcctttttgctatcggatatacaggctttcgcctggatgaatgacgctgtatattgacttgccattgttagcagccagtgtgtacatgctaatgccgtacttgctggcaatgctccagaagctgtcaccagagcggaccgtataatacgtgtggcttaccggtgaggtgtatccagacgaacgcgagccatagctctccccaccattcacgcccaaggcaacataatgatacctgcctgagtagctgagataacgcgcccaaacatatgtgccacggatatacacgtgatcataaatcacactttcacccggagaatagctaccaacggatgcatagccggtgccggcaccagtgcggatgttaacagtcgcggaaggcttgaaaacaccagtttgcgcatagtcggcatcagtggctgcggttgattgcgctggtttgcttggtgctggggtgataggtgttactggttgcttcgagtagccattatcggtgacaccaagcaaatcaatattaccgtcgaggccttgcgacagcccaaatgcgctcgtgtactgccaaatagctaccccatccatacttggaaaata

SEQ ID NO: 23 - DNA, 16514 bp, Lactobacillus paracasei
ccggtctttgaagattatgaaactgccgctgccgtcctttttgaatatgtgcatgctttctacaataggaagagaattcatagttcactgggctaccagacccccttacaagttgaaattgcaacacttacgagccaaatggccgcctgatttaatgctttccagggttcaaataagttattaatcgcgattaatgatttatttgagctgtggaaggtaaacgcggttctgaatgtctcttaaaacctgtctcaaatattgacttcaatccaaacatcaggtaaaacgcttttaagtccagtttgtcgttcgcattcgtccccattagcggctcatcgcaagattaacaattagtgtaatagtttagattatttaatcgatatttaattttcacatcataaaaactctgcaatgttggctgatgcaacactgcagagtttttgtggaaattatcgactgggacaacatgttacaaggtcattcgagtgattgactaaaagtcatcatcgttgcttgccccaacatcagcaatgtcgttggaggaccatttggtcacaccgtcgtttgcttgattcaaaatattctcgacagcatcatcgacattggcatcgatcatttgctgattaacagcctcgatgaacattggtaggctaacaccagtgagtagataaatcttcttttgttgcgctttcggcaactttgagatcgccaagacgctttggttgtatgggctcgcaccgaacaaatcagtgaaaacaatcacgccatcgcccttgttcacttgagtgatgccatccgcgattttctgatttaaagcatcgatatcatcacctaaaatcaaattaacagttacggtgttatcaatattacctacaatcaatttcgcggcgtcaatcaaaccatcgcttaacgcgccatgtgttgcaactacaaaacctaacactgctcatacctcctcgtctacaatgattctataaagtggctaagtacttccatgttcagcgcattgattttcttttggcgtaattgggccaaaggaagaacaaaacggtcaccgtattttttggcactgatcagatatgtgatacggtcgtccattttcatatctgtcgtagtattctcaaagccttcgatgtcacgatattgatggactgtatccttggtgatggcatatagcggcgtatcgccaccaatattttccaccatgaaaaagcgacatttgcccttctttctcctcaaaactcgcttaagtcctgcatcattggtgcatcctgcatcgacgaacgcgaatgcaacagttggtttgcgttgtgcgcccaatatcccaagtaatgccacgagcgagctggaattttggatcaaagtgtgtcgtgatggccaaccacgagtcatttgcccgagcatcaggaaataggctaaatagccaacgaccatcaagatagatgggacagaaatcaaatgtccccccgccaacattgggatggtcaccaaccaagtgaacaagccacccgcgatgatgtacgagagcgcagtgaacatgatgagccaagttgtgctttgttcatgctgttttatatcgaaataggcatagtcgcgccagaccacagtcggagtatcgtagtaggtacaaatgatctgtgtggctcgatgcatgtcacccacatacacgttgtgatacgtgtaaggatctttagggtggagtttaaactcatcgacgttaaaatcatctcggatcgcgttgacatcggtttgaaaagcctgaagaaagcgctccttttggcggtgtgtgctacgttttttcagtattgaactgtaacgaatgaaccaatccatcaactgttcttgctgtgtcatatccaattctactttctagtgatcaaagtccaaatttggccaagaccgatgccaaacctgtctttgatgccgccggagttgtctggaagtagatgttctcaacgccataattgtcgtggagatccttcaacttctcagcgccatctttggtcatgtaaactgccttggtcacctgaacatcgtcatcgtgcgcttgggcgataccgccgatgttcatttctttcattggaataccatgtttaaccaaattgtacatggtgtcaatggtcttggcgatgagaatgcaactgtaatccttgaaagtgaattcatcccagtagtactttgctttctcttcggtcatgacgatggtcttttgcccggtacgagccccagcactcttgtagagatccttcatgaacttatcttttgcaacagcgtcatcgacaacaaagatcgaattgactcctgcacgttgcgataacgtcaacataacttgaccatggatcaaccgttggtcaacgcgtgctaaattaacaactcccataaaaatcgttcctttctatcaaataatattgcttagagaatatgaaaggcagccaataccagtagaatacccgttaaccacaatagagactgagtgaccttgagccccttcttaacgtagtagaagtaaacccccattacgacagtcagcggcaagattcctggtaagacggtattaagtgtatcttgcacaacgaatttcttgcccgaaaggataaacttaagtggtgaggaaaccttcacgtaagaccccgcaataatacccatcataaacattccgagaatagacaacatggagattgcagtctggacaccggaagaggccatcaaggtcgtcgcagaacggcccatcttgaatccggttcgggcaaagaacaaaccgatccctaactgatagcaagcaaagaggacgaacgggatcaacgcgccaagacctgacccttgttgtgcccaaggcaaggcaatggcgataaagatatactgaatggtccctgaatcaatggcatcgccaattcctgctaaggcacccatcaaacctgctttggtattgtacatgatatcatcggtcatcgtaatatcttctcggctgtattcctggcgtgcccgctcgctttcaagtgaggacatcagaccagtgataatgccaccgccccaagttgcttgcgtgttaaaaaatagcatctgtcgtttgtaagcagcttttagctgttctggttctttgtacagcttacgcaatatgggcatcatcgcatacaacaaagctcccgcgatgtaacggtcgaatgaatgcggaatttcatctgcaaagaagaacctcatgtatgcccgatcaatgtcgtgtttcgtaagttgttctggtgcccctgcttgtgttgtagggatcgcgtttttgtttttagttgtatccataatgttatacgctcctttcccttatgcactaaaagtcgtcatcgtcgtcttctgcactatcactatcgccagcactggtattaccagagtcaccggtatcggtctgcactgttttcttgtcgccgctaaaagcaccttgtgacaaaacgaagatgaaagctaacagggttccaatgattgcatatgtgaccattgtgatcttcaagctagtgaatatgacactcatgaagtaggccaaaaggaagaaggccaagtatttccgctgcccgataacataaatggtgaccgcgataccaatagaagcaagcgcgccaccgacagtattgagcatatggatgaagacagtaccttcaaggcctttaacgaaggatgcaataactggtgcaccgaagtatagagcgataaagataacgggggtgaacaataggaacgacacgatcgttggataccagatgatcgaccgtgacaaagcacgatcatccatattttcgattgcccggtctgtcgttttcccgacgaatgtgttcaggaagaagcggaactgatagagataacttcctaacaggccaactggcacggcgactgcgatagcagcgccgggactcttatttcccagcaatgcaactggaaccgcgatagcagcggcaatagccggttcggatggcattgttccgccaggtgaaaaggctcccatgtaaatcaattggatagctgcggtaactttcatggctgaggtgacatctcccataataacgccgacaacaaagccggtcattaatggggagaaacgcatcgtcaaggtcgcgttaccaagcagccaccgtgacatgacagcagatacccatagtccaatggccatggactgccaaacagacagtgtttgcatactcctgttcctccttaaagattgaatataagatcataataatctaaaaataaagcggttacattttaattaacaataaatattttttgcacggaaaacgccgggatacgccccggcgatcactcgagcaaacttatttaggtgaaaacggttctttcttagccatatagtcttcgaggtcgaacatcgcttttttcaagcttgcctcggtaacttcaaatgggagcaagtgtatcttttccttgccgttagcaagtttcaaaacgtgacccatcgtgtcttcattcattggccatacaccaagatccttcaaggacatcggcaaatggaacttctggtaaaacggaattagttcatcgatagtagtgtaacgattctcgagtgcaagctggaagaagattccatatgccactttctcaccgtgcaagaacttgtggatctgtggtagataggcagatagcgcatcgtgtatggtgtgtgccgcagtgttccgtgagtacttgtcgccgaatccaccgaccagaccagcgattgcaataacgatttcagagatatggacaaactcgtcggacatcttacctgacttcatgtcattaatggccggttctgcttccttcatgatcttatccttgcacatcaatgcggcgtaacgcgccatttgtagcatgggttcattcttgtattgaccttcttctagaatcatgtcggattcgtaccacttggccaacgtgtcagcgacacctgcaacaaagtagttaattggcgcatcgattatgatccgcggatccatcactaaaaagcttgcttgacggttgatgtgtaccgtcttaccttcagctaaaccgttgtccttatacatcacagctagcggtgtccaaggagcacagttcgaagccagagttggtacggtggcaaattttgtatgtgcgatcgatgccgtgtacatcgtcaggtcgcaaagcttcccgccgccgacgccaataataaaatcgatattcttatcggcacagatgtcagctatccgcttaccttcgttaaaactacactcgccatggtacttctcgtagtacgtagaaagagttttagtattttcgagtttccctaggtagggtttagctttttcccaagattttgtgccatgaatgactaacacattcttggcactatgctcttccaacagtttagggataagatcaagtgccccttcgctgtaacaatagaattccggtccgatctttacttgcaaattttgaagcataatgatttcctttccagaataattatatttattaattcaattaatattattgttttgaagtgaccagcaacatctcttacctgtttggagcggataccgtattacatggcattttgccgttgatcactgccaacacatcactgacacacttctcgcccatctcgtggagacattcgacggtgtaggcagatgtatgtggcgtcacgattacattcggtaaagtgagaaacgggtgattgccactacatggctcattttctaagacatcggttgcatatcctgcaagcttaccgtttttaagattagcgatgattgcatcttcatcgaccaaagctccgcgcgctgcgttagaaatatacacgccttgtttcatttgcgcgattgccctttgatctagtagatgataatcatctgtacccagactagccgctaacaaaatcacgtcgctttgtgctaacaagtttgaaagctcgacctttttgccaccatgctgtgatatcgctatatcattttgccgtggatccgtacacaacacagttgcacggaacccataatgcatgatctcgactaatcgactgccgatattgccaacaccgatcacgccgaccgttttgttcgacaagttatgacccagaaactgcgcgcgatctcgccaacgaccctcatgcgttgcctgattgctggcaaccgtccgtcgcatcaagcttaacaggttcgtgacattgttctctgcaacagcgtctcgttcaactaacgggggaacaattgcaaccgtggtatggtgagcacgtgcagcgaccaagtcgacgttgttgtagccgatgccgtgacggctgagcagcagcaattcatctttgtgttcgaagaattggtggttgaaaacaggtgtcacactagcaatgataatgttgtatccctgcaacttctttgcgaggctaacgccgtcgatgtccgcgggaaaacggaagcggtcgacatcaccaagtgattgaagttgctcaaggtgctctttgaatacctgtccaaaactactagaattgacaattgcgatgcggtaattcatctgacactcctctccttaggatccaaggcaatattccgttaatgaaagccgtgtcagcaggaactttttcgtccgatcggaattacgaaaaaattttttaatcatagaaatcggttacccagctgatagatgaaggatttctaagactgaaatgttgtatcccactgcacatactaattatatataaaaaaatttttttgtaaacgattccacaaaaactttttttatttttctcgaattattgtatactgtctttaagatcgcttgtctcgatgtctaaaacagtgaggctagtgttaaggaggtcaaatggatggcatttaactatcttgaatcactgatcaaacgcaaaattgccaacaggacaccaattgataagaagatctcggattacctagtcgtggcagacgatggagtgcttacgatgacgatcacacaactcgcccatgccagtggcgtgtcagagaccagcatctataaatacgtcaaaaaattgggttttaccggttacggcgattttaagattaatttggcttctaacgcggcgagaagacaaaatgcagaacagggaatcacggtattgaccgatatcaagccaaatgatcaacccatcgatattgctcagaaagtcgtgcaatacaacgttgcgttactccatgatttttcagatttcatcgacgctgataagttgaacaagaccttggggctgatgtacgatgcacactcattgactttcatcggtcagtctggatcgtcagccatagcatttgactcttaccacaaatttttacggtcgaagtatccttgtaactacatcttcgattatcatatccagttgagttacgcgactaagttgggaccagatgatgtggtttttttattctcacattccggcgtcaccaaagaaacgatcgctgttggcaagcaacttctcaagagcggtgcgaagatcattacgttgaccggcagtcccgcatcaccattgattcagctgtctgatgtgtcctttgtcttatttaccgaagaagttgctgccaaagcagaatcgatatcttctaagatcctttacacgaccctgacggatattttgttcttgaacctcatgttccacgacgagaaagcaaatcaggccgccacccaaaaaattcgtaatgctctgtcaatcacacgagcaggtatcaatacagataagtgacctaatttttcctcgtgcatttggacgcaccatcagattacatttatggaaacaattccaaggaggatacagcaatgaaaatgagctttcggtggtatggtggtaacgattcaatttcacttgatcaggtcaagcagatcccaggtgtgacaggcgtgattaccacactgcatggtaaacctcaaggcgaagcatggacctatgaagaagtggaagcgctcaagcgtgaggttgctaccgaagggataacaattgatgggatcgaaagtgttcatgtaatcgattcgatcaaagtcgccgatgaaaatcgcgatcactacattgacaactacatcaagtcccttgaagcaatcggccaaaatgatatccacatggtctgctacagcttcatgccattatttggctggactcgaactcagctggctaagccgatgaccgatggctcgactactctagcttacaactgggacacgatcgacaatatcgaaccagatcagttgttcgagttggtcaataaccaaaccaacggctttcgtctgcccgactgggaaccggaacgcctagcgcacgtgaaagacttgatcaatcaataccgccaagtggcggaggatcaactattcgataatctagtctatttccttaaagcaattatgccaacttgcgacaaatatgatatcaagatgggcctacatccagatgatcccgcgtggtcaatgtttgacctgccacgcattgtcaaaaacaagcaggatctaatcaaggttttgactgctgtcgatgatccgcataacggcatcacgttctgctcgggtagtttgggctcggatcaaactaataacttgctcgacatcatcgacgccatcaagggccgtatcaacttcgttcatctacgcaacctcaagcacacaggttaccgaagctttgatgaaacagcctgcaattctgacgccggcgacttagatatgtatgctatcattaagaagctaaacgaagttggctttgacggcgtggtacgtttggatcacggccgtaatatttggggagaggtgtctatgccagggtacggcttatacgaccgtgcacttggttccacttaccttgaaggccttattgaggctgttaagaaagaatccaaatgagtctttccgaataatactgaccacatgacataacaaagaagccagcatcatgatcgtaaagatcgtgatgctggcttctttgttttccacactttagccgaattttgcgggcacgacgatcactgcttggttgcgatcggaatgaccagtcagatcattgaccatgacttcaccagcactggctccgagtagaaagggatcctgagagatcaacttcaatttgggctcaatccttctcgccgtttcggtatctgcgaatgccgttgccgttgctttgatgttatcaacatacccttctaaaacaagattagggataaactccagaagccaacgttcctttaaagagaaaatcactgttcgttctgtgtccctcattaataattcgatcagctgcttatgaatccgtttatggttgtatgaggattctgacacctctaggacatctacattttgtgcggctgctttgataccacgatagcgttcacgacgatttgttgccacagctaactccgaagttaggacaatgaagtgagtgaatccttgacgaacgaaataagccgttgcttgtttagctgcgtcgaagttatttgtcacgacttgaggccaaggagcttgaggtgtttctcgatctgcaagaacgatcggtacatcgcgactcatcaaggtcttgatctctgacacggtgctgaatggttgaatgattaatccatcaaatccgtgcgagtttacggtttccatcaggtgcttttcacgtacgatatcagagtcggaatcgaacatggtgccaatatagccattcgcctcaagaatcgagctaacacctttgaatagctctgttgaaaaatagtcatctgtattaccaacgatcaaagcaattaattggctttgtttagtgatcatctgccgcgctgctgcatttggaacatagttcaacttttcgattgctgccttgactcgcgtagccgttgctgtggacattcgcttcagattaccatttaaatagcgcgataccgttgccgttgaaaccatggctagggccgctacatctttgatatttgcttgagatttactgttcatcattgtgatctttccctactcattcgctttttgcagtatcgataccactacctattgtatcaaaaaacactcacaccagctggtgtgagtgtcagtcttgcgccaataagttatctctttaagagaaatttacttgtttgcgttgatacgttccaattcttcacggtacttcttggcttgtgtaatcacactcgcaaaatcgccttttttggcagccccggtcaagttactgcctgcgccaagaactgtggcacctttttcgaaccattcgtgcatattctccaaattaacgccgccggtaatcatcaggttagcttgtgggaatgggccgtggatcgcagaaacggcgccttggccaacaacggagccagggaacagcttgattaaatcggcgccgtaggtcaatgcactttgaatatcgttaggggtcatgcaacctggtgtataaggaatcgtgtaaaggttacagatctttgcgacttctttgttgaaagaagcactaacgataaactgcgcacctgccatgatagcgatacgtgcagtttctgggtcaagaactgtgccagcgccaataacaacttctgagtcatccctgtattgttccaacaattcagcaataatctcatcagcatgaggggccgtgaaagttacttcaatggccttgattcccccttcgatacaagcttcagcagttttgtacgcttcgtcctttgtggcacctctaaccacggatacgacaccagcattaataactttattcaacgtttcatactttggtaacataacttaattttctcctttgagacccaattgggttattccatgttgctatgctcggccttcgctgcgtcgttagagacgtgatcgcgccggcttaacatcaagcacaaaacgtccaaggtcacatgcacgctttgatcaaataaggtgctgagtaattggatggactgtacaccgtcgccacccttggtcgcaccagggacaacgatcgtcgtatcgcccaattggcctagcggtgagccaccattgctggtgaccgcaacgactttaacgccatcttgtttagccttttcagtcggctccaaaacgctacctgtcctcccagaaccggaaacagaaattagtacatcttttggttggatcgccggcgtgatcgtttccccaatcacgaatactgtgtaaccaatatgcattagtcgcatcgcaaagcccttagccatcaggccggaccgaccagctcctaacacaaagatgcgtttattttttttgatcaccgtttcagcttgagtcaattggtcttcatcgaccattcccatcaccgtattaatttcctgcataacatcgttaatcaaagtcatgatataacctccataaacgttttagcagcggcaacagggtcactagaaccaacaatttccccaccaactattacagtttcggctatatcttgctgtgctaattgacttgcttgttccatgttgataccaccggccaccgcgagccgtttgatctgtggaaaatcacggtggaattgtgcagttgtagcgacagcatcaaagccaacatctgcatcttttgaatgatgcaagccaaagatcgcctggtcaaacccagtcagctgtgcgatccggctactatcagcttcaagaagatcaatgaggatctccttaccctgttgcacgcttacattatacacctgttccagcgtatcatgagatgacgcggccattgcggtcagaatcgctgcttcagttgtataaccttgtttgaactcgtaagtcccttcgtcattcgttttgagatcaatcaagagtttggcattttgcaaatgcaaaggatggtcgcgcagcgtcagcaatccataatctttcactaatgaagtcccgaattcgataatgtcaacgagcgggtcaagctgttttgcaagcgccgttgcttcttcgagcgtgacgcgatcgattgcgacttgtaattgcattagttttcagtgactccttccttggcataaaaagccgccaagccatcctgatctgggtagccatcgttatcgccgagtgtctgcacttgaagtgcaccaacggcgttgccacgtaatgcagcactcttcatggacttgccttcgagtaaagccgtgattacacctagtgcaaagccgtcaccggcaccaactgtatcaattactttgtcgacatggaagcccttgaccctatagccttcaccgtcttttgccttcacatatgccccatcagcaccgatcttgacaatgaccgtcttggtccgttcaccatttaagtagaagtctgcgacagcttcgggatcatcagagcccatcaaaattttgccttcctcgattcctggcaacacgatatccgcataaccagccaactcattgatagttttgaccatatagtcatgacttttccacagtgtcggacgcaggtttggatcgaatgttgtcgtaatgtttgcatcgttcagccgtttgtacaacttgcggaagctagcttctgccgtatcactaatcgctggaaagatcccagacatatgtgcaaacttcacgtcgctaagatcgacttgatcgatcactcttggttcaagatgggaggcagccgagttcttacggaaattaaacgttgccggatctccattggtgaccaattgcttcagttgatggccggtaaagtagtcatcatcttcggagatatacttcgtgccaacttgatgctggtttatggtcttgatgatatattcaccgaatgggtcattgcccacacgggagatgtaatcaacggaatggcctaaacgcttgaccccgatcgctacgttgagctcagcgccgcccatgattttatgccatttttcaacatcaactaatgaaacatctggttcagaagaagcaaacgtcgtcaacggctcaccaattgtaataacttcactcatgtgtaaagactccttttaacttaataattaatagttgagacaaacaagcgacagcgtttgccacttgccgattgtttgatcaaaattaaccgaagaatttgtagaccaagaattcattaatgatcgacacgatccacattacaggcaccccatatttcaggaagtccttggattgtaccttcatgtaatccaattcccagacgttccaagactgtgtgatatcgacagatacggccatcagggtcggtacataaagcaacggtagtaggaacggatcgttaaacaacccagtcccagacaaaacagcagctgttgcggccccagcaccccacacatgcaacgggccacggaacaaagccaatggcgccaagattccaagcgcaatcgccaagatcaaatggctatttggcaagattgcctcaaaaatcggtttgaaccggctagcgttcaatgaggctgcgccagtaaacatcgccaaagacatcaggaacatcaccaaaccggcaatatctgagattgcttgcttgatggtgccgttcatgaagttaaggaattccttgtagtgacgcatctttcccgtcaatagcattgcaatgattgttgcgaccgtcaaagctggcacagcgtcccaatggaataacatgttcatcaaaacaggaacgatcggaatgatataggctatcttaggcacgttattgatcgccgcttggttatttgtcccagcgccgataatttctagattcatttcagcgttagctgggttgatccgcttgcggaagatgaacagaaaaatgaccactgctaggatctgcacgatcatggccacgattccgaattgcaggtaatgagaatcataagaagctttcgggaaaaagactttgatctggttgtaaagcacaacgttgatgtacattggcgcgccgatactcattgagaaagcagtcgccgcaatatcacgtggaacaccaaccgacagcattatcggtaataaaataacgccgatagcgataacggaaccaacaccatatgcggaaacgaagatgaacatcgtgactaaactgacaagaatagcagctaacagtggctgcttgcgaccaaccttgtttgtggcttcagaaatagctggcgcgatgcctgattccactaaaacccggccgaaccaagacccaaagacaatataaatgatcgtcgctccataatttgtggctggttctgcaaagattttttgaattgcagtgttgaatggtaccaatccaataacggcccataaaatcgccataacgaagaacccgatcatcaggttcccgcccttcaaaatgtaaccaatgaagagaacaaaggtaatcaataaaagaattgcaatgaaagtcgaactcatgatttatgcacccacttcgtccttgaatagtttgatttgggaagaaatctgcgcatcagtcgccattggatactccagtgcatagtattggtcgcttggcagcaatttcaacaatgcacgccagtcgaacatacctcgatcgagatcatcgctagtcgtcaattcaccgttgttgttgatcacgttctttaagtgaatatagtgagtaaacgctgctaattccttagcggcttgttcagcatcgccatgtgtgaatccccagtttcccatgtcataaacataacccaggctggtcaggccggcagagtttgcagcagtcaaaaaggtcttgattgttgaaactttgccagaaaccgctgtctggtcgttttcaacgttcatttcaatttcatctagtgggaatcttgcaaagtcctttttaagatctccggtaaaacgatcgaaatgacctgtattgaacttgatcttcttcaagccaagtatctggccttccttgaagtattcatccaattttgggttgagactgccatcgtcttcaaaaacgacatctggcacactgaggttaacaatcaaattgttggtcttggcccgttttgcaacttctggtaattcgctatcgagatccgtaaagtattcgcgacgaacttcaatcccatcggctccaagcttggcaacacgatcaaccaagtccgcctgcttagtcccagatttaacatctgattcaaagatccaagtgttcaaaatcaaagtcatgataaatcccccttatattaaggttgtgaataatcagtatttgttgaggtgctggacacgatccagtaattgctcaaaagtcatatctctgaaatgggtctcagtttggctcttgaagttttccttctcaatgccgttaaaatcctccaccaaataataagccgtcaagtaactgagcaaatacttcttagccgccgacaccacttctgttttatcgtccaaaggtgtggcggcagcatccgcgaaactcaacgcaaacttctctggatcaataaaagtacgttctgccattcgaattcctcctaaaatagtttttgtaagcactttcaattttctatggtaaacgtttaaccaagttaatacaaccctttatttaataaaaagaagacatgactttgggctttgcaaagtgagtctcaaaaattttttaatctttagtaacaccgaaatttttacgagtacgtttagcaatcagcacatttccgtaaaattttcggcgttgtcaaagaacctgaaccagctctttgagcttaattcggcagcgatttcgtgacttaggatgccactttaaccagtcatagtaggtacttgaagggatctgtaacgatcggagaatgactgtgatgcggtgtccccggcttaattgatcttgaatcataaaaagagcggcctttcggccgttactaatcaaaggcgctggtccgcgtcaagtagacaggcgaaataattaaagtgcctatacgattttctttacggcgtgattccgatatgtcatcgggttcataccgtttagtgttcttggcggcgttcgtttttataccagttgagtgccacctcaatacgcttcatcatttctagttccgataagcagtgctcaaaggcaaatctctcgatcttgaggcgactccacaagctcgccatagggctgttatcacctggtgtcccgggtcgtgacatgctgtgcgtgataccttctgttgtaggtgctacttgtgtaagccgtgccctgatcactgtatacggtatcaggctcaataccgtcgttattctcgatggccagtttcattgttttagtaaccaaatcagccgtctctgtcagtgccacgcaccaagcaatcacgctgttgtcatgaagatcctttacggcgcttagctgtagcttctgtttgttgtcttcgccgtaggtgatctctaacccagactacgttagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagacctcgtcgttatgatctttatgacgtattcaatgccatcctttactcgcttactacagggtgtcaatggcgtgaattaccgcacgatttcccggaatggcacactgtctaccgctattacgatatgtggcgagataaaccagacccgacagctgattcgctattagaaaggcttttaaaaaaa

SEQ ID NO: 24 - DNA, 2764 bp, Lactobacillus paracasei
agatactgcaaatcactctgcgcacttggataagcatagatcttgtttaaatcactcggcttttcaccagcatcaatggccgctgcgaaggtattgatcaagtcctcagccaagctggctaagacgacagcaccggcaagtcggccggtctttttgtcgacaatggtccaaacttgtgcgtcaggatcctgaattcgattataggtgtaccagtgggttgtctcgttgtgcttgacggtgtattgatcaggtgctgcttccgccgtctccagtgacacgccgactttggctaactcagtcggaccaaaaacaatgtttggaatagctggataggtgatcggggtctgatcgcctaaaatctgctcggcaacataacggccttcgaagccggctaccggtgttaatttaggctgtggcttcaaattgacatccccgattgcataaatcgtctcaactgcggtgcgaagatggtcgtcaaccggaataccacgcgtatcagccttaataccagcattggctagcccgaggtcggcaacattggcgatacgacccatggcagtgattgccatgtcaacattcaaatcgaagttatcagcatgtagatgggtcatggtacctaagggcgtgattttagtcagttcgacgttaggatgaaaatgaatcccggtcttggcaagcaatggttttaaagcttcggtagcgactttggggaatgcccgtaacaaccgatcagaatgaccgatgatatgcacatccgcgccagccgctgcagcgatgttggccagttcgacactgacataaccggctccgatgaaggcaatgctggttggtaactgatcaaggtccagaaaatcccgactcgttttaagcagattggccccagggatatccggataacgaggcgtatgcccagttgcaatcacaatatgttcaccggtcacgttttgggagccaactttgacagcatgttcacctaaaagctgagcatgaccatacaacgtcgtgatcccagcatgagtcaggccattcaatgtgccagcaggtacgccggttgtgtaactgcgcttgaatgccattaaggatggccagtcaatcttcgccgtcccgctgatcccaaaaccattcatgcgcaaggcagcatttttaacttcgaaaccgcgatacagcatttttttcggatcgcagccatagttgggacaggtgccgccccacaaatcgttttcaacgactaatactttttgctttgctgctaaaccgtaagctgctgctaagccgcctgggccgccaccaatcacaatcgttccataatcataagccatcacgatcactccttcgtctctgtgttctgatcgacaaatgcacttgcgagataagcgacaacactatgggtattgaccacaaacgcaccatgttcactattcacgcgcaacgcctcatgcgcatctaaaagcggcaacgcctcggccagcgtcaagttgccgccaaccgcatgccgggccgacacatccgctgcaaatggtgctaactgactgagcgtgacctgcagaccctgattggcttgcgctcccttgaacaaatccgccacgaaatcgttagccggattggtcgcaatttcttccggcgtatcaacctgcaagagtttgccaccgcgcatcacgccgatccgatcaccaagtttcatcgcttcagccatatcgtgggtcacaaaaatgacagtggtcttcaaggcacgatgcaaatgcagcagcatatcctgaagctgagtgcgggaaatcggatctaatgctgagaacggttcgtccatcaagactaccttaggccgtgatgctaaggcccgcaaaataccgatgcgttgctgctgcccgccggataattcgcttggcatgcgattgcgatattctgctggcggcaaatcaactgttgtgagtaactcgtctgttgccgtccgaattttttggcgcgaccaacccttcatttcggggatcacggcaatgttttgcgccaccgtcatggttggaaacaaggcgatttgctgcaggacataccccagatcccaccgtaagtcgcgcattttgtaactagtgagcggtttgtcggcaaattcgatgacgccgctcgttggatcaaccaaacgattgatcattttcagcgtcgtggttttgccgctgccggaggtgccgactagcacaaacaactccccttgatcgaccttcagactcagatcgttgaccacgggcttgccgtcatattcctttgtgacgtgttcaagactgatcaatgccatcagcgcacctccttcagcaagccatgctgaaccaaatagcggtgagccacagttgcggccttttcgttcttcacactcacggcataattcatggtctgcatctgtttttccgtaatttgaccagccaacttgttcaatgcagctacaagttgcgggtgtttttcggcaaaggccgttcgcattaatggcgcaccgcgataaatcggaaacaaccccttatcatcttgcaacgccaccagatgatattgccgcaattgcgcatcagtcgtatacccatcagtcaaattgatctgcccgcggtctaaagcttggtaacgcaaggaagcatccattgaatccaccttaaactgcaagccgtattttgattggatgcccttatacccatcttgccggtcaatgaactctaaatcaaatccggcgcgaatggatggtgcaattttgccaagatcgctaatggtatgcagatcataacgcttggca

SEQ ID NO: 25 - DNA, 111688 bp, Lactobacillus paracasei
tgaatatgtcacgcaacaggaggccatcgatatcgcacttgatactgagcccaagctcaagcaaacctacgagacctacttagcgcttcatgaggccttgatggtgaagaaacatcccgcggaactggcaaacctgttagctacttacgagccaaacggtacggcaatggacatgacgatagcgacgcttaagcgacaccaagtcgctgttctcgccgctgtcaccagcccttattccaacggtccgatcgaaggggttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttggcgtagagccataaaagtggcccgatagctgacctttgtcagataccgagccactttcatttcatgttctatttcatcaatgcaagctgcaaaattgtacctttaatcttcgaacttaaacaagtccgttgacaagtatcgttcaccattatccggcgcgactgttaccacgctcttgcctttgccaagtttcttagcaatttcaatggcaccgaaaatatttgcgccggcagagatacctggcaagaagccttcttcatggctaacgtgacgagccatgtcgatggcttggtcgctggtgacttcaataatgtcttggtataggttggtatccaaaacgtctgggatgaagccagcggagataccttggatcttatgcttgccgccgtgcccttctttgagcattggtgactcagctgcttcaagtgcataaatttgcacctgcgggttgattttccgcaacgcccggccaaccccggtcaacgtgccgcctgtgccgacgccagcaacgaaggcgtctggggtaccgccatcaaaagaacggatgatttcttgaccagtggtgcgctcgtgcacatccggattagccggattttggaactgcatcggcaagaagtaaccattttccttgctgagtgcctgagcttttttaatcgcaccaggcatgccatccgcccctggtgtcagaatcaattcggcgccatagccccgcattaacgcacgacgttcaacactcatcgtttctggcatcgtgatgatcaggtggtagcctttagccgcggcgaccaaagccaagccgatgccagtgttgccagatgttggttcaacaatggtgccgcctggcttcaaaacgcccttgtattcggcatcttcaatcatggccaaggcaattcggtctttgacagaaccgccgggattaaagaattcaagcttcacataaacatctgctgcatcttctgggacgacacgatttagcttaagcaaaggggtgttgccaatcaaaccggtaatattatctgctgctgtcaccatattaaaagcctccatattaattgattgattttctaatgattgtcattgcgatgatccgcgacatgttgaatccaattgtcaaaaatcgttcgttgcgttttcttccaattgaacttgggatgatcgtaatcatttttgtgatgataataatgtttagcgcgaacatagtcgatctctggatgagcagcgacttcacgcttgtattctgaatccaatccccaccgatcgtattcgatgtgtgaaaagacgaaagtttgcgtatcagtcggttcggtcaccatgaagagtttgcccttcgtcgttgtcgcgttaatcgtgagccgcggatcggcatgaataccgcggacatccatttcggcatagcgtgcatgcggcgacttgaagtcatttttgagtcctttcaaaagcgggtgcggctcaagaatggtttgcggataaacgccaaaaagtttatgcggcaagattagcttgctgatgccaaaaaagtaattcaatgcaaccatcccaccccagcaaagatagagctgattagggacatgctgacttaacgttttcaacaaggttcgaacttcggcgatataatgcacttgatcaaattccaaggtttcaatcggcgaaccggtgatgatgaacccatccatcgtcgccacctcatgaatgtccagcggatcgaggattgaactgaccgcttccggcaccgtccgtccggcgtaatgggtcatggggtagtaaaaatgcaaatcgaccggtatggcagtgtgcgtcaaaacatgctgtagccgagttttggtgtcagccttatcatgcatgacgttcaaaataccgatcttgagtggcgagttttccaaggttcacctcctattccctcataatgactaattaaccttaaaagaaactttgcgcgtgaccgtgggtaagaaaccccacatgtggtcatttgcccggacacatcaggtggataccctgaccgttcgactggtgccaacatcgtttgaattcaatgaggtatttcatagtatcctccctttcagtacttatatactaactaaatgtaaggccaataacaacctttgacgttgatatattcgcgaatactttttattcaattagcaggtgaccgcatgtccactcagtcagcttagaaaacgctggcacatggccacggaatgcaaaaagccccgatgttagtgtgccactggcatcagggcttttttacaagattatcttcttttttgatttgtcgaaatgacgattttaagcgcgtggctgactgcttgaattcgtcttcttgcttacgagtgcgcgactgccgccggttcaccaaacaccgtctcgcgaatataatcaactggcatttgtaggcctgtccacagatggaaggcggcggcgccttgattgatcagcatgttaatgccgttatacacgtggttcacaccggcttctttagcgagctgcataagcttggtttcgcgcggtgcatagaccgtatcaaacacgatcgtctctggcgtaaaccaatcgccatcaggcacattactaatagtttctagcggcttcatccccgcgggtgtcgcatcaacatagataactgaatccgaaatgctagcctttaacgccggttgatcatcgagtgcaaacaatgtcgcatggccttgcgtttggtcattaatgatggccacattacgttcggcattttgccacgaagcatcacgacgattaaaaatattgatttcccggacaccgtccaaagctgcttgaatcgcaatcgctgtccccgcgccgccagctcctgccagtgtcattttctcgccgcgaatatccaagccatcgttgctcagtgcttgcatgaagcctatgccatcggtgatatggccggtcagcaccccgtggtcattgacaatggtatttacggcaccgatcaattttgcggccggcgatagtttgtccaacaacggtatggccttttgcttattcggcatcgacaaattaccacccaaaaaatgcaggctgcgcatggcttgcaaggcgtgtgtcaattcaggtgcatcaacatcgaaggacaggtaggcatcatttaacccaagtttctcaaatgttgcgttgtacattgctggcgacatcgagtggccagcaggatgcgccagtaagccagctaaaacggtgtgaccgtcaatttcatcttttaatgacatgttccgaactcctttttgctaatggacttgtgaaactgctagcacatgcttttcctgcgtcttcacgaccagtgctaacccgatgccgacaatcgtgatgacaatattcaaaagaatgatcatccgtggtgccgcatcgccaaaggccttggtcaacccggcagcggcggataacaccgcatagttggcaatacttgaagcaatcatgaccagcgaagtcgccgtgcctttatgactggggaagaaactgatagtcgttgaggtggcaagttgcaacacgccgccagccgcggcataaccaatcacaaaactaccaatgtaaagaatgaccggcgtctgcacaaagtagcacaaggctaacatgaccaccgcaatcgtcggatacaggatcaaaacggtgctttcttttaacccggctttgatcagacgagccgtcagcaacaccgcaatcccagcaccaacggcgtataacgattgcagcgttgctggatttttaaccccgtaagccgcccctagttcctggttgcaattcaaccaaaccatgaaggtggtcgaactggtgaagccaattaaaatggccgccacagacccaattgaaaaatgcattttttcaggcgtgccagctgcattcagctgtggtttttcccgcttaggaaatgggaaaacgataatggcaatggcatcggcagccagcgccacgccgcagatgatgaagatcgtccgaaatgacaggccagccgccgcaacgccgccaatgaagaacggcaagataaactgcgcggtgaccacagcgaattttgtcagaagattggcaattgacgccgattccggaaacatttccatgagactcggggaaacacaggtgtccaaaaacgagttcgccatcccattaagaacaccgatgagataagccgcccagaaactattgaccgtgatgatgccgatgaagaagatcacatacaacccgatcccaatcgtcccagaaaccttccggccaaaatgatccgacaccggcccggcaaacggataggcaatcaagcgacctaacccgaacgccgcaatcactgacacgaccatgctgacgtcaacggtgccattgctcagttgttgcgcaccccaattcgaagcaaactgcgccttatactgacttagaatggaagatgcaatccccagcatcgcataggaaaaatacagtgccagtgccccggcaaaaaatgattacgtttggttttcatcgttcaagttgcctccgtttttaaacgtgttccctacaccagagaccggtctggttcacgctctttcttaaacgcgttctctggcgcagaaacctgcacataaggacctcaagcctaaatggccaaagaccagccatttaggcttgaggccgcttatactccagtttctaagcgcgccagttcacgctcttcctaaacacgttctccagaccagaaacctgcgtgtaaggaccctgaacgcaatgtccaaaacccgaccatcgcgttcaggcccgcttacactccggtttctaaccggtctggttcacgctcttcttcaaatgcctgatatgccttcaccggcatgtcctgaccagtccacaattgatatccggctgctccttgccaaagtagcatgcctttacccggtgctgtttttgcgccaactttttcagcatcttcaatcaactttgtcttcaaaggattgtataccgtgtcagctaccaccaaatctgcgcgtaggaaactcggatcaacaagcgaaaccccatcgtctggtttcatgccgacagtagttgcgttgacaagaatatcggcgtccgcaatcgctgctttgagcctgtcagtattttccaactgaaccacatctactttgacagcaggcgctgcctcggccaactttttggtggtcgattcagcacgtgaatagaattcatcctgccgattaaagatggtaatctgtttggcaccatctagcgccgcttggacttgaatggcagtcgcggcaccaccagcacctaataccaccaaatgcttgcctttgatatcaattccgtgttcctgcaaattccgaacaaatccgatgccatccgtgatgtgaccgatcaatttgccatcatcattcacaacgacattcaccgcactaatgatcttggcagctggcgataactcgtccatcaaagttgctgctacatttttacacggcatcgtgacgttgccgccgcgcattttgaaaaggcgcatggcattcagtgcttctggcatctgctccttggtcacgtcaaacgccacataagctgcatcaattttttgtttttgaaaactgaagttatacattgctggcgagccagaatgaccaaccggactgcccagcaaacacaacaaaccagtcgttccagaaatccacgtctccatgttcagtgcctccattaagttcatattttcacgagcattttgaaaagaagaacctgacccaaggtgcgatcaagttgcttctatcaatattgcaaattacttagcagcttggtgcgctttaatcgcgtattcacgccgaccacccggcttcggaatcatatcttgcatcatgatgcccagcccgccatcaactcgcagttcatcaccgtttgtgtaatcggaacggtcactgctcaagtaaaggacagcattagcgatgtcatccaagttgccaatccggcgactggcaactaagtgctcacggccgtccaacacgttaggatccttgtaaaaatcagccgacatcggggtcttcaccagacatggcatgacacagttgctgcgaatcccaaactgtccccattcagcggccatttgcttcgataacatattgaccgcagctttggttgtgctgtacgccccgctgtatgtctctgggaaatcagccgcaaccgttgaaatatgcaccatcgtcccatgatgttgggcaatcatttgccgaccaaatcgttgtgacatcaagaaataaccagtcaaattaatattcacagccgtcttccactcatccaaacgcaaatcctcaaacggtgaaaaacgcaagatagcggccgtgttcacgagaatatccactttgccaaactcagccacaaccgcttgcaccgcagcatcgacttcatcttcatctgtcgtatcggttgccactgctaatgtttgaacgccatattgatcagctaacttcttagctgctgtctgaatcgcatctttcttaatatcaaccaagacaagcttcgccccatgctctgcaaaggcttcgcaaaaatgagtgcccataccgccaacagcaccagtgacaacgacaactttgtctttcaaacctaaccaatcagccataaaaattacgctccttttagtgtgtcgcaacagtttccttcaaaatttccggccatgccgcctgcaaggttttcaccgtggtgtcgtaagtatatttggcaacccagtcaatcccttttgccatgtagtgatcagaaatgacttcaacgccaatcacttttggatccacgccagcctctttaatcatcttgataaacttttcagtccgatcttcaaacccagttcccggtgctaagcgatcgtgcatcgactcgtcacgcaaaatggactttgcatatggccgcttgtaagcatcatcaagttgaattgagataacgcgcttagcttgttccttcgtcagcaagtcgaacggctggtctgctcgaacccagtgccacatgtctaacaacatcatcacattcggagcaccggcgccttggagaatcgcccaagtcttcttcaaatctggcatgccgctatatggcatcggttcgagggcaatgatgagattaccagccaaagctgcgcgatgtgccagttcctgcaacttcttggccgtgaagtcaactggatagctttccatcaaaccggtgttgatatgttcaacgccaaacaagtgacacatatggaaacaggtttgctccttatatttttgctcgtatgtccgcggttcttcacaccattgcacgatgtattcaacctcggtgcacttgatatgatactgatcaagaatgtcgagaatcccttgatctgttaagccttcattcagcgcatcgacgtaggtttcggcgcgtaagccgatgccatcgtacccagcttttgcggctgctttaacgcgatcttcgaatttgcattggtcgcctaatgtccatgaactaacggtaattggatgagtaagtgtcatgatagtgcctcccaaaatgatttgtgattaatttttcaatcttgtttacaaattgaattgtatacggttgcacaagcgacttctaattcattataataagggtgcttataggtggaggctatcgttccggttaagccttcataggaggaccaaaatgaacctttttcatctgcgatatttcgttacattagccaaatcacagaactatacccgtgctgcccgccagttaaacatcacccagcctagcctgagcaatgccattcatggtcttgaagccgaactaggtcttgccttgtttgttcgacaaggacgcaacgttgttttaacttcggagggccgcgagttcagtcgcattgtggatcactcgctaaccatcctcgatagcggcattgaacagttgcaacaccaaaacaacgagcaaacggtgattaaactgggcgccttacgtaccctcagcacacgctgggtccctggcatggtacgcgaattcttacaaaacagccagcaagatgtccgttttgaattcacgaacgaaaacgggctatcaccacaaattattcaaggtttacgcgctaaacattatgatatttgcttttgctcaaaagttgacgagcaagaggatattgcctattttccaattgcttctcaggcactcgtcgtgatcactccgactgatcatcccttggctactcgcaaccagattgaacttagtgaaaccttggctttcgatcaagtcaccttctccaaaagaagcggcctcgcgcccatcatccgccagctttttgccgaatgcggcggccaaccacacagcgtgtacgccattgaagaggatgaagccgtcgcgggtctcgttgcaaacggcttcggcatcgccgttgtccccaatatgccacttcttaaaacgctacccgttaaaatcattccgcttagttttccaacttggcagcgtattttttatatggcaactttaaaagatcactaccaatccccagccgccaaagacttcattgactttgttcatgcccatcatgcggacattcgccagtaaagtgtgcctgatgcatcaggtcaatagtctggcgctattaatcgttaaaggctgcggtgcactattcaagttcgcgccattttagcggaaagccaaaactaataagatcggaccatgctaaatgcctgtcgctgttctaaaatggaagtgttcaagacattttcaaggaggtcattgcatgcgtacacaaacaaaaacatctgtcatgaagcttgccgcggttggcgccgttgccggtttagtatcaggacttgtcaaattaggctgggaaaatattttgccgccgcggacacctgaacgtgacgcaaccaatccgccgcaaacattcctgcaacaacacggtctcaccgcagcacaaacccatgcaacttatacttattcagaccatcagattccttgggtcagcctcctcatacacttcggcttctcatcaagccttggtgcgctttatgctgttgccggccattacgtaccgctttttaaacttggctatggcagtatgtggggtctgggcgtttgggcaggtgcccatttgtgggcaatgccggcactaaagattgtgcccgccgctaaagatcaaccggttgaggaacacttatccgaagcagtcggtcacatggtttggaacacggtcaatcagatcgtcatcagtgacatgctgcgcgaaaaaagcggcaattaagtgatgcattcagcttcaaagtaaaagcgttaactaaaaagtctatgctgacaaccgaatcttcggcatgccaacacagactttttttactatgatcaatttttatttactaaagtaaccgggcttcatcccgtcgcgcaatgaacggcaaaataagtcccaatgccaggaaaataactggcgtaatgatgtttaagcccatctggaaccaccaagtccctggatcgttgagataattgattttcggcaacattcccaacaagcaggccaaagcggtaaaaagaaaacaccatccgccaataatcatgcccacatgtttgtttttaacaaacatgtactctgcttggaatttttccaaatgcttattaagcaaataataggcaaggaaaacccacaagtagcgtaatggcatcacgactgagttcagatttaacaaccacttatacagctcgttcatattgccgataccaagcgcgggcacaatgatcagcaaactgactaaaattccggtcagccagtaaccattgatcggcgtgccttttttattcagatgactcaacttctttggaataaaatgtggatcagcatcacttagcagcattttcagcggcgcgtcaatcgaaaaagctaaggctgaaatggaagcgagcgcgttggcgatggcatagagaatgacgaaaatattgccaacatgataataactgcccagcattgcgaaggcggtatacggtccattggccatcaaatcggtgggaatctggttgctgttaaacaacatgcccatgccaaatgacccgagcaaggcacaaaaggcaaccatcccggcaagcactagcatccccgttggaaattccttggccgcatgtttcgtgttattgacgtacggagaaattttttccgcgccgccaaccgcaaagaccagcatcgaaatggtggtgaagtaattcagatcaaactttggcaagtacgtgtgaatgtcgcccatatccggtgtggccacatgcacgcctttgaccatgagcggtgcagtgacagccaaaatgataaacaaaatcgacatcaagaacatcgccgtaccggccatactgccaatgcgattcaaagtggttaacccacgtgatgacagccataaaaatagcaagaagagtgctaaacaaattaaggatacggtcattgaagagacggtattcacgaaattgccgttgcctttaaacaaccagctcaacgcaatcagaatggcttgcggcttttgagctaagtatggaatatgaacaacccaataggtccaagcagcataataggccaacctgaccgtaccggtttctttgatccacgagctaaccccaccggcttgatccttaaaggtggagccgagttgaccaacaatcaaagcatatggcacaaagtaaatcgccatgatcaaaatccagcttgttacgacggaaaggccttgctgagcgtagttgttgaacacattgcctaagccccagaccgagacgaatgcaattaacgccacgttataccagcgcagttgtttctttgtatctgccactaaaaatccctccaaacagccgcctgtccatcaatcaacagcgactcgcttttcagtgtaacggtttaacccgttttctttcccgtgaaattgtatagatgaggattagatttttcttaaattaacgttgtgaattaaccattataagctatgaaaaatgtgaaatgagcgttgggctttatcttcgtggccaacaatcgcaggaaaatcaattggctaaagacgccatgccgtgccaaactccgcaatctccggtcagatggggctggcgacgcgtagctagagcggtgacggcgcttcgagcccaaaaaccggtctcgaagtcgcctaacaacatcagcgacaagcccagtcgctgtgttgtttgcacggctgagccccatctggcctacgactgctccgccttggcactggtgtcttcataccccatcaaattattcatgaaacagaaaagtcaaacaacttatgatatttttcgcaatactacccaatacggatagttattcgcccttattcgtcagttataagttatgttcctgcatgtcacacagaaaaaccgccacctattttcaaagtgacggtttttagatattgaattaaaaatttttatttaacagcttctgccacagcagcttgcacagcctgttgctcagcttgaatcaggctgacgcgactggcaatcacactggtgtccatggtgatctcccgcgtcagacccggtgtttgcagctttggttcaaagaaggccttgaactccgtcaatcgttccggtgtgcggaaaacgccggcgatcacagtgatgtaggtcgtgaattccatatcgccgccaacggttttttcaagccactgccattcattgcgaatccagtcccacgcagcttgctcgccagcatggttattcagaaccccgcggaaccatgaacgcagatcctgtggcttaatcgtgtcggcatcctcaaacttatcaaccaatttggcaatttgcgttggatcagttgtactggtcaacgcagccagaatatcagctttataactggaatctgtcgtttgcgtgtaggcttttagcagctgatcaaataagtctgcattgccaaaatgcttcacttcattttccaaaacgaacatccggatgtcagctggcaaagcaaccaattgtgcttgattagctgtaaacaactcatgtccttgcgcaatcgcgtctggattcttagcatataacgccatgctcaggatgtatggacgggtcaactgatcatcaatgctttcatcagctttcggcgtccatccaaggcgatcaagctgtccagcactgagcttgtcaaagaatgcctgtaactgcttttcagcgtctgaatcaggtgctacaaacttcttcaagtcgccagctacgcggaacaaagcatccatgacaatcgcgctgtggctcgcagcaaaccgcggcagcaatggcacaatattgccgtatgaattcttacgaccctcagctagcagccgcaggtcttggataatctgccgctggtcaatcgcattcagctgatccacattggctagaatatcggtcatcaattgttcatcgtactgaacaatgaaatgcgagttgttgccaacattgacgcggaatggtttgccattttccttgcgtaattgcgcatagtcgccaagcgtaacctttttctcggcaaagatttggggtgccacagcatagttgctattcagcgggatctgccactggcggccgacatctttgccagcaccaatgaagaattgctgttgcgacaaggtcagcttgccgtccaccacagctgcagtgacaactggatagcccggttgctccaaccatgactgcataattttgccaacgtccagatgcgacgccttacctaatgccgtccataaatcagcgccggctgcattgccaaacttgtgagcttcaaagtaagcttttaagccagcccgaagcgcatcgtcgccaatcagtgctcgcaccatgacaagcatccgcgcaccttttgcataaacaatggcgctgtcaaacaaggaatcgatttcggcgggatcttccacctgcacgtgaaccgattgcacgccatctgttgcatcacgttgcaaggccattggtgcttcaagggtttggaaagcttcccagatatgccaatcaggctgcaaggcatccactgcgacatattccatcatgttggcgaaactttcattcaaccacaaatcatcccaccacttcatggttaccaaatcgccaaaccattgatgggccaattcgtgcgcaatcaccgttgccacgcgttgcttggtttcgagggaggtattgtccggatcaatcgtcagcaacgcttcacgataggtgaccaatccccagttttccatcgcgccagccgaaaagtccggtagtgccaactgccaagaatgcggcaatgggtatggggtttgatagaagtcttcatagaattcaatcgaccgcttggcaatgtccaaagcaaagtctaactcgtttggtttgtgggccttggtagcaaaaacaccaatcttcacaccgctcttagtcgtggtttgtttattttgcagatcaccaaacgcaaacgcgatcagataagtcgacatccgcacggtggtgtcaaagtaatgcacaccattttcttcgcgaatttccggcatattgctaatgatcgtctcacccggctgttcgtcgaatttgatagccaaatcaaatgtcgccttggcctcaggttcatcaacgcttggaaaagcctgacgggcagcggttgtctcaaattgtgtcccaataatctgctttttgactccatcaacttcgtaataagacggatagatccccatcatggtatccgtcaatggtgccgtgtagtcaatcgtcagcgtcacctttccggattggggcaaagtgatgcgaatcgcttctgcaggatcatcaatcgtaaacggtacatcctgaccatcggcctgaagggcactcaccttcagatacttttgatgaagggcgatcgcggtttgcttcgcctcaccagtaatcgttgttttcccggtaatcgttttgtttgcccggttaatagccaagtaaagctcataatgcgccggttgaaatgcctgataaaaatgcgttgcttcagtcataatttcctcctcgaattgtaagattacgctcattatacgccaagccagacggttacggggttgccaagtatcgaaaagctcacggtgttggttgaaatcgacagacttatttcttttcgccaaaaatcggctcagcgacttaaaaaaattacatgcgtgaaaatacggttattgaacttgcgtgtcaggccgtttctcaactgatcgcgtccgcagatattaacgataattcaatttttaaatgctgctaaataacctttaagatcctcagttatttagaaattcaattgtcgattaaaagtcaattaatataatgcgaattgtttattttaacaactagctaacatactaaaaccaatttattttatttttctaatggttgacattagttttatctcaggataaattacagacatgagagaaaatgagcaagacactcgcttctctagagctgctacaactcacttttcaagattttgttttaatgactaccggaggaaataacgtgtacaaactgaatcccttttcacaggaaaaacgccgctataagatgtataaggcgggacggcattggatttatagtgccattgctgttttaggcggagctggcattctgatgtttcagccaacgcaaaccgtttttgctgatgaagcatcaccgactgccagcgtgacgacgcttgccaaaccgcataccgaactcaaagacaaacagcccgttaccgcatcaccgactcccactgataacccccagcccagcgttgacaagccagcggtcctcgcaattgaaactcagccaacatcagcggccaatcaagtcgaagcgccttcagcaaaaccggctgaccattcgaaggcagcgtctgacagccatgccgcatcgatcgtatcagcaacaccaacccctacgccaaaaactgcacctgttgcaaccgataaagttaaagttactgtgtctgttgaaacaccagcgtcaccagtcatggcgccaaccgttgctccgcgatctgcggtccaaacaaagccaacacctgcgccagccaaaccaccgattaatcaggccgttttaaccaaagggaatgtgcaaccgctttgggatgaaaatattaaaggacaaggcatggttgctgccgtcattgatagcgccgttgaaccgcatgatatgttgcgactaaacgacaacacgacggccaagatttcaaaagaaaccattgccgactttgctgctagtcacggctatggtacctatctcaatgacaagctgccttttttctatgactacaccaccaatagcaatactaatctgcatttagataatcatattcaaggtgaacaaatagccggcattatcgccgggaatggacaagaaagaccagatggccgctatatccttggggtcgcgccggaagcacagatcctaagcatgaaggttttgggccaagcaaaatcactgaccacaaataacgttgcccgtgcggtgtatgacgcggtcgcgctaggtgcagatgtgatttatctatcgctggtcaagactgtcgatgttgaagatcccactgctgaagatcaagcggcgattcaatttgctgccgatcatggcgtccttgtcatcaaaactacaagtaacaacggtaatgccatggcgattcacggcacctccgtccccggcggcactacggctggttatatcacgacaaatgatagcacgctttcgctgacaggtggcggccttagtgccctcactgttgcttcggaaaattcagcgctgggtactaaatccgccatggcgtataactcgtcttggggaccaactactgactataaactgaaaccagatctcacgacacctggtgaaaaatccgtctcgattggcaaaaacaacacgctagcgaccaagagcggcaccgcggctgccagtgcttatgcagcaggtgctggcttactcgttatgcagcatctcaagcaaacaactaagctaactggtgttgaactcgtcaaagctgtcaaattagcgctcatgaatgctgctacccctatgatggatcatgattatccgggcaactttgtctcaccacgacgtcaaggggctggtcaaattgatgtcgccaaagccagcggtttaacggtgacggcagaaggtactgatcaaaccggttccgtttccttgcaacaattcgaggcagcaccaacgtttactatcacgttgaccaaccacggcacaaccgatcaaacttatacggttgtgcccggccatcccctcacgcaaacctttgacaccgcccacactaatggcatttatgctgttgccttgccaggtgcgacgctaacaaccgcaacgccaactttcactttgaaagcaggcgcgtcacaaaccgtggccttcacgttgaccctagatcaaactgtccggctgcatcaagtcattgaaggcttcatctccttcaaagctgcggacgacagtcaatccatttccatgccttacatgggtttttatggctcaaccaatgcagaagtcgtctttgataatgctgctaatgaaggtcgaagtacttttacaggcagctatttgcttgatgaaaataattacccactgggcattgccgatccgctcaccttaagcgacattgttaacagcggtagttataacgttaattgggaaaccgttgccgcctctgcaaaagacaataaagtggcattttctcccaataacgatggggtttcagatgccgtcatcccgcgcatttttgttaaacaaaatcttcaacaggtcgccgcccaaattctagacacagacggtcatcttgtccgggtcattgatcttgaaaatgacaccgctaagtcacattacgtgcaagatactaactataatacggatttgaccttgtctgatagcatgcggcgccatcctgatggtttcaaatgggacggtaaagtttatgatcgagcaacaggcaagttggtgactgccgaagatggccgctatgtttaccagtttgttggcaccacctatactgctgggataagaaatcggcaaggtattaatctcccagttgcgattgataccgtcaaaccgacgatcacggacttcacttatgacaatggcgacatcaccttcaattacgaagatcaaggtgtcggcttcacccaatatagcgccgcagtattggccatcggattgcgaacctatgaagtccctcttggcaatgatggaactaaaaacaccggtaccgtgacctatcagctaagcgacgatcaacttgacgcgctggaaacaggcgatggcaaactgacgctgacaatcaccgatttggccggcaacagcagccgtcagacgattcaagcagttgccggcgagtatctgccagaagtggacaccacgccgacgccacaagttcgctggtcaattccgattgttcatggtaacggactcagaatggatggcaattatgaaatcagaaccaaagatgacaagtacacggttcaagtgatggtgcctaaagatggtgattatcttgtcgttttaaaagatagtgtcaccggcaatgtctatgttgaaagaagcgaccaaaccaccggcatcgctactttcgatgttgaaaacccctacttctatgccaacctagacgtttatgcgctttatgagccacaattcggaaccttcatcaaatcaccggctattccttcgctgttggttttccacgatcctgacgctggcgcttatagcaatgacaacaccaaaactgaaagctttgatgacgaagcaacggccaaaaacgctgcaacgcgattaagcagtgccgaaccattgccggggcggaaattctcggacaacttgctaagcgccataccaacaagcggtttgatgtttaccgatctgaacgacaacagcttgactttagtaggtgtcgacaaagccagtcattgctatgatgccgagcatcaactgcttcacatcagaggaaaaattaaagatccttcgcataccgacttgcagatttttgccacgccgaatccgagtgactcgcaaaatcgggcaatcctcgcagcagatggttcgtttgacgtcacggttcctttcaaatcaactgaagaaaagaacgtcggttatgccttaacgaccattaacgcaactggtcagaaagtgaccactgacggcttccttcaaatcattttagatacaacaccaccaacattgaccgtgagtgacacagatggcatgaccgttgacgcaaacggggtttacaccgccgaaaccagtgccgatatttttacccttgaaggcaccattgacgataacgttgatggctatcggctttacagtaacggcagcaatgtcctcacccagcatgctcgtgctggtttcaacatccatcaaccggcggcaacagctgaggcaggcgcaaacagaacgaacccatatgacccggtgccgtttaagcgcggatatattttgcccgttggtacgagcattgtcaggttggaggccgtcgatcaagtcggcaaccgcaccgtcaaagtgttcaagatcaagaaagttgctgtaacggaaaattctgaaccgactgagtctgatctcgaagatcaaacggtgacggatagtcctgaaatttcaagcacggaatcggctaatgacggcgacggcgtgactgacgctagtgctgtaatggcttctgatgatacgcgggatcctcaaagtgaagatcgtgaagtcaaagattctgcagaagatgcctttgtagaacatgtcgttgacgaagatttagttgaagaagctaaagatgacttagtcccggatggcggcaacgacagcgaagagaccacttcctcgaaaacagtccttagcgaagccaaagaatctgacgaaaacattttcccagacggagataaagatgttgaaaacgatatctcggcagagggaatcctcagtgaagccaaggaacctggggatgagacaacttcggatggtgatgaagatacttcttttgaagcggtccttagtgatgccaaaatgtctaaagacaacgtgacttcaaacgaggacaacgatgctacaagtgatatttcttcgcaggaagcccttagcgaaaccgaagcatctaaagctgaagtggcccccaatgatgataaggcaattgaagacaccaatgatgcgaaatcagctgttgacagtatcgaagacgctcaaggtaatgtctcttttgatgacgctaccacccctaaaaatgattcatcttcagtagtgactgacactgaagtcaaagataccctcgtgaaaacagcggttctcaatgacaaagtgcctcaagatagcagcgatatcaacgaagaaaaagctgctaaacctgagacttcttcgcaagcggtcattcatgaagctcatgattcagcagcggacacagactcaagcgacaaagttaacgccagtcataccgctctgacggcaaccgcagacgagaagatcgacattggagctgccttcgcttctgttttaacagaaaatgggaagaaaaaaatgcctagtaaagagggcattaaatcggcaattacagaactgaccactgacccaaaagctaagagagcatttaaagacgacaaaaataatgaaaaggaagtcagtgcgcacgctgccatcaaaaccgagcgaaaggattcctttgaatcaaccgctaatggtggcgacaaggatgctccaaagatcactgtaccaaatgctaccactgacaatgacctagccaccaaaatcaacgcagccccaacacctgctatgagtaccagaaacgacgctcaatccggtgtcagctccaagttgccacaaatggcgaattcgcatcgtaatgccttgcaaattctaggggtcatcatcatcagcctgatgacaacgctagggatagttgtcactgataagaagaaacgcgagaaaaacaaggtcaattcttaaacaaggaaagccgttcacaaaaactattgtgttcagtattccttcaacctcagccaagagaaaatgctaattgctggaaacagtacttagcattttttcgtaacggtgaacctgatattgaacccaatttttgattgaaggcattgatttttattctgtctgattgaaagtttttaaagttcgctcaacgcctgtcataaaacaagcgttgttcatcgatgcacgcatatggtatccatctatatcacacaaataatttagttgattcgtttattttatgattatccatcgttaaataaatctagccatttcgttaaacacccatctgaatatttttataattgtttaattattcacctcctacagtaataactaaataaaacgttaaaccgggttaattttctacaccttatgattgacattagttttataacgggttaaattacaaacaaggattcactggatcacttattgacacacatatcgctgatggcgccggttactaccgactgctttaaataccattggaggaaataaaaatgaacagagtcaagccattttcacaggaaaagcgccgctacaaaatgtataagtcagggcgacattgggtctacagtgccatcgtgacttttggtgctgcgagttttctgatgatgcaacctgctcaaggtgtttctgctgatgccactaccccgccaccgacaacgcaaacagaatcaaaacaagcagcaccgaccgcgacagccgctgactcacctgccagcaagccagcatccacgaccactggacaagtatcgtcttcagccgacgcccgggcaacaacagctgcaagttccgcgcctacagccactgcgaaatctgctagaccagcaccagtatcgtcacaggctaaaccagaagcatcggctaaagcaaaacaacctactcaaccgacatcggtcaccccctccaccccgacaacaaccaataccaaaactgctcaaaaaacagttagccagcccgcacaaaaggcgccagcagccccagcaaaaccagctccaattgcaaaaccagccccaacatccaacccagaaaacaaagccagtctaactaaaggcaatgttcaaccgctctgggatcaaaatatcaagggtcaaggcatggtggcagccgttattgatcaaggtgttgagccacatcaagactttcgactcagcgatgccaaagcggctgcactttcagaggatcaaatcaaagcattcactgcaagtcatggctatggcgattatgtcaatgaaaagatcccattcttttacgattacaccaataacgtcaacgaaaatctaaaatttgacacgagtaatcacggtcaacatctcgctggtatcatcgctgccaatggtcaacctagtgattcaaagaaatatgtaactgggattgccccagaagcccagcttctcagcatgaaaatactaggcaagtccagttctgactcactcaataatgccgcgcgggccatctatgatgcagtggacttaggtgcgaatgccatcaatatttcctttggcatgggcgttgatattgatgatcctaccgctgaaggacaggcagccattaaatttgcaaccgatcatggtgtttttgtgacagtagctaccggcaataatggtcacgccggtggtatttacgacaagtccgcttcaaatgggatcacaaccagttatcagcctgccaatgctgcaactttgactacacctagcgcaacgccatcagctatggcggttgctgccggaaacgatgttctggatgctaaggccgcattgatatccgcttcttcatggggaccaacagcatcctacaaattaaaacccgatatcacagcacctggtgaaaaagttgcctctaccttactgaatgatgaacttggaaaagtgagcggcacttcacaggcaaatgcctatgttaccggtgccagcttactggtgatgcaaaatctgaaacgcagtacaaacttaactggtgcgcacctcgtgaaggcagtgaaactagccttgatgaatgccgctaatccaatactcgatatcaattaccctggacaaatcatctctcctcggcgtcaaggcgcaggtcaaatcgatgttgcaaaagctgcaaatttgacggtcagtgcagaaggcaccgatgatgccggttctgtttcattacaacaattcaccggtagcaaatcattcgtcattacgttggaaaatcgcggtaccgatcagcaaacgtacacgcttgatcttggccaacctgctaccgaagtgattgacaccgccaacaacaaaaccgttcatgatcgcacattgtctggtgccaccctcacaactgctacgccaactttcacgcttgatgccggagcatccaaaaagatcacctttaccctttcgcttgatgacacggttaaattaaatcaagtggtagaaggctttatcaaattcaaagccgccgatgaccgtcaatccatttcggttccttacatgggatattacggttccaccaacgatgaggccgtgttcgacaagcccgcaaacgaagaaggcagtatctttaaaggtggctaccttgtcgataacaaccacaatccattaggcattaccgatccaacatcgctgagcgagctagtcaataacccgacgaatggtttcacttggcaaacgattggggccaaagttcagaacaacaaagtcgctttttcaccaaatggcgatggcatttctgacaccatcaccccctatgtcttcaccaagcaaaatcttaaacaagtgatcgcacagattttagatcaagatgacaaagtaatgcgggtcattgatcaagaaactgacaccaccaagtctttccttgaggtcggcagcactatcaatgctgatcttgccaaatcaatctcaatgtttctgaatcctgataagctcaaatgggacggtcaagtctatgatcaaaccaccggtcaaatggtgcctgcaaaggatggtatttacacctatcgtctgatcggtatgacctatacaccaggcgaaaataacatgcaaaccatgagcttaccagtggccgtcgatacgattaaaccgacgctatccaatttggcttactcagacggcaagctaacggccgactatagcgaccaaggcgtgggtttcaccgcatatagtcaagccaaactcaccattggttcagcaacctatggcattcctttaaatcacgacaacaaagcaacttcaggcacaatcaattatcaactgaatgatgatcaacttgccaatctgaagacgggtgagggtaaggtaactttgacaatcactgatgccgcgggcaacagtgatcaaggcagcattaaggccgttgtcggagaaaacaaaaccattgagtccaattttatttggccgcaagttcgttggtcaatgcctgacaccaaaggaaatttgacgcgatctgatggacgttatcaagctttgactaaagacagcacctttacagcccaggcaatggtaccaaaaaggcaagactatattgtcactgccacagattacgtgagtgaccgtcaatacattggcacgctcgataaagccacaggtattgttaccttcaatattgatgctaccggtcaaccgtatgctaacctgactatctcagcatttgctagagatggctttggggagttcatcaaatcacctaaaacagaggacttcatcattttcatcaagaagaacgccgctgcatactcaaacgcaaaaacccagacgaaaccgtttgctgacgaagccaccgccataaaaggcgctaagttcttttctggtgctgcccacctgacaggacgttcacctctaactagcacaaaaggaaaaatgatcaacggcattgcatttcttgacctgaacaacaacaaacgaacattggtaggcattgacagcgccagcactttctatgacgccaagcttaagaccctcacgcttcgtggcaaggtatctgatccaaaaaacagtaagttacgcatttttgtcaccccgagacaaaatgatcctcaaaatgaagtgacctttgcagcagatggttctttcagtatgaccatgccatgcaacccgactgaggagcggaatattggctatgtcctcacaactctcgataaagacggtaaagagaagaccaatggcggcttcctgttgctttatatggatacaaccttgccgacactggagctttcagatgctgattcaatgaaaattgacgatgatggaacctaccttgtcaccacggacgctgacactttttcaattaaggggcgtgtgactgacaatatcggcggctatcgtttgtatagcaatggtaacaacatcttcacgcaacaaaatctggcgggtttcaatgcacatcaatcttcggctgcgccgaatcaacttacaaacgggtacaacccatatggtgcagcatcgtttgacgaaacctatcaattaaccgatggcctcaatatcattaccctacaggcagttgatcaagttggcaacacggtaacgaaaacgttcaacgtcactaagacgccaaaacttctcaaggaagaatccttggatgaactagaaattactcctgaacaagaagatcaaacacccaagaataatgcaggtgaagcaccggtcacaacatcatccagcgatgaaaaaactgaggtgacgccaagcaccgagccaacgatggtcaatccggaagacagcaaggttgaaacaagtaaccccgttgtcgaaatagatacatcaaaggaagctcaaagtgacggaaacgatgacacgtcaacaaacacaccagcatcagtaacaacaggtgttgatgaaaatccagttgataacgccacaacgatgccgaatcacgctaagggcgttgattctgacgccgaagccactgaagcaacaaacaccaaagacaacacaccaggaaccactgccccaactagcactgatccggcgacggacaaagagagccccactaagtcggaagttgatccaacagcgacctcactacctgacagtcaagtagttgagaccgcaacagcaaccacagtcaatgaggacaaaggcaataaaactgatgacgacgaaccaactgccacaaacctcacgacaagcaaagatagtgctattcaacctaaatccgatccagccgcaagtttgcaaagtaacgacaaagctgttgaagcggccatagaaaacgataaaattgctgaaaaagaaggtcatcaatccgccaacacccaaccggctatcactgatgtaacgactgacaaagatagtgccgttaaaccagaaatcgatccagctgcaagttcgcaaagtaacgacaaagctgttgaagcagccatggaagatagcaaagccgaaaatgataaaggcagtaaatctgattctgctgaaacgaatatcgccccgactatggccaaaaacagtggtgtaaagtccgaaatagatttaacagccatcgcgccacgtgataacacggcgacatcttctgggactgcaaaggaaaatgccgatgtcaaagatgataagggtaataaaaccgatactgttgaatcagctgttaccgacacagaagatgacaatgaaggtaccgttaaatcagaaattgaatcagtggcaaccacgccaagcagcaacacggccacagccactgaaataacaaaggaaaacacaccaaccgaagatgaaaaagacaatcaagtcaatgtggttgaaacaacggccactcatccgaaatcgattaaagatcgtgccactaagtcagaaattgaatcagaggcaaccgcgccaagtaaaaccgaggtcggtgaaacagtcgcggaagacgccaaaggtgaacatgataaaagtaacaaatccgatgatgtcgaaccaaccgtttcagaccggaaaacagacgaagatcgtgccattaagtcagaatcggacacatcagcaatcacaccaaacgaagacaacatcgatgaaacaaccgtggaagaggctaaagccgaagacaatcgagaggctgcagctggtaccattgcaacagttgccgcagacccgaaggcaagcgaagataattccgttaagtcggaaatggacgcaacgacaatcgcaccaattgataacaaggccattgaaacggtcacggaaactaccggagtcgaaaaagtcgaaagccataaatccactgataccgagtcgcctgtcactgacccagcaattgacaaagatcgtgccgttaattccgacatcacgccagccacagcctcaccaactgctgacaaagcgccggaagccacaacggaaagcgtcgatgtcgaaaacaccgagagccatcaccccgatatcggggaaacatccgtcagtgactcacaggctggcaaagattctgctgctgagtccaaagttgatccaaaggcaaccccatcaagtgacaacacaaccactggatcaacggtcgaaacacgcacaacgggaagtgagcaaaacacccaaatcaacacctcgaaaacaaccgtgacaccagcaactgacgacaagaaggtttcgtctgagaccatcgcaccagctaaaacaagcgacgatacggcggagttcggcactgcaacgacaacatctggccaaaacacgctgactaaaactgaagtcgagagctcaaaccatgcaaccaatcaccctgacaccacggattcgtcaacagacgcaacatcgcaacccgacgaacctactatttcgattgaagcaactaaaccaacaccttcaaccgaagacaatcccgtccaaccgaacgttgatcaaaaagtaatcgaccaaaagtcggacaaagataaccaggataatccgactgctatcgagaaaaatccgaaatccaaagtgactgatgacgaggaaaccatcagccagacgcgtcaaaaagatccgaaatctaatatagttgaaaaagaggatgacacaatccttgttgttcaaaaagatctcaaagcaaaaatggttaaggatgcggaacccgcctcgcctttggatcaaaaaacgtcggctctcaaacaaaaagagtcaaaagaaaaaacactggcaaaatcagtccattcaactaaggcagctgcgaaagtcctaccaccaatggggatgcaaaacagtcattggttgcaagctctaggcatcgccctccttggtatggtctttgcgctaagcatcggcctgacgagcagaaagaaacatgaaaaaaataattgcaactaatcagtcagttagcagcatcaggacaaatcaccgaatcaacaaacactaacaaagagcttcatgccagcagcaaccggcatgaagctctttgcctgtctatcgcacaatttccaatcgccgccttaccactactaatctcgagcactaaagcaccaactagttgtcaagctttttccccgtcatccccgaaccggtcgacttttcaaactcagaaaactgatcgctaaaaatagtccagctagcagcaactgaatccagttgtcagacactgcccgatgacgcatgaacgtcatcatattcaccgcgcctaaatagcgataaccgatacacaatgcaaaatacgttgttggcaagagatacgcgactgccagcgatcgcgataagctgtaactcaaaaccgtgatgctcccaactaacaaaattttgacgacaaagtcgaaccaaagtatgagcagattgaccccaacatttaaaaaagcataaacgccgatcaatactgtggccagcatcgccagtaccaccgcataccaaatgaatcgcaacagataaagccaccatagttgcgtttgcttgctattaatgactgcgccaatctcgaccgtttgttctggtaaaaacagactgccaaaagcaaaaatggtcagcagtggcagaaacaactcgcccggcatggcggcctgcgctaagttgcttggcgtcatcgtaaaaacaaccggcatgagcaggccacacccaagcacgatcaaactagtgctgcactcgttggctttgagttctaacccgaccaagcgtttcaaagttgatggcatgaaattttcctcctcgttgaagatttaacaacaccacagctaagcaaataaaaccaatggcgagcgcggcataggttaaccgattaaacagtaattctggtagatgagcctcatagtaggcaacgttatgcagtgaattatgtcgcggtatcagcaaccagccataattgccagcaacttgccgcgcaccaatcatcatcgtgctcaaccaccaaccaatctgcaccacgaatccgagaaaattgccaaaaagcgcatcacttaaaaagcccactgcgctgctaaccatcactgttggcaataaccacagcccggtcattttgaagaacgcgagataatcgatttgatacccttgataatgcagagcgatttgaatggttaagacgattcccatcaaaaaaatcggcatcaaaagtgtcacgagacttgctaagtatcgactgcctactagtcgccaagtactggtcattttcgattgcagacttgtcgttgcacgacttcgacgatcagcataacaataagcgatgacgacaacggtgggtagaattcccatgacaataccggcgtaatcggcaaatagtcgtgcaaaggtaccactgatacggtcttttttgagaatcagattgtgatcttgccgtgcctcggcttttgtcatcggtcgcgacgcaaacccctgaatgttctgtgaactgtaagccgattgtccgccaatcaacctgtccacctgtcccagtgctttcaccaatgtggcttgtgtctctgcttggttggcttgtgtcagtaaactacgaacgcgggcctgatctgcctttggtagtgtcactgtttttgcaaaccccaagggatacgtgacgtaagtattgtgctgatagtcgtatcgtaactggccaacgccgtttgttttgcgcgtctggaagtcggttgctgtgatatcgtcgtagctattagttgatgtcggcaacgccgccacgtttcgtgcgagcattggccacatatttaacaacacaaatgccatcactaataaggtataaatcgtaaaagtcaggctcgttgtttgccgtttgacctccatccaaaatagtttcataagaaggcctcctcatgcttcatctgcaaatatagataagcctcctccaacgttggcagaacttgcgcactggtattgatctgactggcagctaaaaatctcaacttaaccattgtcccatccgttacttgctcagtaatccgacgatgccgtttaaactcgtttaactttgccactgacacttctttttcaaacacgtggccatttgccgccaataggagttgatcggttgtgccattgaacaaaagccggccttgatcaagaattccgatcgtattggtcgttgcctcaatgtctgacacgatatgcgtcgatagaagaacgatgcgctcatttgcaaaatctgtcagcaaatttcggaagcgaatgcgttcttctggatctaaaccagcagttggctcatcgacaattaaaacttttggacgattgacgagcgcctgtgcaatccccaaacgttgcaacatgccgccagacaaagcttttattttagtgcgggccttgtctgctaaatgaacctcttcgagcagatgttgaattcgctgagattgctcccgtgctgggacattggctaataccgcaagataagtcatggcatcgacgactcgcatgttggggtaaaagccgaatctttgcggcaaatagccgatttgttgacgaatcgcttttgccgctttgatcggcaccccgcagacttcaaccgtacctgctgtcggctgctccagcgtggtcagaattttcatcaaggttgatttaccagcaccatttttgcctaacagcccgtacatccccgtctcaatttctagcgatacttgatcaagcgccggcgccgccttaccgcgatagcgtttggtgagcccttcgatgttaatcttttccatgaaaaaagcctcctttagcttacaaggagaccttaacaagcaattcacaagattctgacaacaatactttttttcagcatttttctgacatcgttggtaacattagcttttggcgctgccgtcaaaatagccgaaaaccgctgtcgaacaaacacccgccgcatgttcacggttttgaattttaaagtaaccgcgatgtgctgcacatagttgattgcagatatacatgcccacgccaaggtgatgcgctgctttatcatttgaaaaataaggcaatttgaccttgcgttgctcagttgccgttaatggctggccatcgttgcaaacctgcaaggtgatttgctggtcattgaaggtgagatgaatccccacctttgccttagcgaaccggagggcattattgatctggttatcaaacacctcaaggatagcgtctggcgaaaccgataacttgttgtctgtcgaccgtgtgctatcaacttgccagtcaatcgtcttggctgttggtaatttatccacttctgaacgaagctgttgttcaacctgtgcttctgtgattgcatgatgattcaaccgaatattttgaatagaggtcacatgactcatcgttttgataaagttgttcatccgatcaagctgtcgctgcatctcgtctagtaaatgttgatctggtggctggccttcttcattgaacgttaacaattccagatttccctgcaagacagttagcggcgtccgcaaatcatgagcaaacgcggcgttgacttgtttttgatcatcagccaattgccatgcggtttcgagcgccttgcgtaatgcttggcgcatttcctcaaacgcggctactaattgaccgagttcatcatcagatgtcggctgtagtgtgaagtccagatcctgcgcctgaatatgagtaacaccatattgtagttgatccaacggcggccccaatttcacacgataaaaaagtctggctgtgatattcatgactgcgtatagcatggcaaaactaccaataattgccccaccaaagtataagctcatcccgccaatgaaccagcgcttggccaaggcagttgcaattggcatcatcaccacatgccaaatcagcaagtagaccaacaccaccaatgcagcggcaattgtgccgatcagaatcagatgcagcaaagctttttttattggaaaacgcgttaggcgctgctttaacttgtccatttatagcccactccccaaacggtttcgattggtgaggttacttgatatcgatcaaaaagaagtcgaatgcggcggatatgttccgtaatgactcgatcatctccaagagcgtcataaccccatattttttcataaagctgttcacgactaaagacttgccccggattcaggcttaacagctcaactagttgatattgcttcttttcaagacttaaaacttgatcgccaattgacacttgtttagcgcggtagtcgatgagaatctgatcaaaaatcgccatccgtgcacgtttttgcggttggctttcccgtctaaagtgggccttaatgcgagcaccaagttcagcaagactgaacggtttcgtcacataatcatcgccgcctgcaccgagtccacgaactttatcctcatcagtcacccatgcggtcagaaaaataattggtaccgatgttatcgcccgaattcgttccgccaacgaaaagccgtcagtatcaggtaggttgacatcaagcaaaatcaaatcaggattattggtcagccgttgtaatgcgctcgcacctgattcagctgtgattaggtgaaacgtcggaaggcggagggcaaaataacgcttcaacatccttaaaatatcaacatcatcgtccactgcaagcactgtcgcgcgcagactttcatcccttaacatccgctttgcctcccactggcaacaacttttcttatgaaaattaattagctttcttttcaaagaatattttccttcgttatgcctactgtacctgctggcggaaccgcttgcaacacgttcaagcaactgtggacattaaactgatcaaaattagttagtgtaagccacccaaaaatccgcactaaaaataccgataaatcagcttttctcgactcatcggcattgaacgtgctgcttgatttggtgacatcgactcagactgacgctggtatccatctggtcgtgaggctcaatagcgaatacggaatgttttaggcgccacgcgataaatcacgatggtgcccgccaccacatagatgcatgtgatcaccccaatggcaagcgcataagtgtagccggaaagatggacctgagtgaacacccacgcaacccaatacatcgcccaatataaaatacgatataacggcgacacgacttccatatcttccgtaaacggctgtagcaggtaatagataaacaaatcatgaaaggaaaagaacaacaccatcccgcaaacttctaacaataaaaccaaatagaaattcaagtgatccggcactggtgtcaccaattgaagggcaagtaacaggccatagattaacgcacctgtcacggcgttgtactgaacgatccgccaaaatcgatagaaaaacccgcttaaaacagctttaggttgtcgataaaatgggtaaaagagcatcgccgaatcgcagttaacgaatagtagctgaacaatcgggccgcccagcgaggccagatacatcacgaagaacaaggcgccgtaaattggggtcaaatcccccacggagtgaatcgcgaataattttaaaagaatcaagccgctgatgccaatgccgctaatccataacacgcgggtacgcaattttttccataactgactgcggtagcgtgcaaatagcaatgcgttgagatagttattgccaagtcgctggttcactttgaccgaaaccgtcgtatcaagggtcaattttttctgcatcgcggtaccagttgccaaaaattgttgcttctgtgttgccgccaccttgttcaaagttatgacagactgttgaatcgatgccattaacagtggaatatcattcgagaagcggtgctgataccaccacaacccgaaaaccccaatccagcaaatgatcaagcctattggcgaaaacaacccagtcacgaatggtgtaagcttgccggtcaacacgagcgcgattggcacgcccactaacccgcaccaatacagaatttgtgcgatcatccccagccggtggttcgaccaagtcaagcgtgggataaacccgtgccagaaccaactaaaaacggatacgcccaaaccaacgaataaaatccaataattttgagtgatcatcgttagtccaaaaaacggcaagaatggtccaaggacgatgccaatcacttgctgtatgcgcgtcagcccacgagccaacgcaagccgatcgagcacaaaatagtcggctaatttaattgcttttaaatcaactggaatataacgaaagaccagtccccgaaacagtaggccacccagcgtatagatcgtcactgccaccatcgcacgaaatgtgaacgttgtcggtaacggatggataaaatcgttgtatgcattggctactaagaaatccatcgctagtaaaagcactgcgatcagtggcttcatcatgaacattaagcagctcatgataatcgcaatcaaactttttacggcacccatacgatataacttagtcggtatctttttacctaatattgggagccgccggataaaataaatcaggccattcaccatagtcgttgcatcaacttgcgcttgaaaccagtaataacgccacgcttcaaccatcggcccgcacctcgtcacttagccgagcaatcacggcatcctcaaacgcctgactatggatgtccaagcctgaaagctctgtcaactgttggttatgcaacagcaccacagcgtcacaaatagcttgggctaactgcataatgtgggttgaaaagatgaccacagattccgccttcatcgccacaatcaactgttgcatctcatgggccgccaccacgtcaactgttgtcaatggttcatctaacaacagtactggcggtcttagcatgagcgataccacaatctgcaacttgttccgcattccctcagaatagtcgcgtaaaagcttattcgcatcagcctgactcaacccagccatttcgaaaaaatcggtcgcctgcacagacgaatgtgcttgttcaagacgcgttcggttaatgctcataaagtagttaacaaattcaagccccgtcataaacgccggtaagtgcggttgcgtgtataccattcccacacttgtatctgcgtagtcagtaattaacccacgaccatcatcggcatcaaccgcaatcgtcccgtgatcatatggcaagttgcggacaatcatgttgaataaagtcgactttccggaaccgttacggcctaacaagccatatattttaccttgattaaacatgaaactggcatctttaaacaaaacttgctgatcaaaagctttgtccaaatgcgcgatctcaagttgtttcatagcgttcgcccccttaacgcgttccccagatcagaacccgatctcgttcatatgctgctatctggcatcactaaagttttctttagtataccaaatcattcacaagttgctgtagcgaatgctctcaccgtcaaagccgaccataccaaaaatagactagttgctgagtcatctaatgacacaggtacgctcaagatcgtttaagtgtgaattttttatcccgaatttttttgacataagccttgtacttagtccggccaagtggcgtgacaattgcgactcgataatgattaccaggcaggctgatgtcagtcaccccagtttgatctgatttaaaagaatgtgtatgtcgacctcgtttcaccacgacttgtgtggcttcagccggtacttccagcaaataatgctttcggccaagcatcaaactgcgtattacgaaaccgatcacgcctaaaatgatcaccgcgcctaaaagtgcgactattagctttaatttgttccaccaaaccgcccaacttgaggcctcgtcatctgccttaacgtaaggaattcggcgacccgttatcaacaatcgatgagaattaatcatataaggcgtgcaggtcattaaggtcacaagatcctgtcccggcacaattcttagctgccgggtatcacttggctcaataacctggcgcttaaagacttggtaagccaatttatgattgcctatgctaataaaaaacttgtcgcctttttttaacgctggtactcgggtaaaaagttcagcgtttggcacaccacgatgcgctgaaatgacagcatgggtatttttaccaccagttggataacttgtaccatccaataaacaggcgccaaattgtagaagccaatcgcttgtatgatcaaaaaccggcagactaaggccaattttgggaatcgtcaactgagcaactgtctgacgagtcaagatttgctgattgcgtttggctgctgtttttgcggttccttgatcattaacggcatgattaaaactggcaacgccgggcacttgctgacttgctgccaactgtttatttttttgctgatagtcgttatattcccgccgcaacaccatctgattcttccgcgcttcttgttgtcgatacctgtcgatgacttgctgattttggtaagaaacgtaagcatcacttgcaaatggatagcataaaacaccaaaacccgctaaaagaaggcatccaatcacaatatcaatcaagcctaaaggtcgacgtgttcgttttgtcactctgattacctcgccatatcaaaacaagagcgccatcgacgctcttgcttgactcatttatcttattaactttttagaaaccattgcggcgcttgcgataggcaactgctccaaatgcaattaaggcaacgcccaaaatcgcaaaaatgactgtgccagtaccaccagtgtgtggcagaataccgcttggtgcatctagaatgtcgctagacgaattatcagctttaaagtctgtattggcagcagcatcataaccatccggcacgtttgtttcaactgccgtgtaagttgtggtgttatcagcaaatccatttaagccaaacttaccgctcttatcagacgtgaaaacagtagcatcgctttcagcaacccacgtcaatcgatagttattggccaatacatcgataaatccttcgccgatgctgacgctttgaccatctttatctgtcaacttcaaaaacttgccatcactattgctaatcttaaagccggctccttcaagcacttctttagtctcagcatctttcttaacaaaagtgcgctcataggtggtcttttgaacattctttgggtagacatagacattcccgtcggctgctgccttggctggtaaggttaaccagaaatcggcagacgtgttataaccagctcgcggattggtttcatggaaaagatagacagcagcacgagtcttaccgctggcatctgttgattgggttggcaatgcttgggttagttgcccctcgtcattagtcgtaccggttgcggcaaccgaagcactatcaaaactgcccttataatccttaggcgatgcccaataattggctgtcacgttgtaaatggtgaaatcaacgccttgtaaaggcttagcaccatcgccagtccaaatttgatcagtcgcacgatcaatggcagtaacatctttttcaaacccgtatttagtaaggacaacgttttgtgttgtcgtatcattcgtatctgcttgaacccgagtgccattaaacccgagaaccatcagtaatgtcattaggatcgtgctggttaatgtcagcactttcttggcaattgtctttttcattcttttctccctaattatcaattttttgttttttcatgttaaaagcaagtactgtcgcgaaaattatcaacccgagcgttgaaagccaagctgcaactgtatcacccgtttgtggcaacaattgacgtgttttctttggaactttttttggggcgtcggtgtgacgacttactattttgttcttaggaaataaatcaatgcgtgattgattcccatgttgaaggttgcttgacatgacaaccacaagattctgactggcttcaatattcttaggtgccgccgtttctttaaaaagataaaccgcagcatgctgcccctgtcggaatggtaaatcgccaaagtacgcttctccctgaccagccgtcacaacctgtgcgataaggctggagctagcaggctgatagctatcttgactcaacgtcgtttgtgctgcttcaatcgcaccgccatttttggagacaagctgccaaaagtcagcggtcacgtcataaactgtgaacgtcacaccgtttaacggtacatctgcctgcgaaaagtcgggttttgttgtcccgttatttgcttgttgagttggcaaggtatctttaaacaacagcttatgcaacacaacatcaacagtggtcggcacagttgccgcctgtgtctgctgcaacgttgtcgttgccaaactgactagtagtgccaagcaaaaggtcaaaatcactaacggacggaaggatttagtcatgttgcttcaccacccgtcgctttatcaaaacaaccagtaataaaaggaacgctgcgctgatcaatcccagtgcgataccaagcaatcgctgatagccctgaccacctgtatgtggcaaaattgcaagtggctgattaatcgcctgcaaagtgatcgtgctgccatcaatcgctaatgtgtatccgttcttactttcgcccggcttcaatgcctcaccgtcaatcgtgacggttgcctctttaccagtcgtagctacctgaatggcaatctttgcaggattgctttgatagccatctggtgcttttgtttctgacatcgtataggtaccatctgcaactaattttgtcgcaaacgcttgtccctcagatgtcgccgatgatgttatcgtctcagcttcgccagcacttggttgcagggtgaacgctgcacctgcaagatattggctttgattatcctgtttgatgacccgcaaagtcatggatggctttggttcatcatatttcgtcagcgtcagaatttgctggtgatccccggtcaccgtaaaatcatctgacttatcaccaacaggattcaaagtctgctggccattaataacactccctgatgtcacattgtcctttgtgccatggtattgccattgcccatcagacgttagctgaaaaagatacgttgtcccatcaagttgataacctgtaggtgctgcagcttcctgaataccgtaataccccggcgctagtgcctgcagatccgttgacgtgatggcgttggttttggatgcctgctgaaaactgttatcgctgtactgggttaagttaaactgcatggccttcaactgatctgctgataaatcagtaccatcggttgtttttttctgaaattgaaaaccatactgctgatttgtcaaagtcaacgttgctgtttgctgatccatattttgagaactgataaacgaactcaaatcaattcccgaggcatcttcactcttaacgacatatgaaaaactttgaccctgattgttatacgcaggtgccgtaaagctagctttccagttatcagcttttttaaggactaaggtctgttgccaatttggatcaagcgaaccgtcagccacttttcgctgcaccgtgacgttgagcgtatccggtaacgattgattgcttaactggcgccattgcttctgcacataaactgtagttgctggtgccctgcctgaaggaattccaaagtcaacagcggcagcgcccgcttttggtgtcaacaatgtttcaccattcatttggtaccaaaaatcaggcttgaagccagcatcctctgttttgatccgtacttgataatggatttgaacttcctgatcctgacccaagttcatgtgattcaccgtcaattgaccatcttggatcgccgcacttggcaactcacttgctggcacagtttgcttgccgacactcgtaacggtcgcctgattgttcgcatattgaaattgcgtaccaatcgggtctgtgatcgtgccgtcaatgatagtattaaagtttttgacaatgtcctttgcctgattattcaaataagcctcaacggcatcggcactatcggcatcttcgtatagatccggtgaagtgggaataagttccatattttgacgcacgtcttcgtctgacatgtagccttccgaccagtagccgtcgtcgccagccagttgaatgcctaaagcgtgcaccacattaccgctatcttttgccttcttagcctcacctaatgttgctggccaagtatcatatatacgatcacctgaactatcgatgtacgaatttttaagttctgcggtatagccgggttcatctctggtggttccaaagttagtgccatacaatgtgccgttttccaccactgaattttttaccttatcagaaaaagtcggcacaccgtctgttaacaaaatcatcatttttttattgccgctggtgtccgcattcagcatggctgatccttgccgcaaaccaatctgcgtatacgtaccaccattaaaagttgggctcaatgcactattaatcgcttgttgctgactggtatttcctgctttgcctaatccaacgcgaatataacccggtccagtggttttattgccgccaccgatatagccgggactagaaaaaccaattaagccaacattgacgtaatcacccagaccggcgttttgaatagaagtcaagaaattcttaacgccagtacgaacggcaccagctcgatctgtgccgccattattttttgactccattgacccagacatatcaacaactaagacaatatctacaggcttcacattttgctgtgtattgcctttgacgttcaaataaacgtcgtacaatccgggggtattcgtctctttagcatattttcgaatctgataatccggattattggggtcaccaaatttcaggtaagaattcgtggtatcagtcgcatcaccattccatattgtattgttatcccaccctgaaacttgatccccgccacgttgattgattacattttgttgtcccgtgacctgccacgaatttgtcggataggtaccattagcatcggtttgataggttgggcgaatgttagcagcggctgtcacaactgaactgccacttgtcactaagcctgttaacatactcatcaaaatcaataagaccgcgaacaaatgcccagttctcgccactttagctgtcatcttcgtcacatttttaccctcctctcaggtgaacttttagccactgacattgcaattgttcttgcgcttacaactcgacacttaagagccagtctttttgtccacttaataacaaataagaaacagcctcaacgataaataccgatagttatttaattttaattgtttccataaaacatttttatgctataattttgggagttcttgctttcggctctaatctttcaagttgtgatacaattcggccttgatgataggagtgttttgatgagatatggctatgcacgcgtcagcactgaaggccagcgtcttgagtcacaaatagaagaactgcgtagagcaggtgtcgatgaaatttatcaggaaaaatacaccggcacgaccacgggtcggccggtttttaaacagttattatctaagttgcagtttggtgatatcttggtcgtgacaaagttagatcgctttgcccggaatacgcgtgaagcattggatgtcatgcagacattgtttgatcatcatgttgggatacacatcctgaatgttggtctcattgacgagacaccgaccggcaaactgatattcaccgttttctcggctttcgcccaatttgaacgagacctgattattagtcggacacaagaagggaaaaaatacgctcgagcacataatcccaattaccatgaaggtcgcaaaaagctttatagtgaccaacaaattaggaaagctttcgatgcacatatgcacggtaagacgtatcaacaaatttccaaagaaaccggtattagcacggctacccttaaacgcagaattcgagatttaagtacggagcattgttctgtggccgaaatgtgattcttagcgctgaaattaaaaagtggttgaccacattagcaacaagctaatgtggtcaaccactttttaatttaggctcagtatgctgacacatcatgttataaaaactagggcaataagccacctcacatgtttgttttgacgacatttttaaattgttcaaaattcctaacgcgtgcaagcgcagtcgccacttgcggctcactgaacatcgtgattaaggcttcatacaaacgcataaagcgctgttgatcattttgactaatagctgcaagaacgacaatattgacacgtcgctctccccaacgaattgagtttttcgctatgccgacactaaaagttgtctgccttgcttccatgtacacagaatgtggcagagcgactgtcccaaaagcagtaccagccgcttcttcacgttcaaaaacatgctgccgaaaacttggagacacaatatggcggcgctccagttgatcacacatcaaggtcacaacttgatcccgttgcatgattggctgcaatgtaaagaagaattgctcaccgaagtagatatcaaaatagcgtcttaaaaaattcctttgtacgttacaacgatgttcctcaattgtcgccatgatggtgcttttctctttactcgtcatgaaaggcgaaattgtcacgactcgataagccatcgatgaagcctgaggtactgtcgtgataagcagcgaaacatcgagcttatcaagctcagaagggtcattcaccaaggcaacaacattcaaatcatgctcaaattgcttagaaacatgctgatacagttgcgtgttcaaattcatatagttcggtgaaaaaatagctgttctgattttttcagagtgttgcttttggcgatctaattcagcaccaatatgcagtgcaatatatgctcgttcgccttccgtgattggaatgtgcaacaattgactaagccgaaaagaaacaaaaactgccagctcaaaaactaccggaaaatcctgctttaaagattcggttagcggactgttcagactggatccctgcatggcacgagaaaataatttgtcgagatgcaagctgaacggaaaaacgaaataatcgttatctagatcaatcccaaatatgtgttggacttctgcaaataatgagttcatcgctcgcacaatgttgtcaccaacagttgtggttaacttgtcacgatcacttagcggtaaatggtcaacattagcatgaaacaacatgtggatctcttcacgctcatgtttatttaaaataaggttaaaaacgttctcaatacgtttaataattttcgtgacaatagccgcatcatacgtgtttagccatgaactataggcatcgcgggatagcaatgtatcgtcgtgatgtaaggattgaatcataatcaataaatgcatcatgagatttatcaatgcataatcattgagttttaatgttgatggcgctaattcttctttgataatttgctcgatctgttcaacatcggcacgattaaagttttgtgtgagcaaggatcgatcaacgaaatgatgaggtgcttcctccataatgaaatgcgaaatcagtcggcgtttgtctttttcatttccggtaacctgaattttattatcgcgaatgactaccctaacgcccgatttcgaaaatatctgattgatctttcgaatgtcattttttaaagttccatagcgaacaaataagctttcctagaagatattcgcttatttaaagaaatggttttcaatagatgtcgttttttgattgcttggtcgcgaattttcttcaaaagatgctcgtcaggttaacgaagaagttttatcacgatttaattgttgaactcaaagcaaacgatatcgagtccatccctattaaccaagacccttcagccattgaatgccgaaaatctgcgccaagcccacgcattggttgagtcaggacatatgattggtaaagtcgtggttgatgggccttgggcttaatatcggcaatcaactgagcagttttgataaatccccacaaggatagcaaaaatgaggcgctttttatcagcacctcattttgtcgtatcaattttctgatattatcagcagtgtgtcggcactaactcaaacgatcactatacactggaaagttctgaaactgaccataatccgtcaacggcttcatctgcttgagtgtggtcatgtcagcatcgtcaattgaaaaatcgacatcagcattcgccttcatatgttctgggttgaccgtttttggcaatggtagcaggcccagttgcaacagataccgcataccaagctgagcaaccgaaacgtggtacttagcagccatggcttgaattgcgttgtttttgaacatttcgccatgaccaaatggtgagtaagcttcaaccaaaatgttgtgcgccttagcataatcaatcgttttgaatggcgtctgcgtgatgtgggccaaaacttgatccaccattggcgcgattctggcatgcttgataatattttccaaatcagtcggatcaaagttagaaacgccgattgcgcggagtttgcctgctttgtatgcctcctccaaggcgcgccacgcttctaaattgccctcaaaataacgattgggttcatcgtacttagcccagggtttcggcgcatggataatcatcatgtcaatgtagtccaagttcagcttcttcaacgactcatcaatcgccttcaccgcttcatcatgatttttgatttcggcagccagtttggtgttgacgaaaatatctttacgagcaattccggacgcacgcacaccttcaccaacaccgacttcattaccgtatgcctccgcggtatcaatatggcgataaccggcgtcaatggcttcatgaacagctttcgcagcatcagcatcggcatcaatcatccaagtgccaaacccgattttaggaatctgtacgccatttgctaatgtataagttgcttctaacataatagtccctcctcgacaaataatactgccttgatctttcatcccattcatcactaccaaacgttcgtgaccgagtggattttccttacgcttgatcaagtgctacactcaccctaacccctaaagttagctttaggtcaagcgattatttaaaaaattggaggtcatcatatgtccaaatcttattcaattggcgaagttgccacgatgacaaagctatcgatccccaccattcgttactacgacaaggaaggactcatccctgaactcaaaaaagacgcttctggtgcccgttgttttgatgaccaaaatctcggtgctctcgaaatgatcgagtgtctgaaaacagcaggtatgtcgatcaaggatatcaaaacgttcatgcagtggaatcttgaaggcgatacaaccttaaagaaacgccgtgacttttttgaccacttacacgtcacagtgctcgcccaaatggctgacctacaacgaaccctcgataaaatcgagtacaagcaaggttactatcgccaagccgtggctgatggtacggagaagtatgtcaaggccggcattagacattcgcaagttgtagcgaccgaccgatagtcgcaacctacatccaatcaaaaagcccgccatcaaaaatggtgagctttttgggtcataactttaaaaatcttccaaactcgtttcaacattgcgccgtttggttgcgacccatagaccgatcaggaaccagatgatcgcgatgtatgggaaggtgttcatcgggaatgccggaatcggccaaagactggtgtaaattgggtaaatgagcacgagaatgccgatgactggtgccaacacatgtttaaacattgatcgccccttgtctttgcggaagtaaacaatggcgccaatgttgaccagcacgtaaaccgttagcaagccgagcatgccaatcgttccgaaccagttgtacatgtcgctggcgctcacacctaagccgattgcaaaaatcgcataaacgattaacgctaagccagtgatgccatccagcgcgtgcgtcggggtctgcttgtcacctgatagttctgccagccaaggatgcagatagccacttttgcctaaagcttccagcatgaaagcgccggcgttgagcgcaccgaagtagcaggcaaaataactaaccatcgccgcaaagtccatgaaaattgcggcgttcgtgcctagataatgggtcgcaagaaagttcattggcgcagtacttttcgcaagatcgccgatgtgggcggaaccaaaaccgatgacttcggcgtaactgacaagaaaatagaaaattgctgcaaagctaacggcacccagcaaagcaatactaatcgccttgcgcggatgggtggcccgtggcgcaatcgtcgccgagccttcaaagccggcaaaagacatcaaagcaaataccatgcccataccaaggccggtcgccatatgcggttgtggaataaacggctgaactgaattgccgctgcgaccacctgagaaaatgatcacgacagtcaggacactcagcaccaaaaccgccaacagctcaagcaccagcgttagccttgtcgagaattcgatgcctttatggctaagccagccgccaagcagcagcacaatgatgttgtacaagttgactggtaaatgaataccaaaatgacttaaaaacacgtcagcaaaattgccgacaatggcgcccgaactgaaaacaaaggtcacgtacgtcagcacgagcagccagccggaaatgaagcccgccttttcgccaagcgccttggcattataagcataggctgacccatcaccgggaatgcgcttgccaagttcgacaaaagaaatcgcaacaaataacacgccgatcccaccaagcaagaaagcaataggcatattgatgcccgcattggcggcggcacttgccgtgttgaaggacatggcgccagttggggcaaccatggctatcgagagaccgaatacctcgagtaagcttaattttttacgtttttgcatgattagtgaaggaactcctctttaaacgcgttctccagcccagaaacctccacataaggaccacaaacacaatggccaaagaacggccatcgcacttgtgcccacttatgctccggtttctaaccgggctgaatcacgctctcttttaaacgcgttcacttacgcagaaacctccacataaggaccttaagcctaaatggccaaaacccggccatttaggcttaaggccgcttatgctccggtttctaaacgcgcagttcacgctcttgatgatagagcttggcactggtttgccagcagatggcattgatccattcctttttctgggcgaggtcaacgaatggcaattggttaaaatgtgccaccaaggcttgcttgaactgccgtgctgccaacccgtacatttctgggtaggtgctggcgtcggaggcaaataggatgcgcgtatatggtgccaattcgacagcttcattaaaaacccgactggccccacttggccctaagttatccaacagtgaaatatcaaagtacagattaggaaacacgctggcaagatatccggcttcgcgatggtatggataacaatgtaacagcaccactttcaagccttttttggtaaaagctttcaagtagtcgcgcatgagcagcggattgccaagatacatatcggtatcagcatcaccgtaaccaacatgaaattgcaacggcatatcttgcgcgattatgagcggcgcaacgtgatacaacatgtagtcaatcgacggcttggaagtcagtctcttttcgcctgaatgcttccacgtatcgaatccagctgctgcctcaatcacgttgaccggttcaaggtgcagtccaacccgataagcagcaatggatttgaacccaacgaacccgtgggccttggcctgcttcacatcgttactgaacgcctgccaccaagccgcaaaattatcatgttccagcatgaagtcttcggcgtgcgtttcaagccgatagatcgccttcactggtataccaacgagctctgccgtctgatcaagatcaagaatcggatcatccggcacaaacccagtgtcaataagtagctccttaaagtgaaaatggccgaaaatccgatggttgtaggtcgcatagccgggatcattcatggccgctaatggattgtttgcgtcaagcgcaaactccttagccaaggctaaaaagccgtgataagccagtcgatttttggtatcggcaagcggataatctttgtctgcttccgttgatacctgcgcgagccggtcgtcacgattcggtaccttgccgtcaatcaaaaaatggcaatgatgatccaacaatgggacttggtcgacaaactcagataagtcgtccaaaatacttcctccttcacacgtttgctggtgcaatgaccagctcacgctttcctagaagttttaaagcgaagtgccttcatacaacgtgatcgctgccagccttcatgacaacgatcatgtcaaaatagtttaatacaattcgcgatgcaaggcagcaattttttccaatgccaatttggcataatactgatcgtcctcgcgcttgattttcgcgtaggcatcgaccaattgcttgccaaatacttgctggaatagcgaatctgcctcaaaagcgtcaaccgcttggctcagtgtgcgtggcagaagctgaatccctttggcatcgcgctcagcttgactgagactggctggatcaacatcgcaatagccatccggttgcatgtgatttgtgatgccgtcaagtcctgccgccagcaaaccagcaaaagccaaataaggattagccgtcgcatcacttgccttgagttcgatgttcatcgagctggccggatcaccccaactggttgacggaatgcgaattgccgcctcacgattgtcttgaccatatgtggcgtatgcactgctccaatgaccaggtgccaagcgctgatatgaattagccgatggacaggtcaatgccagcaaaccttgaatatgtttcaaaacaccgccgacaaaatactgcccaatcgtggatagttgcatcgctgccttgtcatcaaagaaagcatcctctttatcttgccaaagtgacaagtgaatgtgtgcccctgacccggccgaatcaactagcggctttggcgcgaatgaggcatataggtcaaaagccttcgcggtatttttgatgatccgtttgtaaatcacctcattgtccgcagcagtcaccggatcactcggcaacatgctcagctcatgctgaccaatgccaccttctgggtaataagcgttcggcataatgccgactttttgcagttgatcgatcgccttcagaatgaatggatacgcaaaatccatcgactcggtggaaaaggcgacatgtggcattgccggttcgcgatgatctttatctccagtaaataactcgaattcattttcataggccattttgaccgtgaagccagcatcagcaagctgcttgacgacttttttcaaaatggaccgcggatcagatgcgtacggggttttatcaagattgtaaatatctcccattaaggtggcgacttgcggcatatagggtaggacatgtgccgacgccggatcaccaacaaggcgcagttcgccaataggcgtcatgtccgccaccggcaaaatcgtatcacgttcactgacattcaaggttgctttggtcaacccaatcccatcagccagcttggccttcaagctagcaagcggaatcaccttaccacgcgttaacccgttataatccacatacagaaactcgatcagctcagtttgcttctctgtcagctgctcgatgacggcttcatcgcccatgttgatttcctcctcttagaatgccctcgccaattattcagatacacccggttaaaaaacaccgttacatatgtatcgttcggccctaatgttacatgattttaaataaaaggaaagattgtctaaaaattgttgcggggggatttgcaaatagtgtcactaatttggcaggttttacagcagctaccatatccttgtcccgaaaaactatcgacaatcatgaagcaccaaggccttcatcgaaataaaacaagcacccgaccaatctcaaagaatttttgagctgatcaggtgcttgttctgttattcgagctaatcgtaacatccttatttttgatgtgtagcaatccgatctaaaaagtcttgaaaaaccactaattgttgcggatcttcttgttgccacatgttctctggatgccattgcaccccgagaaaaagatcattgtcaattgactccatcccctcaacaacgccatcaggagccaccgctgtcacccgcatgcccttgccgacagttttaactgcctgatgatgccgcgagttcactttaatcgtggtcttcccatacaaggcagccaatcggctatcaggtgtcaaatcaacatggtgggtcgcaaattggcccagtgtggcttggggatgctgaattttcaaatcagggtattgactttccaaatcctgatacaacgtaccgcccatcgccatattcatgatctgaatgccacggcagataccaaagatcggtttatttgccgccagtgccgctttgatcaatgcaatttcgaaaagatctttctgataaagcgtcatgccaatcttgggatgcggttcttccccatagaatgtgggatcaacatccggaccaccaggcaacatgagaccatcaatcagctgcacataatcttgcgcaagctgctcagtctggctgacatcatcaggaaacgcaatgatcagcggcaaagcatcaagtttaataaaagcctctttcaaatcatgcggcgcataggcaggatggttgtttggcatcactgggttaacttcgatcaattcatctgtgggaatcccaatttttggcttcacgatttatttccttctattctacttaggatttatttttcatgagtatacgccgttttggtagtcgccacaatgagcatcatcggccgtcgcaattcatctgccatccccggaatggttttaaccatttcatctgtcggtgtcggctcaatcacgcgattcaaccgtaactgatgatcaagcaaggtattgagataagtcgtcaaagtgcgatggtattttttaatctggtgccccagaaaatcagtcttccgcttgctttcatcgaaatagcgatcaactggccagtaaaggttgtgcccttgatcatccgtgacccactcttctttgccttgggctgtaaaaattggatgttcaaccgacatgacaaaatgacctccaactggcagcttatcactgatttttttcataagctgggcgtaatcctcaatgtagtgaatggccagcgagctcaagataatgtcaaactgatccggcaattgatcaatcgcctgcatgtccatccggcgataagtgatccgctggtcggtcgtctttgctgctgcctcatccaacattttaccggaggtatcaatgccgaggacatttttggcgccatgctcagcagcatagcggcaatgccaaccatagccacagcctaaatccaatacccgtttaccagaaaaatctggcagaactgtttttaattcatgccactcaccggcacctgctagtccctttttggaccgatccatctggctgtatgctttaaaaaatgcgggatcatcgtatatatctgacatgacataacgctccttctaagaatataagtccatcatcgcagtcaccgctagcatgtgcaaccattgtgcatatgacgtaaaacaaacagattggcaaaatgagattttgatttgaattcggtggcaagcgatgctacagttgcttcatactttctgaatcttgtctgtcaggttcaggtacagacaccacgtctaaaatgaaggagtaagcgatggaaatcacagcaatcacggcgttccctcggcaggtaaaacttaaaacgccttttaagttagccttgggcgagttgcgggacatcaccacactgatcatcaaaatcgagactgatgatggcgtcaccggctatggtgaagcctcgccttacgcaccggtaaatggcgaaaccaatgaaaccgaacaagctgctctgccagttttcgtcaatgctttaactggctgcgatccgcgcaatcttgaacaggtgcatgcacgcatggatgtcgtgatggctggtcatacagcattaaaatgtgggattgacaccgcctgtagcgacattttaggtaaagcagccagcttgccgctatggcaactgcttggtggtcatagccatatcgtcaccacggatatcacgattccgattggcactccggctcaaatggtggcttcagcgcggacatatgtggccgctggtttcacggcattaaagttaaaagctggggacaacgaagccgccgatatcgccgccattaacgcggtttgtgctgcagtcggccccaccatctcggtaaaagtggatgctaatcaagcttggactgtatcgcaaacgttaagaattgcagcccaactcagggcccccaatttaattgccatagaacagccggtgcctgattggcagttgctgtctctacctttgttacgcgcgcagtcacccgttgccttgatgcttgatgaaagtatccacaacgcccatgatgctgccgatgctattcgcctgagcgccgccgatttgatcaacatcaagctggctaaatcgggcgggctgttcggcgccgcggcgattgacgcgactgccgcagctgccggcgtaccttgcatggtcggttgcaatgccgaaactcgcctaggaacagccgcatccgctcacttcatcgccgcacacgagaatgtgcactacggcgatatcgacagtttcatgttgctggcagaaactgactggcttagcggcggcttcaccgcagacggtccgaccttaaccttatcagatcgaccaggcctcggcgttgacgtccgactttaagagagcgttcaccagcccggtttctgggctggtgaacgcgtttaagagcctgagctggcgcggttaggaggaaatcaattgactgattggcaaggctatcaaaagattaatgaaaagtaccatctcaatggggcgaccatcatcgtgaatccgactgaaatactttcaagttggcaaaatggtgccgccgatttttcaatgaaacggccgtttacccttcaaacaactagtggcttaggttcgctaagtaaacaattcaccgctgacagcgtgttgctcctgaacgcggctgacaagctcgacatagaggcgtccttagtagattatgtgccgaactatcgctatgccgatcaagtcaccttgcgtcagatgttgaatatggccagtggcattcctgattacaccgagcttttactaactgattatgccaaacgcatgcctggtgccagtgaatcccatcttagctaccctattttggaagatcttggtcatggcgatgagattaccgaggtcatttcgttgctaaatcaacatccactggattttacaccgggtgaaaaaggcgtttactccaacagtaattacttattgcttggtttcatcatctcaaaaattactggcgattcgttagcacgcttttttgaggaacatttctttgaaccgctggcgatgactcagacacgacttgggacacaatatgctgaggccaacagttatgatgacctagacgttacggctggtaaacctgtcgtgcttggccgaggtgcctaccaaggtggggacggggccgttgtcagctccttaaccgatcttgccaaatgggcgcaggccgtgttgcgccacgatattctgtctgaaaaagattggcacgaggcactgaccctcacccacaacttctacggtatggggtggatgcattcgaaaacgccaaattggttcagccatgccggtcacgttttcggctattggacctatttcgatgtttcgttcgacaagcagctggcgcaagtgacacttaacaacatgtcccctggcgatgaggctcgcaagacatggcaaacagagatggcggcttggcgggagaccctctaagtaaaaaaatcctcacttcggacgtgactcggagtgaggattttttattgaagccatttatttttatacaacctaatcaaaaattagaagaattgccgcataatatccttcaatggcggcatggacggaatcttccaataattctcaagatattcggaaccgtacttcatgtaaccctttgcttcatcaccaacgattttgcctggaagcggtgcatcgtcttggacgtaggtattgatcagaaccggtttatcggtctctttgtatgccttggctaatgcatttttgaattcgtcattgctgcgagcggtgtagccaatgccgcctgctgcttcagcaattttggcatagtccatatcagccaaatcaatttcatagttcagctgaccggcactttgctgctcatattcaataaatgccaacttctgattattcatgacaaccatgatgatcggcaacttgtacttgactgctgtgacaaagtcttgcatgaccatcgcgaaggcaccatcccctgcgacactgatagtttgccgctttggaaaagcctcagcacccgcaatcgcgcctggcaagccacagcccatggttcccaaccatgcggaaattgtatacttttgcgttggctgaacgtttaagaaacgggcaccccatgatgtggatgtaccgacatcaatcgagtaaatcgcatcttttggcgcggtttgatcaatcgtcgcgaagactgcttcaggcgatgccggattagtagccagcaagcgcttttcgctcatccacttattccagctctccatattcttctggcaagctttcagaaaacgatcatcatcacgcaaggagcccttcgcattcagttcggtgaaaaaggtgccaacgtcgccgtcaacagcaacatcaactgaatagcgtttgcccaagttttctgggcgcgtgtcgatttgaacgcacttagcttgaccttcggctggcaaataaggcgtatatggataattcgtcccgatcatgaagaggagatcagtcgctttcatcgcctcatatgccggcttcgtacctagtttaccgacattgcccaaactattgggatgatcatcggcgatagtgccttttgctggcatcgtttgaataaacggtatgtgatttgcctcgacaaacttttgaaccaacgcacctgcatgctcagcaccgcgaccgatcaacgcaagtggtttttgtgcctgttgcagcatcgaagcaacgtcctctaactgtttaggatcaactttcggcacattcaaggcaaaagcagcagcgctgtcctgataactagcagtttctttttgagctggcaaatcatctggaatggttaaaactgccacacctttttctgtaaaggctgtgcgaatcgccgtatcgacaatttgtcctaagttatccgatgccatgacagttttgttataaaccgccacatcgtcaaaaagcttcggtgtattcacttcttggaaaaagccttcattcatgttgctcgtcgtcacctgaccgagcagggccagaaccgggacatgatccattttggcatcatacaaaccatttaatagatgaatggcgcaagggccgccaatggagagacaaacacccaaaccgcctgttaacttagcagttgccgctgcggacaaagcggcgacttcctcatgccgcacctgcacaaacttgatcttatcctgatgtcgacgtaaggcatcaactgtggtatcgattgaatcaccaggcaatccaaaaacgtgtttaacttgccaatccatcaaaacgctgactaactgatctgctgcttttgttgccatatcaaaatctcctttatcgcatttcgtcatgcaaacaactcaattgttatcaatttattgacaactccaccttagttctttcaacggcatggtcaactgctcttagtgtgatctcatttatcaaagagatcagactttgtgaattcagattttttcaaaccatacaacaactaacccaatttaagaaatacccacttattgcgatttgcttttctattagttagcattttaaattgtgaaacgtgccacttataaacaaatttccgtcttctttttatgagagtaatctcatttaatcttgactaaatatccgattgcggtcacacaactaccagtttcaaacaaatttcaatttgatggtcattttttattttgtcggcaaaaagtgagcaaatcagtagcattttccctgattacggggtacattcaaagtgactttgcgtacacacagacatatgtatgacgggtgttataaaaagccgtcacgccggtcgagtagctctcatcattttctcgcccttttctcccgcaacatatgataaaatacaacggttgtgaattgtttatttcctaggaggatatctacatgccattagttaacgctgcagagcttgtaaaagctgcacataaaggtcactactgtatcggtgccttcaacaccaataacttggaatggacacgcgccatccttgccggtgcgcaagaattgaacgttccggttatcatccagacatccatgggtgctgctaagtacatgggcggctatgaattctgccagaccatgatcgaagcaacggttaaagccatgggcatcaccgttcctgttgtgattcatttggatcacggtaactacgaagctgccaaggaagctattgctgccggctacaactccgttatgttcgacggccacgacctcgactttgaagataacttggaaaaaaccaaggaaatcgttaagttggctcacgccaagggcatttctgttgaagccgaagttggttctatcggcggtgaagaagacggtgttgtcggcgaaggcgaattagctgacgttgaagaagccaagacattagccgctaccgggatcgacttcctagctgctggtatcggcaacatccacggtcaatatccagacaactggaagggcctgcacttcgatcgtctgcaagaattgaacgatgctgttaagatgccgctcgttcttcacggcggttctggtatccctcaagaacaagttcaaaaggcaatcaccatgggtatttccaagttgaacatcaacaccgaatgccagcttgcctttgctaaggcaacgcgtgaatacatcgaagctggtaaggatcagcaaggcaagggcttcgaccctcgtaagctgctcaagccaggcaccgatgctatcaccgataccttcaaagaaatcaccggctggattggcaacaaaccagttaagatggttccagaagcactttaattttttcattaagtgccattcaaaagcccactcgcaaatttcagcgagtgggctttttcatacatatttcgttactcatcaagtatttgattaacaaaacagtcggcttcatgatcattgaccaaccctgcagcctgcataaatgagtagataacgacgggaccagtaaatgcaaagccatctgccttcatttgcttgctcatgtgcttggccaagtcggttgtgttaggcacctgatcatgactggtaatatgatgccgaatcggctgattgttgacaaaggcccacacgtaatgatcaaagtcctcgcctttggcagctaactgtgcgatcacgcgcgcattgttaatgatcgccgtcactttcagccgattccgaataatttgcgtattttctaagagcacaggaatcttcggtgccatctgctgcacctgccgatagtcaaagttagcaaaagcctgtttgaaagcagcgcgtttattcaaaacggtctgccagctcaaacctgcttgcatgatttcaagcgacaaaagctcaaataagtggcgactgtcatggctcggccgcccccattcttcatcatgatactcgcgcatcaagtcattactggtttgtccccatgcgcaacggtgtttttcagccagcatatcgtacctccagcggttgtatcttaatcggctgggtcacttgtacgcatcgattctgcgtcaaagcaagttgatgctcagcgacaagtttagccatgacatcattgcctagcttgccagccaaatgaacccggcgttccgaaaaatcaatgcaagtctgaatgtttagctgatgcactggacgcccgaggaattgcgcaaatgcgtggcggcctttttcagtaagctgatacacatttggtgccgtcagcacaaccatctttttggctaacagctggtcaaataaggcaacaccagctttcccagccaaatggtggtagcaagttcgcgctactccaagcgcatgggctgcctgtcgttgatctaagtaatcatctgcaactgcacttaatttgctggtcgcctgttgcggctgagtggtctgaaaataatcgcgccctgcaaagtgacgtcggttcattttctgtaatcctactaagtgtaataaagtttcctcaaccggcttctctggcatcttcaataacttagctatttccttaagtgtcaaaaaccggccactgtctaacaagtctaagatcttctgagataaattttcttgcatgctggtaccttcttcccaaatagcaaacatacgttcttatctcgagtatacctttctcattcttcaagaacaatagtgtcttcgttgtaaatggcttggatgctgtggggcggccacataactgaattagcaaaaaaatttagtcttccagtactagcttcattgagccgtactgtatgtgtttaacgactcgtctgcaattgcttaaaatatccctgctgggcatataacaacatcgccaagcttgcgccaatcgctgtaaaaacggcaatccccgagaagccagtaaactgtttaatcaagataccgccgatgacaccaccgatggcctcacctaagtacatgacggcattggccaacgcggaaatcgtgctgcgggctgatcccgcgtgttcttgcaaggtactcataaacaatggcagcagtgcgccaccgattgtatagataaacgccagaatgaccgttgccgtcagtggcgaattggtgaaaggcaaaaccagatacccagcaatgaaaagtaagaactcaagcagaaacgcatgcggctgacccaaccaagtgactaatcggttgcccagcaaactgccaacaaactgaccaacgccgattaaaagaatgaagctgccaatggcaccaactgataaatggaggcttttcgcaaaccaagtgccgataaaggcgaaaccgcaaaaatttgcagtttgaaacaataagtatgcccctagcagtttaagcacggttttgttctgaaaaagtttgcgatagataccagttgcaagacgtgaagttatcgcctcgttaagactgggcatgaaacgcacgaccaacatcgtcaacatcaaggcgataacgccaacgaagaagaacggaaatcgccatgaccataccgctaagtaactccccaatggtaccccaacgatttgagcaaccgccagaccggctgtggcataacccatcactttgacaacttgcgtctttggaaacaataccgggatagccgcccagatttgcggtccggccgtggccgccgcgacaccagcgacgaatctggtgacaagcatcatcgcaaacgtattcgccagcccgcacccggcagtcgccaacgtgaaaaccattaacccgatgatcaaaatacgtttgccgtcgtgccggtcagaaatcggaccaatcaataatgccgatatcatgtagcccactgcataagcgctgacaataaaaccagatagactagtcgaaatgccatagtattgcgtcaatgtcggtaacaacggtgaaaccaaaaaggtatcggtgccaatcacaaacatcactaagaagaatagaaacgaaagtctacgttctttcatcagaaagtctccaatcagttttacggttttaaaattatcaaacaatcagcgctaaaaaataagcaaccatgtgcttatttatagcttctcaagtaaacccgggaaaaccgattcaattttccctgtactcagcgtaacaaatttttgtcgtccttgggtacgcgtggtaatcatgccaatttcccgaagcgttcgcaaatgatatgacatcgttgatttgtcaatctccacgtgctggttcagctcgttgcagcccatctcatgaccgacgtggtaaagcatgcggacaatcgtatagcgaccaggttcagacaaagcaaagaaaattcgttgtttgaaggcaatttcgtctgttgattgtttgatatccatacaacagttatgccacaaacttaatctgtaagcaaactttctttgaaaaaataagcttttcaattctccatagacggttcatgttttgggtaaataagtttttaacccacattcatgggtaaaggccccttttacctgctagtctcgaataatcatggcaaaaatgtgaaatctcgtgtccacttggtatactattcctgtgttcaaaatttcactcaaaggaggtgtcaccatggctcgtacaactgatcggcaaagaaatacacgctcaccgcggcaggctcgccgacaattgaataaattgttgcgtgaccccatcgtaaaaccccacaatgccgccgcagttcgcattcgcttagatgagatgatggcgattctccaacatcgcaagtaccgtccagagcagccaagttcaaccaatcaagtcaatacacatgggcaggttcagtttgacctcgcgcgctggtatcctgaaggcggtcgcctacgctataccttacgaccgcgtggcgccttactcccaatcgcattcactgttcaagactttggtaatcatcgcaaaagtctgacgcgcggcctcgctctagctgtcgctggggcggctcaccagttagatcaaatgaaagccgccaacaaattgccgttgatcatgcaaccttttagcgactgggtgcacctccttgcaattggcttacaaaattggcttgaaaatggtcaggtcgttttctctttagccgatcttaacggcgcctatgttttgaccagcatgccaactgctcctgcgacttggctggccagactcttcggcatttcgttaggcaatccagaccagtctttagctgatctgcgtcgtcaacggcaagagcaggccgaccgtttgacaacgcgacttgcggccaagtttgccattgaagaagcgccgttggtccaagcagctaatgatcgcgctgctaagtcaattcaacttgatgcagccaccatggccatgttagcttcagatcaagccccactgcggtcgcaaaaggatgttgttgatcggctggctcgtggtgattacattgtcatcgatactgagttcgtcgccgatcgcaaccaacttgatctgacagaaatcagtttactccgggtacgccatcaccaagttgatggggccttcgatatttttacccaattacctgaggaccaccacgtcatgccattttcagttaaaatcacaggcatcaccgatgatctgttgtcccaatatggtcagccgctgccacttgccaaagctgccgttgaacaattgttgaagcatgaactcgttgtgggttttgccttaagtaacgacctgcgtgcgctacgagcgggactgaatgtcgatatcatcccagtgcaagccttcgatgtggctgctttggcacgtaaaacattcggcatcggcaaaaagcacaccccgtcgttgcaacattacaaagaggcgcttggggttgatttgccttcccacaccgccttgagcgatgcgcaaaccacaatggcgttgctggaacatctcatctgggaaggcagcccactcatcactaaagacattggctttgaacaacggccacctgagcacgccaatgacccggaaccttatcagaaacctgatccaagtaatgacgtttcgcatccacgcaccaaaacttgaattaccgcaatgacctatatgaggaggcgtcaccatgcaagatgaacgctggaaccacccgctgtatacagcgacggctattaatgacgaagggctggaaggccacgcttatattcccggtggacttaaagtgcaaaccagcagtccgatgaatgatcatcccggaaccaacccagagcaacttttggggctatcattaagcacatgtctagaagccacgctggaagcggttgaaaaggagcacggtttgccgcatacaggagccgtgcgggtgaaggtcgctttcatcggcgcccgcgctgaatatcaatttttggtgcacgcccaggtcatggtcaaaggcgttgatttcgatactgctaaggctttcaccaacgaaatcgaaaatcgctgtcccgtttcgaagttgcttaaaaatagtggcaattatacgatcgaaacagtgactgattttaaagactaaactgcccgaggccaatgatcgaagcctgattcctttagatgtgtcttctgccaggcgcgtacgcaacaaagtcagatttgttgtgtctttttgcgtaagcgattgcaaagactttagacttactttatgattaacataagttgatcaaccatgcacccttaaaagtttttcccacccgcttgccgactgctatcagcaaaacgggttttcttatgcgtccttctgcagcaaagcattgccatctatttgattttgctggatacccacccacctcagcatgacatgcaccatcaccgtttttaaggcaatctgaacatcaatatctgctagaaaatcactgtattttagcattgttagggttacactgataactagaagggagttgcaaatatgaagaaaatcatcaatgcaccgggcgatattgtcccggaaatgattgctggactcgctgccagctatccgcaatatttgaaacagattcctgatacaacggcggtcgtcagaaatgatgccgcgttcaaacaacataagaaggtcggcgtcatctctggcggcggttccggtcatgaaccgctgcatgccggctatgtcggtcaaggcatgcttgatgctgcggtggcgggccaagtcttcacatccccgaccccggatcaaatttacgctgctattaaagaagttgaccaaggtgcgggcgttttgatgatcgtcaagaactattcaggcgatgtgatgaacttcgacatggccaaagaccttgccagtgttgacgatatcaccgtcgaatccgtagtcgttgatgacgatgttgctgtcaaagattcactgtacacgcaaggacggcgcggtgtcgctggtactatttttgccgaaaaaattatcggtgcggctgctgaagctggtttaagtctagatgacctgaagaagttaggcgatgccgtcgttaagaacaccaagtcctttgccgtagcattgcacgctgcaacggttcctgaagtcggcaaacccgggtttgatttaaaacctgatgaaattaaattcggtgttggcattcataacgaacctggcaccggtcaggaaaaactgccgacctctaaacaattggctaagcaactgattagcaagttgacggcggagttcaaagatccacaagcccacaagtatgccgtcttggttaacggtatgggtgctaccccgttgtctgaacaatacattttcatgggcgatgtgctgaatgaactgaagactgaaaagttacctgtcagcttcaccaaagctggcaactatgtcacatcactcgacatggctggcatctcattgaccatgttggctttagacgatccgcaatggctgacctacctgaatgcgtcagcccacactgttggttggggggataccgatgttaaacgctgatacattaaccaaatggatgacgaattttgaaacccgcattaccaaggaaaaagaccatctcaccgaacttgatcgcgtgattggcgattctgaccacggcaacaacatggagcgcggcgtcgaagcgatcaaagcagccttcgaaaaaaccccaccgactaccgatctggctcaagacttcaagacaattgcaatggccatgctgagcaaagtcggcggtgccagcggtcctttatatggtacagcctttctcgaaatggctaagcttgccaaaaccgacaccgattttggcgacctcgtcgatgctgccgcaaagggtattgctaagcgcggccaagcaaaaaccggtgataagacaatgcttgatgtctgggcaccagcagctgatttgatcaaacaaggcaagctcgatgacgccgccattgacaaattggttgcttccaccgagccaatgatcgctaaacgcggccgggcgtcttatcttggtgaaaagagtgtcggccacattgatcccggcgccgcttcaactggcgaattgttgaaagcctatttagatgcgaccgcttgatcgacaaccgacaaactatgaaggcaaacacttgtaaaggagtgatcctatggcactaggcattttacttgtttcacacgttccggcgatcgccaatggtgttgaaactttaatcaaacaagtcgctaaagatgttcctatcaccacagctggcggtactagcgacggcaaaatcggcacggatctcgaccatattcaaaaagcaattggcgataatccagcttctgaactgcttgttttctacgacctcggcagtgcgaaaatgaatttggacattgccgaagaagtcagtgataaacagatgcatgtttatgatgtcgcgtttgttgaaggggcttatgcagccgcagcattgctagaagccaatgtcaccctcgacaaaatcgaagcgcaattgaaaccactaaaagtaaagtaagtcatcgccgcttgtcggcttgaacaactgacaagcggtttttcatgccaaaaatgttgaccatggctacaggagagattgcatatgtccacatctgatcaaactaaggcgcatcttgccaaggttctcaaagtacaaatgcagcacaaaccattagatcgcatcacgattgccgagttaagcgcagctgcacatgtcaaccgcaacacgttttattaccattttgatgacatctatgccttactgaaatggaccttagaggctgacattggccgtaaagtgatgcaggacttaggcgcagccacatgggaaacaaagtatcagctggtgcttgactatatcatggctaatcaggtcttttgtctgaatgcgtttcattcagttggccgtgacatgctggaagaattcttatttcagtcagccaccgacatggtgaaaccagtcgttttggacattgacccagcaacaccagcccaaaccgttaccgatatctgcaacttttatggtgcagccatcgtcgggcaagtgctgctgtggttagcgcagtccttgaaagaaccggaacgcaatctgatcaagcgggctgatttgatgttaaacgggtcgattgctttcattgtccgcaagcggtcacttggcccacaataaaagttaattttcgaacaaacatcacaatttgactaaagacgcttcttttacttgtgcctataatataggtgacatcagaaaggaagcgtttttagatgaaaaaattcttattgacagcgctaggcgttgcgctggttgctggcggcaccgcatgctacttcgcaaacaaaatggagctgtttaaagatgacgctgacgcatacaagaagttcgaaagtcgctaggaggcgggaaaatgatcaagcataaggcgatcatgatcggtgcagggctggccaatatggctgcagctgtttatctcattcaggaagctcattggcaaggtgatcaaatcaccttctattcactggatgaccatggttcaaatgatggtgccccaacagtcgatactgtggatgaatattggaacaaaaatcatcccatggaaaacacgaagggctatgttgctcggggcggtcggatgttgaattaccggacgtatgtcgatttgatggatttgcttagtcggattccatcggcaacggaaccgggactcacagctgaagaagacacgcgccaattcgatgcccaacatcggacgtttgataaagctcggttgatggaaggcggtattggcatcatccaagcaggacacttgggcctgaataacacggatcgccttttgctgacgaagttaatcatgatgcctgattccgaagaagaaaagctcgacaatgttagcatcgccgactacttcaaggatgatccgcacatgttccaaaccaatttctggtatatgtgggaaaccacctttgccttccgcacacaaagttctgcgcaggaattgcggcggtacatgcacatgatgatttatgaatttactcaaattgagcatttagtcggggttaaccggacccgctataatcaatttgaaagcattatgctgccactgattaattacctgaaggagcaaggctgcaagatcattttgaaccggcgtgtcactgcgtttgaatttaaagacacggccatgaccgatgaaatcaccgtcaccggcctgaccattctgaacacagagactgatgacgaagaacatgttgcggttgatgatgataccgccgtcttcttcacgaacggatcgatcaccgactccgcaactcaaggtgactttgatcatgcagcagtcgaaaacatggactacggtgctgccgcgagtctgtggaaacaagcgactgagcatttttataaccttggtaatcctgataagttctttgcggatcggtcagccagcgagtgggtcagcttcaccttgacgaccaaagaccatttgttgcttaacgaaatcgaacgtattacaacgcaagtccctggtaacgccctgaattcgttcatgtcaacccaaccaatcacggcacttgggcaaaaagatgttatgatgtcaatcgtggtacatcatcagccgcactttaccacccagaaaccaaacgagaccgtcttgtggggctacttcctttatccacggcgctacggtgaatttgtcaacaagccgtatatcgaaatgacgggtaaagagatggcccttgaattgattggtcagcttgctaaagttgatcccggtcctggtaatattcgtgatcatcaagataagattatggcaagcatcatcaacaacatccctgtttatatgccatatgcttcggcactcttcaacaatcgcgccaaggttgatcggccagacgtgattccagcacattcaacaaaccttgcctttaccggtgaattcgctgaacaaccattccaaatggtcttcactgagcaaagtgctgttcgttcaggtgagattgccgcttatcatttcaccggcattccaatgagtcatttagttaaaacaccgcggtatgataaagacatcaagacattgatgcgtgccacgaaaaaaatgtttgaataataacgttcaatatcaaaagcgttgtccgtgcacgggcaacgcttttcctttttgtgcactaaaaataatgctaacagctatcagctcaagcttgttactgttaaactgttcttagtgaatacaaccaattttaatggaggccgatcatggactacgaattaaaactgcgacgccatgccagtcgcgaaatcgataaatactgggaaaatttccagaaaagcacaagttatcaacacctgctgacagttcccggctttagccaagtgccaccagatgaaattcgattaatcctcgtcacctttttcgtgcatgcctttgataaccttcgttcaaccattcaagcgcttgatactgaacacgttgcagctggtttgcaggagaccttacagacttatcatgatgatgcattggatcgcagcgagtcgttagcgatcgcggcggaactgttaaaaacatttatgctctggttgattgcaacaaatgagattaaattgactatccttgaatttgttgatgccttgatgaacgtgttcgtcactgccacctatctgctcggcttgacggaagaggaggccctcacatcaccattcggcaatgatgattttgatcttcccggtgttgatgatgccttcagtgaccccgataatgacgttgactttgattccgaaaatatggctgaattatttcaattgacgatgacctttttagaatccaaaacgtggctgcaggttcctaagccagttcagaatcaggaactatttggtgccaccacgttgttccttgcccacacgattcagagtttgttcggccacgatccaaagaattggaccgctcaggacattaaggctgccatgtccatgctactatatgacaaaaaaaccattggtcctgatcagcgcgcagtcattggacaaatggtcgctattttcattcgatctacaacaacctcccacctctggacaccaacccagcgacaggcacttgctacagctgccgaaagtcgcgttcaagaacttgttgccgccaaaccagcaccccaacaacctactagtaacccaacagaaacgacaacgaataatcgagttgttccgatcgctgggtggcaaaagcacaaacacgacaaataacgataccaagtcaccactccggctcgttagatgacaaatcaaaaagacaacactgaaccccaaaaccaatgattggtctctcgttcagtgttgccttttttcatatcaatgatgtcagtctacagttgattgaactgttcagttttagccaaatcttcataagtgacgtcagtaatagtcggatcaagtgttttcgttgtcattgtcaatgtgtctgaatcttgcacgaaaatcgtctttttcgtcaggtcatagccagaccagtattgcgtgtaatccgttaaaacctgatgttgtgggtcgcgacctagcccctgcggaatcaagacagtcttgaaagcattgtataacacgcgaatgccgtctttgctgttgaagggatcaagattacgcgaaacaaacattgcccgcaggaaccgcgatggtgatgtgtaatcgcctggcaaaccgaacatcccgtagcctgtgcctaactcaatcggctcaatatggtagtcgcctaactcggaccccttaggatagttattgtcattcagactgacataattgcgcaaattggtttcatgccacccgtattcaggactattcgtcatggcgccgatactatcatacagcttaaaggcgccgtgatcggttggttcgacaacaatccctttacctgatggatcaacaaatgtgtaatgtaatgggattttcaccccttggccgccaaactcataaggttcatccagcaggccatactcacccgccaaagcgcgtacttcgtcaacatttttgcatgtcgtcaaggccaaggtcacaaactcctcgcctttaatagcttttagcccacgctgtttcaaagaatccgcactcgcccagctgcactctaccaaaacctgcaagtcgccagccaagccttcgctattgacgccgtcgaaaagtgccgtactttgatcaataccgacgccaaccgctgcatactttgtggtccatttggcactttgtgttggtaatgccttatttgctggcaaactgacaattttaccaggaaccccgccgactggtgattcatgaaagaaactggtgttgtaatccatggtccggccccagaaaatatcaccttgtagcgatttaattgtcattgaagaacacatagcaacgacccctttcgaaaataaatgtcagtgtttaaagcttaatttttacgattactgtcattataacccgaattgcttaatggctcgatccccttcaacaaaaaggctgctctacagccccataagtactggtttcacagtgatctcgttattattatttttgttgtagataactgatcggcttattcacatcaagtttcgtgccagaaaaagtctttttaatccaactctgaatcgttgggtcatggtaaagcggcactaactttttaaattcttccttttttccatttttcactgcggtcactaatatattgacgttggcgcgtgtcgtttggctcaacttctcatgcaccaatgaatctttcaaaacattcagcccaccatcaagtgcccgcgtattcgaaatcagttctgcgtccaaatcgggcagcatttgcaccgatgggtcgacctctttaaactttaagtgcttcggattggcttgaatgtccttcacggtacttaaagcattgaagtcagacttaagggtgacaagcttggtcgttgctagcaaaagtaaccctcgtgtcgcattagcaggatcgtttgagatgccaatcgttgcaccatctggaatctctcgcagctgtttatattttttagaatacagtcccattggttccaggtaggttgtgcctaatgctgctaatttttcgctcggatttaatttgttatattgctgaaagtaagcatatgactggaatgcattaacatccaattgtccctcggcagtagctgagttggtgacgttgccatctgaaacttgcttgactttgatcctcagaccagccttcttggcctgcggtgatttagcaatatgttgccaaatttgataatccgagccactactgccgatgatgattgactcactttttgaactagtatgactgctattgctactagttgctttgccacacgctgttagtgttaataatgaaaccaatgcaatccctgtgaagatagcttttttccaacgactcataagagatcctcctccaaacatttccaccagcaaactatcaagactatctcgttaaacaactttgatttattttagataaccttgcgctgccacaaaaaaacgccccttaactacttttgttgtagtcaaggggcgacagtgtcgcgttaccacccttattcacgatgttgatacatcgtctccagtacctgttgatacctgacagcataacggccgtaaccgactcgtgagcgttaaccgcacgaataactattcgaagctcatcttcaccttctagcagatgacccttttccatcaaccgggctttctacagcgtctgcgccaaggttactcttcttctcaaagtgttgtttttataaatgtcattcagctcgctttgaaagttgtgctgagtaacacctaaagtcttgttggaaggactatacggcccgcgcttgtgaatgtcaagacaaaggtttgaaaagatatgttgattgttgatttgcatcttgcactcaaatcaactcaatgtacgagaaacccgcctcgatctaatcaccgaggctttacctcagcgggaataggcgattcaaacaacttattcccaaaatgtgctgcaaaatcttcttttgcgtcttcgaccaattgcggattcgctaaggcatcgtaggcggtcaatgcaaaaaccttgccgcctaacaatagtcccttatgagcaacacttgaaatgccatttgaaacccattgccagctgtgtggagaggtgccttgaggttcaaagccattcgtaaattgagcggtcggcacgacttggctgacatccccgacatcagtggaaccagcagtttcatcactaaattcaagcggcaacttgtgcaaagcaatgccagaatcagcttctgctttgatctgctcttcagtccaatcaggaaatgaatgcttagcccgatgatataaattttgcttgctggcatcagaaacagtctcagagagtttcttttcaaaggctaattcttccttagtcagcttcaaaggtcctacgatatcaagatttctatcaattgcgcgggttaaaggtttgttagcgataaaatcggagcatcccgcatcaaactctttggtcaatttcgtttcggtcatcaacgcagccccttccgcaattttgtcaactcgagcaaagatcgccttagcttggtcgacatgtggcgcgcgaataaaataatataacttggcacttggttggaccacgttggctgattctccaccagcatcaataaacgcgtaatgaattctggctgaatcaatgatatgttcgcgcagaaattgaaccccaatattcattaactccgcagcatctaaagcactgcgccccatctctggtgctgcggcggcatgtgctggaatgccagtgaattggtagtaacattgcagaacggccaaactactactgccccacccggacatagaatccattggatgatttgctaaagcaatgtctaggtcgctgaaaataccatctctagccataaaagcttttccgtaaccactttcctcggcaggacacccgaacagtttaatcgtccctgaaagttgttcttcttccatcaaagttttgatggcgactgcaccagcaagtgcggccgtacccaacacgttgtgaccacatccatgaccattatcgcctgcaacaattggttgatgttcagtcgctcctgctacctgactcaaattccccaacgcatcatattcagcaagcataccaataacaggcttccctttaccccaagtcgcctcaaatgaatagtccatatcagcaatgccttttttgatctcaaaaccttctttttctaaaacgtcatagtatggctgaaccgacttttcaacagcaaaccgggtttccggagtatgccaaatctgatctgaagccttaataaactcattttgcttgtcctcaacaatctgcattaagcgttcttttgcatccattttcatttcctcctctttgttttaagcctttgtcttaacagcaataacagtcataccgcacagtaagctcatcacggccatgaacagaaatgccggaacgaacgaaccaccagcggcctgaaccagaaaaccaatgaccataggcgctaaaaagccgccaagtgtgcccccagtgttaataatgccaattgaagagccaatgatattggcatccataattttatgtggccaagtaaaaattgctgtaaaagccgtcacactaatcatgctgatgagcagtaacaagacgaccgagatatacaggttactcgacaatacaaacccaaccagcagtgcagcaaccatcagtgtggcgatcagaataacccgcttttctttatgcaagaacaacttagagagcagttgcccagcaaaaattgtggcaatcgtttgaaagacagcgttaatggctaatatcatgccggcttgactgatacttagattaaaggtagacgtgatataagatgggagccaagacatgttgccgtaaagcaaaacatttaacagaagcatcgccagaaacagaacgaacacatttcggttcttaagcatagccagaaaactcgttttttcagtttgatcgctcgccttacgattgccgtcttgaccttttggaacaaatcgccaaacaaacaaaagtgctaccaagaaaagtgttcccattgcgatataagcatagtgccagttcatatccactagttgggctcccaaagtgaacgctagaatgcctccaatgccagacgttgaaagaatcaatgattgaacaaaagtacgccgctcttttggaaagttttccgcaatggctttagaacagcttggcggataaccaccatgccctaccccggcacaaaagcgaacaacgatgaagaaaagtaagccattggcaataccgaataagtatgaaaaacaggcaatgataaacagtgaggccattaaaacacgttttgacccgaagcgatcggctaaccaaccactcggaatctgcatcaatgaataaccaagaaaaaacaacgacatcattaggccagtttgacctgagctgaaatggaactgcgaagcaattgggataattgctgttgaaatcatgcttttgtccatgtaaaccatcgaataacctgccatcaatgacgtgatgagcattgtctctgatgatctggacgttttaccgataaccgttgccatgttgccacccaccttcagaaaattttgctgataaccatattgtaggtagttacttcatggctcatagggtattattcgtttttatatagcgctttcacaagccgattatccgcgctatcatgattagagctaatattgtcggacaaaattcaaagcgcacatgtgaagttataaaaaagcatccctacacttctgcagagatgctgcttgtgttattgtgatccttaatcattcagcggtcttatccgatagacacgcatgctattaaaagactgggtagccgacaagaccaacttgccatctgttgttgcgatatcctcgatcttaagtctcggctgtgtcatggtcgctaaatacttaatatattggggagaatagtttatcactgcgccaaccttaagccactgattatagataccaccgcaatccttatctaacaattcactgacaattcgataacgttgccctctaagtccaacaagctgtagttgtaattcctgcgactgatattgcatgagactatcactaatcgacatacgcggatcgatataggtaggattggaaaataaaactgtataatcttcaccgttgcggtaacaactgaaccatggcgaactcaagatgcgttcaccaatcaaggcgtccagaaaccgcacgacaaagtaaactggtcgccgaatggtgccatacaaaaacaaggacaaacactcatccgttgtatctggtataatgctgattcgacttgtgatactgagccaaaagctgacattatcaaatccattattctgtcgcagtatctctttgattaaagctgagcgaaagaaggttccaaccgtaaccgcatcgttaccagccaaagtgttccaatcatccagtgctatttcaggcgcgtattgccgatccggtgccagccgctcttggatactatcaagacgcgacttaagttcggacaagtcttcttttatttcagttcgaaggaacagataatcacatgataaatagacaaaccggttgccaaggttcattttcttgtctttttcggtatgatggaagttcttttccgtgacgtgaacaccgatgcgttgccaattgttgctttgaaggaaatacgatatcacagtttggctatcttcgttgtcgctgacaaggcagtcatactcaaattcaataatccatcggcggacaacacttttaccaaacatttgcgcaatggcctcaaatcgggctattaaatcttcaggcgaacagtgcaacaccatttctactgataaacgaataattggctgggcccctactgcgagtatcgcgtaaaaagcactcattaaattcttctcactcgtcacaaccgtgctaaaaattggatcagttctaactttgctaacgccaaatactctgatgtaggcaatcggcatttcttcagtcaattgattcaattgtgtgacacattcttggttattcaagttcaacacgtcgccaacattgacggtatatgtggcggtcttgtgggtaagtacttgggccgtttggacatctaatcttttttgttgagaggtcacgggctgtatagatgcaagatcctcttctgccagctgtcctgctaaccggaccaaggcctcctctcgagacaacgtgatgacctgtcgagtactgtcaatggacggcaggtttgctgcgagcgtatgtcgaaacttttgcggagacatcccatatcggtcttgaaaatttcgggccatcgttcgaggttggagaaaaccgttgtcgataccgatttgggtaatgcttttatctgtatactttaaatctagctcaacatgccgtaatcgaatagcgttgagataacgattaaagttgagatgcgtctgttccttaaattttttagacagataattgtaagagacatgcatttcatcagctactaacctcaagctaatatcctcggcatactcggtttctaatttggtgatcactgtattcacgagctgatcatggtcaaagattgacttgctttcttcgtgccaaagatagtgagcacgcaaatgacccattaatgccaatccggtagcggcaactgtagcctcgtccacatcctcagaaagactggtgatcatcatgcgatgcagtagccgccgacacgctgcaaggttattgctagtttgattgggcgatgacattggaagattccaaaaacgttgtttactagtatcaggtaagatagtcgttaaatgggtcgcattaatggtaacagcgagtatcaaagctggcactgttgcgctaatagaaaatcgttcgttagggtttaaaataatgaaattgtcttttaccaacttataatcggtttgaaagatcgccaccttgatctgaccttccaagaccatcaatagacgccagtcatgggtgacattttcttccttcacaatttcctgaatatcgacatgcaccattcggttcatggtcagcctccttccgataaatcgctttcattttcccattgaattcgacgcatgtctatcttctgttcgttcatcaaggtggttctcttttattgatttttcaacaatttcccaattttgcgctttcaaacatctatgcagtgttaggcatcatcgtccttaaaaataaggtaacactagcttgctatcgacgctttacatccccgatattggttaacgtaacaataccttttccaatgaagtaaaccagtcagcccacagacgactggctactgtgaatcaagaaatacgaatattcgcatgttataatctacaaatacaaatttgaaaatcactggaggagcacaatgcgaaacataggaaaattagttgcactggactggaagcgaattgttaaaagcccattcgctttcttactcattttggcgctggttgtgatccccagtctctactgttggttcaatgtctgggcgctatgggatccttacagcaatacccaagatcttactgttgccgtgtattcagcggataaatcaaccgaattccgtgataaaaaaattgccattggcgatgagctggtcacccaactaaagcataacaagcaactcggctggcgttttgtggactccaaaaaggcggttcaggaaggggtcaaaagcggcaaatattacgcaggtgtcgttgttcccaaagatttttcaacggacttgcttagttttgtcgatggtaagattcacaaaccaaagctagattattatgtgaatgaaaaaatcaatgccatcgcccctaaaattactgcaagcggggcgtccacgctgcaaaacaccatttcagacgaatttgtgtcaaccgttgccaaaaccttggtgaccgtcttcaatcaggcaggcattaagctggatgacaatctgccgatgattcggcgctttgcaagtctggtaaccaatacaaacgatcaattaccgacaattgaaaaatacatcgcggaagtcggggttttgcagagtaaaatgccggccatccgagaaaaactggcggccgccaacgaaatggccacctacttgcctgaagtcaatcaaatggcccaaaaattaacggcagccaacggttatttaccgatggtggccgatgccggtcagttggcggtcgatgttcgcagcaagttgcctgaagtgcaacaagccggtgcgcagcttaatacagtgaccaccaactttggccaactagaatcagcggttacgaaggccgtgagggtcaccagtcagggcattaccgtcgtcaatcaagttgacggcactttgcctgctctgaccgactttggcaaaaacgcccaggcagcgattggcacgaccaaagatgaagtcttgccaaaagtcagcacagcacttgatgtggttcaaaatgcggtcgatgctggtctgacattgatagccgccgcgaatactagtttaagtgctgacttaactgccttgcaaaatcagttgcagcagttggacactagcagtgataccgccgctatcaaacaggcaatggtggcccgattaaccgctttagctgatcgccaaggcaaagtggcagccaatgccaccagtctggccgatacattaacccgcctgcaaaccagtcttaacaagttgaccggtaaggacgatcaaccgttggccggtgccattacgcgactgcgtgatgttgcgactaccgctactgctgttcagacggccgccagcgatctcgccaaagacgtgccaaatttaagtaccaatgagttacaaagtcgtttggcgacactcaatgatgtcgctcagaaatttgcaagtgatgccaatacgctcaaggatctggatctcggcacgagtgtgaagcaagtactgaacgctttcaaggctgcgcttgctgatgctgccacaacgctgactaaaatcaacgatcaagtattgccggaactgccgagtttactcagcggaacaaaggacttactgacacaagccaacacttttttggttaaaacccaaaaacagttaccagccttgaagcaggaactcactgatgccaatacgctgctgaacggtcatatgaacttgatcaccagtggtatcacgacagtcgctgacttatatcaaaatgacttcccaagtcttaaaacgaaattgaccaaggcaacaaattttatcaatcaagatctacccggtgtggaaagcgacctgacatcaacgctcgctttagccaacgaaaaaatgccgcaactacaaagcgggctggatgatgcacaaaccttaatcaaagatgactggccaacattgaaagatgccattcaaaaaggcgcaacggcaatcaaaaaaggcgagaaatccgttgatctgtcgcagttaatcaaactgctgagacgtgatgccacgaaagaagccggttttctggctaagccggtagagctcaagcaaacgagtttctatcatatcccaacctatggctcgcaaagtgccccgttttatttagccttatgtatttgggtcggtgccttgctgctcggcgccattctcattaccgaatatcagctgccggaatcgctggctcatgcgaccgtcaaacagatgtacaccgctcgctggttaacgtttgcaggactggggatgctacaaggcctcatcgccgcactcggtaatctcttcctaatcgggacgtacgttgtcgacaagccgctgtatttgctgtttgcgatgttgctaagcctagtcttcgtctcaattctatacatgttgatttccctgttcggcaatatcggtaagggcctgggaatcattattttagtcctatccatctccggcgcaggtggcaacttccccgttgtactctcaggtaagttcttccaagccattaacccatggctgccattcacctatgccgtcaacttgctgcgcgaaaccgttggcgggatctactggccaaatctgtggcaagatctcatcatcctcgtggcattcggcgtcgcgttcttccttctggggcttttcctaaaagaaccaattcgcccgtggatcgagaaaatgcaccatatcacgcggaagtctaagattattgaataacgtagaaagctgcgtcaattgagctttaacaatctgcttacaccttgtatttgggcaactgttgataatcttttatccatgattagggactgttttcaagccaccacgcctttatcaatcaagtgtaagaaaatctttttgcaaaacatggtgttgacagattgttacaaaggccttgtcatggtttaatatatatgtaacgaaaaagagccgctggcgggaaccagcgactccatgattcaacaatgctgcttaaccggtggcctatagtaaaattaagccgtcacgataagcctacccagctagctcgtgacggctttttggtatcaccgatcgttcagcttcagaaccaaggtaatcagttcgagaataaataacccgaacatgatcataaggctcaaagcttcgtagatcgacatcttgctcctcctttcaaagaattttgtgatctctacagttctaaaaccatagccaccacctccttcttaagaaagagccaccgtcgcgtagcattgtcgtttccagtctatcagttgctattagctcacgccatatataccgtttgttatatattaaaaagaggcatcgatagaaaacgtgctaatccgttgatttatctcagtagtgcatgatagaatttgagtgtaccaaaagcgttgctggtgggagcaatcgccatggtacaacaatgttgcttaacggtagctcaattgtcatagattaagccatcacgagccgcacgagcaacccagtttaaagataagccgccacggagctgtacaagctttccgtggcggcttatttatgtctatctacctacttcacctccaacttctctggaaacttcttcatcttcaaaaaacaccgaagcatcttttgtctacccgttcaacaagctgatcacatgcatctttttcaatccagccgtagaataagctcaataaccaaaacggaggcaactgacatgctgaaaattttgttcgaccatatgcacggctgggcacgggtaagtttttttctcgcgccgttagcgatcatgggcgaagcattgctgacctgcaacaaccgaccttgatggctagcatcgtggacgtgggattggctaagaaagatatgacttatgtttggcataccgctattctcatggcagtgattgctattgctgcattcgctttaggtgctatctgtaacgccttctcctcctatgcagccttgaaaatgggccaaaacctgcggactcatctgctggctatttcactggccgatcgcgatccccaagcactcaaacccgaaacactcatcacccgcatcacaaacgatgttacgcaaatgcagacgctggtaagcatgctgacgcgcggactcgttcgctcgcctatgctgctgttcggcggcattgtcatgtcgattatcgtatcaccacggctgtcatggatcattttgattgccttacccattcttgccatctatatctacgtcatcgttcgacgttcgctgccactttacacggctatgcaaggacaagttgacgtcatgaaccggattatgagtgaaaacttgactggcgccaaaacgatcaaggcgtacgtactggaagaccaccaactgactcaatttaacactgaaaatcgcaacctgcagacgattagtcaacgcgctgttttggcaacggtcactttggcgccactgatcatgctggtgctgaatctggcagtcgtcgctgcactggcttatggcggcaatctagccatcagccacaccatcaccactggcgaaatcatggcgttcgtcaattacatgattcaaattacgacggcgatgaccaataccgttaacctcatcacgaccttttcacgggcaattacttctagtgcacgcgtcaacgccgttttggccgaagaagcaggcactgaggccagtgggacattacctgccccagctggtagcaccatccagtttgagcacgtgaactttggtttttcgcaaagtcgaccgatccttgatgacatcaatctcaccgttccaagcggtcagtggctgggcattatcggctccactggttctggcaaaaccacgctgatcgccttattaacccggctttatgagcattatcaaggaaaaatcacggtcggtggcaccgatatccaacaaatcaccttaccggctttacacaaaaaaatcacggtcgccttacaggactcactgcttttttctggcactgtcgcgcataatctgagttatggcgcgccgcaagccacgccgacacaattagccaacggcgttgctatcgctggggcaactgagtttgtcgggactaattatgttgcccccgtcgaagaagctgggaaaaacttttctggcggtcaacggcaacgtctgaatcttgcccgcgccatcatccccgatcctgatattctggtcatggatgacgctaccagtgctgtggaccaggaaaccaacactgagattcaaaatgccttggttaaggcccgccgcaaccgtacaaccatcatcatttcgcaacgcgtcccgaacatcatggactgtgatcaaatcatcgtcatgcaaaacgggcaaattacggctcgcggaacgcatactgagttggtcaaaagttcgccattttacgcgcaactggttcaaacccaactgggaggtgactacattgattaatctcaacggcagacgcgggccacgtaatttgcaccccgaaaaagtcaccttagttgattggaaacaaactgtgcgaaggatttggggccatctcgatacagatcgccgcaagttgctgatcgtttttggcctcacattattcacaacgttggccaccattgttggcaaccgggtcaatgggatcgtggtcgaccagtttatcaccaaaggccgtctgcgcgaattgttcattgtcagcggtttgttggctgggatgtattttttgagcagtatcttcacgtattttcaaacaagtatcaccaccaaagtcgcacaacgcactagtgctgcgattcggcacgacctgtttgccaaaatgcagcgtttaccgatgcggtattttgatacgcatgataacggcgatatcatgagccgattgaccaacgatgtcgacaacatcaacaccgcactgatgcaaacttttgtacagctttataccggcattatcagtgttgtcggtatgggtattgccatgttactactcagcccgctactaacgggcattgtcgttctggcgtctgtcgcgactttcttttactcgcgaacggcagcacgcatcacccaaaaagccttcacgattcagcaacaagaattgggcagcttgaacacccaaattgaagaaaatgtttctggtaaacagttggtgcaacttttcgatcatcagcaagataccattgatcgcttcaatgaaaccaatgtccgctataccgctgcggcttatcgcgcgcaactcttctccggggtcatcggtcccttcaataacatgaccaataacttcgcctacttgctgatcacgtttgccggtgcagttgccattcttcgcggtggcaccagcatcacagtcggcgtcattttcaccttcctgatctatctgcgcaactttactgggccgatcaacaatattttgaaccttatcaacaccttgcaactttccttagcctcggccgaacgcgttttccaagtcgtcgatgctgagcctgaaaaagatgccccgaatgccgtcgagttagatcacacagcgggcaatgttaagttcgatcacgtctccttcgcctatgacggtaaaaccgaggtgctacacgatattagtttcactgctcatcaaggggaagtcgtcgccattgtcggtccgactggtgcagggaaaacaaccattatgaacctgctcaccgatctatacccactcaccagcggcagcattacccttgatgatcacgatgtcacccaaattacctttgctagtttgcggcggctcgtcacagttgttcagcaagaatctttcctttttaccgcaaccattcgcgaaaatattcgcatgggtcggccagacgccactgacgccgaagtcgaaactgccgccaaagccgcaaatgctgacggcttcattaaccaactgccagacggttacgacactatgcttagcgaaaacgctagccgcctctcgcaaggccagcggcagctcctcagcattgcccgcgccttcgcagcccaagcacccgttctcgttcttgatgaagcaaccgcctccatcgactccaacaccgaaactgatgtccagcatgccatgaaccgcctcatgcaacagcgcaccagcttcgtgatcgcgcaccgcctatccacgattcgcaatgcaagcaaaatcctcgttattgaccaaggcaaactcatcgaatctggtacccatgagcaactgctagcggctggtgggttctatgctaagttgtacaatagcccgttggcggatatggataagatgaaacgataaacaagcttgcgttctagaacttaatgctacttcaataaaacagcttaagtcaaaaacactccagtaacaaaatctattgatggaatttttctggcaaagacacgatataacacaaaaatgctcatcttctaagccaaactagaagatgagcatttttcgtgaattcgaactcactcgtattgctattgaagcttgtacaccactgcgccaaatggtggtaatgtcagtgttttctctagtgaatcggaaatttcactattccgaatcaacacatccacatccttagcttgcaagtcatccggcactgaccatgtgcgttcctcacttgagaagttacctgccaccagcaaggtctcatgttcccccttgcgcaggtaaataaacaagttcggatcatcaggagcaagtagctcaaatacaccagtggtaatcaatggctcttcatgtcgtaatttaatcaggtgttgataatagtggtaaacaccgtcactatctgccagatccttagccgcattaatctgcttgtgatctggattcagccccagccatggttgcccggtggtaaagccacctttttcactgccgtcccaaggcatcggcgtgcgagcattatcgcgcgaatgcagataaatggccttcatggccgcttcaggactttcatgatgttgttgcgtgagttctttaaaaatgttcttagtctcaagatcgttataatcgcttaattgattaaaatgaacatttttcaaaccgagttcttcgccttcaaaaatatagggggttccttgcaacatgtgcaacaccgtacccagcattttggctgatcgaattcgatactggccttcatctccaaatcgtgtcacaggccgcggctgatcgtggttgctccagtaaaggctgttccatccatcgacttgcgctaatgtgttctcccaacgtgccaagacttctttgagatcaactaatttaaatcgatttgtcgagaacttgccatattggccatagtcaagatgcatatggtcaaaatgaaaaaccatatccaactcgtgacgatctgccgccgtgtataattgcgcctgctgtgccgttgtatggggcgtctcgccaaccgtcatgatattgtagtgcgacaacacttgctcgtgcatttcctgcaggtaatcatgaacctttgggccatttgccgctccggcataataactaccgtatgccttgccttgaatgagcgggccatctggataagccggatctttagaaatcagtgatatgacatccatccggaagccatcaactcccttatctagccaaaagcgcatgagatcataaacttcttggcgtaccttaggattttcccagttgagatccggttgttgcttggcaaaaagatgcaggtaatactcgcccagatcttttttgtattcccaagctgaaccgccaaagcttgagccccaattattaggctcatgatcgtcaactggcttcttccagatgtagtaatcgtgatgcggatcgctcactgatgatttggcggctttgaaccacggatgttgatcagacgtgtgattcacaaccaagtccaagataatctttagatgtcgatcatgtgctgcctgcaacaagtgttcaaaatcggccattgtccctaattgtggttcaacatcgcgataattcgaaatatcgtagccgttatcaacctgtggtgatcggtaaatcggattcagccagagcacatctacgcccaaatcggctaaataatccaatttttcagtgataccatttaagtctccaacgccatcaccgttactatcattgaagcttttcggataaacctgatagacaacgctttttttccaccatggtatttcattcatcatcgtcatcttcctcaacttgaatctcgttgacattgacgattgcatctttggcctcttgaatcagcgcatcaattcgagcatcgctaatatactgatcagccggttccatcgcaacgccaagtgcaagtggcagattcatgccgctgatgatatgtgtatgcggacgtgtgcgatatttgaagaacttttgattaacgctccctgccgtcatatccgtcagtaccacaacatcacgatcagctgggaaagcagtcataacctcatcgacttgcttttcaaccggctgattgtccaaatacgctgccagcgtcacgatgtcttgaccgccgccactaatgaaatccaatgtgtctttcaacccttcagcgagccgatgatgtgacgccaatacgattgtgcgtttcatgaatcttcctcctctaaccacgtttaccagaccagaaacctgcacctaaggaccttgtccgcaatgaccaaaagacggtcatttcaggcctaatcattcaaaagtatctccaaaagtgcatcgctcagtgttgccggtgcgagactggcaacagttaatgctgctctacttgctggcatatcgttaacgctttgccacaactgctttttcagatcaaacgcaactttagcatgttgcagaattgcaaagatatgctgcagtttaattgcctgttgatcttcggcttctaaatcaagtgtcagtcgctgatcaaatcgtcccgagaatggtttcattgtggttttaacgcccacaatttgtaattgataggtccgcttctcgggtatgatgtgattaggatcagtaacggtcatcccaaatgtaccggccacgggatcccaagaaaatttggtttgcgctttcccagccgctgtctgttcatgtaatacataggcatgttgcttgccagggaaaagcgtaacggtcatagcttcgggcagatcatcaatggccgccatagcgtcatcagctaatggcacgatgccgcctgagcgcacaagaaccggatactgaaacttgttgcgatagaacttaacaactgccggaccagtatattgctggtgggtaaataaatcggtccaggtaccggctggcacataaccttctgcactggctaagcccgttgtgtcatcactaggcgttgtgatcggtacgaccagcatttctgacccgaagaagtactcatttttgaactgataagcttcttttacttctggatatcgataataaacaggttcaatcaatggcatgccttgctgatgtgtcaacacatcagccgtcgccagataagggacaagctgagcgcgcaatcgcatgaaacgtgtcatgctcttatccgtttccagatcatattgccatggttccttgcccataaacggattgtccgaactgtgcaaccgcataatcggactgaaaacaccgaactgcagccagcgtagtgacaattcaggatcatagctgccgtgcatatgcccgccaatatcatgactccaccaagtgtagccaatattcgtggccgttgctgtgaagtacggttggaaagttaatgatcgccaactggcaatggaatcaccagaaaacccaattggataccggtgactgccaggtccagcatagcgtgacaagatcagcgcttgatccttcttttctttcacctgatccagaaaatgcaacacattaagcgaccataatggatcaatctgcgcacgtgatcgtgcagcgccctgctgccaatcaagccaccagaaatcaatcccctgtttttcaagcggatgatgaaccaagttaaaataggcttgaataaattttcgattgtttaaatcaaacaacactggctgcttagaggctggatcaataccgacagcctcagcaacttctggatactgcacttcagaagggcggataccagcagccgggtgcacattgagcgtgacatgtttgccttgtgcgtgtaaggttgccaataatttttctggttctgggaacagctttttattccaagtatatccagtccaaccgctgccatacgtcgtcggaatatctgtgacatgccagttcatatccaagacagcgactgctattggaataccggctttttggaaacgatccatgagcgcaaggtaactttcttgcgtataaggatagaagcgactccaccaattacctaacgcaaaccgtggtaccatcggcggaaatccagtgagctgataataatcatacaaagccttgcgatagtcgtgaccgtatgcaaagccataaagatcaatttcctcaacaggccgattcctgatcgatgtgccggcttgcagcatactggttgagtcatccaaaatagtaaaaccgtctttggacataatccccgaatccagcgatacagcaccatctgcgccatctaacgttcgggccgttccaagcaagttcttgacatcgggatcaccgtaatgccaacgcggatagtgcgtctgaaaattgtattttgtatcaatgaacaagttggcaccgttgaattcaccaccgcgataatagaggtgaaatgaatctgtctcgatttggacagcaaaaccttcttgatcacgggtcacctgaaaatccggcttgccaaaatcgcgattaaccactgtttgcgtcgttgcatcttcaaactgaccggcagattgatattccatgcggatcatcttatttgtaatgacggtaaaccgataatgatccccgctgacttgattcttctgattcaaaatatcaacccctcaatctttcatcatgattactttgttggttcaatcccgagaataccaaagaaggaacctacgagtgcaatggctaaaattaggacaatgacacgattaggcgtccattttttcgaaccgagcaacttgtaaaccatccaggcaaccaaggcaggcagcaaggcaggcatgattttgtcaagaatacctgtctgcatcgctaacttaactttgccaaactggaattgtagtggtgtgtaaactttaacaaccgttgcaatcaatgtaccgacaacggtaatccccatcacggaagcagcttctgtgaaagcactcaattggttagccatggtcgtaaccagcttaaccccagaatcataaccgatatcaaacagcttaattcgaacccagaaaagcaaaatatcaacgagaatccagataattgcacctagtggattgccttggagggccatataaccggcaatagaacccatgatcgtcggtaacagaatccagatgatcgtgtcaccaacgccggcaaatgggcccatcagcgatgtcttcaacgcctgaaccgcatctttggacttaatgccatcacgttcttccatggccagcgttgcccctaagatcatgccagccattgcagtggtcgtattgaagtatttaaaatgattgtccaaagcagcgacatactcatcatcatcgggataaattttccgcagaacctttgaaaatgcccaaacaacggatggcccctgttgcgtttcgtagttaaaattgttgacgcccatggccatgtaacgaaggatggcactgtgtcgttcttttttagtcagcttaggttgtgtcgcactcggctggttggttgtttgctgtacatcactcatcgtaatcgtctccttcgtcatcatcatctgaagcatcagcaccattagctgtcgccgcttccttcttcttagaagcactgatcaggttctgataggtgtaaattgctagtgccaaaccaatgatcgcaacgccaagaatcggcactttcagataagctgacataacgaaaccgatcataagaacccagatatacttcttcaaaggcatgtaatgcatcagcatcccaataccaacaactggcaacatgctacctgcgattgtcaaaccatttgtaagccacttaggaatgatcttgagcaaggcactgatggcagaaggtccaactgtgacaatcaagatcatgggaataaagttcttgagggcgaagaacaacggtccaagccagttaatcatccgcattttattaaattctttggcatgcgcatatgcttgtgccttgtgagcaatgaagttgttgacgattttaattaaaacatccagttgaatcgtcaacagcccgactggcagtccaacggcaaccgcggctcccaatcctgcgcctgtccgggctgacaaatagatcccaacgatggtagctaagccgtagtcaggcacagatgcgccacctaggccggcaacccctaaactcattaactggaaagtcccggcaatggtcatggctgtcggtaaatcacccataatcaatccggcaaaaagtccgaccgtcaccggccagtagttcataatcgtgataccttgattatcaagcgttgcgtatgatgccaagaaaatgatcaggatatcttgcaaaatatgtggcatgatgtttcctcctcgcgcgttcttcagccaagaactcgctgattatttaatgtctttgcctgcaatggccttatcaaatggttcgggtgaatcagcgggtacatagcgaatgttcacagggacgccgcgcttttcgagttctttaaaatcagcaacttcttgttgattaacggaaacaaatttgctgatctgtgtccgtccgtcttctgcaaaaatgataccgatatcgacacgcggaatttcgatgccagcgtccaacaatttcaacatggtgctgggctcctttgcgataacgaatacccgttgggcgtcatacttaccagctttaaaattcgtcaaagctttttcagtgtcgatgatggacatccctgtgccggctggtttactcaaccgcatgctagctttcacgtcttcatcctgactaacagcatcatcaatgaccatatagcgcttcggctgcacctcagcagcccattgattgacaacgatgccatgaactaaacgttgatctactcgtgctaatacgactgtcatattaatttcctccatatttttggtattgataccaattttgctcaaaaaagattaaaccgactgacgaacaacaacagaaagcggtaaaacgacttgtctggcttcaaccgttttttcttccaagtcatcagcgaccatattagcaatacgatcaccgatctcatgtactggttgatgaatggttgttaacggccgcgcaaccacctgactcagcggttgatcatcaaagccaagaacagcaagctcttcaggcaccttcaattgcatggtctgcgcttcagcaatcatgccagcggctgcttgatccgagccggcgatcacagcatcaggacgatgcttcatgaccatgatgcgctgaagaacatcttgaccatcagcaatggttccaacatcagtaaactgccattccaccgctggctccaagtcgaattctcgcaatgcccgaagatagccacgataacgatcactattcaaatcttcaagtttgtcattgtatcgaatagcttgctgcccagtgcaaaatgctagcttgcgataaccacgattcaagagatatttagtacccgcatacataccgccttcctgatcggcacgcaccatcaaaacctcaggatcggcaacgtattcattacaaataccaatcaaaccgtattgccgatactgcttaatcaaatcccagtcattctcaattgcgcacataatcacagcatcgacctggttcgtcttgagaaattccaaggcattcagttcgtgacttttctgaccgaatgtttgcacaatgactgtcttataggatcgctcatcagcagtgcgttcaatcgctgcaacgagttctgaaaaaaacgggttcgtaatgtaaggaaccgtcacggcaatcgtctgcgagccagaaccgcgcatttgtcgagcagcttgaagcggtgtgtaacccaacttcgccatggcatcggcaaccagggccgctttgcgcggtgaaacatgtggtttgtggttaatgatccgtgataccgttgaaaccgaaaccccggctaactttgccacttctgaaatcgttgccatttttcaccgctcctccacatctccttgattacatgaataatatagcgctttcagatttcttgtcaacgcttttttggtatcgatttcaaaaacaagccaaatcaattttgtgaatttctttttaaaagtgtgacatgccgttaaccaatccttcacaagtcaccactgtcttcgataaaaatatttttccattgttgttcattgcggtacgcttaagaaaacaagaaaggcaggttcatcatgccccactaccaactcacacaacaatcacgcttcaaaaagcacctcaagcaactcctccaagctggccgctttactcagaacgactttgaacaagtcaccaactacttgaaaaccggcgacccgctgccggaaaaatacgacgatcatgtcatcaaaagtcgcaaacctgatcgcgctttgttcattaaaggcagctggttgctgatctatcgggtagaagatttgacggtacggttgttggatgttgggcgtcatggtgacatttgacgttattttgttctactagctgaaggagaccgcttcggacaacactagtaatagaacaactgttaagacgacagtccttcacactaatatgtgattggcatacagtacaaaacgccattcgatgatcactgcggatttgtcacccgcattattaacggtcgttcgaacggactggcgactttctttgttaaggaagtcgtttttttatgtcccgccattaccagtaacgtttattggccatcccccaacgtttatcttccacattgtcccctcccaccccgctgtgctaagctggcatgaggaaggggtgtgactgccatgtaccgtttgattgcggttgatttggatgacacattattaaattcacataagcagctgtcacccgctacaattagcggtttaaagacggcgattgctgccggcatcaaggttgtgccatgtaccggacgacctttgcccggcgttcatgccacattagaggctttggggctagaaggcgacgatcaatatgtcattgttcaaggtggcggcgtagtgcaaagcgctagcggcaaaatcattgctgaaaagtttctgaatcatcaggattatcaagacttttcgacttttgcggcttcggtcgctagcaacggcattgacagcaacgtcttgacgccagccggagaggtttatacggcagatcgcaatatcagtcgttacaccgttttacaagcatgggaaaatacggccggtattaaggtccgtgaaccgcaagaaatgccagaagacttcgtgattgcaaagggcatgctactgggcgaaccagataagcttgccgcgattcaaccccaagccgaaactgaatttggcaatcgttttaccgtcattcgcagtatgccatttatgctggaaatcatgccccatggcgtcgataagggctggggcctagcgcaactcacccaacacctcggattttcagcagacgatgtcattgcgtttggcgatgaacataacgacctcgatatgttcgatttcgccgggacaagtgttgctatggctaacggccaggacattgtcaaaaaacgtgctgattttattacagcaagcaatgatgaagatggcgtggtgaaggcacttaagcacttcgcgattatctaaccgtcaggacgccatgagatttcaataagcaaatgaatggtcgctgcaactgagatattgaatcttactgcagcggcttttttcatgtctttgtgaaccatcaacgagattacttttgactgggtaaaaatgttctacaaaaaaacgtgcacgatgccacctttttgaacatgatagttgccacgatccctgttaggcagcgtcgtggccaaagctcatctgcataaagttagccgtctctaaaaataaattgttcaataattaattgtcgtctatcattgactatagattggaactattctaatatagagatagggccgatgatgaaaagtcgcggttactacataattaggaggaatttttgtggacaagccaaagatcattgttgtaggggcatcacacggcggtcaccaaagcgtcttagaactgttgcatcgttatcccgatgcagacattacgatgtttgaagcaggtgattttgtttcgttcatgtcctgcgggatggaactattcttagaaaatcaagtaaccgatgtgaatgatgttcggaattttcgtccagacgatttgatcaagcgcggcgcacatgtgttaaacaaccatgaagtgacggcaatcaatgctgatgtgaaatccgtcaccgttcgcgacacgaagaacggcacgacgcaggattatccttatgacaaattaattctgagttcaggcgttcgcccgaattccttaccagtgccaggcaacgatttgaagaatgtcttcttgatgcgtggctacgattgggccaccaacatcaaggccaagttagaagatccggcggttaagcacgtcaccatcatcggtgccggttatatcgggattgaagcggctgaagccagtcgtaaagctggtaaacaagtaacgttgttggatatgattgatcgcccactgggtacctatctggatccagaaatgaccgacattctggccaaggaactcactgataaaggtgttgagctcaagcttggtgtcaagatcgaagccttcacaggcgatgaagctgttagcgccgtcaaaacggacgccggtgacgttaaaaccgatctcgtgattcaagcagcgggtatcaagccagcaacggaatggctcaagggcaccgttaaccttgataaacgcggcttcatcaacaccgatccttatctgcggaccaatttgccagacgtttatgctatcggtgatgccactttggtttactcaatcccagcacaacaaaaggtaccgattgccttggcaaccgttgcgcggcgtgaagcccgttaccttgccgaaaacatttttgcagaaaatccagcacggccattcaagggcgtcgttggttccagtgcgttgagcgttttcgactaccattttgcagctagcggcctgaacaccttcacagctaaacgggctgacgttaacgtgcataccgctttctacaccgattcactgcggccagactatgtaccagaagctaacggcaatccacaggtgtgcgtcaacttagtctttgacccgcaaactcatcgactgttaggcggtgcagtattgtccacttacgacgtgactgcacaaggcaacgtcttggcactcgccgttcaacaacaattaagccttgaagacttggctgaagccgacttcttcttccagccaggttttgatcgtcaatggagcttgctgaacttggctgcgcaacacgctttaggcgaaccgcgattctaattacttttaaaaagacattaggcaaatgatgtcttcatttcaatcagccagataaacgattaagcttcaaaaagagccctcttgtgtcagaattctgacacaagagggctctttaagcatctaccgcgttaatcatactgtagcaaccagttgtttttcactatgctgcgttggaagtgtcaccttcgcttaactgaccatccaacaaagtaaacgtgcgatccgcaaacttttctaagcgaacatcatgggtgacaacaacaattgccttatcacgcttatgtgccagatcagctagcagctgtccgacaactgccacacgcggactatccaatgcggcggttggttcgtcggccaacacgatggctggatcgggatacaaggctcgtgcaatggccacccgttgtgtttggccgccggataaggaagccggatattgattaactaggtcaccaataccgagatcatccagcaattgatcaagttcgtcatggctgagattgttttttggcttaattttgtcaactaaagtgaactgctcgccaaccgtcaaatatgggacgaggttgtatgactgaagaacaaatccgatcttatccaaccgcaatgcatcacgcgccttgccggataacttatcaagctcctgtccagcggttgtcacgacccctgatgttggggtttgaatgccacctgcaatggtcaaaaacgtacttttccctgaaccagacggcccaagcactagcgaaagactgccgggttcggcactgaagctaacatctttgaggacttcgacatcgctggttggcgttttaaaatttttaatgatgtgttgtaattcgatagctgacatacaatcaacctccaatggctgtgacaggatcaactttaagaatcgtccggactgggacaattgcaccgagtaagccggtgagcaaaatgccaataacaactgcgatgcttaaaccggcggagaaaatcatcggcacacccataggcatgaaccgcgctgtaactgccgtcagcaccccaccgaggatcagaccgaatgacacaagcatgagtgcttgcgcaatggtcgttttaacgagggtccgcgccggtacaccttgtgcccgtaaaacggcgtagttaggaatcttctgcatggtcaaaatgtacaggaagaccgcgatgacaatcaacgaaatcacaaatagaaaaccaatcatgaacgcaaacgtgctattttgggctgaataacccggcagcttctggataaatgtatccgctgtataggttttcagatcgctgttgttaactttaaaatcagccgacttggaaataatgccgctagccgtaaaagcatccggcaagttgtgcagttttcgccatgtcgccatggtgccgtagacaaccggggcgacactcattttggcattttccgtgaaaccgacgatggtatattgctggccatttgtggttagccgcaccttgtcgccaagcttgtagccttcatttttaaattgtgtatccacgacaatttgattgtcactttgcacgcgatgaccgctcaccagctgcatgtccttgccgatgtactgattccaatcaagcccgaccatcgttgaacgaatttccgagtgcttgctgctggtcgcaaccgcgccgattgtaccgacataggcttgcgacttgcctagcttaatcgcttttgtctgctccgacgtcagcagcgactggctcaaattgatatccgagtcctttgccaataccaccttcgatgtgtcccaggactcgattgcttgcgtattctgctgtgcaagcccattagccaacgcactgagaataaatacaaggtaagtcaccagcaaaatcataccgatgatcaagccatagcgtaatttttcatgccagatttcttttaatgaaagatacattgtttcactccttaacttgcagctgagaaagtgctgccttcaaatgtgccaaaatcaaggtcgcgtcagccggatcagccagcacctcggaaatcgcactgtggcataacgacgcgacagcccagtcggttgcatctgcgggaacttgtggccgggcaacattcaccaacccgctatttttagtgaaatgcaagcggatgaaatcccggtcacgactctcactagcttcatgcagaaagtcggctgttgctgtatatggatcttgccgcatggtcggacccgtgatacccgcatgcaaccgcccgatcacctgtccaaaggcatagcgataggcgtcatctagatccgtgaagtacttataaaaagcaccgcgggcaatatcagcctgcttcacgatgcgcgccacctgcgcctgcgctaacggatattgagaaaattctgtgatgagtgcagctaagacccgttgttgtttagctgcatctagatgttgaaaagtagtagatgccatgattgcccccttgtggtgacacggtgtcactaattgataattcgtagtttatacgggaagtgacaccgtgtcaacacgttttacacaatctttttgtgaatttttattgaatttgctattttcatcttttaaaacgacttgatatcctagaaaaaaagctgtctgttcggtcttcttgaccaatcaacagctttctttgaacacggggatatcaattcacccgtaactgatccccagggtgaatcacactcaaaatcgtcttgccattcaatgcagccagcttgtccatgtcatgtccgtactggtgcgcaatcgcccaccagctctcccctggttgcacggtatgaaaccgaatcgttggcacgcgcgcgacaccatcgttgagtgtgccagtgagacgcgttgtatagtggccaaaaaagtcgtaactcatatcaacacctagcccttgaaagttattcgtgaactgccatgtgccaacattatcgacgcccggttgattcacaccataactggcaagccacaggtttttcgggatcaaggcgacccgatcaaagcgccgcgtggtcagccaactggccatggtatacagatccgtgtgcggatatccgatcgctttgaccgtttggagaaaaacattcgtcaaccccgtcaactcaccagataaacccggatcctccacatccgccgccatcaccgactcggttggcaaccctaaagccttggccgtagttccgaaaaaccgtccttccgccacggcatcagcactgttgtgataatgcgcgtaatgataaccatgcacctgcatccccattcgccgaccggccgccaattgtgccgcagctttgggattgcggtaggtggtgccttccgtcagctttaccaccaccgccttcaccccaacatccgccagcttgcgaaaccagctgtccgattccggctgccaactactcacatctgccattaatatcgccatctcgcccctcctacaacctgtccttggcatccaactttgtcatgaatttctcaatactcgtaatcaggacatccaaccgccgctcaatccgcgtcagtaaaaacacggcaatcacaacgccaaccgcctgatctaagacatacgtcaataattccttatccattttttattcctcctaaaaagtgagcggtcttcaacgcgcttagcagccggcttataagcggcctttggcgtcatgaccgctctttggtcattgtggccgaggtccttatgttcaggtttttgcaactgagagcgcgttagtcactgctcaccgaaaacgcacgatcattatccgaccacctgccgatacttggcctgcaactgcttacgtatcttcaaaactcgttgccgactaatctgtaatcgacctgcgatgccagcatcagacaagtcagccaatcgcaagcccaaaactgttcgctccataggcgtcaaaatagccgcgagtcgttgtagctgaccatcccattccagcgatgtctgcacattcaagacagtgctggcaaaagtcgttttctgcaataaagtgatattgcttggcaactgctcaatcacgcttcgctgccggtttttctgcattcgctgcatcaacgtcagataaacaaaatgccatgccagcttattaaacttgcgaatggcagcctcatccgtcaatggatcgcgatatcggttgaagtagttgaggtacaccaacatcccatcatcacgccaatcctgaaaatcacttcgatcacgccgaatccccaactgcgccaaaactgcatacaccaccccttgatgtgcgagatacaatgcaaatcctgcctcttcctgtgccatctcctaatcccatccggcgcctagtgtttttcgatatcgatgggtttagtttatgcgggcagcgagttagttgtcgtgatcgcaatcaagtaaccaaaacgctgaccaatcaaagcgatatgtctgcactagcgcagaattcccaaaagatcgcttaaccattagcgcgcgacacgataattgcggaggaaaaaaacatcaaaaaacgcgatcggccaaaatcctcctatcgcgcatccaccaatatcgtattgatcgtcaagtcagcctgaaaaccacgaaatttcacagttgttaattaatgttacataagagatagataaacatttgaaaaaagcgtacattttttccattagtaaaaatagcttgtccggcaacttcacatcatagggggattggccatgcagccttcgcgcaagatcgcatccaatatttttaaaggatcgctcggcaatatgattgagtggtacgactggtacgtttacgccgcgtttgctgtctacttcagcccctcgttttttccaagtcatgatccaacgagtgaactgttggatgctgcggcagtattcgcacttgggtttctgatgcggccgattggtagccttgtgatgggccggtatgctgatcgccacgggcgccgggccgggttgaccttatccatcctaatcatggccagcgggtcgctgttaattgccttattgccaaattatcagacagttggtatttgggcacctgttttgttagtggtcattcggctgtttcaaggcctgtcgcttggcggtgaatacgggacaagcgctacttacctgtcagaaatggccgagccttcacgccgcggcttttattcaagttttcaatacgtcaccttagtcagcggccaattgatcgcacttggggttcagattatcctgcagatgtacttgactgaaacagaactcagctcctggggttggcgcatcccatttgccgtcggtgcagccggtgctctactcgttctctggctgcgactatcgatggacgagtcaaaccagtttcagcacatgtccaccagtcaacgccaatcagctggcacgatacgcgccttacttaagtatcccaagcaaatcctgaccgtggttggcctgacgctcggcggcactatctgcttctatacttacacaacttacatgcaaaaattcatgatcaattcggttggcttgcccaaaggaaccgtggcgttaatcaacttcgccgccctcttcatcttcatgtgccttcaacctttggcgggttacatatccgatcacatcggccgacgccccttgctcttctttttcgggatcggcagcacggtcttgacggtcccactattttggctgatgcaaaccaccaaaaccccactgatggcattcctgctaatgttagtcggtctcatccttgtcactggctatacctccatcaatgcgattgtgaaagcggagttatttccaaccgaaattcgcgcactcggtgttggttttccgtacggcctgaccgtcgccttgtttggcggaacaactgagtacatcgcactatggttcaagcaagcacatcacgaaagttacttcttcatttatgtttcgctatgtgcgcttattagtctgattgtttattggcgaatgactgagacgatgcatgctgagtgggattaaccgccaaaaaaggacgactttttcaatgataataagatcttccgcaatcaaaaataaatattgctcatactaatccattgactttctaatcgacacaccatatactcattgtcaactaatcaaaacatcatattgacttatgcgttgaagagaagagtaagcgtgaatccgtttaaagagactgcccggtggtgtgagggtggaacggtgaagcactgaagatgagctctgagcatcggcaaccgtgaaagcgggcgctgcgtcaggactcgataccgtcccagacatcgttttgacggtgttgttgagttggcgggagcaatcccagccaagaattagggtggtaccacgaaggtcttcgtccctgtattaaacatacaggggcgaagatctttttttgattaaacaggcaaaggagttggtagcggtggggtttgcaacattgttcgaagttttgcagcatttagcaccatacttaggcatcacattttggatcattggcgcatcagcacttttcgtacttgtatttggcgcattaatctcgttggtgcatttcagccattcgcgcgttctggaattgctttataacgggttcgtcagtctcatgcgggcaacaccagttttattgctattaatgctggtattctacggcatgccatttctattccagttagtcggcattgacatttcgtggtgggccaaaaccagtttcgccattcttgctatcggattggaaaacagtgcgtacttctctgaaaacctgcgtagtgcttatgcctcgattccacagtcacaatatgatgcctgtacatcgttgcatttcagccgcatcgcagccattcgcagaattttaggtccgcaggtttttgcggccgcactaccaaatatcgggaatacgcttatcacaattgtcaaaaactcagcctacgtctatgtcatcggcatcactgacctatatgagcaagcccaaattatcgcccaagcatcatttggcaaacagcaagtggtcgttttcattgccttgtcactcatctactgggcaatatgtgcagctatccaagcatttttcacccagcttgaacgccgccggtcttggtcaggaggtgcaaaatgacgattttctggcaagattggcaacaaatcatcccaagtgtttggacaagcatttacatcgcactgttggcaattctttttgggatcccgattggttgcctcatcgcttggatccgtgtcaaacgtccgccaatcctcaatcaattggtcggcatctatctctcgtttgctcgcggtgtgccgatgatcgttgtcctttatattctgtactttgcattaccgaaccttacgactgtgctaaatggcggtaagggactgcatattcccgccactgtggttgctgtcgctgctctcgcactattctccagcgcctactttggtgaaactttccgcgcggcctatcaagcactcgacccggcgcaactggaagcagcactcgcctcaggactgagtaagcgcacggcgatgaaacgcattgtcctaccacaagcggccgcgcttgccctgccaaatgttttcaatagtgtcatggacattgtcaaaggcacggccattatttacaacatcggcctgctggagatcactggcactagcatccttgttggctccaaaacgtaccaattcattccagcctacctagcagcttggacaatttacctagttctttattggctcgtcagcgctatctttcatctcatcaagcgtcaagtcacatacttacactaaaaggagttcttatcatgaaaaaatctcgtcttgcactcattgctggcaccgccgttctcgcattattcctcgcctcctgtggcaaatccgacaccgccagttcgaccagcagttcaaaagttaaaacagttcaaatcgttggcccgtcagcatctcaaccctaccaaatttataagagtaaagataaactgtccggctataatggcgatattcttgccgctattcaaaaagacctcaaaaacaaatataagttccagtatcaagtcactgaagcaaactccgtctttgtgggcttacaatctggtaaatacgatctggcagtaggcaattactactactcgactgaacgtgctaaaacctacgactactcacgcaaccctaccctactgagtgacttgcgcttggttgtacgaaaagatgataacaaaatcactgaccttgcatcgctggcgaaaacaaatggtaagttggaaccgattgatgttgctgatccgcggtatggtatcgttgaaaactggaataagcagcatcccgaacagaaagtaaccctcaaatcatccggtttcgttgatacagctaaccagttcaaagatattgtgaacaaacaatatgatgccattctttacccacggacaaactttgatactgcccagaagaagctcaacgaatcgctcaagctttctaagtcaatcgctgtcttcccagtggtctattactatcacaagagttcaaccagcacacaactacgtaaggatattgacaaagaactcctcaaactgcggaaaaatggcaccttggccaaattgtcccaaaagtggcttggtagtgatccctttactgcaaaaaatgatcgtgtgactgacgtgaccaagtcttacgctcaagaaaagtaggtgattttgatgggcttgttagaagttaaaaatctcagcaaaacattcaaagggaagacaattctcgccaaccttaatctgaccgttaatgccggtgaaaccttagtcattataggcaaaagtggcgcgggcaaaacaacccttctacgatgcctgaacctgctagaacggccgaccagcggcaatctcacactgggaaacaacacttacgattacagtcggctcacagcaggcgatatccggacaatccgtgatcaactcgctatggtttttcaaaactacgccttattcaacaacaaaaccgctttggaaaatatcaccgagcctttaatctacggccagcatcaaacaaaagccgaagcgcaaaagaccgctcaaaccttgcttgagcaattagaactaactgacaaagcaaacttatatcctgcagaattatctggtggtcaacagcaacgcattggcattgcccgagcagaggccttacgaccatcaatcatccttttcgatgaacccactagttcactagatccggccttggtcggtacgatcagtcgtgacattctttcgttgcgcgaaaaaggccagacgatgattgttgtaacgcatcaactggattttgcccaacggatcgcaacgcaatgcgcttttctaaatgaaggccatctggtcgaagtcgcgcctgccgaccaattctttacacacccagcccaaccggaaacagttgcgttcctgaatgcggcgaaggaggcggaggcatgaaagcaacgattattggtgccggcaataccggttttgcttgtgcagcagatcttgctcgccatcatatcacgacaacggtttactcacgcgatcctgccaaagccgccaagctaactgaaaaccccttcgccatcacaggccgcttcacaactacccagcctttaaacgtcagctctgacctagccgccagcattcaatcagccgacgtcatcatcgttgccacttgggccaacgtacacaccaccgttattgatgccttgcgaccgctcattcatcgaggtcaagccattatttttctcaatggtaattggggtctgcttcaagctgttgcggccttcacaccagcatggctcgccgaaaaaagggtcagtattttggaaacatcaggcatgccttacgttgctcaatggcaggtccattcattgcacatcagcgaaatcaaggctgaagtaacggtttcgacttatggcgccaaagaagccagcatcaaaggcattaatttgctcaagcagttatatgcgcaagtgatcgagtcgcctaatattctgcaggcaagtctaagtgcgcttaacccaatcattcacgtacccgtctccctcttcaatctttctcgcatcgaacacgccgcgtcttttcacatcctcacagacggtttaagttccgccgcaagagcttacatcatgcacattgacgacgaacgcaaacacctagcaagtgccttgcacataccatacagcagcattgtgcatcaacttgccacacaatggggaacagactttgacacgctacgagaggtgtttcatggactgcctacctaccgcgacctgcccgctccagacagcttgcaatcacggttcatcgtcgaggatttaccatttggcatcgatccactggttaagctaggcgaagttctcggtgtttcactgccatacagcgagaaactagcagcatttgcacatgctgtttttgatcaggtgccggaaccggatctcggatttattaatgctgagacaattgctgctgttcagggaactgggtcagcataaataaagtttcaagtttcacaaaaaagttttcgcctaattcgttgttgtttgatgtattgttgctgtgcatatccttagtctttacaaacagtattaagtatatgttcgaaattcaatcctaatatcttgggatcaaatccagacaccatataaaaatgcctgcaacagagaatcctctattgcaggcatttttaagttgtcagtcttcattaacaagttgtgaatcaaagaaatcctatttggcattgccaacattggcaggcaacttcgccttcgcttcccaatacgccttcagcaatttctcaaacattgcactattcggttgaatcttcgtatattgagcaatggccttttcaattccatgcgtttggataaactgctgcattttgaccgcttgcttatcatcaggattatggaaaagcaaggcacacgcagcaccgcgtaataaatattgattatctaagccaaaagactcgcattcattcgcaggaccaatgatccggtcattgggagaaagcttgcggatcggttctcggccaacacgcgtcaccggatcagataagccaggcgtcgtcatccgcttaacgaacatcgtctcaatataatcttgcagtgactgtttcgaaaaatgatacttcgcctcaagggctgctgccgattctgccatagccgccttcacttgacgcaatagtacctcgtcatgcaagacttcttgaaccgtgtgatagccgtgaacttgacccagataagcactgatcgcatgaccacagttaatgatataaatcttacgttgcaggtacatttccaaattatcaacgtattctgcgcctttaattggttcgctattaggatctaacagctttcctctttcgatcgccagttcatacgcgtcacccacttcaataccatcttgcccctgatgatgaccatcaaatacaacgcgatcaacagccgtatttggataaaccgctgcttgttcaagctgctcactggtcatctcgcctgaatcaagcatcgccttttttagaatatctgtgcccataatggcattctcacaagccataaccgtcattttaggcagatgtttttctaaccgcgccttcaaacccttcgcgataagtggcgcaacttttggtaagttacttgccatgaccgatgtggtcactatgtcagcatgtgttatcgcctcaacgacaccagtaggatcttgaatggaagaaacagcatccacattgtcgattatccgttcttgataatcgtgatcaattagaaaaagtcgatactgtttctctttcctcaactgtgccactgtcttctcaacaacatctgcaaagacaatgtgatagccgctttgatgaagcaaatctccaatgaaccctaaccctatttttcctgcgccaaaatggactgcggttgccataatctccatcctctcaaaagataacttgttagtgctcactaagtttcaaaatgctgaggaccgtttgcttgtccttggcctctcgaagtttttggatattgttatcctccgtcaatgcctgcgcgatttgaccaaggagctgaacatgttcctctcccttgccggcgacgccaactagaaggtatgccgtgttgccatcgaagtcaacaccatctggaacctgcacaaaacagattcctgaatgcaaaatggaatccgactgggttaacccatgtggcatagcaactccatcgccaagataaactgataaatcttcctcacgagcaaacatctcctgcttgtaaaacggcttcacatagccaccttcgatcaggatatcagcacacgctgaaatggccgcattcttatcttggaaacttgcccctaaaacaatgttttcaactggaaacagtggtttttcaagcacttgctcggcaacttgtagcgttattgccgtttcttcggctgcttgtttttgcgttacatgatcgtcagtgtcacccaccatcgttcttatctgatcaatgatgcgctgatattctgttcgatccataaaatttttaaccgttaaaattggcagactgcctttactcatcatttctgcccgcggctctaaactttcattagtaacaatcagatctgctctactggtttcatcgccaatatctgcaaccgccatatggtccacttctggtgacaggccgaccttcttgagttcggcacttaatattgaagcccccattgctgatgaacccataccagcatcacaagcaaaaataatccgatttaggtggcgcaactgattcttgggtgctaccgcaatgccatcatctttttcagctgtttgaagttcctcagaaacagctggcgcggcagggcctgcagtagcgacagcagccgtgtcaaagcttgaaagcatcttactagcatttggctgccgaacaaacttgaggattagtcccgtcactgcaaacgaaaccgccaatgcgccaaagtaagcaatggaattaactagaaggctgctcttaggcgtcatcatgtaaaatgcgaataccgatcccggagatggtggcccaactgtgccaccaccaaagagtgaaagtacagttagtgaaaagatattgccagccatcggcccaagaatggtcagcggcatcattaggcaataaggaaaaacaacttcagcaataccaccaaagaacatgataaccgctgccccaggagccgttttcttcgcaatacctgtcccaaactttgcaaatgctaaggctgtcccaacccaaattgcgccattagcttcaactaggaacaagattgacttacccgcttcggctgcttgttgcagtccaagtggcaccatgatgccatgattaatcgcattatttaagaataaaatctgcgctggctgcacaaacaaactggttaaaggaatcaaatcacgtttggtcatgaaattaacgccagcagacaagaagttctgaatacccgtaataataggggcaattgccaagaaacctaaaatgaccagaataaagccaagaatacctagcgagaagttatccaccaacatttccatgccaggtttaactttgcctttaaccagcttatcaaactttttcaataagattgcaccgattgggcccataatcatgccgccaaccagcatcgtgacactcgagccaacaatgacgccaagggttgcaaaagctccaatgaccccgcctcgacgtccataaatgttggcccccgccgtgtaaccaatcagtgcaggaagcaagtaagtcagaatggggccgaccaattcattcaactgcttattcggcgcccaacctgttggaataaatagtgcagttaataatccccagccaatgaaaacaccaatatttggcataaccattgcgctaagtgttgccccaaatttctggactttcgcttgcgctacctttaggtccataatgatccctctttcttaacgctccgtttgcgcttttatcatcatgatgatggtggcctattccaaattagcatgacgaggaaacatcgtgtcagtcgtctcgccggtcaatttcattaattccaaaataatggcgtcataagttaaccaactgagctgttcaaacaaggtccccattggttgcaccgaatgagcagtgtcggctgcccctgtttcgtttttaggcgtttcgccaggaatcgcaatgatcgcatcggccagactgccgatttcggctgttggataaatcgtcaccgttgccaatttagcgcccaccgcttttgccttcttagcatcaaccaccaggctacccgtcgatccggaaccagagccgatcacaagtaggtcgccttccccaattgatggggtcgtggtttccccgacaaaataggcgtgcaatcccaaatgcatgagccgcatagcaaaaccgcgacctgcaaaaccagagcggcctgcaccgccgacaaaaatccgatttgcttgaaaagccatcttggcaacagtttcgacttgggtgtcatcaatcattggcgcatattgatccagttcgctgataattgtcttcaaactttttgcttccatgatcatttctccttattaagcgcttacattttcatgcgaatgaattttgtcggccaaagccttcgctgttgcgacaggatcgtcggcatgattcaccccgccgccaacaataatgatatctgcgccaagggcctgatactggtcaaccgtgctgactttaatgccgcctgcgactgacagctgtgagtgcttactcagttgtttaacttgcttcaatgcattcaaaggtgtttgccccaccgcttgctcatcaacgccaacatgaacactgatgctatcaaccccaacatcctcaagttccttgatgcgggtgttcaagtcaggcacacagatcgtatcaacaaagacttgcttgccatatttctttgccgcagcaagacaagctttgatcgtcaagatgtccgtcacaccgagaactgtgcagtagtccgcaccagctttaaaggtaagctcagcttcatactcgcctgcatccataatcttggtatcggccagaatctttttttccggaaaataacgccgaaattcgcgaacggcgcgcatcccttcttggatgataaacggggagccaatttcaaaaatgtcgacatagtctcgaactttttcggccagaaccaacgcatctacaagcgagatatcgtctaatgcaagttgcaacttcataagaattctcctcctcaaggctgatattccttttgacaagttcagtatagccggctaatgtgtatcttgcaacataaaatgtttaaattgccacattttatgtttaataatcaacaaatcgtggcgttgttgcgttgtatttgctacaatcgaaagcgagaaggtgattagccatggcaaaattaagtgccattgacagacaaaaacaactcgttgatctgatctcacatcaaggaaccatgaagatcaccgagttagccacttatttcaacgtatctcgcgaaacaattcggcgcgatctgcaggaactcgacaattctggtgccgtcaagaaatggtacggtgcagtgatgcccgttcaggatttcaatattccgccagttgaacaaagaatggccagttttcacgaacaaaaactggccatctgcaaaaaagcgctgtcctatgtttcccagcgctcaactatttttattgatgccggcagcacggcgctgacctttgcaagtctgttaaaagaaacggctggccatacgatcatcacaaactccatgcctgttgtgaatgaactcgtgaccagtcaaaatcatctcatcagtgttggcggctcggtcgatcctttgacgtttgcgacaatgggcacacaaacactcggcttcatcgaaaaaatcaggatggacatggcattcttaggcacatccggcttcgctgagcacaatggtccaagttcaaacagtcttgacgatgtcgaaattaaacacaagatcattcaaaacagtcgactgaacttcgtcttagcggacagttcaaaagctagttcctcatcactttcccagtatgcaaattggcatgatattgattacttaatcactgacaacagcttacctgccaaaattaaagatcagctgacggcgcaaacagaagttgtcacggtctgatcaggttaagttcagctaaaaaggaggtcgttggtctgtgcgatgtattctctttgacatggatgggacactgattaactctgaagccaaatactatgccatctgggaccagttactagccgataatggctaccatcttacggttgacttttatcgtcatattctcggcatgcccatgagcggtattcagcaaactttcacggaccactatgggacaggctttccgtttgatacactctttgcggcctttttgaaacggcgaacagcgctggttcagcacggcaattttgaactcatcccaggtacgcgtgccttccttaaagcttgcggccaccaccaaatcagttgtggcttggtcacttcctcctatcgagaagaaacgcaggcgattttagaaaagcttgatctggctagttattttcaattcgccttattcggcaacgaaacgcaacatggcaaacctgatcccgaaatctatctgcaggccatcgccaaatccggtttcccaccggatgaagttgtcgcttttgaagattctaagaacggcattttatccgctaaaaacgcaggcttagcggtttatcgcattgaaaatccaatcccgatagatgctgatattctcgacttggtcacggcatcttttagcaactatgatgaagcccttgaattttttcacttaaataaagaaaagttgcaataatcgggtaacggtagccccttcaatcagactaccgacctcccacgccgcctagttgattcccctgtcagacgcaatcaaaaaacgacgatccgcaaagatcgtcgtttttgggttgcaaaaatttgtgggtctacactttctggtgttgagaaataatcaacactgaacgtgtaggctctttttggataacgcaaaaagacacctactcagtgtccatgctatgcttgttagcgtcgaaaccaaaagcaagcgaggttatgagtaaatgtcccaatacgatcctacactgtccgtccttggaataccagaccataatatcaaagttgcctttgttcgtcatgaatatcgcggcaacgg

SEQ ID NO: 26 - DNA, 5073 bp, Lactobacillus paracasei
tcgaaggggttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttgacgcagagccagagattcatctcccgactattaaaacgacgtaagggaatcgagttcagacgattttcatatttaacaatctcattagccataaggcacctctaaatgttgatagataaatcctacagtggataactgacgatgtcaaagaaaggtctcgttaattgatagaattctcttggacaaaacctcgtcaataagcggacaaaatctcgttaatagattgctgtatccattgctgcacaaagagtacagcaccccctaaagaggtttaaagaggtttaaagagtatataaagagagaccctcaaaaaaacgagggtcataagaccttggggagaacctctccccaaaccccatacaaaatcctggtcgctttgctccctaaaaaggtgtggcttcgccacatttaactccggcttcgcctgcgcgccgttggcttgccctagcgcgcttcgcttgcgtggctcagaagagcctcagctgaagcttcggcagggctagcgccatacaccgacaaaagctcgttgcctaaatttgatcaatcactaatgcttttcattggtgccatgaccatatgctgataaaaacggcttagaacgcttatatttgcgttctaagccgtttttgatgtaaagagcattaattgtacccgtcagagtaagaaacgctagcacgggccctttagcgctttttaaaactcactgttttgataaccaattctcaacgatatttgatttggtcactctgacatggtacttagccagatccggattttgattcacttcctgttgcttttttgctaccagctgatccaattttgcaatcgcctgatcggtcaaagtgaacatgacccggtgtgtttcgtcttgctttgtcatttcaaaaacctcctgaatggtgatgatgaatgatcgtctagcaaaccgacgcggcgttaaaatggcgtcatgttgccgaacgatttttggtcaacagttgcgactaccctagtcaaaacgtgcacgtttttggctaggtaaaagatcaaaataagttgagttgcgatccgatccatctcaaaaatcggttcggctggatcgaccaatttttgaggtcgtttggaacgcgcttaaaatcaagcaagagcataaggtgaaactgctatcaaaattgatagaaaccgcagtgcggtttggtttgtcgtgatagcacgctggggtcaaaatgttgtctatttgcaggaaattcaacactagcaaaattggtgatgttggattttagaagaaaatccaacatttgccaataggggctacccccaagcgccagttggggtacagaattcagtgtcgtatttttttgaaaaatccaacatttagcgaaaatggcatctgtccgatcgaatgagcacgtttttggcgttgcagcgtacacaactctatagtggcttgcctgcaacatgagatgtgtatagcgagttactcgaattgaagcataggtgttgctttaacagaaactatcgagatgcttgtaacgcaacaaaacattgcattaaccgtagcattaaagttgcatgaatataaactgacctgtttcctaaacgcaactcatatgttacacgatgttcaacttgaacgaaaccctaaatgcaaggatatgtaaacaccacgtgtaacatcgtgcgaaggtcagcaaaaagatgtcgtcaggtgctgtttgaattttggttttgaaggggcgactcactcctccttcaaaataacagggggattgggggcgtgctccccaaacaaaattgacgctcagtgcagctgagatttggtcaatttttcgcaagtggacgtccacttgcaaatctcgcgacagtagaaaatcgtcaaaaaagcaaaatcggtaaattgctgattttgttttttgtttaggccgcggctgcaaagccgtggcgctcaagcataacaattttataagaacctgattagtatctaaggattgcattggacatgtcataaagatcatatcgatacggcctaatatgcttgcgaaagctttctaaatcaggacgaattaattcaaatagaatgaccaggggctgtctaagttaccattatcaaaaacaagtttgacattttctaaactgagtggagagtttgacgttgcataatacttgaaaatactagattttcctttgtttaatttattatattttgaagataatcgtaaaggaattttttcccctgtacttaatataagagagaagttagcttcattcggaagggtctccaagtcatagtcataattagtaacttttacttgcaagactattttttctcctgaaggggtagattcgtgtatcgcgtgtattagttgtagtttaaacagcttttgattattataaccatatttaattaaatcttcgcccctattcacaggaagtatgacgattgagctcatatacactcgatgttcattaggtagttttaatgatattcttgctttctttcctctgccttggcacgttattatgacgtatcgcgtgttaaccttaattctttttaattcaacttttccagaggaggatcttccggtggctattgggtatttatttaaatctgaaatcatataagtggcatttttcgtggttttaaagcgtaaatcaatttttgagctactttggtaagatgtggccttaacatcagttatgttaatcttgttttcgagagcaagatcggtagggtggtaaaaatatttgctaatcaaaaagattgatgatatgactaatatagatactattgcaagcgctttcttcggtttggttttcatgttacacctctagttgagttaatgacagaaagaaggaagatagcaatgaaagcacggaggacacttttaactggggtagcaatccttttaagctttttgatattttggccgttacgtccacttcaagctaattcggacacttctcttgataaagcagagacagttgccctgcctcccaacacaatgaagttctctaagaggataactcctgaggaacttgtcacccagattaagtcgcaatataagtattcgtttccaaaatataatggaacaatcacagcatacacgaatacacaatatcacaactacttagacgggaaaacctcagattatatatctcctagttacatcagcctgcttgataatagacgagaacaagtggaaaccttgtacaaatataatttgtacagtagtggaaataatttgaaccctgtaaccaattacgacgttagcccatatagtgccgtggggataaattctacttggttcaatttgcctaatggggtgattgtcataaactccccttacttagagtcttcctctgttcccaacccaagtacgacatatgaaggttccacatctttcggcataggacctaatagaattgcttcggctgcccattgcttttatgatgccgatgctaagaaataccctgatggcggtataacattgtggggagatgctaatgttaacggacatccaagaggagtaacagcatttacatcatttaaaataccttcgagttacagtaacgggaaagatttctctaatgattatgcagcagcaatagttcaactgaaatctggtagtctgcctagcacactatcactgagtacctctacctcgaataatacgcaagcatcttctattggatatcctggtgaccctcaagcgggaaccccatatgattctcaggggcaaatggtattctctcccggaacagtcttccctgatcctgatgatcctatagggctataccagtcttcatcagtgcgagcatatcacggaatgtctggaggcccattgcttgatccatctaacagggtaataggtattaacgtgtacgaatattctcctaatgatgttgaaattgcttggggattcaaacgaatgacgccaagcgtggttagtttcttgttaaatagttaatgcataatggccgcgattgttacagaagagtctaccccaacggatcgtccagaaacatcttgaaataaggcctaaaatccgattcaaataagtgacccgaaacgatttctaagatcgtttcgggtatttttatgggtagtcgtgtttagccattgctataattgacattagattgcacgagatgaggacggttatatgagcaagaccatcaaagagttagcaaatgaattaggcataagcaaacaggcagttagtaagaaattaaccgccaacttgcgagccaaccacgtaacaaccgttaccaccaatggccgccaacacttggtgattgatgatgatggcgtatccgcacttaaggcccaacatatagcaagtcataaccaacacccaactgccaaccaatcaaccaccaacgttgtcgacaacaacgttaacttggttgatgaactaaaaaatcgcatattggctcaggagaatgaactatctcaaaaaaataagcaaattcttgctaaagatacccaattggagaacatgcagaaactacttgatcaatcgcaacaactccaactaatggctgaaaataaacttaagaagctggaagccccccacaacgacactgagagcggttctgaactagcagaagaccaaacgcatgaacgagcgccagaggcacctgtaaaggctgaaagtagtccagaacagccgccgtctttttggcagagattgtttggtactggaaaatagaaaatagccaccgtgggcacggtggctatttcactaagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattca

SEQ ID NO: 27 - DNA, 43375 bp, Lactobacillus paracasei
gggcaagatgcaacaattatggcaggtaccattcgttataacttgacgtatggggcgacgcgcaactatacagatgaagagttatggcatgtgcttgatatggcgtacgcaaaaacctttgttgaggccatgccgcagggactcgatactgaagtcggcgaacgtggggtcaaggtttccggcggtcagcgacagcgactcgccattgcccgcgcctttcttcgcgatcccaagattttaatgctcgatgaagcaaccgctagtcttgatgccgaatcagaaatgatggttcaaaaagcattaactaaattaatgcatggtcgtacaacgattgtgattgcccatcgactcagcacgatcatgaatgctaatcggatctacttcattgaaaatggcacggtgagcggcagcggcacgcatgaggacctgatcaagtcgcatccaatttatcgcgagtatgttaaagatcagttcggaaaggccgcgtaaacgttaaaagtaggtagtcttgacaaaaactaactaacggattatactcatgctattagttcatgggatagtagactaactaaaagacaaggagaatagcgatgacaaaaacatcagaagatttattgaaggcctttggcggcttaattcaaaagcgtccattcatgggtgccgtggctagcagcttgcgttttggtgatcgacagcgccagccaaatcaattaagactcttgcggctgcttgataataaaggcgaactgacgaattcagatttggttgaggcgttggacattcggccaagttcggtttccgctttagttcagaaactagaggatttagggttgatcagccgccgcgagtccgaaaccgataagcgcgttcagctaattgcgctcactgatgacggtaaaaaatttattgaaacgacgggtaaactgaagacggatttacctgatcaaattttcagtggtttgtccgaagaagagcaggcgcaattactgacgttgattgaaaaattgtctgccgatttggcaactagggatgaccttagctggccagaaggcaaacagttcgatgatatgcgcgaatgggccgcacggttccatcacggtcatcacgagcatggcccacgtcgcggctacccaggtggcttcggcggcggtccacgaggctttgaccatcgattctaaatagtgacttgaatggacaggctgcgatttaattgacagctgtcaatatagacggttgattttccgcaattcatagggaaatcagtcgtcttttgttttctcgcggatattttggagagatttaaagattacagtgccaaggcagagtagtcgacggctagatgaggcggctcgaagcaccgtcgccgcgccagctccgcgtcgctagccctctctgaccagaggttgtggcatttggaacgacaaagaatttttagtctgcggctttttccatgatccaatcgcgcatctttgctaaacagttggccaatactgacaactaagtgagttttcgttaaaaaacttcgccgaaactttactattagccgcgaaccatgcaagatgaatctaatagcatgaaaatggagggaactagcttggcagagacgatgcgttattgtccaaattgtggtttcaaaataccggctggaaccaaattctgtccgaattgcggcgcagatttgacaatcttcaatgctcgggttgctggtgagacggactttggtcgtgagcagtcacaacaaccagctgcatctgaaccggttcgtgaacaggtacgaggagaacgctcacgccgacagcggcaaagtggttcaaccagcatcaaaaagagtctggtcctaactgacgatagtttcgatcattttatcgattggttggcaactcacatggtgtataccttgatcggagtcatggtacttttttgtgtctttagtttttcaacgatcgctggatgggtgttggcagttggctgtgctgtcgccatttatgttgttgcaaatcgccgaccagtggcgtcttatactagtcgctttaacgatgacgattcaggcgactcagatgatgatatttggacagcgccgcggccagcagcgggtcaatcggtgccaccgtatcctaatccgtatatgacgcagccggacaatggcccgatggcgcagcaagcacagaaaatgagcaatcgttcgccgcattggtggtcgcaccttggaaccacagcaggccaaccgagacgaagaggcggcatcatttggctggtttatttaatcgcgtcgctagtggcatttacagcggcctatgcctggccatttggtgctggcagtgtcgccacggccaatgttggcggcagtttgtatgatcttgtccgcagtgctgtcaccttggcggaaactgctgcaaccaatactggcgttgcttcgcctcaaaccaatctgccatacttagcgcttattttagcggggataggcccagtgttaggccttttgttcggactttttcggtcacgcgggatgatgcggtttgctggcatgttaggtttgttaggctacggggccttatattttgcctatgcgccgttgatgagcagtgccaacaaccaaattcaaggtttgctgaatcccggcatcgggttttctgtcggtattggcgcggcgttggttatgttcgtcaccgctcggttgttgccgagagactgatggtgttttcgatcaaaaaataaaagatgttctgtaaatgccgtcagtgttgtaggattaagaagtaggtcacaactgtcgtcagttcctgggggtaggcacttgaaaaaagataaaggaaggttaaggcgagcttggttgctggtatatcgtgggggcttaacctgtgcatcgcggtaaggcatgggtcttagctggtttcggtgtgttgatgtttttgctaataggagcatttattcgacattctcaattggcggagccgcacgcgcctgcgactgttagtcgtcagcggcagtcagccataactaagcagtctagcaggaagacgcaagcagcatcgacaccgtcacagaccgctccttctattgcgggttcaacggtagcgcaaacaagtagcagcttggcggcgttcaccttttccgcgccaacgctacagcgatcttggtcatatatggcctatgtgccagctggctacgatccgcacaaacgctatccattagtgctcatgctgcacggcatggatggcgatgacaccaatctggtccagttagtggattcgaaaagcttacttgatgaagctgttaattcgactggtcatccagcagtggtggtgtttgtggatggtggcaatagtttttacgttgattcgccagcagaaaaaatgcagacggcaatcatgcaagatttactaccacatttaaagcaacaatttgcgcttttatcgcaggcggatgcctatgcggttggcggcgtgtcgatgggcggctatggtgccctaagactggtgctagccgaacctcaacagtttcggatcgccgcggctttgtcgcctgcagtttggcagcaggtacctgaagcggcccaatcacgaatgccagcctttttaactcatggccaatgggatcaggcccgttgggatgccgatcaacctgccaacatgctgacggcggaccgacttgctggtttgaaagtttatttggcgtcaggacaagctgatacaactgtgccatttactgatgtcactcattttgcctcacagcttcaggcagtgggggtgacaccgactaccagctggtcagcgactggcacacatggatttaactattggcagcaggcgttgccagcagcgtatcagtggttgctgcaacagctaccaagagcaacaaccaactaatatttaaaaaaagctgcgctagcttgcagcaaagaaattgagggggcgtttttttatggaatattgtccaaattgtggcgtacaagttagcgctgacgaagccttttgccataattgcgggtttaatcttgcccaatatcgtgctgaaaagggtggcttggcacaagaacaaccggcgcaaggacaaggtagtgaagtgaatggtcagatgcaaaccagtcagccatcaggacaacagccactggcttcaggggctgtgccgccgaatgcgacgcgtcggcgatcaaatggtggcggtgggcaaaagcaaccgcatggccgtccttgggtcattgttagtattgtgttggtggcagctgttgttttgctagcagctttcttattctttcaaaaccgccagcagcaagctcgaactgaggcactggattcatccagctcagcggcggcgagtgcctctgcttcgtcaattgcggctgcatccgcctcggattcacgagtggctgaatcaacttcggcttcggcctctcaagaagcagccagcgaatcactcgccaatgcccgtgaatcggccgaagatagtcgcgatgacgatgagagtcgcagtgacagtgatttaagcaatcgtgaagttgcgcaaatggcggccgattatgacgattttgatttggatgactatcgcgtcgaggtgacatctccggcaactaacatgaaggaagtcgatgtttacgataaagatagcggcgccttgcacggtaaataccgctatgatgaaatccatgatcagatgagcaagtttgacgatgattctggcaaatggacgttaattcatggggatgatgactagtcgtcaggcttgaaatatacgatgatgactgagattctccgaattaaatattgaaaaatagtcggttctaacgatgggattcttttcgttgggaccgacttttgtttggacaaaactgacggataatgatccagatccgtcacaggccatgcattttctgagtaggcgcgcggcgctgctaatgacctgacgcatttttacaaaataaaacgatgcagcagtaaggtgtccatgaaactgttgcatatgaaacagaaagacgtatactggttatcatggaggttttgatgatgcaaagtgaatcgaacatttccgggctgatttatcagctcgcaaaactacagaagtattttttgaatcaacatttaagcaatttggatctcaatagcgatcaagccaaggtgcttacttttattgccgctaatccaggcgctaatcaacgacaggtcagtgtcgaattaagtcggggaccggctagcgtgtctaatttgattaaaagtttgatccaacgcgggcttttggaaaaacgaatggcaccgcacagcgaacgtgagcggcaactgtttttgactgatgagggcgagacaaccgcagagcaagttcgtgatttgtttcaagtactggaaaaggcctttgcggcaaacgtgcctgatccagaagcactgacggtgacgttgaagcaagtgttgaaagccttgcaataaccttgtcggcgtttatgaccctttgaagggagcaaaattatgtctttaaccatcattgaacgacgcaacacggagaaagaactggcagctaactttaacttggctggcgtcacacttgagcaagctgcccaagatcttgcgaccacgccggagcatgtcgaagcggttttgcaattgcaggttgatcaaattgaagagccttggattcttcgaaattacctcaacaagcaacttgctgcacaagggaaaacgccgctaccttacagccgcctacaaggcgatccggccgtacactggtttttaaatactgatttgattgccaaaggccgattaaattaagtctcggtaagtaaaataacaaaaacatcaattaccccttggcgcctgctgagaaacatgctacactatgcacaaattacagcaagcagaaaggtgtcccttatcattgactggcgcgacgaatgaggagttattcgctttacttttccctaaaaacttccccacattgctagtggcaaagcaggcacggcggatgttatgcatccgcgcggcccatggcaatgtggaggccgcacggttattacgcgtgcgagccactccaatccgggttgtttacgcggttaaagcgagtcactaagaaaaaggtgggttggtagtccggctgtttaagtcgggctttttttgtgcgctgaggaacatgccggcgtccattccttaccagtttgggagaaagtagcgagtcaccacgttaccagctggattcatcgatacccgttaactgaacgagatccgagaatttgccactattcgcgtttcttttacctttaaaaccgttacaattaaagtaataagaaacgatcaggttcacactcaaaaaaggagcgataactttgaagaattttcgatttcagaataaaaccgatattcgttttggtacaggccgattagatgttgagctgcacgacgcggtgagtcaatttggttcgcgtgttttgttcgtttatggtggccattccatcaaaaagtcaggcttatacgataccgtgactggactgctcgctgatttgcagttaaccgaattgccgggcattgagccgaacccgaagatcgattctatccgtgctggccaaaagctggcgaaggatcaggatattgatgttgttttggcagttggtggcggctccgtcattgatgctgcaaaagtcattgccagcgccaagttttacgaaggcgacccatgggatcttgtcaaagatcgtggtgtaactcgccgcaaattgcagcaattgccagtcgtcgatattctgacattagcagcgacaggcagtgagatgaacagcggctccgtgatttcaaatcctgtcactcatgaaaagctcggcacagtcgggccaaacacaccagcggtttcatttttggatccgtcactgacctttactgtgccagccagacaaacggcggcgggatcaatggatattcttagtcatttgcttgaacaatattttgatcgttcaaaaaataatgacgccagcaaaggcatgattgaaggcttgatgcgtacagttattaagtgggcgcccattgcgttgaaacaacctgataactatgatgcccgcgccaacttaatgtggagcgcaacgatggcgctaaacggtatcgtgagtgttgttaacgaaaatggctggacagtgcatagccttgaacatgaactatcagcttattatgacattacccacggtgtcggccttggcattttaacaccgcgttggatgtcgtttattctgaccaaggacgcaacgacagcagaaatgttggcacaatttggtcgccatgtctgggatcttgaaggtgatgaatcttatgccgtggcgcaagcggctattgacgcgacctttgattggattagtcgcttagggttcccgatgaccttgccggaagttgggatcaaggatactcagcattttgatgccatggcgactgctgctgttgccaatgctagtcttgaaacgcgcgcctatgtgccgttgtcggtagaagatgtcgaaacgatttatcaagcatccatgacagatgggctggcataaaagtgttagcggtaacgagtctatacctgacattgttgtgccacttttaaagggggttcttttttgacgcaaccaattcttgaacatgattctgttgcttttcaggcggcacgaaacgctgaaaatcaactctgggctgactttcacttaaagcctaagacgcgctggtttaaaattgcgcctgatgatttgcgggttcgggtcttagagtttggtcatggcgaccccgtgctggttgtgcccggcaatactggtgatccatatgcgctagcgccgttgttgccgcaactagtcggctatcatgtttttgtcatggcgcgcccaggtggcggtttgagcgatggatttgatcatgagcaagtagatgttcacaattttgccgtggatttgttcagccagatcatggataagcttgatctcaaatcagcaccgatcattgctcattcgatgggtgcgcattgggcgacttggtttgcgctggcctatccagatcgggttcagcagctcattttactgggtaatcccggccgaatgcttatgaccaaaacaccgacattgctcaaaatggcgatgatgccaggtcttggtaaatggttcatgaaacgtcaaatccctaaatcagccaaacgcgcttggggaccgctgcatcgcatggggactgatccggctgccgtcagtgctttgccgcaaagctttgcggactgtgtttatgcatttgatcatttgccaaactatcagctggcaaccttgtccttattacggacgatgaatcaagaaaagtatcacaatgcattgaaagagtcgcaattgcgcgagctgtctgttccaatgacgttaatctggggaacgaatgatacctttgcgaatcctgaactcggtcaagaaatcgccgctgtcgtgcaacatggtgaactgttaaccgtgaatggggcaggacatgaaccgtggattgacgatccaaaaaaagttggcaccattgtccgacttcggctaaaagaaaaccatttgcgtgctgccgtgtcccaaacatcggctaatgagtggtaagttcaaccggattttgtaaaaaagctattgtgtattctcaactttagcttttttattttgccatttttgacaacgaaaaccagaaaaaagtcgagatttttttttgcatagttaggcttttttcggtaacccttaaaccccttaaccatattatctgagaccgtattcattctgatgcatcaatattctcaaaatataataaacacaaaaaaggtttgacaatcaaagcagttctgcatatgctttgaacattcaactagtttagttgagagcgtgagctggcccggttagaaatcggagtgtaagtgggcctgtacgtgatggccgcactttggccattgcgtgcagggtccttacacgtagatttctgggtcagcgaacgcgttttgaaaaaagctggcccggttagaaatcggagtgtaagtggacctgaacgtgatggccgtactttggccattgcgtgcagggcccttacacgtagatttctgggtcagcgaacgcgttttgaaaaagctggcccggtttttccgggctggcgaccgtgtttaaaaagaaagcgtgagccggcaacgtttaggccggcaatcgcgtttgaaaagaggaggcgaagctatgacaactttaaatacctcaaccattcaggcattaattccgaatcgatatccattgttttatatcgatcatgtgagtgagttagtgcctgatgaatcgctggtggctgagaagtatgtcagtgttgcggaggatcatttggtcggctatctaccagatgaactaacgatgccgccaacactgattattgaaacactagcgcaagcggcatccattttgattttaaaatcgccaaagtttgctggcaaaacagcttatctaggcagtatcagtaaagctgatttttcagcacaagttccaaccggcagtgtactaacattggcgatcaaaatggttaaggttcgagagaatatgggggtcgttgcgacgactgccagtatcggagatgaattggtttgccacgcagaattgcatttcgtggtagaagccaatgcttagctcacttgacaggctatttttttcaactgatactttgaatatcaaatcagttgtcaatggaggcacacctatgtcccaaaagccaagcgtcaagcggatcaatgataaattgattagagtttataccgatattttacgaatggaagaagaagaactgcgtaaaagtcagttccgcgatttaggcatcaaggaaatgcatacgatcgatgcgatcggcattcatgcgacaccgagttcaagcgatgttgctaaacgactgcatgtcaccgaaggcactttgagcgttgccatcaacaatttagcgcgtaaaggttatgtcgagcggttgcatcttgagtcggataaacgcgttgtgaatttacggctcagtcgcaaaggtcgcctgatgtatcgtgcccatcttgcctttcatcaaaaaatggttgcgagtttcgtcaaaggatttaccgagccacagatcgaattgatcgagcgggcactggataatctgaatgaatttattgacgaatatcgtcattagaaagaaggacccgctttggagattctggccagtgcctattcggtacctgccacgcggattgagaatgatcaattgcgccagtacatggatacgtccgatgattggatcaaggaacgcaccgggattaaagcgcgccatgtcgtcaccaatcaaaaaaattttgatttagcttacgatgttgctcagcagttattggccaaagcgcaggtcgcggctgaccaacttgattttattattgtggcaaccatgagtccggattatgcgacgccggctgaggctaatcggttgcaggcggccttgcaggcagaccatgcctttgcttttaacatcaatgttgcctgtgccggctttgaatatgcattacatgttgcggatcgcctgatgacgagtccaacggttcatcaaggaattgtgattggcagcgaggtgctttctcggcttgtcgattggcatgatcggcgaacggccgtattgtttgctgatggtgctggcggggttttgatcaatgatcaaggtttcccggttcaggccgtggatcttaaaagtttcggcgatactgagatggctttggttgctggtgaacagacgaatcacagtccgtttgccgaagcaccctcagctaagccgtccccatttttcaaaatgaatgggcgggcggtttatcaattcgccatttccgaagtgccacgctcaatcaatcgggcactgacacaggcagccgttgcggttgatgacgttgattggtatctcttacaccaagccaatgccagaattgtgcaatcagtcaccaaaaagctgaaagcagatcctgccaagttcccaattaatattgatgagcatggcaacaccagtgcagccagtgtgccgatcttgttggcacaattagctgaagacggtcgcttacaacgcggtcagcggctggtactcagcggttttggcggcggtttatccgttggctcgttgatcgtcacttattaacagtatgtttgagtctgatgcgctcgcagtcgcagaagcccgcttatgggtccgcttctgctggcgcttacaaaatagttaactttaaaggagaacattaaacatgacaaacgaagaagtattgcctaaggtacaaaacattatcgctgaccaattggataagaagccggaagaagttcaactgacaaccaacttcaagaatgatttggatgctgacagtttggacattttcgaaatcatcaacgaaatcgaagacgaattcgacgttaagattgataccgatgaaagcattgaaacggtggctgatcttgttaacttcatcaccgaaaaggctgaagcttaagacaacttgaagggagtgggccaatgagtccattaatggaacgcttgggcgttaaatatccgctttttcaaggcggcatggcgtgggtcgctgacggcaagctcgccgcatcagtttctgaagctggcggcttgggcatcattggttctggtcatgccccagcttcttgggtcaaagagcaaattgatattgccaagtcactgactgacaaggcatttggtgtgaatgtcatgctactttcaccatttgtcgaacaagtcattgacgtgatcgttgacgctaaggttgcgcttgtgacgactggtgccggtgatccaagccgctacttagaacggttgcagcaaaatggcacgattgtgatgccggttgtaccgtctgttgccatggcaaaacggatggcaaaagacggtgtcgacggcgttatcgctgaaggcatggaatctggcggtcatattggtagcattaccacgatggccttagtaccacaagttgtcgatgcggttgatattcccgtcgttgcagctggcggtattgctgacggtcgtggtgtggcggctgccttgagtttgggagccatcggtgttcagatggggacgcgttttctgacgtcaacgtctagccgaatccaccagaactacaaggacgccgtcattaaagccaaggacgttgatacactggtaaccggcctgtatgtcggtcatgctgcccgcgttttgaagaacccaatgagccggaatttcctgaaacttgaaaagaaaattgccctttctgacacgaccgatttttcggcagttgaagaacttggtaatggcagtttgcgtaaagccgtccttgaaggcgatcgtgaacatggttcctttatggctggtgagattgccggcttagttaagcgtgaagaaagcagcgaagacattgttgaggacgtgatgcgtcaggccaaagaaattttggctggctcaaaaatggcggccttattgacaggtcaagtcgatgtgcaggcacaggcttaacggcaaacgtccgcattgaaacgaggaggtacttgcttgcgttttgcatatgtgtttaatggccaaggtgccgaggtccccggaatggggattgatttttaccagaatactttgatattcaaagagattattgaccgcgctgatgcagttttggacttcgatctgccgcagttcttggcgactggggattttgctgctcatccggatgctttgcaaccggctttagttgcgtacagcgtggccatgcatgaagtagcagccgcggcattgcccgatgaaaccgcacttgctggcttaagtctaggagaatacagtgccttgattgctggcggcgggatcagtttggaagatgggttgaagctggttgctgcccgcggcaaggcgatggccgctgcttgtcaggcccatccaggcagcatgttagccgtcatgactggcgatactgctgtgattgcggctgcctgtcaacaagtgcctgatgtttggccagccaattacaatggccctaaacagaccgtactggctggcagcaaggctggcttggcgcaggttgaagcgtggttgtcagatcaaggcgttcgcactgtgccactgaaagttgctggcggatttcatagtccgttaatggctgatgcgcagccaccattgcgtgctgcccttgaccaagtacatgtctttgatccagctacaccggtcatcagtaccacggcccttgagcccttctcggctgaaaacatgcggtcaattttggcggcccaggtggctgaaccgactaagtttgctgatgtggtgcggcaactgaaggcagctggtattgacacggtcattgaactgggaccaaaaccagtgcttagcaaaatgattaagcgcattgatcgcagtatgaccacacacttgatcagtaacgcagcgagcctcaatgcagtcattgacttgaataacggagtgaaggcagattgaaattaactgataaaaccgcgatcatcactggtgcttcacgaggcatcggcgaagcgatcgcccgaaactttgctgaagcgggcgcaaatcttgttttaaacgctcgccacgaatttcccactgagttgatcaaagagcttgaagcctttggtcatggcgtcgtcactgtccttggcagtgttgacgatccagcaactggtcagcagctggtggcaaccgctctggacaagtttggcagtgccgatattttagtcaacaatgctggaatcaccagtgacatgttggccatgcggatgaaaccggaagattttgcccgggttgtcagcgtcaacttagatggaactttctatgtgagtcagccagtattcaaaaaaatgctgaaggcacgcactggtgtcattatcaatcttgccagtgtagtggggttgaccgggaacatcggtcaagccaattatgcagctagtaaagcgggcatcattggtctgaccaaaacattagcacgagaaggtgccatgcgtggcgtgcgagtcaatgcgatcgcacctggcatgattgctaccgatatgaccgcagcgctgagtcaggctagtcaggatcagattttggcggagattccgttaaagcgattcggtcaacctgaggaaattgcgcatgcggcccgttttctggtcgaaaatgcctacataaccgggcaaacattaactgttgctggtggattaggctaagtacatgaacggaggaatgacattgcaacgagtagtcgtaaccggaatgggtactgtgaatccgctgggtcattcagttgccgaaacagtggcaacgatggatgctggcaagattggtattcggccaatcactaagtttgatgccgagaagaccgggatcacagtcgctggtgaggtcgaaggttttaaacctgaagtgcgaatggaaaaacggctgagcaaacggctggatcttttcacgcaatatggcctttacagtgcaatcgaggcatatgaacagtcaggtttaactaaagatgatgttgattctgaacgaatggctgtcatttttggctcaggtattggtggcttgacaaccattcaggaacaagtcacaaaaatgaatgccaaaggtcctgatcgagtaagtccactgtttgtgcctgaagcgattagcaacatggtcgctgggacaatttctcagtactttggcgcgcacggaccgagctatgtcgttgtgactgcgtgtgcttcagccacgaatgccattggcgaagcagccatgcggattcaaagtggtaaagcggatgttgtgattacaggtggtgccgaggcttctgttaacgaaatcggtattgctggttttgcagccctgtctgccttatccaaggctgccgatccggccaaagcaagtttgccatttgcggctgatcgcagcggttttgttctcggcgaaggtggcggtgcgattatcttggaaagcctcgaacatgcgcagcagcgcggtgccaacattttaggcgaagttgttggttatggtgctacgagcgacgcttatcatatgacggcgcctgatccaagcggccatcaagcggcacgggcgatggaactggcgattgaagaagctgggattgcgccaagtgatgtcggctatatcaatgcgcatggcacggcgaccaaggctaatgatgccatggaaagcaaagcaatccacgatcttttcggggacgatgttttggtgagttccaccaaggctttgactggtcatttactgggtgcggctggtgcgattgaagcgatcatgacgattagtgcgttgcatgaaggtaaattgccgatcaatgtcggtgatgctgagcaagatcctgaatgcccagtcaccttggtggatgccgctaatcgcgatgtcgaagttgactatgcactcagcaattcctttggtttcggcgggcataatgcggtcttggccttcaaaaggtggtgagcatcatggacaccgaaatgattgaagtcctgatcaaacaattggagcaaagttctttgcatgaattagagctgacgcttggcaacgattctttacatctggtcaaagcaagtgcggctccggcgccaattgttaatactcaggcaacagtgcctagtcaaccggtaacgccggaaacggcggtgccagctgaaccagaagctccgacaggcaccgcgattaaggcgccattggtcggtattgtctatctttcccctaaacctgacgctgatccgtactttgaagtcggcgcgcacgttaacaaaggcgatgtggtctgcatcattgagtcgatgaaaatgatgaacgaaatcaaaagcaccgtcagcggcacacttaaggcgattaacgtcgacaatgaaagcctcgttgaatatgatcaggcattagtcacaattgaagaagacagagcgtgagtaggagcgtttagaaatcggtgtgtacgcgggtctgaacctgatggcattgcgttcagggctcttatacgtagatttctaggctggagaacgcgtttaaaaggagggcattatgctcgaaaccaagaaaacacttgaagcacaagaaattcaggccattttgccgcatcgctatccgatgttaatggtcgaccgggtcttggatcttaagcccggtgaatccgtagtggcacaaaagaatgtttcaattaacgaacagatttttcagggacactttcctggtaatccaattttccctggtgtgttgcagattgaagccatggcgcaggctggcgcgattgcattgctttcgatgccggacttcaaaggaaagacagcctaccttggcggcattaagaaggccaagttccgccacatggtgcgtccaggcgacgtgctgcggattgaagtgaccttggagaaactgattgacaatgcaggtttgggcaaaggcaaaatttatgttggcgaaaacatggccagcagtgcggatttagtttttgctattggctgaaactgccattgaaaccagatttgtgtgaggaagtggaactttgttcaaaaaagtactcgttgccaaccgtggcgaaattgcggtccggattatccagaccttgcgcgaaatgggcatcacctctgtggcggtgttctcaaacgctgatcgtcacagcctgcatgtcacccttgcagatgaagccatctgtattggcggaccgcgggcggccgactcttatctgaatatgcgcaatgttgtcagtgccgctattttgagcggtgccgaggcagtgcaccccgggttcggcttcttatcggaaaatgccgagtttgcgaaactcgtaaccgatgccggattggcctttatcgggccaaaaccgactgccattgatcaaatgggcgacaaagccgttgctcgacaaacaatgattgacttaggcgtacccgtgattccaggcagtcatcctttacaggacgttgaaaccgcgctggcagcaggtgaggccattggttatccattgatgctcaaggccagcgcaggcggaggcggcaaaggtattcgcaaattaacggatgctgctgcattgaaagctgaattcgcgggggcccaagcagaggctcaagcggcgtttggcgatccgacgatgtatcttgaaaaagtcattgtccctgccaaacacgtcgaagttcaggttttacgcgacatgcacgggcataccagtgttttcccagaacgagactgcagcttgcaacgtcacagtcaaaagatggtcgaagaaagtccatgtccagtcttgacgtcacctgaacgcagaaagttacttcacctcgctgcgaccattgctgaaggagtcgattatctcaatgctggtaccattgagttcttgatggatcagcagcatcatttttatttcatggaaatgaatacgcgtattcaggtcgagcatccaattacagaaatggtgaccggtgttgatttggtccaagctcaactacgagttgcagctggcgatgaagtggcattaacgacacctgagccatcaggagttgcgattgaatgccggttaaacgcggaagatccttatcatgattttcgaccagacgttggcacccttgaacaactacgctttccaaccggcggcatggggctgcgggttgacactggcgttgcgcctggcgataagatcagcccctattatgatgccatgattgctaaactcattgtccatgggcgaacccgtgacgaggccttagcgaaaatgcatcgtgcactgattgaattgcatgtggaaggtgtcaaaaccaaccgggattttgcgctggcgttattccaagcaccgacagttctggccggcaaagccgataccgcctatctcaatcgcgactttttaccaaaatggcagagcgttagcaggcccgtttagaaacctgcacataagtggcctcaagcctaaatggctgggctttggccatttaggcttgaggtccttatgtgcaggtttctgggcctgcgagcgcgtttaagcagaggcgcgcgaaccagcccggtttctggggtggcgaacgcgttttgaaaggaaggatactgcatgtcacaaccacaactgacccaagaagcacttgctcgtgaggcagccttacccgaaaacttgtggattcaatgtccgtattgtaagcaaggcagctatcgtgagagtttgggcaatgctcaagtttgcccgcactgccattacggctttcgaatcactgctaaaaaacgattgtcacttatcgcgacagcaacagaagaatgggatgccgatctggtgacgtcggacccgctggatttcccgggctataccgagaaattggcagcaggccaggctgctactggtttgaaagacagtgtgtggacaggtcaggcgacgattggtggtcaaagctgtgcgcttggtatcatggatccaaagttcatgatgggttcacttggaactgtgactggcgaacggttgacccggttatttgaaaaagcaaccagcgccaatttagcagttgttcttttctgcgctagcggtggtgcgcggatgcaggaaggtattcattcgctaatgcaaatggccaaagtaagtgccgcagttaaagcgcacagcaatgcaggcttgttattcatcagtgtcttgaccgatccaacaatgggcggcgtaaccgcgagttttgcgatgcaaggtgatatcacgttggcagaaccgcacagtttgattggttttgcaggtcggcgggtgattgaacaaacgattaaccaaaagctgccgcaaaactttcagcgagcagaaacccttttgcaaagtggttttattgatgcagtggtacagcggcaggatcagcctagttatttaggggatttgttggcgttgcacacagcctgagcagtgacatttgatgaggcatggtgacgcgatgctagacggattgattgccatcttggatcaatttgcctagcgttcttcatatcacgcgtagccgtctgacaaacacattgacaggcatacagttgcagcaataagggaggctttttcaagcatgacggataaagaaacgctagcgtatgagacagttcaagcagccagagcaccacgaccatatcgcacgcgggaactgattaacgggttggtgacaaacttccatgagtttcacggtgatcgctcaagtcatgatgatccggctgtcattggcggcattggctggcttgatcagcaagccgtgaccgtgattgcaacggataaagggcaagacctaacggagcgattgcagacgcattttggcagtcctgagccttggggttatcgtaaggcgctacggttaatgaagcaggcagccaagtttcatcgaccgattgtcacgctcattaacacccccggcgcatatcctggcaaagaggcggaggccaatggccaaggcgccgctattgctgatttgttatacacctgtgctgatctcccaacgccgattcttgcgattttgatcggtgaaggcgggtcaggcggtgccttggctttggcgtttggggatgaggtctggatgacggacaagagcatgtatagcattctatccccagaaggttttgcggctattttgtggaaggatgccagccgtgctaaagaggcggccgcggtcatgcaactgaccccgcaagatttattggctaaagcggtctgtgatcgcattattccggataccggtacgactttcgcgacgacgttgaaggcagcgatcaagcccaagctcgcagaattagttgctactgatccgcaggcactgattgccaagcgacagcagcgttttcgaaaattttaaatgaaaacggctacacaccgtccattttcacggcggtgttttttctttggttaaaaagccgtataattcttcttgtaacttctcaaaacggaggccatcatgcttgaaaaaaagttttatcataccatgttcagtcactctttcaatattccggttcgcgtggactactgggatcatacggaagaaacgtatggtacaggtgagccaacgatcacgattaaaatgaaaaaggccattccggtccgtgatttgctgaaaaatgcatcgttggcactgggtgaggcttatatgcgtggcgacattgaagtgcttggcggcacacggccattgcaacaattaatcgcggcggcttatgcgaatgcgggcagttttatgcgcaacaagaaactcatgcgctttctcccgaagcaaagtcataccgaacataagtcaaaagaagacattcattctcactacgatcttggcaatgatttttataaactgtggttggatccgactttaacttattcctgtgcctactttgaggactggagtgacgatctagaaaccgcccaattaaataagattgatcatattttgcggaaacttaatccacagccggggcggacattgctggatattggctgcggctggggcacgttgatgttacgcgcagctaagacctatcacctgaaggtcgtcggcattaccttgagcaaggaacagtttaaactggtttcggatcggattgaatcagaacatctatccgatgtcgctgaggtgctgtatatggattatcgcgaactgaatcgagagccgtttgattacatcacatcagttggcatgtttgaacatgtcggcaaggaaaatctagaaggctactttaaagatgtcgctaagttgctaaaagatgacggtgtggcattgattcacggcatcacgcgacaacaaggcggcgcggtaaacgcatggatcaacaaatacattttcccggatggttatgtgcccgggatggcggaaaaccttaatcacattgtcgacgctggcatgcaagttgcagatcttgaaccactgcggcgtcattatcaacacacacttgagatttgggataccaatttcaataatcatcgcaatccgattcagcagaaattcggctacgaatttacgcggatgtgggatgtttatctgcaggcggccgctgccagctttgaatctggcaacattgacgtgatgcagtatttgatcagcaaggggccgtctggaaaagatctgccggcaacccgtgcttatatgtatgaataaggtcaaccgcgataattaagcggtgaccgagattaaaaaagtgcctgttcaggcactttttctttataaggagaaagctattgacaaatctattagtgattggtgctactggcaatatcggtcaaccgctgatccgcgacttgcaagatgatccagatgttcacctatttgctggtgtgcacaattcggagcatgccaaacaggcgttaaacgggctgaaagttcaagtacgccggtttgactttctcgatcctgccactttcgagcaagccttagctgacatcgacaaggtcttcttcgttcggccgccacaattggctaagcccaaagaggatatgtatccttttctcgatgccttggtggctcgacatgtgaagcaagttgtttttgtgtcactacttggggtggcgcataatccaatgacgccgcatcatcaaatcgaaaaacggattgttgaactcggtttgccttatactttcattcgtccaagtttctttatgcaaaatttgaataccacccaccaagctgatatcgtcggccatcgcgatctgtttgtgcctgctgggcatgctcgcactagtttcattgatacccgtgatatcggcgcgactgctgcggttgtcctgcgcgatccggcatatattggccaaaagctcgatattaccggcgcccaagcgctcacctacgccgatgctgctcagatcatgacgatggaactcggtgtgccgatcacctatagcaagccgagtttgtggcgttttcgcaaggtcatgctgcaacgcgggctaccgaagaactatgttaatgtcatggtgatgctttacttgatcacccagttaggtaacgccaaaacggttacgacaacattgccaaatgttctcgggcgcccagcaatcagcttcgagcaatatgttcatgattatcgggcagaatttctacctaaaccgctgtcgtgagcagatgattttaatcaacagacttaacataaagacccatttaccatcacaaaaatttcacacatcgcttgtagtattaacaacatagaaatgagccacccactcattccttccccaacccaactttttcatttttactcctccaaagtaaaaaatcgctgatcggccaccctccgatcggccaatcaaaaatccgcggcctaagctgcggattttttgcatcaagtttgttggttgcggatcgcttttcaggatctatcttgggcagcgatttatccgctagcctgagctggttccgcggcgatgggttcagtggcgggattttcctaaagcaggtgggttgcctgctttaggagaaggccgagttttgagccagcgtgtcggatttgcccgttggctcaaaatccgtgcccaccacgctagcttcgcggtcgccatcccgaatcactgcggcgccaccccgtcctttcggtggtcaaccagccctcccgaaaatgattgcatcaagatttcggaaacctgtttttctgtcttcattgacattgcccctaactcatatatgatgggggtaacattttaaacaaggtggtaagttcatgaaagaagcaacttggagtacggcggcgcggtatcagccgtattcgtcctgggcgcctgattatattatgaagttgaaggctcaggttgctgcgagtaaatggcggacaaagacgcatgttcaaccagatactggtttaatcaatgacccgtgcagcttgaactttttcaacaacaaatggcacctttattatcaacaatttccgtttggcccggtccatggcctgaagtcgtgggcgcatgcggtgtcgaaggatttgtttaactggtgccgggtgccaggcgatctattgccggataacgagtatgattcgcatggggcttacacaggatcagcgttggtgacacacggcacattgcgcttgatgtataccggcaatgcgcgggatgatcagtggcatcggcatagcacccagctaggggccgttctcggcgctgatggccggttgttcaaggatccgaagccattaatcctaacaccgcctgctggttacacccaggagttccgcgacccattcttgtttaactatgaaggccagacctatgtcctgattggcggccagcgtccagatcacaccggcgccattctgctttatgccaagcaaaccgacaagagctggcggtttgtggcaccgttaagtattcctgatgaattttgcggttacatggttgagtgcccgaacatcacgttcatcaatggcaaagtggtcttagtatactgtccacaaggtctcgatcaggactttttcgaatatgaaaatgtctatccgaacattgccctcgtggccgataactttgatccggcaactggtaacttaacccaccagcggctgcaaaacattgacaaaggctttgacttttatgcgactcgtctggcgaatacagatgatgatggcaccttggcgatttcatggctcggcttgccagataccacctacccaacagatgatgatggttgggccggggtcttgagttatgtgcgccaattgacgctacgtgatgatcacgtttgcctctatccgcacccggctatcaaaaatctgcgggagacagcggtagaagatcagccggttgttcagcagcatgatgatgagtggaccgttaccaacttggaaggcgcctttgaactagccttcacgcttgcggcaggtcaaaagacaacgattcatctgcctgatgggggccatgatcagttgctgattcatctcgactctgatagcgggcaggggatgattcagcgcgagaatcgcaataatggcggcagtttgcgccagttcggctttccagctggaaaaacagttgaaatccgcttgttcattgatgtatccgtgttcgaattattcattgaccaaggctaccgcgttgtctccggtcgcttctttggcaatgaagcaccaaccgcggcacgcatcaccccaccgtcagcggccagtgatgttgtgtcatggaatcttaaaaaggataatggcggtctttgatcgcaagccttacgttgtggcgacacggcgtaaggcttttttagactggggcgcaaaaaatctttttagtcaatgcttgacaatttttgaaagcgctgtatactcgtctatgaaatcgattccatataaaggagatgcaaggaatggcgacgattagtgaaattgctaaagcagcaggggttggcgtgaccacggtttcacgctatctgaatcatcatccctacatctccgctgaaaagcgagcgcggatcgaaaaagcaatccatcagttgggctatacgccgagtgccgccgctacgtcactgcgcgcccaagccactggcaacatcggggttctggtatcccgcgtgaccaatccgttttttgctggcttgttcgatgcgattgaacgggaactacatgcccacggctaccaagtgatgattacccagacatatgatgatcccgaggccgaagaacggtttctcaagcagctgaaaagtcgcgaattggacggcgtcattttagcttcagttgaagcccctgatcgagttgcagcagttgcgaaagcctttccggggcgagttgtggttgtgaatgccgatgtccagatccccggggctacttcgctggtattgccacattatcaggcgacccgtgatgcactcgactatttattcaatcaaggccatcgccggtttgcgtatgtcagcggtggcaccatcagcggcgctcaccatggacaaagtcgcacacaagcgtttttagactttatgcaggcacatcagcttttagtggcgcaagatttactgtttggtcaaattcacacagccaaagaagggcaggcaattggcaagcagctcgcgagtctggggccgaatgtgcggccggatgccgtgtttaccaactcggacgaggtcgcagtcggcgtgattgacagtctgttggctgccgatgtgaaggtgcctgatgacatcgcagtgatgggatatgacgatcagccgtttgcgccttttgccaaaatcccgctgacgacggtgcatcagcctgttgcttcgatggcagcggcggcgacgcacgagttgttaaaggggttgggccgacaagtcgcccaagacacgcaaccaaccttgcacttatcgttgaaaatcaggcaaagcgcctgagttttatttttgcctcatatggaatcgataccatattctcatacgacagcatcagctaactggaggatatagtcatgacgaacgaaactagccgtacttggtggcaacaaggaattttctaccaaatctatccggcctcattcaaagatagtaataatgacggcataggcgatctgcctggtatcactgccgaattaccgaagttaaaagaattaggcgttaccacgatttggttgtcgccggtttataagagccccatggttgacaatggttatgacattgccgactatcaggcgattgatccacgctttgggaccatggctgactttgatcagctcatggcaactgccaaagatttcggaatcaaagtggtaatggatttggtggtcaaccatacgtccgatcagcaccggtggtttcaagcggcgctcaaggatccggcctcaccatatcgggacttttatattttccgccaaggtcatgatggtcagccgccgaacaactggcgctcaaacttcggcgctggctcgtcatggacggcggttcccggtgagcccaacacctattatcaccacgtcttttccccacaacaaccggacctgaattgggaaaatccgaagttgcggaaagccatttatagcatgatcaattggtggctagccaaaggcctcgccgggttccgggttgacgccattacgtttatcaaaaaggatcaggattttgcttccatcacgccagatggcagcgatgggttaggcaaggttaagcgcaaaacggaaaatcgaccgggtctggatcaatttctcaaagaattgaacgctgccacctttaagccggccaatgccgtcacgatcggcgaagcgtccggcgttgcatacgatcaactcggtgacttcattggcgaaaacggctacttctcaatgatttttgattttcattatgccgacattgacgtcgcttccgggtctgagtggttcaagcaaaccaactggacgccgaaaatgcttggcgaggcgattgccaaaagccagctggcaattcaaaaagttggctggggggctaatttccttgaaaatcatgatcaaccgcgaagcttaagcaagtatatccgtgagccgcaatatcgcaatgcgatcggggcaaaagccttagcactgttatacttcggtttacgtggctgtccgtttatctatcaaggccaagaactcggcatggtcaatgcggtgcgaaccaacattgatcaattcaacgatctttccgcgctcgacaactatcgccgtgcactggcagaaggctactccgaagacgttgcgcttacctgtgtcaaccggcgctcacgtgacaatgctcgtacgccgtatccatgggacgacagtcaaaatggcggcttcaacgctggtcatgaaccttggttaccgctggccaagcaagctgctggcgtgaactggcaggcagaacacgatgatcccaattcggtctggacggtttatcaaacgctctgccgcctgcggaatgcatcaccattgcgcgccgatttgatcgaaggcgactttgccccgctagatgcacacaacgacaacgtgattgcctatgcccgcgggcaacatgtccaaatttttgtgaatcttagctcgaagtcagccgcagttgacttaccagctggtcacgtttggctgaacaattacccggacgttggaacgagcttacaaccctatcaagcgattcttattgaggtgaaatgatcatggctaaaaactatgaagaagaagcaaaagcaattttaaagctggttggtgaaaataacgtcgattccgtgacccattgccagacgcgactgcgttttgtggtgaaagatcggaaggcaattgatgacaaagcccttgagaagttgccggaagtcaaaggtgttttctatggctctggccaatatcaggtcattatcggcaccggcgttgtcaacgatgtctacgcggccattgctaagcttagcaccgtgaatgcgatttatggtaaagacgacgccgacactgccggtaaaaccagtaacgagcacaagacagtcgtacaacgattaatggcgatgctgtcaggcattttcattccaattattcctgtgattgctgccaccggtttgttcttagggctgaaaagtgcagcaaccaatgcgcaagtattaaaacttttcggagcggtcccaagcgatataccggctagcctgacatcggtaatctcggtgcttaccgataccgtttttgctttcttgcccgccttgatcgtctggtcgaccttccgctacttcaaaggcacaccgattattgggatcgtcatcggtttaatgctggtttcgccaattttgccaaatgcgtattcggttgctgatggcagtgccaaggccattatgctgtttggctggttgccagttgttggtagtcaaggctccgtgttaaccgccttggtcgctgggtttatcggggccaaacttgaactattcttccggcgtcacatgcccaacgttttggaacagattctcacgccatttttgacgatgctcgtcacgttcgccatcatgatcatgggcgtcggtccaattgtccatgccattgaaagtggcatgcttgtcggtgttgaagccgtgatccatctgccatttggaatcggtgggttcctgatcggggctgcttatccactgatggttctcatcgggattcatcagaccatgattgccattgaaacttcgctgctcgcgtcaaccggcttgaatccgttgatcacacttgaagcgatgtatggctttgccaacctcggtgttgccctcgccattttcttacgagcacgttccaacaaggctaaagcaacttcgatgggtgcctttacctcacaactattcggagtttccgaaccaacattgtttggggtcctaatccgctacaactttcggccattgatcgtcaccgttttgacatccgggattggggctgcgattttaagcatgctcaacgtcgctgctaactcgtatggccttgcagtggtgccatcttatctgatgtacatttataacggccacgcgttgttgtggtataccatcgtgtcacttgggaccgttgtcgcggcctttgtcgcgaccaacgcgtttgcgatcccgaaggaagtgctaacgccagacggggatgtcgaaaccgccaatgctgtgatctcctcaaccgtcagcgacaacaaagtctatgcaccggttggcggtgaaacagttgcgttggatcaagtcagcgatcctgttttcgcttcagggatgatgggtgaaggcatggccatcaagcctgccgaacctgacattaacaaagtttacgcaccacaagccggcaccttatccgtcgtcgccgacaccggccacgcatacggcctaacgacagatgatggcatgtaaattctcgttcacctaggtatcgatacggtcaatctcaaaggtgcaccattcacagtcgccgtcaaagccggccagcacgtcaaccaaggcgacttgctcggcacctttgatcaagcagccatcaaaaaggctgggctagacgcgactactatcgtgctgattaccaacagcaagtcttatgcacggatcgagccagtggcggctgataccacggttcaggcaggtgcggatttgcttgctgtgcagcgtgaagatgtgaaggttgaatcggttgaaccggcttgatgttaataaagagccgagttaggtacgtttttgatttaaaacatctcagattgctccacgattctgaattatctgaggaaaatctctaggcaaaaagttctatgtcgtgccaaactccgcaatctccggccagatggggctggaacgctgtgacggcgcttcgagcccgcaaggcccgcggtctcgaagtcgcctaacaacatcagctccacagaccgtcgctgtgttgtttgcacggctgagccccatctggcctacgattgctccgctttggcactgggatctttaaaattgacgctaaactacctatgaaaaagctaacaattttccgttatacagtgagtgatgtcttaacctgcgtagctaaaaattgcccccaaatttcttcgaaaccggctataattaccgaaaagtactgaaaattgcccccaaattgcccccaatttttaaaaatacccctagtaccgacagatgattgaagcgtctgttagtacttggggtattttcaatgctagatgggagccagagtgacaagttgccaactgtagtggctttcgactagtcggtctacttttttgaaaacatccttagttaacaaggctatgagaaactgagcgctgaattaatagagcgtgccaagaaacaacagttgatcaaagctagtcagtgtttaccttgtctgtcgtcaccgtcacgacaaacgtagactcgtctttttggtaaagccggtgaatgttttgcagtagcaacataatccatgacattgcgagggcaaaggctatcatctcaaacgctgtcagtgacaagtagtggacgaattggaagaggattgcggcgaaaatgatgatgccgccgatgatgtaactggtgctcaaaaattcgcgtgatacgcctggcaacagccaacgaaccgcaatgatcatgccgatgatgaaataattcaggaaccaagcactttgcgtgtgcaagatatgcatgaggccgcgattgttcgggaaaaggccaacacccagcaaagcaattgccgcaaccgtcaacatgatccgcatcgtgatcaaccgccaatcatttttgcgatgcgccatcagtggtacgaagagataatccaccagcgcgatccacagcaaggccgacacagcgatggtgagattaaattgccacgcattcaaagccttgttcgtgccaagaaaactgacgttatgttgccaccactggcgcgaactatttgtcacaatcgcgccaatgacgccgccaacgaaggtcgatagaaacagggtcgtgatgaaggaggtcgaaattgacaaggccgaataaatcatcaggtagttcacaatactgataaacagaaggaacaacccagtcgccgtgtaaatatcaaaactgacgccctcaaacatatagccaatcacccagaaaaacactgatgtcacaaacgcaagaataattgcaaaggacaacagcatcgttggaaaaattcgccaataacggcgccgatgatcccgcccatgaatctggcgatgattctgaatgtaagcaaccgcaaacgtagcaatcccactcaattcgcccagcacaatgaccatctgcgcaatcgaattcttacccgtcatcggtacctgcaaaatctgaaaatagataaagtaggccaaaaacgcgatcccagccaaaaccgttggaatcaggaagaaccgcagcgaaatcgtctgcgtccccgtatccgtccgcttaggccggatcacggcttccttatcttttaaagtaacttcaacttgctcgccatctttaatatcaagatcttccatgatggcgtcggggatgacgacgtgatgtgtttctttagccaatgttttaacacgctccaaagttggtttgatgtgatgtgttcaggaacttactgtagcacattttggaaaaagggtgttgccaacttaaagtacggtctaactttcgattgttaggcaatgcctatgatacaatcaatctgaagttatgcggtaagggagactcgcagtccgcctatgggctggcacaaaagggagcttttattttcaagattgattgagcctttttctaaacgataggagctacgcgtcatgacagaagcagaccacgaaataagatatgcagagtacatgaatatgatcaacatgacctattctgaagcagttgcctatttactcaataaatatggaccggtgaaagacaactattttaatgaaaaatcttatcagtgttttctaaacggtgaaatcaagtctattagcaaaggcaagtatgccagaacttcagaaggactctatacgcaccatgttgacgagaatcgtgcagaaaacctgagtgatctaagatttattcgatattatcaatatccgtttagtatgcatcgtaaagacagactggtatatgcggatctaatcgaacatcttattttgcacgccattattgctaaagagacagatggacgctttggtgaaaaaggatatagcgttttcttagccccaaatgtcgatcaatggtttataagtaagaagatgcctgaacctgagtggatgaaggcagtgtatcggcgttcgtttctgactaaagaagaggcaaagagacttttagagcaaattgatagtggcccacgagcaaaagttgctcgatattacagaatctgaatgattcttacgcggtgaaaaagcagtgttactccatgattagcgtgaagtggcactgctttttgtttacgtttctaaatgtagtcagatttcgctacagaattgtcccgaaaacaaatgtaaactctaacacaatatttgctctattcgttactcaacttcaatttagtccgaatcggtgacgaacgtatcctgattttctgtcagaagtacatattaaatcagtcagtcagttgagtccctctgtatggacgttgcccgtaatatgcttcataatgaagaaggttatctatacgctggaacgcggcgttaaggttcaaaaagcatctcggccttgcgggctgctttggatgaatattaatacagttttgaagatgcgaatcaaggagtatgaatggttcgtcagtggcttgcaggatctgaagaaatacgactaacgggttttgcaatgacaacaggaggagtcaagaatgggtgcaacacttgaatctacgtttgaaaaacgattaatcgaacagttaacgaggggcatttcacaatggacttatcgtccggagttaaagacggaggaggatttgtggcgtaactttcggcaaaagatcgagcaaaataatgttgctgtgttggacggacatccgctaacagaacaagaatttcgtcaaattcagaatcagcttcaatttggcacgttttatgatgctgccaagtggttggctggtgaaaacggcgtggcaaaggttcaagtacagcgtgaagatgccacgctaggaacagttcgactagaagttgttcgtcgtgaagatgtggctggtggcacttcttcttacgaggttgttaatcaaatcgaaatgcccaaagtgttcgctgactaccagaatcgccggtttgatgtttcacttttgatcaatgggttaccgttaattcatatcgagctcaagaatgctgatcactcatacatggatgcttttcgtcagattaaaaagtatctgagcgacggtatgtttaacggcatctattcagttgttcaaatgttcgttgtcagtgacccgtaccacacacgttatattgcgccggcttcaggcaccaagatgaacgagcgtttcttaaccaactgggtcgatgagcataatcagcctgtagagacgctgactgattttacggatcaggtactctcgattccacaagcacataaaatggtgactcagtataccgtgattgattcgattcgaaagtccttaattttgttgcggccttatcagattcatgcgattgagcgggttcgtgaggcgacaaaacaccaagtgtccggatacgtctggcataccacaggctcagggaaaacgcttacggcgtacaaagtagctcgaaatctattacaaattcccagtattgataaaacaatctttattgtggatcgagtcgacctagaccagcaaactacaagctctttcatggcttacgctgaaaacgatacgattgatattgatgagactgaacacgttcgcgatcttattaagaagctaaaaagtacagaccgcactgtcattgtcacaacgattcaaaagcttaactttgtcatgcgccggtttgcggataaacaaggcacacgagattatgagcgattgacaaagttaaagattgcttttgttgttgacgagtgtcatcgcgctgttacttcgcgaaaacagtgggaaattaacggctttttccatcacgcgttgtggtatggctttacgggtactcccatatttgagcagaatgcacgtaaagaagagggaaacttgccccgaacgactgcggaacaatatggcgaacgactgcatgagtatacagtcaaagaagcaattcatgatggtgccgtcttgggctttcaagtggagtatataaatacgattcgtgatgatcaactaactgagttaattgcgaagcgcacaggagagtcccttgcagatgtagcaaagatggatcctgttgagatggaaaagaacctgctctcttctgattatttgaacaaaaatcatatgtggaaagtgatagaggggatcgtcaaccattcacaaaagaagctgggcttgtacaatggccgaggcaattcttacacggctttgttgacaactagctccatttcgcaagcacaaaaatattatgaattattcaaagagttacgtgcgggtaaagcgccatttacaatgaacaagcgtacctcagaattattacctgactttccgaaggtcgccatcacttattcagtcactgaaaatgatctcgattcaaccctgaatcaagacgcgatgcggaagtccattcgtgactataacgagatgtttggtacgagttacagtcttgagaatattaacttatataacgctaatatcaatgatcggttagctcgtaaacaggcccgttatctgtctcgtgaagagcaattagacctcgttattgtggttgatcgattattgactggttttgatgcaccttgcttgtctaccttgtttattgatcgcaagccgatgcagctgcaaaatatcattcaagccttttctcgaaccaatcgtatctttgacaagaataagcagtatggacagattgttgtctatcaactgccgaatacctttgcaaaagcagtcgaagatgcgttaatcctctattcaaatggcggcgaaaatgaagtccttgcccctgagtggaaggtagcacacaaccgattaaagaaggcagcttcaagcttgaaaaagttcaagattgatccttctggtccacctatcagtgaattgccagatgcgaccttgaagcaatttgccaaggcatttcaaggctttgataagggactggctgctgcgcaggtttatagcgaatatgactcagacgaaattcaagatgagattgctatcgattctcaagacatcgaggcgtatacgagcgcctatcaaaatgtcattgacgaattaaagcggcgtcgacagactgaagggccggaagaagacgatttagatattgagtatgagttggaaaccgtacgtcaggatacgatcaactacgagtacatcgttaatctcatccaagcctatgtcagcgactctcgcgatgataagcctgccgtgagtcaaaaacgggtggaagaaatttcgaattacgtcgatagattgaagaacaacaacgagaaacttggcacgttgatggaaagcctatggcgtaaaattcaagctaatcctaaagaatttcaaaatcagaatgtccaaactttgcttcagacaatgaaaaacgaaacaatcgagcatttggtcaaggatgtcgcgacgacatggggtgctgatcctgcagaggcgcttttctacgctgaaaattttgaccctaagaaagaatctaatcccggcgaagagagcttaaaacgtcatatggattatgaaatgtataaggaaaaaactgaaaatccggttaagaagatctcgtactggcgcgaatttaaagatgcatactcgaatcttattcgcgaagagatcttgccacttaatcaggactaatttggaggaacttaacgatggctcaaatgacgtcacagacgctgtaccaagcactttggaattctgcggatatcttacgatcaaagatggatgccagcgaatataagaattacttgcttggcttaattttttacaagtatctttctgatcgcatggtggtttatgcttcagatcaattggaggagaagacaacagatctggataaagcccagcaaatttacacggatgcatacaatgataaagatttgcatgatgatctgataagtaatgtttccgatgagtttggttatcacattcagcccgatctgacttttacggctctgatcgataagatcgatcacgggacctttcaacttgaagaccttagtcagagttttcgtgatattgaacaatcaagtgaattcttttctgggttgttcgaggatgttgacctgtattcgcgaaagctgggtgcaaccccgcaaaagcaaaatcaagttatctcggatgtcatgaagcaaatctcgacgcttgatttggttggtcagaacacgaatgacatactcggtgatgcgtacgaatatttgattggtcagtttgcttctgattccggcaaaaacgcaggtgagttctatacgccgcaatcggtatcacgtcttattacgcaaattgcgatgcacggtaaggaagatgtccgtggtttcacgatttatgatccaacaatggggtcgggttcacttttgctgaatgcccgccgttattcgaatgaacgtctttccattaactactttggtcaggaactgaatacgtcaacgtacaatttagcgcgtatgaacatgattcttcatggtgtgccaattaataaccagcatctacacaatgctgacaccttggatcaggactggccaattgaagagccaacaaactttgatgccgttgtgatgaacccaccgtactcagcgcattggcagccgtcgaaggggacggaaaacgatccccgatttgttagctatggtcttgcaccaaaatctaaagccgactttgcctttttacttcatggctactatcacttaaaggacactggggtaatgtgtatcgttttgccccacggggtgctttttcgtggtggtgcagaaggtcgtattcggaaagcattacttgaaaacggcgcgatcgacacagtgattgggttgcctgcaaacatcttctttaacacgagcattccaaccacagtcacggtcttgaaaaagtctagaacgactcgcgatgtgctctttattgatgcatcaaaagaattcgagaaggctaagaaccaaaatcatctgacagacgacaacatccaaaagattcttgaaacgtatatcaatcgcaaggatgttgataagtatgcccatctcgcatccttcgatgaaatcaaggaaaatgactttaacttaaatattccacgttatgttgatacgacagaaccagaaaagccagttgatgtggtcaaagtggttgctgatatcaagaaaaacgatgaagaaattgccagattaagttcggagctagccaaagattttgacgatttagtggctaataatgacgaagctgccaagcaactcgctgccttgaaggagttgtttaaaaatgagtaaggatgctaaaaacgttcctgcattacggtttaaggggtattctgacgcttgggaaaagcgtaaatatggtgatatcgcaaaatcttttcaatacggtttgaatgcgcctgcaaaaaagtttgatgggatcaataagtatctgagaattactgacattgatgatctcactcgattattcaaacaggagagtttaacatcacccgacacaaatttatctaacgcttctacataccttttaaaacaaggagatgtgttgtttgctcggactggagcaagcacaggcaaaacgtacaaataccgcaagggggatggtaaagtttactttgcaggattcctgatccgtgcagatctgaaaccaaaatttgactcagaatttttttatcaaactactctaacagactcatttttggactttgtcaaggtaacatctcaacgatctggtcaaccaggaatcaactctaaagaatatgccaataaagcaattcaggttccggaactctctgagcagcaaagaattggatctgttctcgcaatatatgacaaccttatcgctgcaactcaggataagattgatgctttggaacaagctaaaaaggcgctacttcaacgtctctttgatcagtcatggcgcttcaaaggttactctgacccgtgggaaaagcgtaaagtctcagattatttatgcgagagtcgaataccgggttcaaatggattgaaagctaaaaagttaactgtaaaactttggggaaaaggagttgttcctaagaacgaaacttacagtggaagtattaaaacaaagtattatgtacggtctgcaaatcagttaatttatgggaaacttgattttttacacgcagcttttggaattgttccacaatcacttgatggatgggagtcaacgattgattcgccagcgtttgatgtcaataccagtattggaaatgctgcctttttgctagctctttttcttaggccaaatttttacttgcgagaaggtataagagcaaacggttcccgaaaagcaaaacgaattcatgaagatacgtttttgagcatgtcaatttcagctccgcaacgtaaagaacaagatcagattgcagtggtgcttgacaagactgagctccttatcgctgcaactcaatccagactttctagccttgaattattaaaaaaggccttattacaggaccttttcatttgaaaaggatcgtcttacgcggtgaagctgcgttaggcgatccttttgtgttacatcaatgaggtaagatagcgcattatcttatcgttgtcttggttttctaattcttggatgatatgaaggtatgtcttctgcgtggtgctcatattggcgtgtccaagtcgtcttgcaactgaaccaaccgagacgcctgcgtatagtaacaaagacgcgtgagtgtggcgcagtccatgaatgctgatgacggggatgcttgctcgcttacatttgcgctcaagaatgtcatttgctgtctcgttgtatactcgctgtccatctgtaacaaaaattggcttgtcctgcgggagacttttgatttgagttgcaaattgcatcgcaacctgccaatcaagtggcaccttgcgaacagaggccgtattctttgtctctgcaaagcttccagtggcacttttgtagtcccatgtcttattgatcgtcagcgtcaattttgccatgtcaaagtccataggcgtaacgccaagtgcttcaccgaatcgcaaacctgttttggcgattagtagcaggaaataatcccagtccaatccatgatcgagatccagcaaagccaacagctttgtgagttcatgttgatttagaaacttaaccttatgtacacgcgacacggttcccttgatgacgactttgcgcgtagggtcttgttctaaaatgccttcgtccaaagcatccagtatagctgccttgagatggtgatgaaagtcgagtgtcgtctgtttttcgtgatttgcggcgaattcgttgattaactcttgataagtccgtcgcttgagttcgtccatgtgcagatcaggtgccagtgtaaccaaatgcttatgcgacatttgatacttctgataagtgactggtcgaacagcgccttctttgtagagttcaatccactgcttgaagtacatatggaatttctgcgtgcgtaagttcattgcgcacctccttggtttagttgtctttgttagacaattaaactgtttaccatatgaaccggtaaaagtctgcggaattgtgcggttactcacgttcacacaaacaaagattttaaaagagaatctttgatggtcctaattttctgaagcctctcttgagtttgattcattacggtttccagattttgaagtaaggcaccaatcttcttttgttcgctttcctcaggtagttttactggcatttgttcaaaaactttatctttaattgcaaaccggtcggatcgagctcctgtgtctccattcaggtacataaatctataccaactttcgcccttaaaaaagtattctaaaaacattggataagcagcgttagtggctttaaaaacatagtacaaaggcgacataactcccgttctatttagtttgtttcttctcacaggtccaactggggccaagttggaaattctaggattataaacaaaatcgttttctcgaaccacataataatttgtcaagtttgcttcattcgaaattaacttatcaaagaaagattgttgttcaacgattccgtattttgcagaattggtgaaggtttcatgatatagattttcagtatttttttcagtgacttttgaagtgatttctccgagcaaatgagacgtccacagttcagaatattctccgaaacgccacgattgatcgaaaagatgttgtagaaaggccttcttgatttgttcaaaagcatcaatcttatcctgagttgcagcgataaggtcatcaagtaccttaatggttaacccgatactttcttgctcagttttttttgtagggaaaaatagttgctgatcaaaaaagtcacttgcagaaatattaagtaacccatggtttctcgctccctcggaagctaccttactaactgaaacgtaccaagtagtgccttcaaaataagtaactaaaaattgagaattgattttcttgggtttaaagacaatgtatagcgtcgataagactccagaagggtatttgtctaaccttttgactgctccccacggatatccgacagaatagcttttgttgtaagcaaaatctccagctttgaggagaaaatagtttgatatatttttacttgcaacagttttactaaaaaattttctctgatcaactaatccatcttgagcagaaatagtcaatgggcgtgtagagacaagatctctgttttttctcgtcactctttccacaacttcgcccaacttacgcttttcccaagcgttccaagcaaactccaagaacatcagcaaccaaactccgccacaaccccacatctctggtatgctaatacccagagaatgctagcgatcaattagtgtcaatcaatttgaaccagccagcaaaatactactttggggtgacaattttgaagggtaatgcagagcttatcgtcagtcaggtgattgcgaataataggactatcaatattccagtttatcaacggcgctatagttggcggcgggaacagttggaacggtttgtcgcggatttgaagacggcttatgcgaatcaacgcgagcgatatttctttggaagtttaattttgaacgccaccggtgacactagtacggtagatgtcattgatgggcagcaacgactgaccactgtttcgttattcttgattgctatccgtgattttttaggatcaagtgatgtggattatcaacgagttaacgaaatgtttttaatagacaggtttgatcgggattcaatcgcgaagaatcggttgcatccggtacctggtgatgaggaacagtatgtcgatgtactagttaatggtatgtcagctgcggatacgatttttaaaagtacctacgcttatttttggaacgttttgcaacagggagacttaacagttcgtgagtggctttccttgttggaacaacggttgcaagttatgaacatcgttgttgatcagtacgatgatgctcaattgatctttgaaagtttaaattcgaccggtatgaatttaacggaatcagacaagatccggaactttttgctgatgggcttgaagggcgatcaacaagcagcggcttttcaactgtggcaacagaacgagcgcttggttggcagtgaggagctctcgcggttctatcggcagtacttgacctcgttggctcggagctcaaagccggttaaagaaaatgaaatttacagcgattatcgccgttatgtgggcttgaccaaagactttgatcaaattgctcaattgaaaaaggagcaggcggcagccaaattatttgcggaaatcacagcgccagtgactgttgccatcaaagatcaacgagtcaaatcacttttgattagactcggtcatttgaataacgatatcttggtgccgtacttattgcaggtttttgcaaaaacgcgtgatggcgtgctatccgctgatcaattagttgaagtgttgcgggttttgctggcctatctggctcggcggctttttattggtgtccccaccactgggctgaatttactgtttgctgcgctggatcgccaagtggagcattatgttgaccaggctaaggttgattatgttgaaggcttgaagttagtgttgacgcagatcgttaaagaaaataaacgttttccaacagatcaatctttaaaagacgcgttggttgagaaagattactaccacatgagttctatgtcactgtggttcattctagatgaactgaataatgcgagtggtgaggagcaggacttattcgatgcggcacaatctggtaagtattcgattgaacatattatgccgcgagttgtgaatagtagttggcagaaggctttggggaccgattggcgactggtccacaatgtttggttgaaccgactagctaacctgactttaactgggtttaatggtcagatgagcaatcgcccttatattgagaagcgggatatggcagacggctatcgtaagtcaggtattaaacttaaccaatgggtagcgcaattcgataagtgggatgaagcaactttacaagaacggcaggctgatttgttaacaagagcgttaacagtttggccacgtcccaatgtgtcaactcagcttgcgacagacgatccaaattcatgggatacgttggatatgattctagaagccaacccaaccggcactaagccagttgctttcagttttgttgatgatcaggtggttcaaattaaaagttggactgatttatacaatcaactgattgacctcctgtgggatgctgacccatctaacttttttgccatggccaatagtgatgaaagccttgttaaacatgttaatgaagtcgaggcagatcaacgttaccggcaactaggtgattctgacgttgccgtctacgcaggtggagatagcgcttggagtcgggtacaacacatcaaacgattgttagctggcagtgatcatgatttgtcagaagtaaatgttaaaacgcgtaaagttaaccattcataacattaagtggtgtgtgacacgtcaataaaccgaaaaggagtccttcatgtccccaatcgacaccatcaaccgcgtcatcaacatggtttcactagtcatcctgctcttttacatcgttaagacttaccgacaagtccgctcgttggactttttggactactttgtcctttatttgaagcatcgccagacgatttatgccgagatgcagcggaatccgcagatgcggcagaaacagttgttgtcgttgtttgttagtctcatgatcctgaccttttgggtgattggtagtcttgagaaactgatgacggcttggaatttgggaaacttgatcaatgctttgatcgtgttgtggttgtttggctactttctttaccagacttggcaaactaaatatctgaatgaacagaatcgttatctgacgtttgctaatcattttcaacagcaacattttaacgatgtgatggcgatctttcagcggaaattaacggcgtggtcagcggaggatgatgaagatgcgcaggcgcggaaacggtttcagcggttgttcgatcaggtcagtgagcaggcgaggcggcagcgtaaggccgcgatgttgagtgatgacatgtatgccttgtttgatgatcacctgttgcttcgggctgacagtaagccgttgactggtagtgagaagaagttgctgagttattatgtcgggtactgggatgctggtccttacaatgactatagtttgagcatgatagaggagatggatgaccaagagcggcgaatcgtgacgaaggtgcttaacgttacgatggcgatgatgggattgggtttggtgttactggcgattcggcaaatattgggctgaaaaacgcatgtaaactctgattgtggcggcgtggcgactaacttccggatgccggacatcatgtcgattggcttaggcggtgggtcgatcgttcgccagcagcaagatggcagtgtcacggtgggccccgattccgttggctacaagattaccgacgaggcattgacgtttggtggtaacattatcaccgcc

SEQ ID NO: 28 - DNA, 1383 bp, Lactobacillus paracasei
taagccgtgccctgatcactgtgtacggtatcaggcttgataccatcgttattctcgatggccagtttcattgttttagtagccaaatcagccgtctctgtcggtgctacgcaccaagcaatcacgctgtggtcatgaagatcctttacggcgcttagccgtagcctctgtttgttgtccttgccgtaggtgatctctgagcagtcggtcacccagactacgttaggagcgactgggtggaaggcgtgccccatgttgacggtgtagagcttattgacgaggagaaacgccttcttctccacttgacggtcacgctttgccacacgaatggaggcgcggatacctgccaaccgcatgattcggcgaactcggccgtgactcacgtggtattgcgtctccgcgttgatgtacgtcatgagccgtttaacgccgaagacgtagtgattcttctcttcgagctcaatgatgtagtcccggatggcctgattctcctgctcatggacggtcactttacgatgtgtccacttgtagtaggctgctcttgagacgcccatcatccggcaagccttgctaataccgtagagcttgcctgcgtctgggttcacttcttgtgcaagttgttgaatggtctgatattgttcgtctgaccggcattccttctttccaattcctggagtttttttagtactgccgcctccgttgacacatggaccagtcgcgcttgtagtcgcttattttcgagcttcagacgctcgatctcagtcagttgcccattgtctttcttggccttgccacgccgatcttccaaggcagattcgccgccttgcttgaacttcttgacccaggcgtatacctgcccgtaggagatcttgaattgctgcatcgctgcgccgtagttgtagtcattggcaatggtccattgtgcaatctcgatacgttcaatctgtgtggttttgcgtccgtccttcattggtctggccctcccagtggtttgtaatggttgaccactagtatacagggaaacccaccgaacaataacgctattgtcggggataccatattctcgggctagtactgggtacgatgtatgccccgcaagatatttctgaacaatctctaatttgaactcctcagcatacttctgatgaacgcttctgggtttgaggccgtctacaccggttgcttcaaagcgttcaagccattgtcgaacctgattatgcctaacaccatattctcgctggacagcccaaggtgcccagccaccctcacgaaccagaccaatatagaataatttctcctccagcgtgtatctggaaccctttcggcccatacaaaaactcctccctaggaagacaagctttaattatttgcttgtctacccaa

SEQ ID NO: 29 - DNA, 61847 bp, Lactobacillus paracasei
aaacacaatgccaaatgcgacaaaccatctgaaggcgtagtcaaacaatgagaaagatatgatggacgcataaagcgcaaatgcacaaatgataagcgtaaatatttctgcaatcattgatacaatgaaatctgccatcttgtgtcctccttattgctgtggagcaacagatgatggtgctgcctgagtagtggattctcctttgggtccttcctctcctacggggtctccatagcttggaccaaccagttttgcccactcatatttgcttggatcgttaccatcttcatcgtcatggctaaagtaagctcccatatacgattttccgatagaactcgtggttgaaaaaccgatcttgccatcagcactatctgcataagcaaaatggggatataactgtttagaattgtccgtttccccttgcagcgccttaatctgatcctctagcgccttgatcttagctgccttggtggtaatgagtgccgggtaagctaacgcctgctgactatcactaacgccctccgtggttggatcaacggctaccccgacaatggtcaataatgcaaacactgcattgaccactgcagtgagttctttacccaaactagcaaagtcccagttgtaaccgaagactgccgccaccgtttgaatcaccaacaaagaagctggcacaatggccagccagaatttgacgcttaatactcgtactttccaattaatcttcatactgaacattcctttcagtttttaatccgaagttgcaaaactttgttatatagcgcttcgcccgttccgttaccgcccagtgctttgtagctgcggaaaaggtaattaagatcgtccaagtcgtccgtgctgatataccccacctcgatatgatggttacacagcatgtaaacctcatgatgaagcaaaccgacaaggcctgaatcaattgcctttccatgctttcgatgcatgcgccattggcttgcaaaccaaccaaacaaagctccaccacccaactccacaaacatatctatccaactcttgaaatccacatctttatacttccttccataaaaatagccgctagcttttgctggcggcatagtcactgcctgtaatttgtttgtattggtcctccgttatttgccgccccacgtactgctctatcgggcacccccaagaatatagtgtgccacaaaattcaaagtcactcattttttccaccatcctcaagctttgtcacacgggcatacagcgcggcaatcatctgctgttcaggtgacggtccgggaagtggatgatcattagccggatcgtaaccctcatcggcaacgattttaccgtctacaagagatgcgtgatcctcaaaaaactgagacacgtaagttgcctctatgatttgttgaccgtcctctgttgatcctactttggcatcttccgcttcataggcccagttggtcaggcggttttgctcatctagccaaatcttaatcttcatcttaattcaccaccgcatcattaatcggatacgcatcacgagtaatgaaactcaagctgccagcatacccaccttgactacgccacggaatgatgtaaattccacccgctgaaacatacaattcacaggccgcacccgtatacgacatgctaccgagtaaccttgctgcatcatcattattaaatgggctatatcctggtcgaatgttggcaattttgacccacccattaccagttttcatttcaaaagcaatcccaatggtgacattcggaccttttcttgaatatccaattttcaggcttttaacatcattggtttcaagtccgctatcaatgtgctgatagaaaaccgaatcagccgccgtaaacgttgatgcaagcgtgacatctttgccagaaggattatataaagattttagtgtgagcatgccttggcgtgcatcaacggaactaacttccttaccatcgtacattgacttgctaaccaaccccaactgatcaactttagattgatacgtttgcttgctattactatccagcgttgcattcgtgaccatgctgccaccactaatttttgtcgtcccactgatcgtatttggaaaaccatctggttggatgtggttgaaagatgagataaaggtagatccgttaaaagtgaccccattaaaagtcatgccattaaaggtttcgacatttaatgctttggctgcaattggttttgaatcccaaccacttgtggtatcaaatatggcaaaagcggcaagatttccgtcctcgtcggttaaccagtgctggtccccagcctttggtttagcagggtaactcgggccaaccgtcacaactggaacattatcactaccatctttaccatcacggccatcttggcccttgaacaaggcccacaagtagcgcgtcgggtcggtgctgtcagcttgggtttcgtcaacgtactgcccgaagtaagatctgccgctagcgtctgttaccgaaaaatcagttttaccatcgatgctattagcatacgcagtatgaagatagctgctgatgccatcgtcacctttaggcccaggcttaccattagctccgtcttcgccctgaatcaactcccagcgattagcataatcagccggattgtcgcttgggactgaagtcttgtcagaccaaacaattgctctatactttttgccagctggtagtgctgacatgttagtacccttatcatcatcggcatagcgggtccagggataaaatttaagtgttttagccatgttggccatctggttggcaagatcgctgagccgttcgtcaaagctgactgtttcatgcgcgaactcacccagagtcaactgcactgaatggttagcacggctgcgctgaatgctcaataccttggcagacaggaataattgttggttttcatcggcgatgtggacggtttgattcagtggtacgtatggcgaattaaccaaatcaatgtcgtacgtttcgtttgggtggttatactttttcaagtctgccaaagccgcttgcaaaagttccgcctgcgattttgaatcaaacgttttaacccgattccagtcagactgtgttgggttagggttgctgttgcttaacaaacgtgaatatttctgcacagcaatggtatcgtgcaagaacccgtactgatcaagcacaaactgtcccgttggatcagtccatttgtagccgatcaagttgattgggtcctgattagttgatccattcgtactttctggcaccgctccataagccttgatcgatgtttccatgtcataggtatcgaggtgcgtgacgatattgttgatatccttattcatttcaaagaaaatcaagctgtcaccggccgtttcatgccgaatgttaatgacacgcttaaccaagttggttccaacaaactcaaagccaaaactaagcactgcatcaaaatcttttgccacggcaataatgcgagccaacgatgattcttcactagtccactcaagtgttcgaacattgtcaggaaattcgttgatgccaatctcccagccagaatcatttgtaaaccttgtgatgtagtcagcgatggtatatggtttgtcggccttgtacgcgccaacggtttcgttaatcaaatcattaccggcatcactagcaacaattgagtggatatggcctagtgaatcatggtcaaccgattcaatcaccatttggtgagcgttgccttcttcatcctgataaagaatgaagttggttgctttagccatctcattgactgcttgttcctgatcagttgtgaagtgaatatcaagagaaagctcgaccgcaggacgattgtcaacactttgtttttctatatcgttgtcaattcgccattcgcctttgccatcagtcgacccaacacccaaaatgtttgattttcgatctgcaaagtaatactccatttatagccacgcctcccttatctcgacttcacatgcaaatggttgtgcccagctcgagggcgtgataacaatctcagtatcaccgggtggcagttcaaattgctcccattgattaccgatcgtgtgcatggttgggtcaagagaaccattcaagtatgtcttagcattcgccacatcaatcttgagaacatcaccattgctaaatcgattcttgatattcgtataccaactgacgttctgccatttgacagtagacgcaatcagatacatggtcgattcgccccatgtcttgtctcgcatgaaccacgtcgaaaattgtttagtttcagtatcggcagcgtccgcaaaggtaaactggcgggtaatagtcgtctctcgtccttgattgccaacccatggtgacactcggaaaacaactgaattaccaaatttctgtaattccaactgaatgaacttttcgttagtgaaaatgctacgatcaagttgttcattgacgaccagttgatctttgtaatagcacatccaccaaagctgatcggacaatgcgctattatccttcagtatcatctgaaagattggcttactgtcactttctaacgttgtttcgagtgcacctacctttgataccccagtttggaagcgtgtcataacatcccatgtgagattgctcttgtagttgccgttatgcgtctggacgagattgtgcttgattgaaggaccgttccaatacttgtggtcgccagtaatacttggccaattaggctcaaccttccagccgtcataatcgtcatgagtccaaatcgcattgccaatctgttcattaggcatactaggatcaccaccccaatagggattgtttgtggcggcttgattatccatatgtgagccttgcacggctgccaaatcaagtgctacttcgctttcttcggtggtgaaaccatcaatttcttgcgtaccgaattgaagaataccggggcgatcattaacaatcccaaccatgccgttatcagcgtgcatagttgccgtaataactggctcaacaggataagtgccgccattgtgaaccgtgatggtatcagaatagtattcaggatcagctaggttaggcgaccaaggagaaacagtgggttcttgttctagcttaatattgtcaatacaaatccagccatggttagtaccgcttttaacaaatccaaatcgaagatgtgtcacagtcacatccgcagtcgctgtaaacgtagcagtaaatctatgccaagtagtttgccctccagtggtaattcgatttccgtgccccatcgaaagcccaaaaatcgggtttgcattgctgccacttagcaaataatctgaggcttgtcctgctgcagttcctgcactggcataatagtaactgtatgtccaagtttcaccagatttaattaaaaccgcgtttgctaacggatacattgcaaattggtctaaaacagtagatgtatcattactgtcaatcttcagcatatagttaccaaagggtatgggtaaggttgctcccccgctgcttgctgcaatagttccaattgctgatggtccccatgtaacgcttggaacatttcctgattcaaatccagaatcagtaagcatgttcaccggcacgtccttgtatggcatgttgtcaaacgtcttcgtggctaccgagtgcgcaatgccatcggggacaaataaagtgaacgaagaagtgattgcatttctgcccttaggaacatcgtcaacatctgtgagcacggcattccagtacacagacaagtcatcattgaacgaaacctgatgagtgtcaccgtgcaagatgccacttagcttatagaaggcggtgcgaaatgcatcatcatcatcagcaataagctgatagccaacagttatctcgcgagatggatttcgaacgtattcaagcgtttccccatcagatatgcctatgacattgctagtagcagattgcttaagaagctctcgtccaccaacttgcagcgtcctatatccgggcacaagattctcaatgtattgtccatcgattagcattgcttctgctggaagctgattatcatctgcacccgtgaagggtgtcgtttctctgaaatcgtacaattagactaacccctttcgataattgcttatctttgtcaaacgattaagctctgtttgcattgggtttgcggttgcacgagcaacctctcggccgtcaatatacagaggaacctcaatcgtttgcttgcgagtgtagttgacatcaagatttgaagacaaggttgcgccctgtagactgttattaagcgactgcaatgatgcatcaaagggagaagtattcactgccggcatcgtaacagcagcgctatcagcaatagcttgtgccatgctagaaacattactttggacgtctgagaacttgtcagtaagccctgcatttaagccgttcatgatggcgttaccagcaggtatgagcagctttgcatcgtatctgattgggcctttatgcttgcgaatccaagaagcaattccgccaacaaaatcggttatcttcccccaagccgctttgaggccattgaagaagctatccatgatagcgcggccagcgtcagccaagctaaaattacgaagcgcattgaatgctcctttgatgccattaactattccacttaccatgccagtaaaaccagaccatacagccttagcgccattaaaaatactagtggcagctccaatcacaatagactgtatgttgttccaagctgatgaaaagaatgatgtaatgctattccacaatccggaaaagaatccgggaagtgcgttccaaattccctcggccgtgctgactgttccgctccataatcctgataagaatgaaacaacactgttccatacgccctcagtggtagacacgatgccgctccataatccgctgaaaaatgacgaaagcgcactccaaatagcggaagcggcagatactgcaccattccaaagcccctctaaagttgaaaccaaagtattccaaacagtcattgcataggtttgaataaggctccaaataccggagaaatacgtaacaaggccattccatatctgaccagcggcggaaacaatgctgttccagataagctggagatcagcgcctagctgtgtccaatttgcagtaagcaaatcgatgacaataagaatgggacccataataactgctttaagcatgttccaaacaccggtagcaatttggacaatcccattccaaattgtcgtcagggaaccgccaaaggttgaccatacagcagttgctactgcaactattccattccacagagtcgtgaagaatgtggatagcacgttccaaactgtcgttgctgcagtaacagcaccttgccagatagctgagagagtggttgtgaatgctgtccaagcagctgatgccgtggtcgtaatcccagtccatagattactgaagaaatctgtaatgccgccccaagctgtctgaattccgctaattgcagatgtaaacgcacccgatatagcattccaaacagcttgcgcaactcctacaagtccttgccaagctccttgtaaccacgaaacaaatcccgaccatagtttttggccagtcttggtttgggtaaaaaagtacaccagaccagcaaccactgctgcaatcccagcaatcaaaagtacccacggattcatgcctaagatcaatccaaacgctttccatacaccaccagccgtttttacgatagttccgaagttagtgataacggatataacgcctctaatagggccgatcattttagaaaaaacaccgagaacgcttgaaaatccgccgatggctaatcccattactttgaatgccccgacagctccaaggatcgccgcagcaaatgatttaacgatgtcgttggcaaacgctgctttaacaatagctgcgattggcttcaaaacagccaccagtccgattagagcgcccttaacaccgttaaaaattgctttccacggtaaattagcaataaagtttccaacagtagtcatcgcttccattgctgctactccgaaatctgtaacagcttgtttgattacgttaaatattcctgaaatttgcccattaccgaatgccgaattaaaagcatctccgaccttttgagcaatactaattagattgacaaatgcaacattggctaagctaccaactaggctccaaatggtttgtaaaacggaccctactccttggagaacggaactgagcccgctcatcgagtcgcccttccccaaactgcttagttgtgtcttgatgttcaaaatcaatgccgaaaatggagaaaaaaagttgccgattgatgctataacagaatcaaaattaatggcgctaattttttcaatgattccgctaatagctccgacagcgactttagacatcgcctgccaagcaggctgaagcttgtttgccagtgtttcctgaaggccgtccattgcctcaccgactgtcttgtaacttgtggccatcttctggaaagccttgctgtttcctgccttttcgatgccatcaaagaactgctgcgtgcttacgttgccggcttgaacattctgaaccagttctttggtgctcatgcccattgctttagcaacggctgccatgcctgctggagtctgttcaagcattagacgaaaatcagcccactgcaccattggcttagcagccatttgtgtgccttgttccatcaatgtcttcatagcttgcttgggattatcagtggcagcagctaggccacccatacctttaacaaggcgaccaacgccttttacgcctactgatgcaaactgtgcataggcagaagccatgtcagatgaactgtaaatggtctcctgagcatatgattgtaacgacttttcaattgatgaaatctgtgcaggcgtcttaccaagaaaagtcatattactctcaaacgtctgccaagctttgcttgattcgtctagttctcctaccatgcttctcacaccatcgccaatagcccctacaactttggtaagtcctatggctccagcaattttgctcacggttgatacaaaattaccagctggctttgtcgaattttgaaagctatcgccgacctttgacgcagaactcgcgatattattaaaagtccccgaaaagttgcggtcaacggcggataaaattgcttcaacactaaaactgtcagccatgtgctccctcctttctttcagataacggaataattttgccttcgcgcttcaaacgctgaaattcggccatccgttttgcgaacacttgtgctctattctgttttagttctgttgtgctcatctgtgacacttcgtaattgggctcataatttgatcgcacgttatcaatagctgctttcttgtcaaagaagtcatcaaatttcttgaacttaggcttagggttcttgataccagttgttgcctgcacttgctggttcatccatgcttgttgtgcaatctcgttctgtctgtcgacttgcttaagctgataagcttccatgcgcagttcgtattcaacaagcgtcatgcgttcgattttccgaatatcagaaaagcctagataggcaaaagcgtttaataagatttcgtgatacgtttcttcactactcttttgaacgctttcgtcctcatctaggccttcatgttttttgctactgcttttactgcgttagcactgttcatttcatttgcaacttgcttaaatagagagtctaagtctgaattgctgtcaataaagtcatcgacttcattagctgacggacgtttcttagatgtcacggtggctgaataaatggtgtctgataaaacagcagcatcgtatgcattcagaccagctagtgcctttgcaacacccatgccaaagttaattccgtgcatgacggcacccatattcttatccatttcgcgaacaaagcggacgccaaagttaagctcatattctttaccgttaatggttaattgcatgatttaaaatcctttcttttaaagccgcccgggtttaacccgtactgtgactttcttaggcgactgattgacatggttactgggcgctgatattcgccccatcagatgtagggccaacgctaaccccacttggggccgctattttgacgtggttgtggtggttgttgtttcgcctgaaacgctcgtacctggatctttatcagaatcccactggacaccaccaccggtcttgtcagtatcagtgaccttgccaaccccaaggaatacgtaatcgacctgttcctgagtttcgtcatcgagagttgtccatccgcgtttaggcgtcccgttaacagaaaatgtgacatcgcgagtagagtggtcgtcaggatcattgtcgctgctatcttcttgcaccgttacctgcatataccatgcgagatacttaccttcagcgttcttgcgtttgcggtagagaatccaaaagtcgagcaattcgccgtcaaacagtgagtcgtacattacgtctgcaattgcggctgtgttattaagaaattcgacttcaagatcggtacttgccgagcttcttgttgctacattgccgtccttggtaacagtggaatcactgtcaacagacgggtcaaatgacagcgaagtctgccaagggataatttggccgctaaccgttgcttgatcgctatgtttgcgagccaaggcaacaacgtccatgccttctagcacttttaattcatttgccatgttatggcctcctataaaatattgagattgagtatcagcgtggctcggttgagaaccgtgtcagggacactctggtcttgtgtaaactcttttgaatggtcttctacacgtccatagaatcggtaatcatcagttagcacttgcccaatcgcggcacgaaaaaagcgctccgccatatcagatacggtgaaacgctgttttttgtcgccccagatgtcgattgtgattagcacattgccattgagcgacgtctttgttgcggtaggaacaacttgaatatccccaacaatgacgaagggataaggggcgttctcctgctgcatgggcaaatggtcgtaggtcttgtacccagatgattgcgagaaagcatagaagtagtcgtatagttcttgctctggtgatgtgatttgaatcacctactttgctgcttgtttaagctgattaataaactgcactttctgataaaggaacgcaggcttcaatacaggacgtgcccgcatgaaacgggtcccgttttcggtgtatgggttgtattccattgacatgccaactatgcccgttagaccgccatcttcaagcgataacttgatgccacgctttgtagcaccagtaggatgagcatacacggtgccggtcatttgctgagaacgagtctggagctgtgctgtttgctgcttgacgatttgtttgacaacgtccatctttgctcgcttaagcaaacctgccaccaatttgtccatgccttttatctgcatgttatagctaatgccagctttgctcatttcgtctcacccacaatcaaagtagcgttttgaagtgggacacggtcagtattgagggcataatgagtcgcttcatcgtcaatcgttaaatagctccaattgacggtgactggctcaactaatcggatcacctttgccttttgagcgtagtttccgaatagctgaacgctcttgtctgttcccatgtcggtgacactggcaactgcagttgccacctttttcacatcaccgtattgatgtgtttgcggatcatattcttcatcatcaagccagaatgtaacctcatgatctaaccgcatatgatcacctctttggatagccagaaatgaagctgacggtgccaagagacttagcattcttcccgttggcttctttccagtcgttgatgtcatcagcgaaatcatcgaagtcgttagacttgaacgtgaacgactggccttcttgctcataagacgtcatgccttcgttcttacgcctgttgtagcgtctgacgcatacttctagggcaatgtaggccaactcactaggaaaggcctcatccgttcgcaaaccgagcttaaatcgtaaggcttgtgtggtatttttgatgatgagattaagcgcaccatcttgtgcgtcagttttgatttccatcatcgtcttcaaatccgcaagtgttactggatcagcattagccatgtcatgcctcctttccgccgccctgctttcgcagcactgtgattttcataagcgacggtttactagctactacgctgcactaacggtaactgctaccgttgcagtgaaggaaccacttgttgcggtgattgttgtagaaccaactgctaccgctgtaatagtcccatcagcagcgactgtggcaacaccagtgtcgctagatgcgaacttagcagcgctaataacctcacttgcgttaaatgcatccacaggatcagcggatacagtaatttgcttggtagcgccaacttttagggacgccgttttctgactaagcgtaatccccgaagccggcgctaaccttttgggacattgataccggcaacaacaaacttcttgtcgattgtgaagcgatagtcaacgataccaatgttgcgaggatcaccaaccaaatcgtacatagatgttgcagaagcgttgattgtgctgtagccaagaccagcaaccttagtaacgtcggtgaatgacgtacccgcaatttgcattgcaagagtgcggcggttgataaccgcagtctggccaccattgccaagactgtcgcgcttgacctcatagctgttttctggattagccaagccataagaaacagcaccgttagcaatgatgaacgcgtccgtggtaccatctgctgcaactggcagtgcatcgtcttcaacaatctcaatgccgttgtagtagctgattggcgtaccaccgtttgatggctgaatggtatcaatcaggttctgatcacgcattgcaccaacagcggcagaattgagcacaatcttcgtcagttgagggctggcaacgtcacccatgcgagacaatgcggcaataaagtcaccagcagccaaaggagcaggcgtgtccataccatatgacttaacagcctgcaaatccgcattgaggaatgcgttcttcaagactgcaatcagaagcttgttgtcttggatgttccagaaggatgcgaattgccccgcgatttgttccgcaaccggagcgccggtagaaagttgaccaaagtctgtgtatccaaaagcttttgcttggtacatctgtggagcaatggcgctgtagctgtcaacgttgccgacagtaatgtcgctagtgtcgttccacgtctgagcttccccgctaagactgtgcagggtaggaatagttacataagtcccgcccttgagcaattgtgcttgaataattgggtcggtagtgagaatgccgctagagagcagacggttagtagcagtttgctgttccaagacataatccgcgaatactttaggttcgaccaaattcaatttggctgttgcaccactaaattctggcatatttgtttacctctttcattttgttagtaatttcttgtacatctctgggtcttctcgttccaatttgctgcgctctaacaaatccatatccttaaggcttttcgtctttcggttggaggacgggtccaatggtgtactgcctttcagcagttcttgacggatacgctctgctacagtttggtcgtgcgcaatgagccacttaacatttgcctcggttgattctgcctctggcgttacaacatgcttcaaatcgtcctctgtgaccgatagcttggcatcttcgaacattgaacgagcttgtttgcccatttggtagcttgcgagctgcgattttagctcatctcgttctttttgagccttttgaagctcataatccttcttctggtcagcattcatcttggccagttttgcagcttcgtcaacggcagcttgcttttccttctcggcacgagcaaggcgcttcttgacgatttcatttacctgttcatcggtgtagacgtgcttaccatcaggatcatggtcagccggttcttcttgcttcttgccttcaggaggatctaccggatcaccatcttttggcttagggggatctactggatcaccttgagggttatcttcagcgaaaaattgcaaattcataggcattaaaatcttgggaatcatgttaagaactccttccacagctttttagacggatcaggcttgcgtcttaatttaccggagcttttagagtcgatcacgcttggacttgatggcataaaaatagccgctagctgcggcttagaaattattcagtttcatcgtctggtgcatatggcgcaatggaacatcggcagttggggtgagctggaatatctggcacatcgtctacgcgataaatgcctctaccagctctcccaccttctgaaatctccttgcatatatcacacgcgcttggctcagccacccatttgcaatagtcatagccgaacttattgaagctatctaattgcgcctgtgtttgaattcgagctgactcagtacgtgcaattcgttctgtcacatagcggtgattgttaaccgtttctgccacttgaccgcgtaacttacgagcaatctttagtgggctctgtccttgaatggtggcggcagtcaatagctcgtccagttcggcctttagaatgtcttgattgatccagatgcgctgtgagaaggtgtaatctccctctcgtttggatagcagcttggctaaatcagtgtagccgcccttagataccgtctctccaagtattcctgcttgccgtttgatctcggattgataatcatcgctcaattttgatattagatcagcgttcactttcatgtgtgcatcaagcatttcttgaccaatctcactcttgagcatttctaagcgattaatgcgcatggtagcgttgtatagcttgagacgatcattgacatccttgctgaagtcggaatatttgagcggtccaccgttatacatctttctagcatcatcgacaatcgactttgcttccgcttgataagctttaatgtcggtggccattactgcttgacgcgcaccggccatgctgtcgttgctgtatgcggcatacttggcaagctctgaatcaatatccttttgaatgttggttaaagctttgtcaaaatattcctgaattcgggcattgaacgcctcgtcattcttaaggttctcgacaatccatttccgttcagcggccgttcgcttattccagtaggcagaattactcgctatctgttgttgagtcgttgttgtcatcattgccaccaccattcagcaatttctggaagtccgggcttgacggactgttagcagcagcgtcttttgctttctgggcggtctcatcagcgatgcgtttcatttcggccttgggatcatcgacaaatgataaggtgctaagcatagtctgatctgatacgaggccttttagtttagaagccgcgtccgcttcgtcggtaatgttctccggaagatttcgcgtgaatgcgaagttaagcttttgccagtcatcagatttactttctggaaggattgtcccaacactgaatgcgatcttgtaaagctcccggagtgactgagtaaacttacggtcctgattggccgctagattgcgcattggtagcaatttgtattgcaatgcaacgccagaactattgccgctgaatgcttcatcgttcaagtttgcaaccatgctgatctgatagatcatgctgatgaggcgatcaatgaggtgctcttgaatggcatcgccatcaggtttggtcagaaattcagctacgccttgagcagaatcggcgtctggagcatagataatctggttgccattaagatcgagtttggggttgccgtcatcgtcctcatcgagtttcaggcctttgagaaccaagtacgcgttgtcaaaatattcattctggtttgccttttggcttaacaccttgtccagcgcatcaattagcgtctcaacgttctcaaagatgccttgtcgctcggtgttcatgaagaactcaactgctggtacttcgttaaatgggttaaatccgtctgtacctttaaagcgaaccatatcaaggccgtatattccgtctttcatatacaccttgccagttaaattgttgttatcatcatgccaatacatgacaaacgcaacggctttatgtgctaccgtgtcatcatagatgaggaacgaattgataggcgagctgtacgcaatacacgtcttgctgtcttcgtcttggtacaaaaaagcaagcgcccgtccgtaaatggatgcttgcttgctaatttcgcttaatttgtcctgaacgctgttcgtgtcgttccacccttgcagcaccgcgttgtcctgtgtgttatcaagcgtgatcttcggtggaatgccgatgtagaacccattgtaggtgtcaacgatatagtgagccaagttgccgacaagacgattatcaggaccgtggtctttggcatcttcatgaagaatcttgtgcttgccaagatacatctttttagcaggcagatattttctgcgagctagttcatcgtttgcactaatgaaattggtgatgtcgtccccagtaatagctgtatctactggaaaaatgaacacgtcaccatctgtaattgagcctttaccttgaactgttaatatgatggccacctccttagaagtatttgcttgtgttcttgaacgtatgagctgcatttctccgtttgattacctgcatgacaaaatacctcatggcgtccattgcgtggtcatgtgccttgaccactttgtcttcacccttttgactggccttgtcatcccacacataagaagcgaactctttgaacagattagttagcccaggtgtaaacataatctctccagagttcatagccgtttgtgtttctctaataccgtttaacacatcgttattggccttaataactcgataccggcgttctctcaatttggtaataaatgaagccgctgatggatcaacaatcacttcacagcgtatgtcaccgacaaattggctgaaatcccgagcgtattcatcatctgtcttctgtctgctgctatgccgtccatcgtagtaatactctttgaggcaataccaaacagacccacatttaccccaaagtaagaaaactgtggggttctgtgtgccatagtccacactgacatagtatcggcttggctgctggcttggattgctgaccatctcgtctttattgaagttgtcgtagacaattccatcagccagaacccattgtcccagaatatatcgctggtaaaacactcctgagtacatatgttcgtacctgtcaataacttcatcgctcaggcttggattgtccttcatcacaaagtggagacgcaatgcgcgtttatcgtctgcttgatcaatccaatcagtcttgaaccagtgatacgggccctctgggttcatattgaaccagtatttgccgccagtaacggaaacacgcgctgtcgcttgattgacaaacgactgtggcatgagagctgcttcatcaaagaacattccggcaagtgtgatcccttgaatcagatcttggctgctttcatctttaccgccgaataagtagtataggttggttcttccatcaatgctgatttcaagcatattttctgaacgccgatccacaaccgagaatcccacttgttgcaatgtttgtttgagtggcctgataacatttcggcgtaatgatccaatggttttgccggcaatgccaaattgctcgcggtcaaacataatcatgccccacagaacatagctgatcgacatcgcaaacgtctttccggaacgcacagcaccatcagcaatgattgtctgcttgtctggatagcggcgccaccagttgatgatgtctaactgtttccctttgaattgatcaatcggagttgtcattgacatcaccgccctttgggatactctcatcaattgctgccaaaagcttgttcagtcctccatcttggccttctggtgtgcgataggcgctggccttggcttccatgatgtcagcctcagctttggacttgcgaacttcttcggccactttttcggcttgtgcttcgttcaattgcttgaatgcttgatcacggaacaactccggcttgcgattcttcaaccaaaagatttgggctgaggtatccggtgccagctcgttctcattgaccattattggtatcttttcataagtaggaacgttctcaattgatgcttgaacaagttcctttctagtgaactctggatgatcaatctgatgttcatttcgccacctagctctttttgcctccaatacgtcatctcgaataggaaccattttataagtcgtattagtgatggtcatacctaaagctcttttaactagtgaaccagcaaccatttgatcaacaacttcttttcccctctttagggcgtcagaaatgtcagaatactttttcttccagtcataaagtgttggcctcttgataccgatgttatgggctatttgttcatcagttaggccgtctcgcgcccacccttctatgagagccagtttttctggtgtctgccactcttgatatttccccttagccatcacatatcaccacaccttccttccattaaaaaagcggtagctagttagctatcgctggttataattcattaagctgttgttactcctggattgtctttactaggctgtttcttcttatcagccttggtcttgtcccgctgttttttcaacttgtccttgaggttcttatagacgtcttttggtgacggcaagtagaatgccacagtatccaccccctttttgacaagcataccttactttcaggatgtgcgtatccgcctcgcgtcttaacttgattagagcgtgaacggacaatttctctgtcaatcttgccgatggtccacgcttcaactttcggcatgtaaacgccgtatttggttgtaatcatttgagccataaaatcacctcacacatagtaaatggcacgggtatcatgatcgctgtattcgaccagctcaaacgttttgtgagcaaccacgccaatatcatcagtccatttgtcggttggcttgcgtgttgatacttgacgctgaacgaatccacctaggtctttgctcatctctgaatgcagatgtcccgtgaacagctcgcgattctgtgccgtgcctaacatgaatccaaactcatcgaggtattttgcgaggtagttgttcttgcccttgtctccgtgagtggcgccaatgaagttgtgaccaagcatagcgcctttgtaatgcttcagcgatatgtcccaagtgatgtttgtttggttgctgtaggcgcgtttcaataaccgtgcgaacatatatccaactgacggatcatgatttccggcacagtacatgacctcacactcattggcattcttaatgattgcttcaatcagtgtctcgaagtattgctccatttcgttcacagtctcgcctaagtcagttgtttcgagctgtgtgccctttgccgtggtcgagttgatattatccacatgagccagatcaccgcccagaatgagcaatattttggcgtagtggccgcgttgaatgattcctaattgccgtttaagagattcagcatagatgtcgaatgtgtgaccattgaaatgtgtatcaaaagcaggaatgaccagataccgatctgattccacaaaaataggagccttggcttgatacggctccttgtgtgtgatgatgtcattcatcaatgattcatattgttctgcttcaactaacggcctaatttgtatcttactctggtacaacgttgcttcaggagtctgcttccagaagttgcttgtggcacgtacaagctcccacttggcgtaatcgtacccatgagcttctaaaacctctctaggcgtcattttgtggcccctgataacctttagaatggtttcactggactgtgtgccgtctgaatcgtactcattctttagtggcttttgaaactcaatgccaagccgtcttgctttaccttgaagagcatcgtagctaatccctagcttgtcggccgcctctcgtctggtaaaaccttcagaggcgagcttcctaatgccactgatttgttcatctgtccattgcatctactcgcctccgaaaatttaaattatatgtccgttgggtcgtcataacacggcccttcttcccaccatgatgcaagacacttagaggatttagttccttcagggtatttattgtctagctccattgtgactacgttgtcatatccatgtattctggttgacatataatcatcgagcttggctttatcagttgtagcaaatacaacatctacctctgcagttccgccttcccattgatcggcgtccccagtctcgcatacaaccaagtatagtttcatgccctcgcctccgaaattatgtataaaaatagcacctcaccgtttggcggagtgctattaaatgttactatgttccctattttgtaaaacctatttgacgcattttaggcaatttctggctttccacctgttgctgatataccgattcgttaagagcaagcagtgatacaacatttcgtaagaaatattttttccccaattggttgtggtcaactatatatccctgcccgttttcaatcttaggaacaacattgaaatcgaagtattctgggcgttccttaatttcaattgtttctccatccgccatcgttaaaatataatgtgtcacaaaaatcacctccaaacaaatagtactccagcatgaactggaatactacattgaggtgatatctgcgcttcatatctgctgctcgctctcccagtgtcagatggggtcatcgcaagctgtgtccggtcgctaaactggacaatgaggacggtgggaatcgaacccacacatatgacgtccatatgctttaccaaacacgtcctctgtgctgtccgtttatcgtcccctcaacggtaagagtggcttttagccgtaacagacgatacagcacattgcgttctgatgaatttctcatcgaactatcccgcgctggaatcgaaccagcagccgcacgcggcttctacatcgggattaccttgccacagctttatcatcactgaggctcggaggaaaaacgcggtgtcttaggtttctcacctttggcacaataccatcatatgacggaaatactggtaaatagtccgcaattagtccgcaaagtgtccactctgcttttttaccaaggtaactaatggacataactcagcaaatgcgtacagtgcccgatttctagcgatataaaaagctgatcgttccatttttagtttcgccacaatggcgtcattagttagacgcttgctcggtgagataatgtatgtttcccacaagatggtacgataatcttcatcttcaatgacattgattgcattttcgcaagcattcaagtaatacagttcgtcagcgtgcgacacaagcttttcctcggctttgttgccatagcttggtgacttgggcatgtcgtccatcacgggacttctgagcgctattttggtgcgttgagcgagccgcttgtgatgccagtagttccccaagacctctttggcgttttcaattgttttgtcatgatcaattgggctaaaatatctcgttgctcgcaccactgcgtccactccttatggtataatgaattttgtaaaagtttgggggatgagcgtgccgtgatggtgcgcttttttgatactctaaatgtgctttcaacgcgtgcgtttgctatactacctgtggaggccaactcctaatctttgatttcatttactctcaatcgtacgtctggcctccggcgcgtccttcatcagacgcgcttttttatttgcaatcattttcctcttttccagttagcccacatccacattgcaacacctgcgattaacaacatgacggcaatcattgctttccctccagcctgcgtccgcacatcgggcaataattaatcacgattggatcatcaacctcagcattatcaaagccaacagcttcgcatgtgtgcattgctgcaccgtttatttttttaggctcgattctatcccattcatttccaccagtcataccgattcgaaggaagttgccaagttctgattcaatgagcttatgtggttcatggcagtataggcagtccgtgtcgccgtcactggctgcagcgtaacgggcgcttaggtcatcgtaggccatctcccaactactaccctgctcgccgaactcttccaatgctctcaatgcgtcctcaaatacgtcctgtttagtttcattagtcatgctcggtcacctccaactgttctctgttgtaattgatttggtgtatgtcttcatggtgatgtactcctactcaaattcgattgctggtgtgttcaggtactcaatcaagccaaggcgttccaaccgctcatggttgagacgctcgcagtataaatctgcttcgtactgagacctgaattccttgatttcggtttcgccattggggcccacaatcttgaatttcatttttttatcaatcctatccagttggctaatttcttcaaaatatttactcatttctccgcctctattcttctagtagccagtcaatcagcttttctaatgcccaaaaaatgatccatataactgtcaataagccaattaagaaaaacaagatagttagtgacttaactattccaaattcgatagcaggcttaatcaacgcataccatagtgcaccggtaagtccgtaaatgctgacacctgccaaagatgccaaaataatataggcaatcgcgtgcttgattttcattcctagatctcatcgccattctcgttgacctcaactacgttccactcatatggcaattcatcaagcaaattgtttccaaagttgaactggccattttcagccgatagatcgtaaaatcgtgctgctttaccatacccgggtgtatcttccatcaaatatgcagggtagattttgtctttaaggtaaatgcgaccttctgccttcaaatttccagttgccttaaaatatctagtcttaggaaagctcatttctccgcctccaatttcacgatttcgccggtttcctcaacgcgccagacacccagcacccatgcacgggcgaatgtgtcttgcagtttgagccatctatctttatttttatcagtgtatccgccccaaacacgaaatgttttagcaacttcgattgatgtggtctcatcgcccagcgcaaaagacaaggaatcatcatttgctttacattgctttatccaatcgctttgggctttcggaatcaccggcatatcatctggcaaggcggcagcatagcgagaatcataatcgagcaattctcccgttggatgtaacgcccccggcacagcaatcgcgtcatcatatgagtctaaaagatcatcgaacacttcccacttcgtctcattgctcattgtctttctcctttttgatcctcacgaaccccgccgttttcagaatgcgaacacgatcggcgtcagtgatgtcagtggcttctccgtgattcagtctagcttcccatacggtggtaattgggtttgccttgaatatgctctcaatgaaatcagtatttatccaattgccgctttcaagctcaacgaatgccatcgtcagtcacctcttctttttcgcagtcttgcaagccgtattgttcaatctctgattcagttaatcgaccagaggaaagagtgctcatgtttttgcgttcttcaattgaccacgtgatcgtatttgggaaagtaaatgatcggtacgcttgagcaacttgctgatttttttgctttccgcctagttctttgaataccagatacttcttctcccttgccacggtgtagccgttgacgtaggcatcaatcatgccccacgcctcatctttatattttgcgagaatgttagaaaccgcatcaggattgtaccggccataacgagcaaccagccagccctgacgcaaagcgtccgttttgctgaggactacctttttaggttcctcagtcagcacgacaacgtgaccaccataatcatgaacaatagccttagcattatcttcgctgaccataaccggacaatacgattcggacaatggcagaaattttgcatattcacagtcaaaatatttgccatcatcgttctttaccgcgtacagtttttcttcgctcatttttcgtcctctactttcgtatgcttgtacaaagttcctttgatgtccacgtacaccggctcaccggtcacttggctgatgtaaacatcgtctacttccggctccattggccagcctccttcaatcgatttcttcgacttcaactctcgggttagctttgtcaataaagaaccgatctcgcagttctacaatgtgatcccagttgtcgttttctaaaaattcagccttttgcatgccgtcgaagataaacttgtgctgaaacgcgatgttgtccgggtctgttcgcttgtcataccagtaccagtcgaaacttagaggttttccccattgaaatttcacgccctgattcatcgcttttctcacagccaacattaccgtttccgttgcttgtttcttgacttttgctccgccgaacatgttgcctcgttcaaccttgatgtactggttaagagtcatgaggggcaatggaataatgatcctgttcacgctggcttcacgtccttcagatagtattgacgttgcttgccgtcaaccatctcaaccgttgtgattagctctttagacgcgttgccatcaaaaataaccggcttgttaatatcttgccttgttcccctagcgttgtatcgttcaatcctgatgattcgtgccacaccgccaagatcacgcacgcccatgaatactcgatcaggaaccacaaccagatcgccgacgttcactgttgatttaattgcttgcatttagaatgcctcctgtttaatgctcggtttcattgaaaaatctagtgttgcgaaatgcttagctagccacaataaacgcagcaagctccccgatacgccaccgtcagcacagatactctctgacgcttcgcaaatcatgcgcgtatcagcgtgaataacagcgcctaaaagtacgataatgtcttgccactgtgcttcggtaacgtctaggtagccttgatcataatcgctttcaatgtcagctatcgtttgattcaaggacgcttcgtaggccagcaagtgcttgtccaaatgctgcaaagctctatttgtcatttcttctgctgtcacgatcttttcccccttacgtccgttaacttttcaaagttcaatgtgcagtcttttgattttggaataattcgactgatgagtttgctgttgtacatgtgctcaagctcgctcatctcgttgttagttgtgatgattgttgatagacggggactgttgctctcaaaatcaaggcgggcatttgcaacgcgatacatcagctcttgcatgtcacgtctcactggcttgatgtcgagtttcataccgccttctgttccgaagtcgtccaacaacagcacgccagcctctttcattgcccgctcaatgcctgccaaacgcttgcgaacgtctggcgcatcgtattgcaagcccatcaggttactcagctctgctgttgaaataaacagccctaactggccttcatctcgtagactcgtaagcatcgctaaggccaaggacgttttacccgtcccacgcggtccaaacagaaccacgttcttaggcacttccgccatttgcttggtcagcttgtatgcacgattccccagattcctagagttttgctgatccgtctgcatttcaggccgccatttttcgaacgtaaacttagccggaacgtttccggggaagactgagtagcgataaatagcacgtgcctttttacggttcaatgcggccatagagcgttcgtagaagcgccgttcaatctcggcctgtgttggcagcttgctaacgtccattcctcgcttttcgattattttttgcacgtccgcatgtgtgaatagacctttagtcgactccatatccccagttctcctttttcggttcggtgtgtggcgttcggtttgactggcgttcactatcgtttgcttcgacagcagcagccgtgagaagacgcttgctctcccagtttttcaagatgccgttgacgtacttgtagtttctaacattgctttcaactgcagtccttagcgcctttagaactagcttctcaggttcaggtgatcctgcttttcgcatgtcatcaacccaatcaacaaggctttctctggtgaacggtgatagttgtccaaacccattgccttcccagaaattgcaaatatcaagaattgatgatgacgacgatgacggttcttcagtaggcctctctgctgcctttactggagcagtagtctgttgtcgtttagttttgtctagtttagtctcgtcttgtttagtgtatgtgctactgtgttgcctactaggttgtaaactaccttgtaaactgtgttgcctactaggttgcctactgtgttgcctactatttgacacactgtcatcagcttgactaccaggttgcctactatctgacgtactaagttttcgtgaaatatcgattactgagtaggtcgttgccttaacaccgttagtttgaaaatctatcagccctgactgttttagcgcgttacgggctttgacgatgccctgacggcttaaaccagtcaacgtttcaagtgttcgattcggcatattgaattcgcttggccagcctagctggttacattggtaaaccagcccatgccataatgctatctgtcctgtgcttagcggattaacgctttgctgaatgtagaactctcgaattagcttgaataaatccatgcggtgagtcacctcctactcgactagctcatccatgctgataattgtggcgactcgtttagttgccttgcagtaatcacaggcctcacatcgatgtggccgcacctgaccggatttaaccgcctcaacgtgttcggtgctgtcctggatctcttccagtgcctcgtccatacggtactgtggcacttcgatgacggcatggtcgggtacatcttccttggtcacggcaatgatgaatgctcgtggtcgcgttccgtaattttggtaaatcagctcctgataaaccgccatctgaagctgatagttataggcatcaacgaaactggttggctgacgttctcctggtttccaatacttcttgtgaagcgactgtgtggtcttcagatccaaaaagaatgactttgtggagtcgaagcagtccagcttgcccatccactcgaccccaaacagatcaccggtaaggatctcttctttttcaccctgataaagtcgttgaacattctcatcagcttcaagcgtggcaatcatcgcatcagcttgtttatacggggctttcagttgtccttttgatgatccacgagttgagaacatctctgggtgtcctttgataaaagactcatgagcttgcttggattcgaaatagctgtgtagatagtttccaaccagcaaggcagtcggatcacctcttggcgtccatttaccttgcaactcggccatcgcttctgcttcgcatgtcagaaatttcttaaaccaggtagcagactgatatttgaaactggtatccagcgagtaataattatccttgttgaccgtcaaagatttctggttgttttcctgcatttgggtcgtgggtaatgtctggcttaagagcatctggcttcacctccgattttgtgacgggttcagcgggagcgttaagtgcatcctcgatcgagttaggatcttcgggggtaacatccctcagttctggatcagcttcgactggtttttcatcggcactgaccgcgctttgcatgtcggttgtcattggaccccacttagtcagcagcgatttgattaccgtcttcagggccatagcttcgtagttgtctttccaaacgcccttgggctccgcgccaccgccagatttgctgaaacgcttgcgatgatcatcgacttgctgatatgtccaatagaccatcttttcaaaaccgttagtcagtttgaacgatgcggcatagccaaccggtttttcgcttgcttcgcgatcgtggaagttcggcgtgtactcaagttcctccgttagtgggttccaactcttgaactcatcttcataaattggtaaagcagtcaggcgctgatatcgtcctgatcgttgagctaattggatatagcctttataaccaatctgtggctgcgcctggttcttgtatggaacgatgtagacaaaacccaggttcgggttaaccggaagatcaagcgttgctgctaccatggccgagttgataacacttaactgatcaactctggctaagcttggattaaggcttaccgcgctggcaatcgatgaaagaaactgtggtgcccgtttgtccagaagcgctgcaaacttgtttcgaatagcctgcgtctcaattagttgcttaaccggcatttttgttaggtcatattgtgtcgtcatatgctgctcctcctatttccattcctgaaatccttgattcttcatgaaatcgataatgtctaagctgtcatcactaaagaaaatctcaaccagttctgcttttggatacgtagaactagcagcgtcttttaagaatcgctcagggccgtgaatgttgatccaatcttgcaagtattccttcgccttgtctttgttaaaggcgccttcataacgcgatgtagcacagctttgatagaaccaaggtttctttgtatcaacttcatattcatcggcggtggccaagaactcctccgcttgttcgatatccatatctttgggcaagacggcaccgtgataggattcccaatcagcaatggctttatcttcaagcgcttctcgtcgttgatactcgttcagaaccgctgtattgtaatcaagcatggtcatcgaccgccttccgtgataaaattaagtcataataatatctgctcagtttctgatttcccgtagtaggagctacgggatttttttgtgctctttttatcgtgtccattgtttccaacctcctactgctgtggcaccgatcatgatgccagccagagctacaagaagatatttccaaaaggctgatgatgggtcgaacagcaccgacatgattgcttctaacatttgttaggcctcctattgtcgtgcaaaccaacgctccatcttctcaggctcaactcgctgtgttttacctggtccaacgaatggagcgccacgcttcttccaacggctcactgtcgcagcagaaacctgatagtgtgccatgacatcttttggcgtccaataaattttcggtttaaatggcttgcgtgtcctttgcggcttagtgggatcgatcagtgtgaatccttgttccatgcctgctcatccttcctcatataatgaagtttttgataatgtggaagcctttcgctgaaaagatccataattgagatgcctagcatttcacaaatggcattcagctcggttagatctgcgactgtgctatccaacttttcgaatgcgtatgctttcaagtttttagcgtcatcgcgtgtaaagttggggtcattagcaaggccctcaatgtcgtgcttgatgaaagaagctttctcctcgtcttcttctcgtttatcggtgaataaaagcccgcgtaaatcgtggtatattccgtcaccgctaaacagcttagggattcctagaaacaagttagccatttcatagcttagttcgctgtcattcatcgaattggcaatgtcagtagcctcatttgctctaatgggagttccatgaaaatagttgttgatcgttgagcgccctaattttgctgcataagcgatcaccttctgtggcgtgttggttctagtagcgaacctattcaaagggctactaattgttgctttcatacgttccacttcctttaaaagatgaaatattggtggatattgattcatgctagagaaggctatgattaacccatagcaagttgatcagcgtcttcagctagccattcgttaacgtggcccttcaactgctcttcaggcatttgttcgaatgcaaaggccggaacctctgggtagatgcgggtcaaaaaatcaatcattgcttcgcgttccatttgactcacctccttaacttgaaaacttaatattgtgtgattgcctcacgccgagtgcgataattgcatcgaagggaggtgattaaaataccaaaacgagtcagcgttacaagcgaaaacaagtcagggcgtaatgagaagtttcatgacaacttcaccggaaagaacatgaatcgttctcagtttgtacaggccatacagaatggcgagtataaaaactacaccgttagaaacctgcatggcttaaaaactccagcatctaagccagacagcaccactaacaacaaccttgattaatcatcgcttgtaaaacgtgcatctttctcgttatcaacaaagtgtacgaagaatcctttggcggtaatgcaatctgatgcgcttatcgaagcaattaactcgttatttctggtcacattgatcattgcgtatggatgtcctttaatgatcagctttgacgggtttttggaggtctctgctggttccgaccaatcagtagagatctttttaatcccatcagcgtcaatttcaattcgctggtatggatttccttgttcttgcaatatttctgcaatgcgcaatgcgtgctgtttgagttcttcgttcatttgactgcctcctctcgctgggcggaattgtgtttacttaaagttgactgatattccaaaaaaataagatccggcttcgtttttaatgcagtggcaattttaaatgccaattcatagctgacacggcgttctccgcgttcgatcaatgaataatatcctttgctaatgccaatcatatttgaaatatcttgcattgtaagatgaaattccttgcggcgttctttcagcttttcgttcaaatgatcacctcctaatcaactttatgtaaacactataatctacaattagtaaactgtcaactaaaaaagtgaactttttttaaactttgttgagtttacaatttgtatacactattctattcctatgaggtgatatgatgagcttcggagaaagactaaaagaacttaggaacgaaaagaagatgacccaatctgatgtcggaaaaattataaatgtcagcaaagcgtctgtttctttatatgaaaagaacgaaagaactcctgaccaagattctattaagaaactagccagttactttaatgtttctaccgactttttgcttggagttactgatgttcgctcaaagccggagcaaattgacatatcagattcaaaaaatgacaccatcatgacttttgaaggtcgccccattccgcctgaagatcttgagataatcaagagacttcttcgaggtggcaaacatgatgactgaatttaccagcgagatgctgagagaagttttaaactatggatttgaccgtggagtcggggctgagctgacatataagctaaaaccgtacactccgtcagtttctaatcctgaaacgcgttggattgcggttaatatgaattggcatgaaccaaaacaattgccctatcaagcggcacacgaaataatgcatgttctacaccaagatccagcttgtctgtatttctattcagcatcaaagaatagcattgaaggtgaagctaacattgggggaattcacatcctggttcctttatattttgctggcattgataaagaagacgccaatctgaatcagtttatgaaagcgtttgatattccggcgtcaatggaagatgctgcttcagaagcgataaaaggtttttatatataactgattgttagtccagacacggaagacgataaaagctgaaaattatttatggaggaaaacaaaatggcaaaaaaggtaatgggtgctgacggcaagcagtataaggtaaagaagcctttttacaagcgcgtttggttttgggtattagttattattgtggtagcagcgattggcggcggcctcaataataaggggaaatcaagcagcgaatccacagaaaaaacggcagttagcaaaacggataaatcatcttcaactacagcctcatcttcggaaccggaagataaagtgtataaagttggtgaagttgcaagctataaaggctatgaaattaaagtaaataatgtcaaattcgaccaaggcgatgacattaacactccggattcaggtaagcaatatgtaatcgcaaacatcacaatcacaaacaacaccgacaagtcacaagattataaccccttctttttcaaattaaatgccgatggtaacaaaaccgatttcagcgagattactacaaatgttgaagatactcttcattcaggctctttagataaaggtgctacagttacgggtaatcttgtaggacaagcaaaaacagatgctaagtcattacagcttcaatatcagccatcattttggaatgacaagtcaatcaagatagatctgaaatagtgtttatttccccaagcaattggtagaagccaaacggcttggggcttttgttgggcacaaaaatagcgccccctagaagcgcaaaagtaggtgtattatcatactcgataatctaaagaaagaagttaacgaagacttagatttcgaaacgaaggccctagaaacactatcgaaaattgacttcgcactatttggtgccaccctcgccgcattattcggtggtaaatttttagcaacactcgtctattttttctggggagttggtgccttggccgggttctgcttgattactctaggattatcttggcaccgcgatcatatgtatcacgtcaaactcatcgccaaacttacagaaaacatgaaagggctggacgagaacagcgaacgagtcaagtccgaacgtgattatgtgcaaactctgttagcggcctacatagcccgcgacgatgtacgctttgaagaacttgcaaaggagaaaaacaagcatggcaattggtagttcattcaggattgtgaaaattatcgacccgactgcttttgttatcaacgccgggcatatgaaccatatatacaaaggcgacaagtttcagattatgggtaatcaaggtgtcccggtcgttgaccctgattcaggaaaaaccttgggaaccctcgacgaagttaaagcagtcatcgttgcagagaccgtctacgataacatgtctatctgtcggtccgaaagaacacagccgggatattcagtcttaagcgcaataactcgacaccaagagcttgatgttgataaatctcagattaccggcggtactccacaatcgtcaccaattaaggttaacgatcgagttgttggtatctagtgtacaaacgagtgcgtattgatggcggcagataattcatactcaagttgactaaaatcggaatattcagcaaccgctcgtcgataatgctcttccgtactctcatcgggaaagcgggagttgagcaagtttacgcgtaagttaattgcctgccaatagcttaaactcgacaccaaagcttgaacatttttctccggtgattgcattttggcctttggtctgaacatttatattccccctttttgacttacctacaatgttgcacctatagaatatcaggaaccgtgacacctactacaggattacaaatttaggaaatcagtttttaggctttatgatgaagccatcggtctccgcaaacacacaaaacggcgataattagccaaacataccagtattttataaaaagatggccaggcgttaagttgatcaaactatcaatgaaacggctcatgccgtcacctgctttcagttacaagtaaacacaattcacttaattatagcaaagatgaattgtattcaccatcaacggctaatagccccgccacccgcatcaaattaatagttaagacaaggagtcttacttatggcaaattctacgatcaggcaggccgatatactgttaagagagtgtacagttatgcaggtagctacgcttgataccgataccggtttccctaatatagtttcgctgacaccacttaaatcacaccgatcgcttaaagagatccttttttacactgatcgcgacactactaccattcacaacgtcctagagaagcctgtggtggctgtttactgtttcaatgagctacaccactcatcgttgctattacgtgcaaaaacagctgtattgactgctgaggaggtcttgccaaactttgctgaaaacctcaacacttttcaaaaatcgctacagtatgatcgccccgtcatcattcgttgcacaccactaaccgtcaagattagatacaacaatgacatcgagttcagtaagctaaacgaaatctaagcttagttcttggagatgtacttatgaacggtccagatacattaagcgaggcacacttcattggcctcatcattgttcttataggcgtctacttcgccctgtttggccacaggcatcattgggttcgttggctcattgacccagataagcccggcagcaacctctggtgggcagccgtttttatcattatcggcgtgctcatgatgatggttagaaagatgcaataattcggccccaaaaagggggctagttttcagacaaagaaatagccttccgcggaaggctgcgtgggcgatgaagcaaaactaaaaattaaactatttgaaggagaataaaatggaagaccataatctgcatgatgaggctgaagccgaaaaggaactgagagagtatatctatgttgataccgacttaatgaattccttattagcccagtttgacgaaggcttgagcaccctgactacgcgtatgaatgagaaaacctccatactgactcaggtcgcaactaaaggtggaagaaaatccgcaaaaattagcggcggagtcccagggatagcaaatggttcaggatcggccgaagatagccactctatggcagacgaaagttcaacacataataggcatcagtattcagagaatatagtatacggtgattacggggtcgagatccttgaaggctatctaaaaaaacaatttgttcctgttgagaatgcggaaccaggagacttggtactttacaaagatagcttttccttatacgacttcgattctcttgaagccggtaccaaccctgaaattattgatccagtgctgagattgtctacagataatgtttcagaagaaaagttagatggtttaaaaaaacagctgagagttctccaagcaaggacaaggaatgccagcaacgcgaaaatgcaaatagatgacatgaagaagaaaatccaaaaagcagaacaaaagataacagaggacaaaagctcgcaagagaattttagaagtgtttatgcaatggtgaacttcttttcaaaaagtatgccgaatagtgtcattgtttccactgagcaaaccgttgtttttgcacaaaagtctctttttagattaagcccatcacaacttcaaatgctacaaaaaaatccacgaaccctttatataatgggaatcgtggaaaacaaatcagataatacaaattggaaacaccaaactcttacaaattctcaattggcaccccgtgatattggtgcgattgcaagttacttatcatcaatcgcattgactaactttggcatttcacaaaaagaggattctttaagaattcggcctatctctatgtatttttaaatgtcgtttaggtccttggtgttccgcacttggtttggtggtcagagaagctttcttcatttcacgatcaatctcttcttgcattttctgaattttagagtcttcacgttcgtaagtttttttaagcgacgaataaagtttaaccgcgtcttggattttgaaagccttcatcatgccaccacctttccatgcaatcataatataaaagttgcaaacggtctaccaaaagaatctatccatttagaagcaacggagccttgtttttaatgaggcttttattttacggacataacgaacatacgtttgaattacaagctctaagagttcgaaaggagtgcgatatcatggcatcaattacctcatataaactaaaagatggcaaaaaggcctgggaattctatatattcgctggtgttgatcctcagacaggaaaagaaataaaaattcatcggcgcggttttccgaccgaaaaaatagcccagcaagaagcaactttagctgaggccgaaataatcagaggccactctcactaccaaactgaaagaattttaatggctgattatcttaatcagtggatcaccaagcttaaggttaatgtcaaagagggatccatgatcatctatcgatataatcttaagaaatacatcatcccaaaaattggggatattcgactagccaaatacacgcttaaggaacatcaggagttcatcagcagtctattcaatgatggcttgtctcttaacacagtaaagctcatcaatggaacgttgcacaatgcattaaaaaaagccgttgcaattggttacattaccaaaaaccctaccgttggtgtcgagttcagtgcgtatgctaaagacaattccaaaaaacttcacttttggacaaaagatcaagttggatcttttatagaagcagctgaagaagataaagatcccatgtggctatcattctttgtgacgctgattgactgcgggcttcgtgtgggtgaagccatggctcttcgctggtcagacattgacttcagtaaaaataccttatcagtcaatgcaacacgaatctatcgtgctgaaactggatcaaacgctggcaaaatagcgcttgatcgtcccaaaacattaagctctaagagaaccgaatatatgaccgctcgagtaaatgatcttcttcaacaacaatatgagcgccatttcagtcacggcaatgtacaaggttttcggttttctactagccacaataacgattttgtcttcacctattcgtctgatgccaagtttggacaaccgctccgatctcgagcaactaccggtgcttttaatcgcatcaccaatcgggctgggctccctcacatccgtatccatgatttaagacacacgcatgccgttttaatgcgtgaggcaggattaagccttgatgacatcaaagatgatcttgggcataaagacatttcaaccactcaaatttatgctgaaatctccccagcaaaaaagaaagaaaaccatcaacaattcgaaaaatacttaaatcagtgaacacaaaaaagctccagaacctgtggataagtccgaagccttcaccaaaacttcaccacggacttttccaacatgattctggagctctttatttaccacatttcaaatcgcgcaagtccttgtcattaaaggcgcgcgttcaattccttggtcatatcctcataacccggacggccgagcaatgcgaacatgttcttcttgtaggcttcaacacctggctggttgaatgggttgatcccgttcaggtagccggagattgaaacggcagcttcgaagaaatagatcagatagcctaaggtgtaggcatcctgctttggaatggagacggtcataactggcacgccgccatcggtgtgggcgagaacaaccccttcataggccttgcggttaacgaaggacatcttcttgccagccaagtagccgaggccgtcaaggttgttagcatcttcaggaatggttaggtcgcggtttggttcttcaacccagacaacggtttccatcagattgcgcagaccttcctgaatgtattggccaagactgtgcaggtcagtactgaagttggcacttgaaggatagatccccttctggtccttaccttcagattcacccatcaattgcttccaccattcaccaaggtattgcaacgttggttcgtagttttccagcaattcagtggtatagcctttgcgatacaaaatgttccgcaatgcggcgtactgataagcttcgttttccttcaaatcagctgaagcgtatgccttacgaccatcaccgagaccacgcatcatttcgtcaatgtcaccgcctgcaacagcgattggcaacagaccaacagcggacattacagagaaccgaccgccgacatcatcgggaacaacgaattcttcgtagccttctgcgtctgcttcttgcttcaaggcacccttggcacgatcagttgtcgcataaatccgttcctttgcgccatctttgccatacttttcgatcaactttgccttcagaacacggaatgcaattgaaggttcagtcgtggtaccagacttactgatcacgttgatcgagaagtcacggtcgccaataatgtcaagcaagtccgccagataagtaccagagattgagttaccagcaaaataaacttctgggaacttcagatcagggtcaaggttacggaaagtctgggaaagaaaatcaaccgccatccgtgcgcctaaataagaaccgccaatcccaatcgcaacaaagacttgagaattgccttgaactttcttggctgctgccttgatccgggcaaattcgtccttgtcatagttgactggcaaatcgataaagccgcggaaatccttaccagcacctgttccttcacgcaattccttgtcagctgcagtcactaacggctgcatctgttcaagttcattggcatgaacgaacttgtccagcttagatgaatcaaatttgatgtacgacatcgtgtgcttcctcctctaaatacataagtaactgtcaaaagtcgatatgagagtggtttcataaaaaacgtcaattcaattattaattcgaaataactcatcaagtaaacttttaaattcagttacccatgctttgttcaaattcacactctaacaagttaactttaaaattgaatttgtaaaaaagcaagcaatcgagcaacttctcatcgattactttgctttcatgatgccaaggacgacaccaccaaggatcaccagtgccgacccgcagctaacccagatcatttccttgcgtgttttatgctcgccaagcagataaatcgagccgaaagtcgaaatgacaattcccatctgtgacaatgaataagaaaccgctaaaccaacattggccatcgataacaacatgaacacattccctgttccccaaagcaggcctgtcaaaatatttttggcagttgctttagcaaatggctgatggccaatacccattaataacgcaccaataatcatgccgatggattgcggcatcacaacggccaaagcgccaagatgcccagcgttgacgataatcgtgtaacctgcatacccaactgtcgatatcagtaaggttcgcagcccctttgcaacgccactttgtgttgtgaagtcgtctgtttgttcgcgccttgatgtcaacgttgcgcccacaatcagcaataccagcgcaagaatgcccaaggtcacatcacgaccattacgccattcgtggaacaacagcgcaccggccagtgttgtcgcgacaagctgcatccctgtcgaaatgggcatcgtcattgagacacccatatatttcatggactgaaactgttggccttgtcctaatgcccagaaaagcccagaaacaatcccaagtaaccaaattttagtatctaagaccggacgcatgacaatcaacgtgccgatcccgaaaaccagcgcgccaaacgtcatccccaaagtttgctgataagcattgccacctagtttgccactgaccaagccaatggagccccatgcaattgctggaatcagcgcaagtaaaaatcccattacgcgcctctttctatttcaatgattgatttaaaaaaattgaacacaaaaaaatattctagcggttttcccacggcaagacaagcacaacctgatctaaagcatttccaagagacagctcaccttcatgatacacagaaaactcatgatgaatactaaaacgactcatgcttatttacgatgatgaaacaagcgatataggctatagccgaaaatcgcaccgatcacattgaaaataacatcatcaatgtccgctaccccactgattagcagaaattgtagggtttcaatacttaacgacgtcagcaagccaaatataaccgtccccgcgagacgccgtcgacgtttgctcacccagggaataccaaagccaagcggcataaaccaagcaatattccctagtgattgataccagagatcgaagtgactggcagcatgttgtaatttaagcgtttcaacaagcggtcggatattaatcacagataatggccgattccaatgaaagtgcagttgccacggataatacacatcgcgaaaaactgtcaaagcaaataggagcattaaataaccgacaaaaatgcctagttttaattcccgcccaaaagtggttctccgcttcgtcaccaacagccaaaggcagcgcaaggctgcaaagatcaataggtatagaatagttttgtccaaactaaaaacaatcaatcgaaccaaaggaaaatggttgacgcgactgagcgaggttgtattaatccagttgtaaaatggccccaaaaacagcattgtgctacctccagttgtcattgtagcaaagtgactgaaggatacccacaatgtgttacaacttttaaagactctgtaagaatgatgagcatcaccctctgccattaggaaaatgaggtacgctaatcattgcatgatttgctatgataccagcgacgggatcaagatttaagatcatttcaccaatatgtcgggaggccggcgcgggacatcaaaaagcactaaaatagcgttctcgcctcattgtcccaaagcagcgtagaaaccaacacataagggtctaagcaaaatggtaattaggccttttgcagttgcttcagaaacacgctcgcaagcacagctcatttttcagatattgagacacgcttgccacccccaaaaccaggttggttcacaccctgcttttgtgcttcctcccttttgcgggtacaatgacaaagaacaaagtggaaaggagttgccgctttgaaacggttacgactaaatcgcctcgcacagtggataagatcaacccggattggctttctagcctgtctgctttttttggtatgggctaagaccatctttggttactttgtggacttttcacttggcttaaatgatccgctacaatacaccttgctattattaaatcccttaggaactgggatcattttcctatcgcttggcttgtatcccaagcatgcgcgccgcggttacctcatcggcgtcattgtttacatactcagcactttgctattactcgcaaatgttctgtattatcgtgagttttcagattttctgaccatcaacacggtccttggcgtctctaaagtgagtcagggtcttggagctagctcgcttagcatggttaaaccacacgatatcatttatgtaattgatattgtgctagtggccttggcttattttagttacagtatttggaatatctggcgctatatccacaacgagcctttgcgctggccgcatttcggtctgacgttggatacccgccaacttccctttcactttccgcaagcggtcaccgtctttgggatcgcgctgttcgggttgatcatggcggttagtgaaatgaatcggccgcaacttttgacgcggacttttgatcggaattatatcgttaagtatctcggcttggcgccattcaccgtttacgatgctgccaaaacagcccagaacaatcaggtccgcgcccaagccgacagttcgaatcttgacccagtattgcaatatactcggtcgcattatgccgctccaaacgccagttattttgggacggccaaaggcaaaaatgtcattattattcatttggaaagcttccaacaattcttgattggccaaaaaattgacggtcaagaagtcacgcctttcctgaattcactcattaaagaaaaagacacactaagctttagcaacttctttcatcaagttggtcttggtaaaaccagtgacgccgaaaacatgctagaaaccagcacgtttgggattgccaatggctctttattcagcagtctcggcactgaaaatacgtttgaaggagcgccggccattctcaatcaacgagccggttacaccagtgctgtttttcatggcggctctgctagcttctggaaccgcgacaatgtatacaagagtcttggttataacgactacttttccggcaacttttataatcatgacgaaaaagcagcgactgaatatggcattaaagataagttgatgatggccgagacaccaaagtatctggagcatctgcaacagcctttctatgccaaaatcatcacgacgagcaatcataatcctttttatatcacccaagctgattccgattttcctgacgccggtactgatgacgccacgatcaacggttattttcgcacggctcattatcttgatgaagcgctgaaggaattcttcaactatttgaaagcaagcggtctggaaaagaattcgctagtgatgctttatggggatcatttcggtatcagtaatgatcgcaataccactctggcaccgttgcttggcaaggatcctagcacttggaatgcgttcgatgatgcacagttgcaacgcgtcccgctgattttccacatgcctggtcttaaaggcggcgttaatagcacttacggcggcgagattgacgtcttgccgaccttacttcacttactaggcattgatagctcgcgttatgtccaatttggcaccgatctgctgtccagtcagcacgacagcgttgttgccttccgtaatcacaattttgtcacctctaagtacaccgtacttggcagtaaagtctacgataatacaaccggtaaactgctgacattgacgcctgcgcttgaagcaaccattgccaaggatcagaagtcagtggacacaagactcagcctttcagacgatgtcgctaaccgcaatctcttacgcttctacgtgccacttggctttaagcccgtcaaccctaaccaatatgactacaatcagagtctcagcaatgtcttgtcaatcgaacgcaatctaggcagcaagagcacaagtctctatagcgaaaataatgaccagtcaacaactggactttaccaaaccgatgcccctgaattagccgacgacactgatcccatcaccaccttcccagataaagttcaggatcaaactgaagcctccagcagcagcgaatctagcagttcgtctgatgtgaatgtcacaacccaaccatctaaataaattcaaataacatagtaaatgctcggcttatgttcacactttgttcaaattcattgcttatactgcttgtgaggtgaacgggtagatgcatttctttgagcgaacgttttcaggatttcgttatcatcgccgttattatattgtgatgatgctgttatcagtggcgttctgcttgatcagcatcatgctgatgacaagtgaaatgattgaccaatctgctcaggcagcttttttgcaacgcttgaactcatttggaacacaaaataggcagacgattttgctcagtacgcaggtcggacaagcccacattcaaatggtgcaggctgctcagtcgatgctgaccaaagttgtttttgctgacggtcttttgtggcttgcaggaactgcttggctatggcggcgtcgacggtctgaaactgatgctttgtatttagtcggaaaaagcagtatgtcgatcggcttacaatacgcctttgaagcaattttcagctttttaattagcttcattgttagtatttttcttgtggttttattaaatgatcaattgatttatttcttaacgaccacaaatcgttcggtatttgcccatctgctacaacaaaagtatgacagcatcgaaatgaaccacgcatttgagcaactctttgcccgtcacctgactggttttacccgtgaaaccctcttttattacggtagcaaaactgatgatatgacacagccaaccggtttcctgtcagcactgggaaatggtctcgccgtgattttcatcaccaacataggtttggtcacaccactttccatgcttcggaaaaggcgtgccttaccgcgttaggagacagccatgttatttcgatcaaaactacttgatatctatcgcgaaaattttgccaaactttttaccccaacgacgattcagtatctctatgcctcaaacgagaatgacctgattgccttgcatgatcagtacgtacgcgattttattaatggtggcgtcatcaagcaagtcggcttcattaatagccggcatacaggtatccttgactatctcagcgtgcgaaacaacctttgcatcaatggacgctgcaaggattctgatttcttgcctgaatggttatccacgaattcaccgatcttagaccagccagctgcgacattgaacaccatgcaacgcatttatttgcaattttatcgtggcttgatgggtaaaaaacgttacctgctgctaaccagctctcctgcgatctttgatccttatgttacccgcgacttcctcactgaagccaatcattcattgcaacaaaccaatagttgcttgctagttttaacaacagatcaatccttgttaaatgcgaatcctaaccatgcttggcaggaaccgcctgtattgacgctgagtgccctgacaaaatgagtcttgttctcgttgctatcacaacttgaacaggactttttctatggtcaacaggtggcacaaaatgcggccaaacaaaaacggcgagtctgcactcgtcgtttttgtttgatttatttgcttatgctaaaccaactcgtttgaaaatctcatcaacatgcttgaggtgatagtggtagtcgaaagcatcgtctaaatcggcctgacttaaccgatcagtaatcttcggatcagcttcaagcaacggacggaaggagcgatgctcatcccatgccaccgctgtcttgggttgaaccaagtcataggcttgttctcggctcaagccagcttcgatcagcttcagcatcacccgctggctgtaaatcaggccatgcgtcagattcatattggctttcattcggtctgggaaaacatccaaattgtccaaaatactggtgaagcgatggagaatgtaatcaagcagcccggtagcatctggcaacatgatccgttcggcactggaatgcgagatatcgcgttcatgccacaacagcacatcttctaaggctggcgtctcgtatccacgaatgacgcgcgccaagccagaaacattttccgaaccgattggattgcgcttgtgtggcatagcactcgagcccttttgacctttgttgaaatgctcttcgacttcatgaacttcggtacgctgcatatgccgaatctgcaaagcaaatcgttccaccgaagtcgcaatcaggccaagtgtctgaatgtaatgcgcatgcagatcacgcggcagaatctgagtcgagatttcttgagcgcgaatacccaactgctctgtgacgtacgcctcaacagcaggcggcgtattggcgaaggtaccgactgcaccgctaatcttaccagcttcaacatcgctagccgcgtcttcaaatcgacggatgtctcgcttcaattcagaataccacgtggcaacaaccaacccaaaagtagttggttcagcgtgcacgccatgcgtccgccccatcatcacggtatccttatgggccttcgccaacttcgctaaactagccttcaaggcggccaaatctgcacgcagaatctcgttagcctgcttcaacaggtagccttgtgccgtgtcgacaacatcggtactggttaagccaaaatgaacccatttcttctcagcgccgaggctttcagaaacatcccgcgtgaatgccaccacgtcatgatgcgtgaccgcttcaatctcatgaatccgatcaacatcaaacttagcatgcgcacgcaatgcttggacatcagcagcgggaatttcccctagtttggaccaggcttcggcagctaagatttcaacttccagccatgcagcataacggttcttctctgaccagattgcggccatttcgggacgactataacgcggaatcacaggctttttcctccttcaagtggacaaaacaacaacaggtatccttggtttgcgactgccagcacgcgatcattgaatgacaaagtggccagtcgcattcacactggctttgattgctttcaaatcacccacgatctgaatctcgccggttagctcgccaccagtcggataaaacgtaaatcgccaatcaggtttaatttgaatctgagtcaaaaccgcgtccatatcttctgaacgcagcggaatgccaacgccgtcctcagccaattgcaactccggcaatggccagcctagaattgcgcgcagatgcagctcatattcagaaatgtcactcgtattcagcatcagatggccatataatttcggccctggataaactcgcttcacataaagcgttccattgctggctaagaaaaattcaagactaaagatgcccgtataggctaacttctctgaaattttagcggcgatacgccggatctcaacaatcactgctggatcaacatcagcgcgcacagatgaagccttcaattgatgacgatcaaaataattctggatgaccgggccgatgcgcacttctgtccccgccttcgcaacgatcacagcgacttctttgatgtcttgtaagtaagcctcaagaatatatggtcgctgttgcaacaactgctgtgcccgcgcgacgtcatctgccgtggacagcagcaactgctggtcaacgcccatccccttctgaatcggtttcagcaaggctggataaccgattgtgtcaacagcctctttaatatcattcggcgtaatgacttgggtataaggcaaaatgttcatattcagatcgtccaaaaagactttttccaaatagcggtcttgggtgacagtcaaaatgtcaaccccggaaggcaattggttggcagtggctaattccgccagcaacgaaccatcgacattctcatctgtaaaagtcatcactgtgcttaattgtgtgagttctttcagcgctgtccgatcagtggcatcgcccaccaacggaatatccgccttttcaaaagcaatatccgtttgtgttggcgccaaaacgaccgtgcgcatgcccatcgaattggccgtattcgccatttgaaaagcagttacaccgccgccgataatgccaatcgttgcacctggactaataaattgcgtcacatctgttcctcgctttgactttatttatctgaatcgcgttcgttcaagccttcatcaaccgacatttcttgcgtccgacgtggcgaattgaacagccagttcagcaaaaccgcactcaagctggtcattaaaatgcctgacccaaacagcaattgaattgtttttggcaaaaactgaacgatatgtggctgaactgtcacgccaagtcccagaccgatcgaaatggcagcgacaagcaaattcttatcattgtcaaaatcaacctgttgcaacatccgaatgccttgcacagccaccatgccgaacatcaccagcatggccccgccaagcaccggtgctggaataatcgtggctaaagcgccaatttttggcagtaaaccaagaatcactaagaaaatcgcggaaaaaatgactggcttgcgggtcttaatccctgacaattgaaccaacccaacgttttgcgagaaagtggtgtatgggaaggtattgaacaacccgccaagcatcacggctaacccttcggcgcgatagccgcgcttcaggtcgtctgcttcaattttatggccgacaatgtcccctaacgcgaagaaaacgccagtactttcgaccatggatgtcatcgaaattaaaatcatcgtgacaatcgagctccactcaaactgcggtaccccaaagtaaaatggcgtcggtacgtggaaccagctggcctcaatcaccggctgaaaactaaccaacccaagaaaaccgccaagcaccgtaccagcaattaagccaaccaaaatcgcgattgaatgcaggaaacctttgccccagacattgatcgctaagatcagaagtaccgtgaaggccccgaccatcagattggtcatgttaccaaaatccttggccgttgttgagccaccgccaagattttgaaaagcaaccggaatcaatgacaagccaatgaccgtgatcaacgaaccggtcaccaacggcgggaacaagaaacgcaactttgaaaaagcaccgccgattaggaaaacgaacaacccagcaacaatgatggccccgtacatcgtttgaaaattaaacttctggccaatcatgatcaaaggcgccaccgcttggacggcacagcccaaaacgactggcagcttaatcccaaaatacttgttgccaaatacttgcaaagccgttgcgataccacacatgaagatatcaatcgacaccagatacgtcatctgctcagacgtaaaatgcaacgaagcaccaatcagaattggtactaacaccgaaccggaatacatcgccagcaaatgctgcagtcccaatgcggctgctttaggattcgaaatcgctttattcttcatcgtgggctaatcctccggcgcaaagatgacctgaccattttcaaatgcattgatgcgcgccaatgattcgacgcgaacgtgcttttcatcaagcaacttgcggcctttttggaaagtcttctcgatcacaatccccacaccgctcagtgtcgcaccagcctgtgcaatgatatccatcaagccttcgaccgcctgaccgttggcaagaaaatcatcaatgatcaaaacgttgtcatcggctgaaaggaacttgcgagagatagcgatctcattggacgtctttttagtgaacgaatagaccgtagctgtgtaaagatgatcttttaaagtcaagctcttatgcttacgagcaaaaaccaacggcttgtgaaactccattgccgttgcaatcgccggcgcaatgccagaactttcaaccgtcagaattttggtgatcggctcattgctgaagcgccggtagaattcatgaccgagatctgccattaaatcaggatcgacctgatgattcaaaaagttatccaccttcaagacatctgttcctattacttggccatcctttttgatccggtcttccagtaatttcaccacaagcactccttttaattgtaaattttcaacaagcttaccataaaaatcagtgtggaacaacacaatcacgctaattcccgaacaaacacgcgaagccgctttcatcaaaagaataagtaaaatccccgtgattcggctttaaaaagtcaaaataacgaggattgccgcatcactaaaacacgaacgttcaactatcatattgggttagattccaagtttcaatcaaatgaatcaatttttgtggataatcaggatcagtagcatagccatccgtcttcaaagcagctgccgctgttttatagtccttagcggcacgaactgtggcatattgttgcggattccaatcagtcccattaacgaataacagcgcatgatcgcggatcgactcactgtcgttgtcatacacccgaaaacggccatcgaccgtgatccatttgtcattgacatattcctgcgtgcgcaacactttggtcgtggctggatcggtacctttgatgccaaacaggttatggtagtccttcgccaatgcactggtaccccagttggattccaaaatggcctgcgctaaggtgatgcttgtcaaaacaccatattgcttttgcatggcctgtgctgtcggcactaagcgcttaataaaggcaactttttttgcgcgtactgccgccttttcatccgcaacttcttgtttttgcgtcacttctgtttgttgttgggcccagtatgaaccaaccacaagcgtcacaccgatcgcaaagaaaccgatgactagccaagcagcaagcggaattatttttaacgtaaaatgtcggcgccttttggccaaaagcattactcctttgttttatcagaacttgtcaataacaaccgtcgtcgtaacacaaccatgtcctgcaactgcatcccttctgcatacagcggatgggcatactgatcgaagaaatgcttacggatcgcgtcgaaccggaatccctggcgcatgtaaaaacgcagattctcgaaatccacatcaccagtaccaaccagcatatcctgataatcaggcgcatacaccagtccgacgtgccgtaacaaactcgcgccaataccttggcgacggcgggcaggcagtaccgcaagattcttcagttcaatagtggtagcatccacaggcactaccatggccacgccaaccggcacagtctcgtcaatcgctgcaaataacgtgccagcatccaaataccgccgcaacatattcggatcctcatccccaatcaataaaagatccaaataatgcaaccgagcttccggcgcaactttcacaaatcttaacatgcagcccttccccgccttccaaaaaatgtttcaattaacatgctatgaactagtttaacatgcacttacacgcattgagcacctgccaaatgagttttagaaaaagtcagacaatccgccacttttatttgatgccggcacgcaacatcgctactcacccattttacctgtatctgtcctcgtgcacacgcgaaaataaaaagccggttgcatctctgcaaccagctctgaaacttttatattagtctttgttaacgttaaccgcttgtgggccgcgatcgctgtcttcaacttcaaaagtgactgcttggccttcttcgagggtcttgtagccgtcgccttggatagctgagaagtgaacgaaaacatcgctaccatcttcgcgagtgataaaaccgtaacccttttcagcattgaaccatttaactgtgccgtgttccatgagaacattcctccttgcgtctgctgacgcatgataatatcgtgtatttctgtttggtacaagtggaagaaagttctgaaaccatgcaaccacgaccattcaaaaagtacatatttagtctaccatcacgccaaacggcaagcaagtatagagcgtgagccaacccggttagaaatcggagtgtaagcggccttggatgtgatgactgggctttggtcattgcatccaaggtccttacacgcagatttctgggttggcgatcgcgtttaagagcgtgagcaggcgcgattagaaacctgcgaacgcgtttttgcaatgcaaacgacgtttctcttcagttctattccagtcaagtatctcccctagtccgagctggctacgcggcgaggagggctggcgaccgcgaagctagagctgtgggcacagctttgaactcgcgcaaaccccgcgcgatttcaaagtctggccttgttgtaggcggtaaaccgccaacaacaatttcacggctgagccccctcgccgctccgccagctcttgctttctatcttagaataccgatgacgcaactacgctgttgtactcatgattgctcaaatgatcagagaatgccattattgaattttcgtcactttgagagacagaatcaactggaatatcgttaccttgcttgcggcgatgggacatcagcgaaaattgtgctcaatatcagcccactcttcgggttgataaagtgaaagagatttagcctcagcatatgggttgttaatttttggcactaatgagtaacttccgctcttgtcaggaactaacagaaaagcatccccctgcttgaaactcgaaccacttggcagcgatagtgctaatgaggtatcgagttttatgactttgacatccatcagattaaacgccccctttttattttccaacttaaatgacttaggacatgtaggaaaccgcaaatcaattctgtgatgaaataatattgttaaaattccgctttaactgcaacaagcgggaaaagtcttctaggaaatagaacaatcgcgcgcggctttcgaagcttgcgcggtctgttggcagcgctgatttagcaaaatcgcgttgaatttttttgaccatggtgaccaattgtgtggcgggattgtcttcggtcagaacactggctgtcatcgccaaagcatcgctgatgacggctgcttgttccacaggtgtttcgatacggtcaaggctgtcttgcatttgccggagcaactcatattgattgtcgcgcatttcaaaataggcttgaaaataatcgttatcggccagcaattgattgtcactatggcgattggcccaagcaacagcggcatctaaggtcattttcaaatctgacagattcgcccaattgtccgcacttttaatgtgatccggacccaattgctggctcatatgatcgagaatctcgcgcatctcggcttcgacttgtgcctgaaactcagtgattttggcttccagacttggcatgaacaaattggcaatcaatgccacaccagcgcccactgcgagcaataatagttcatttttaatccagaaccagctgcagcttttcgccatcataaaatgagtgactagcaccgcggtcatgacgataccgctctgcaccgcaaacacgttggtcaaaggaatgaaaatgagtaagaaaagcccgaaagccagtgcattgtaccccagcaccaaaaatgcaccgatcgcaatcacaaaacctaacacggtcgccaataagcgatacgcgactagccgaaatgatgccttggtcgtattctggactgataaaatcgtaataatcccagcggccgtccaatattcaagatgcaactcgtaagcaatcagcattgccgctgccgtccccactgctgttttaaccgttcgcatacctatgtgcatggccatcaccctccagagtcagtttagcatagaacattccatttaatgaatagtcaacacatgtacccgtcacgccccgctagtatttaatcgggctttacgctaccatataaacagaggagctgctatgaaaaaattactcattttgttagccagtctggcagtcttgattgttggatgctcggcgactttaaatcctaaaagccagttaaaaaccacaaccgccaccgttcaaacgcaggtgcagcaagaacaagatgcgttaaagacgattggatcaacggtaaacgcctttccttctgcttttgaaaaggcttaccaggaaaatccgcaaactgatttaaaaaaagaaaatggtcctgtcaaaaaacttttggataggcgtgccgcggcgtttaaatcactagaagccgccaacagcgctttggttggggcaaataatacgttgacaaagctcaacaatcagccatctgaggatacaccgcaaacacagttgaataacgttctcacaagtctgaaactcgccaagttagatcacaaaacactggtcagttattaccgcgaaatgttaacggctgaggataccttcttctccgccaccgcagatagtgacacctcacaagatgacttagaaagccaaatttctcagctgaatcaatattacagttcactcaatcaacaaatcgatgtcatgacggccaatctcacaaccgtcaccagtcaaacaactaagctagcaaaagcgattaagtctatgcgagattagctctgttatagcgaccccgtgcgagttgacacgccaaaatattttttcagccatcatcaaattagcgcaaaacaggaggctttcccatgccgcaaagtgtggcaattatcattccatgtcataacgagtcagaaaatgtcccgctgatttatcgagaacttgttaaaacattccgcgacgacttaaccgcgttacaagcgcaaatttggtttgtcaacgacggttcaagcgacgatacccttcagcaaatcaaacagttacaagcaaaagacggtcaggttcacttcattgatctttctcgctcgtttggtaaggaggcggccatgtatgctggtctctccaccgcaaaagcagactactacgccgttatggatgctgatctgcaagacccgccagcgatgcttcctgatatgtatgccgccttgcaagacggctatgatatggctggtgctcaacgcactgaccgctcaggcgaagctcggatgcgttcatttttctcggatttattctataaattcattaataaagtctcgcaaactcaaattgtgccaggggcacgggatttccgcttgatgacgagacaggttgtcgaagctgtcattcaaatgaccgagcgcaaccgcttctctaaagggctattcagttgggttgggttcaaaacaaagtatctgccttatcgcaacatcgagcgtcaacatggggagacgagctggtccttcatggggctcttgcgatacgcgcttgatggcatcatcgacttctctgaagcaccgctaactttcgtctccatcctagggattgtcagtttcgttggctcgtttttagccttaatcttcattgttgttcgcgcagctatttacggtgatccgaccgctggctggccgtcaatggtctctatctttctgatgatcggcggcctccagttgttcgccctcggcatcgttggccgctacatcggccgcatttacttagaaaccaaacgacgcccgatttttatcgcacgtgagatcaagtaactgtatgtcacatagtcaaaagtaatttaaaaatgattgagctgggacataatccagtgctattaaagaaaagcaaacaactccttattgcggaaaattgtttgcttttttcacggatatttttattagaatttaaagataccagtgccaaggcggagcaatcgcaggtcagatggggctcagccgtgcaaacaacacagtgaccgggctttgtcgctgatgttgttaggcgacttcgagaccgcgggttttgcgggctcgaagcgccgtcaccgctctagctccgcgtcgccagccccatctggccggagattgcggagtttggcccggcaagaatctcttttgtttcattattcagacccagtcgttatccgctcatccgttgcccgttgcctacgtgtttcacgcaacaaccaccagccgccaaagccaagcgcagccactaaggaaagccagccggtcacatgttgcagcgccgtacctgtatagacaactcgaacacgatgcgtgcctgctggtgccgctatcgtaatctgagcatttttcccacttggccagtagtcaactgtcttaccgctaatggtcacatgataaccgacgtagccaaattttggcagcttcagggtcaccggcttgctgctggtataggtaaaacgcatatcattgtaagtttgggtcggcatcgttagccgggtcaattgatgagaagccgttaccgaataagttgtctttttaaaaaaagtcgttgaatcaaaatcttctggtgcatactcactcccgccgccagttgcatcttcataataagccgttgcattctcatcggtgatgcgataaatgttggcattaagcatcgtcgcattgatattcacggcataactgaaaccgacaatgcaggttgccagcaccagcccccaagcaacatgtgatgaggctggacgatccgccacgatcaacccaattgccagactaagaaataaagtcgtcagctccaagtatcgccaaggaaattggatgacaccgaagatcgttttgctaaacaacgaccacgggaacaaattggtgcttagaaagatcgtcaacagccctaggccagcaactaccttaaccgcttgattcaatttccgccaacgaatcaccagcacaatggctgtcattaacatgaaaatgcccatgccaggtcgaaaggcttggccgacattctgcatattactggttgaggcatacatactcagggagttctcaaaaagatcacccaaactatagaggatgaagttcggccagatcgtcgcagactcgcttaacttcaacgcaatatgactggacatctcaatcatcggcaagtagccgcccagtcccatcagcagcgtactgatcgctgccagtatcgtgtacttgaccattcgccaagtcacgcgccgcatgccaaccaacacgagaaagccgccaaccaaaaattccagcaccataaccagcgacaacatatgcgcatacatcagaccggtcacaccaaacgccagtaaaaaccagttatcggttcgtttaacgtaaagctcatacatgcccgcggcgatgatcggcaggaaaatgaaggccagattttcacccaaggccccccgcacaaaggcgtctaaggcccggtagaccgcagtcgtatacaccatgctgaaaacaaacgccgccagcggttttcgccgaattttcaaaaaactagcgtaggcagccaatactgtgacgatgagaatgagggcctgataaccatcatacgcaccgaccacccccatccccatcagccgtagccacacatatggcaacaacattaatgaaggatagtacgcgtcaaaagcatagccaaagttgcggactgcctcaggaaaaaccttgggaaaatactggccgtgccgcacactggtcacatagctttccaaccgccgcagctgtggcatcgtatcgtcttgatgaaaaatatagggtagatgcagctgcggccactgcacgagcaaaaccaagaccatcgccaaaatcggcaacagccagacagcattttgtgtcatgaatgtcttcagctttgctgatgatgtctgtgcgtgcataaaccgtcctcccaaaataactttcattctattgtaccgttccccgatgctgtttgtcttaccggaaaagattattttcatccctttgaccacacgacctgatgtcacaagtatcaccaattgctacgttttttttaaaatagcagccacagcgctttcattgcgcttccggtcacttttcagttcaaagacgcgttatgattaagttaatattcaagacttgcttatttttaagttagtcattttttctgctatcatattgtttattaacttttgaccctaccgaattttcgaaggagtccctctctatatgtcgcgatttaaaaagcatcgaacatggccattattgctcatcagtttcagcgtcaccttcaccatcagtctgatcgttttcgccgcgttaaaaatggcgccttttggctcgtcatctattttggcaaacgattcagccgttcaatatgttgatttctttacttatctgaaacacgccttaatgggcaccgctggcaaagcttattctttctccaacagtcttggcggcggcatgtatgcaaattggacctattacctgttaagtcctttcaacttgatcttcgtgcttgtatcgcgccaagccattcccgtggccatgctgtttgtgaccgcgcttaagtacagcaccgcggcacttgctgcgcaggtattagccagccatcgctatggcaaaaactggtacaccttggtcttcagcgtcagttacggcctttccggcttcctgattgccaactttctgaatatcatgtggatggacggcgtgattttattgccgctcgtgattttaggcattgaccgcctctttgaagaacaccgactcatcccctatgttgtgccattaagcctaagcttcatcacgaactattatattggtttcatggtcgccattttctcggcgctgtatttctgctggcaatgggcgattcaccatcagcctcaactgctgcgcaaaatcgcgcttttcgtcggcgggtcgttactgagcggcatgatcggcgccatcgtcttgatccccacttatctggccttaagtgcctcacgtctttccagtgctggtgcggatttcaccatcaaaccacttttctcgctgatcgatctgccgtcaaaattgattcctggcagtttcaactttgcgcagttatcaaatggcctgcccaatttatacatgggcatgatcgccctcttaggcgctgtcttttacttcttagctccagcaatctcggttcgcgagcgtttgatttccggcgtgatgactgtgattctgatgctgtccatttggctcaacccgcttgtcatcatgtggcaaggttttcgcgcgccggtttggtacctttatcggcattcttttattgtcattttctggttgttattgctcggtttacgcggtctcgccaacctgccatcagtctcacgtctacgaatgatcatcgccagcgtggttgtcggcggggtcgtcttcatcccaaccgcttggcgcatgggcagtcacaagtatgtcaccttgaccaacctcgtcctcggcggcgtcttactcttagtagcggccatcttactgtatagttgggcgcatcacctgttcccacaaaaatgggtggttggcggtcttctaaccttgctggtgctagatatgggcgccaatgcttacaccagtcttaaggccatcagtttcatttcaaaagccgacttcaccgttacaagcaaggcgcttaacgcggcttacaccgaagcgaaaacactggcgccaaatactttttaccgggtaaacagtgatacccagcgttccatggacgatccttatcagtacaattttaacggtattagcaccttctcatccgtcctcaacactagcacgatcaatgcgttaaccaatgtcggtgccattggctcagccggccgcgtgaaaaacaacgacctgacttggccgctcgaaagcctgctcggtgtccggcaactgttgctggtcaatacgcaaagcacgaaaacgacaacgcctgaataccagcagatttcttctcgaatcattgacaacccccgttatgatctgccggcatacaagttgatcggtcataacgattatttcaatatttaccaaaatcccgatgcgctccctgtggccacccagatttatcgaaaagtcccaacacaggtgcaagcgaatcccgtgcttcaacaaaatgcctacttcagcaccttcacaccggaaacaatcggcgcaattttcacaaccaccgatttctccggcatcaccgttgacaacgtgaagccgctgaccaccttgaccaatgccattgccaccaaaaaggataaaaagctcggcgcgacgattaccttaaacgtcaacccgagtaccgagcagcgttacttggtcatgggtgaaaacatgcgcaaaaacatggccatcagcatcaataatgtgccgctcaaaaacgatcctgacaatggcagcaaaacggtctcattacctattgacgcggaaaaaccgacaactgtcaccttaacgttcaaccgcaacattgatcagattgatctcgatcattttgctttatataccctcaatcgccaaccattcgaacaggcggttgcggcagcaaaacaacacgcgcctaagcaagtcgtcaaaaacggcagcgtcactttaaccacccgtcaaaacaacagcggctacatcatgttaaccatcccctatgaaaaaggctggcaagttgataacaagcaagtgaaaatccaaaactatcgcggcttcatcggactcaaagtcccttcagcaagcctgaaattcaccttgagttatcacacccctgggatcaaagctggctggaccgtgacaagccttgggttaatcggcttaattgccctcgctttccttgaatactggccgcgaaacgggaaacacgccattctagttaactggcccgctcgctttcggacaatgtggcaataacaaactgtgctaatcaattcactgccgtgccaaactccgcaatctccggccagctggggctggcgacgcgtagctagagcggagacggcgcttcgagcccaaagaccggtctcgaagtcgcctaacaacatcagcgacaaagcccggtcactgtgttgtttgcacggctgatccccatctggtctacgattgctccgccttggcactgggatcttaaattccgactgctgacaaaaaaactcaatttttcaatgggtaacaattttgttcgaaagctttcttaagcgatcattcagccccaaacatgctgaaccagtctttaatataatcacattcatatttataatctttcttgaatcaaaatattaatgattatcagataaaataataaaaatatgtgctttcattcatcgaaatggttgcgttttctatagtcatcatgctaaaatacattgaccagataacgcatcacaagcgcatgttactgcttatgcaggcaagacttggattatcgtttcatcgcaaacgattttcttcagtctgcctgcttttttgtgccaccaaacaggcgcttcgcaacaactggcacgcgtcctttgcaaaacttgcggtcagtggcggcccgcaagcatcacacgaacgacttatgaaaggggtgtccgatgtttcgcatcaaaaaagtgctcaatgtcaatgtcgtcctcgctgaacaggacggccacgagtatatcgcgtttggcaagggcattggctatcggcaaaaagtgaacgcctgtcttcccgacaacgcgatcttcaaaaaattcatgccgctggatgacagtcgcaaaagcgaaatgatccaatcgctcaataacataccacctgtttacatcagcattacctcacagattgtgacgtatgctgagcagcaactgcagctgtcccttcttcccagtatctactacgccttaacagatcatctggctttttcagttcagcgctatcacagcaagcaatcactgggtaatcggatttactgggaaatgaaaacctactaccccgaaatgtttgccattggcgaatatgggctgacggttgtcgaagcgaccttgcaattggcactcccacgggaagaagcggctaacattgccttccacatcatcaatgcaacacctgccgcggccggtaaagcgaatattttggaagtaacccagcttgttgacaacgtcttgcaggcggtgcgtgcgctgactggtggcacgattgacacgacgagtttgaattacgaacgctttgtcacccatatgaaattctttgctgagcgttaccttggtgataccatgctcgctgatgatggccaactactcacaagtgtctacactgtgtatcctgaagcggccaaaatcgcacttaaagttcaaaaagccattattgctatctacgaaaaagaaccgactaaggaagagttggcttatctcattattcatatccaccgggttttaactaactagtcatctcatgccttaccccaaccataacgcgccccccagcgcagcaaccgcgctggctcgcgctcactatccgaggaggaacacaacatgtctgaccatcaaaaaatcaccgatcgtatcatggcagcggtgggtggtgccaaaaatgtcaaaacgctcaatcattgtgcgacgcgattgcggttcacgctggctgataaaacccagttcgatattcagcgacttgagcaaatgcctgaagtgctgagtgccgtgaactcaggcgacgaatcacaggtcgtcatcggcgccaatgtgactaaatattatgccgaaattaccaaaaactatcacatccgcgaagccggcgatggcaccaaacctagcgcggatcatgaaaagaacattttaaaacgggtcctgaatgccctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctcg

SEQ ID NO: 30 - DNA, 3829 bp, Lactobacillus paracasei
tcatcactgtgcacgatattcgcaaaacagttgatccgcaagttctacgttttttcatggcgggtacccaatatcggatgccgattcgctattctgaaactaacctcaaaaatgcggccaacagtctcaatcggctaaaaattgctcgtgagaatttgacctatcgtcgtcgcggggccgaaaccggcgttgatccacaaattaccaagcaactgcaaaccttgaaggatcgcttcgtgactgccatggatgatgatatcaacgtccaaaatggcctcaccgttttattcgatctggcaaagttgcttaatgaatatgctaatgaagagacggtcaaaagtgaaagtatcaatgaccttttgaatgaatacgatgcttggctgcaaatcttcggtgtggtgtttgctgatcagaagagcctggatgcagacattgatgccttggtgaaggctcgagatgcggcacgggcagcgaaagactttgctaagagcgaccaaattcgtgatcagttggccgcacaaggcattattttggaagacactcctcaaggaacacggtggcgcagacaatgacatttgatccaaaacaattgaacggtatcgcgttagcctacatgggcgacgcggtttatgaagtttatattcgggaacacttactcaagcgcggtttagttcgaccggcatcactgcaacgggcagccaaggattttgtgtccgcaaaggcacaagcggcgctgattgccgggatggaggaagccaacctgctggatagcgacgaaaccgacattttcaagcacgggcgcaatgccaaaagctacacgcacgcgaaaaataccgatgtggtgacttatcgagtttcaacaggattcgaggcactgttcggctacttacatttgatcggccgcgatgaccgtgttgctgaattagcagcatggtgtatccaatacgttgaagaagggaagacgggacatggcaaaaaagccgcaagcaacaactgaacatgatccagatgagtttatctttggccgccatgccgttgaggcggcgctgaaagctggcaccgctgccaccatcaacaaattgttcgtccaaaccgacctgaaaagtgaaccgattcagcatttggtcggcatggcgcaaaagaagaaaattttagtgagcacggcacctaagcaaaaattagatttgatgagtgaccaaggcaatcaccaaggggtcttattggcaatgacgccttacgcctatgcaaccttagatgatcttttcaaaaatgccgctgataagggcgaagatccatttttcctgttgctggataacttggaagatccacacaacttgggctccattttacggacagcagatgcaagcggggtgcacggggtgatcattccgaagcatcgcgctgtgggcctgacaagtgccgttgccaaagtcagcacaggggcgattgagtatgtcccggtggcgcgggtgacgaatctcgcccagaccattaagacgctgaaagaacgcggcatgtgggtctttggcactgccatggacggtcaggattatcgaaaatgggatgcaaaaggcagtactgcgttggtgatcggcaatgaaggcaagggcatctcgcctggcgttgcgaagttaatggatgcgacgattgcgattccgatggtcggccacgttcaaagcctaaatgcaagtgtggccgcgggcatcctgatgtatcaggcattcgccagtcggcatgagggaaaataaatgcgcgaacacatcatgatcgtcgacggttataacgtcatcggcaactggccggaacttgcaaaactcaaagctgaggatcattttgatgtggcccgtgatcgcttgttggacattctggcagaatatcgcagccacgaaaacgctaaaatgatcgtggtcttcgatgcgatgtacgtgcccggtattggtaaaagttatgcaaaatgggatctgcaagtcgtcttcaccaaagaagatgaaaccgctgatagttacattgaacgcctcgcacaggacatgaactcgccgctaatgcagcttgtcgtcgttactagcgaccaagctgaacaatggaccgtcttctcccgcggcgccttgcggatcagctcgcgcgattttctcaaagaagtccagcgctctgatcgagaattcaaccacgacacagcaaattacgccgcccatctcgcccgacgcaacagtccgtggaataacgaccagctattcttgctagacaaaatgcgccggcatttggagcggcggccgaaaccgaaagagtagttatggggatgacccagccttctcaaatttgatgacattaaaaaaagacacagtggacttcaattttgtcctgccaggatgagcagaacaagagaagttactgggtcttttttttttgcaatcaaacattagtagccaacaaactttcgggatcaaggtccagcaatttcagccattcaatattcatcttgtacaaggacggatcaatcagttttgtagctcgcaacaagacggctagatcagtttttgcggattggtttttgtgttcatggatggacacaacgagacgaacaaaagtgacatgatggcgtacatataaagccgtatgcttagctgggaactcactaatcatgtctagcattgttgatgatctctcatagtcacgatcttgcagatatcttgcagatatattgtaaaacgttccaaagaaggcttcgtcataacttgaaaggtggaactcacgatatttcttaagcatatggcgaagaattcgatcattaattggatgtgagagtgagtggcacagattggcgtaaattaaatactcgaaatgaaaccacggcccctctgccagtagaaattgttgaatgtgttcttcttcttcgtctgaaaagatcggatttttcttttctagattggcgatgcaggaaacgataacaagcttcagcatatattgaggtgtttcttttcccatgtttgaatcgtaaacgtctagcagttctcgcagacttggaagatcaaggttcttataggaagtactaacttttgttaggagaacgcgaagttgaccatttgaatcatcgattagttcaaaaaattcttgaggttccatgaacgtcggctttaagatctccattaaatttaagagacgtatatttgcgttcttattttcaaaataagaaatcgcggttttgtgaagattgccttagacattgtgaattgtcagttgacgccgtctgcgaatttgacgaaacaaggcgccacaattggtatagtttgcaaacacttttttcacccctcaggtagaaaatactcaacttttgctcgtgccgctaagaaattcaggtaagttagttaatgacaaagggttgtggtttaagaaaagcgtacgttattcctgaattaaaagagtaataggtcaacgcatacccttggattgaagcatcatctttataaagcaattatgcccaaagtttagaaaaatagcgaatggtgtatgggggagattgaaattaaagactcaataaagacttatctcatcggcgtgggtggttggattttgctaatactttttaacgttagttttgattttattgcttatcggcagctgtattggccacaatatttcaaactaacagcctatatgtcgatgtcagtcataaaatgtaggaaaatggcgatttgaaattgtcggttttcctacattttttgataccatgaatcacatcgtaaccaaggaggaaaacgatgtgagacatgacattcgagaggaagttagaaaatttatgattgaggatatgaagcccaacttcgccgccatt

SEQ ID NO: 31 - DNA, 361 bp, Lactobacillus paracasei
agtatgttcaactcgaatcgtcgctttatgtacttgatgatccttatatttggcacagtagtctcgaacgattgaatacttgccagtgaagccatgtttgacgatgaatttgtaaattgccatggcagagcacgaaatatctaacttttcattgatttgctttttgtacggatccagtttactagggcgtttgggctttggtgtagctggtattgttggatgctgtacctcctcataggctttcttaacggtccggtaatcacaattgtattgctcggcaatggcggcgaagttgggcttcatatcctcaatcataaattttctaacttcctctcgaatgtcatgtctcacatcgttttcc

SEQ ID NO: 32 - DNA, 451 bp, Lactobacillus paracasei
agtcattgacttgcacaagcaacgatggcgctgtcataactgttaccacacagtcagtgccaagacgccactcgtgcaacccaaccacacgatcgccgctcacatgacagagcgaatcatgaagttagcgcatgaacggttgccagtcaaaaccatcgcccgtattatcggaatctcagcttcctcggttcaacggatcattgaccaaaatctcaaactccgaccggctcgccggctgcccacgcgactctgctttgatgagttccgttctactcatggcatgatgtcgtttatctgtcttgatgccgattcacatcgtctgattgccttgcttggtgatcgattcaaccgcacgattaaaaacttcttcatcgctcattattcactcgctgaacgcactcgggtccagacggtcaccatggacatgaatgcagcttatcagacgattatt

SEQ ID NO: 33 - DNA, 6640 bp, Lactobacillus paracasei
cgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggagatgacacatcaccaaacgcgcgaagaaaatgagaaagaactagcagaacgtaaacacgaacagacactagagaaaaacgaaaattatactgatccgcaaaacgaccctgcacaagccaatattcatgatgctaaacgctatggcgaagtagatcacatggacaccgacgaagaaaattctgatcttgatcacggtcgcctcacgggaaatgaagacgcccctgaatcaacttcaggtaatcctcatggggaccaaggaatccatgattctcaacgttatggcgaagcagatcacatgaataccgacgaagaaacttccggcctcgacgttggtcatttaacagaaaatgatcattctgaatctggttttgaagatgatgaacatcatggtcaacaagaaaaacatgatagtgagcaggaacgctatatgggcggtaattcagctgatgaagacgatgagttagcaaaaaaactcggtgatcgtcgcggaatgccgcaagatagctaataaaaaactcggtaagcactagtttaactagtatttaccgagttttttctatcgagatattaatcttattcttgcagacgttctatcatttgattcatttttttaatttctttcttctgagtctcaattatttcatcagccaattttttgacttctgggtcttttaaatcagcttcagtactcgttaagatagcaatgctatggtgaggaatcatggctttcatccaggaaatgtcggaaaccccggtttgcgtccgcaccatgaacaaagaggcaacgaagataactgctgaaataactaaaatcaaaccatttttcttcttactaggatacatctgccacataaataacaacatgatgatggccattgccgctcccatcattagtgccatcaagattctagtcacgctgatatggatgtgcgtaaaagaaaaaacatttagaaacatcatgccatacatgatcaccgtactgacgaaaatcatgagtaaaaatttgcgatacttactcatcacttcagacctccaagattttattgactaaagcatatcaagttgactgacatgacgtcaagagagatgctcaatgtgttcgaataaatccttttcaatgttttacaatcttgatttaagaaaacgtttttattgcattatccaactgctccatgctatgctgaactaaacgtacccctaaaggaggcagtaaaatacatcattatcagctaacctatttagaaattattattcgcttagtcgcggctattatcatgggtggtgcaattgggtttgaacgtgagtacaagagccgaccagcgggaatgcggacccacattttagtttgtgtgggggcagctttgttagcactgattcaggagcaaatcacggcacaaacagtcgactttgcccaatctcaacctaaattgatgcaaattctcaccgctgaccaaacaagaattattgcccaagttgtcagtggtattggttttctaggcgcaggtacaattattatgacaaaacagacagtcaaaggcttgaccactgctgcctctgtttgggccgttgcagcggtaggaatcgccttaggttcaggtctttatgtaatcgcactcactggtttcattgcaatcatgatcgccttggctgttatttcctatttggtccctttgccgcgcatacgtcgtctccaagtggagattgaacacggtgaagagactgtggcttatattcaaagctttctaaaagaacgacaagtcttaatcgaaaacctagatttgaagattacccgtgagacaatagaatctgagcggaaatatttgattatgctcactctaaccgttcctaaagatgtagacgaagacaaactagtcattgaactttcggataataaagacattttgatgattcagattattgaatagtgtaaactttagaaaacaaatttctctatcaacctatttagataaccttaactgacaatattataattttttcttattaataatgaagtaatatttttattcttatatataattttttgttatcgataacattgattatgattgattattttatttgactttgttatgttcaattcataacattatgtttattttaaggaggaatattttattatgaagaaagttggcttaattttaactgcggtcttggcttgtcttgtattattgggaggatgtggcaaaaagaccgctgatgctgataaggacaccaccactaacgtaaagagtagtaaaaaagttaccttagacttttggtctttctggggttcgggcgcccgacgcgaggtcattgaatcaattatcaaagactacaatgaatcacaagataaagtgaaaataaaatatagttatcagccttggggcgatatttggacaaaatctttgtctgcaattacagctggtaatccacctgacgtaattgttcaagatattaactctgttgcacaacgggctgatgcaaaacaagcaactgatattaccaaatacttagacaaaggtattaataaacgtttctactctcaactttttaaaacaacgcaatatcaaaacaaaacttacggtctgccgtttaatacagatacacaagttatcttctataataaaaaaatatttaaaaatgctggtttgactgataaagatttgccacaaacttggtctgaactagacgcggtggcacgtacacttgacatcaaaaaagacgatacttttactcgcattggcttttatccattatggagtcttgatacccaagtttgggcattaaatgctgacgatggtacaagttggtttaatggcaagaatcaagtcaagatagatacaaagaataagcgaaaagctttacagtggattcttgacgctcaaaaatattacggcaagaaaactattaatcgcttagaggcagaatttggttccggtgtcgcagatccattcttatcaggtacagtagcaatgcgtgcacaaaacattaattactatacaacaattaaagaaaatgcccctaagaacttcgaatttggagttatccaacttcctgaattccaaaaaggctccggtcataagacttggggtggcggttttacattagaagttcctactggtgctaaacatgtcaaagaatctgtagatttcatcaaatacctgacgtcagataaagtccaagaaaaatttggcgcagccagttttgatattatggccaataaaaaagcaaacactaatttaattaatggtaaacaattagatgagactggacaaatgatctataaaacagccgatcaagcgatgtcgtctactgttctgacacctattccactaagcgcaccagattataacaatcttgtgaatgaacaaattgatgccgcactattgggccaaaaatcagctaagcaagcacttaaagacgcgcaaactgctgttgagaatctcgttaaacagcacaagtaattgataagaggtaatgctgaaatgactaaacgatcacttcgtcaaaagcaagaagcacgctggggattctttttcgttgcaccatttctcatcggctttgttctctttatgtttgggccaatgttattttcattaattggtagttttaccgattataatttaacttctaaaatgaattttattggacttaataattttaaacgaatgtttttaaaagacgatttattttggaaatctctttataatacagcttacttcacgatatttaatgtacctttaacaaccctttttagtatctttttagcggttattttaaaccaaaaattggttggcatacgtttctttcgcactattttttatcttcctgctgtcctatcaggtgttgctgtctatattttgtggatgcagttactttcgccatctacgggactgattaataccatactatcttggttccacataacaggaccatcttggctatttgatccaaattggactaaacccgccttgattatgatgaaactttggagtgccggcggcgcaatgttactatacttagcgacattgcaaaacgtccctactcaactttacgaatctgccgaaatagatggagctggtatttggcaacaatttcgccatgtgactttaccgatgattactccaattattttttacgatgttatcaccagtacgatcggttcattgcaaatctttcaagaagcctatgtcatgaccagtaacggtcaaggcggtcctgctaattctctgttattttacaatttacacatgtggaataaggctttcgtcggttttgacatgggctatgcaatggccatgtcaatggttctatttatgattgtgtcggttttgactttgattaatctgaaactagctcctcgttgggttcattatgctggaggtgatcaataatggcgactgaaggacaacgtctgagtcataccattgtcactaaaaagggagcgagtaaacaaagaactcgctttattaaaacgattagcagttatctactactaggtggcattagtctcgtcttattaacacctttattatggatgatctttacctcacttaaaccaatgactgaaattgtgcaatttccgcccacttttttccccaaaacaatccattgggaaaattatctaatggcgattaacagttttccattttggagttacgcaaaaaacacgttaattatcgcgggtagtgtggtcattggtaatgttctggcaaattcatttattgcttatggctttgcaaaacttaattttccaggtaagagaatcttgtttgctttggtattatcgacaatgatgattccaggttttgtgacaatgatcccacaatacgttattttctctaaaattggctgggtaggaacttatttacctctaattgttccttcgttttttgggaatgcctttaatatatttttgatgcgacaattttatctctctatttccaatgaattaattgaagcagctcagttagacggtgctaatcatctctacatttggagccatctcatgattcctttaactaaaccggctctaattaccattgcaatcaactcttttaatggcgcttggaatgattttcttggacctttactatacattaaggatccacgtcaatatacgttgcagataggactccaagtcttcaagaaccagtcaactacacagtggcattatttaatggccggtgctgtcttagttctattgccaacgatactgctatttttctttgctcaacgttactttattgaaggtatgaatttaacagctggaacgaaaggataattacacgatgccaaaatattctaatcggttcgttaacttaatccactggataccacgtttagtcattctaaattacttgtgggtattggccagtttgcccttagtcactttggtatcctccactcgtacaaccgcctatttggttatgcaatgtcgtcaagaagatcgaatctctaaaaatatttggcaaacgttttggcaaacgtttaagacaactcgacatcgttttgattttatacgtagttttattttagttctgacagtactagactgttggttacttgctaaaatgacatcacccttatctaaaaccgcactagctgccttaatcctaattttgctagggtgtacattacttagcagttggcgtatcacattaactgctaagtacaaacatgtcagctggattcaagtttttatctactgtgggcaacacttcggtccgctactcggccaattactattcaacattgtggtctgccttgcactattcttattcggtcaaggcttcgctttacttgctggtatcagtacaattatcggtctaaatataggctttactcattattttatcaatagtaattagcaaatcctagattgcaataataaagttaccacctagaaagaggcttgctcactgcttgaactggggtttgccaacggagacattttctgggtttgttattgataagcgctgtggctcgttgaatattggcctctgaaacctgatcaaactgtgttcccttcgggaaatagtagcgaagttctcggttgaaccgttcatttgtgccccgttcattcgggtgataggcgtggcaaaaataaaccggtatccgatagcgctttgtaagcgcctgatcgcaggaaaactctttaccgtgatcaaccgtcactgatcgaaccggacccggaaagtccagcatcagtcttgcaaaacccttgagaacagcattttgtgataagttttcaagcttagttgtcgccattaaacgtgtgacccgatcgacaatggtcaaaacagcagcctttgacccgcgaccaccgcgaactgtatccatctctaaatgtcctttttcggttcgccgattagctgactcactgcgaatctcaattgaggtgcctactgcttggttatagcgcgaccgaaggtcttgtcttcttttatgacgtttaccg

SEQ ID NO: 34 - DNA, 3894 bp, Lactobacillus paracasei
cgaagcaattcaacgatgtcacgatagctgagactgaatctgaaatagtagccaacggctactaagatgatgtccttttgaaagtggcgtcccttaaagtgattcatgcgcgcaatccctcgtttcttggcacccagtatactaaaatcaagtcagcgaggaaaatttgcaccagaacctatataaagatatgattcaaaaacgtttagaaaactgattgtaacatttagaggacttactgcgatttgatgttataatttcattatctttctacaaaaggtagatggtgttttgaatcggacatgcaacatgaccattcttattctgaatagttcaagcttataaatgttttcgtattaagaaattcgagttggcgggaaccttaaaactactggtagcaatgaaggagtatatacaacgacttattggaaaaacttaaacgcaatagcgggtgtcgcagtattgttctttctgtcgcttgtttttgcaagctggacgatgatgcagactcctctgggattgagcacgcttgttctctttttaaccttgtttatacaggagatccgtataaacaataagcagataaggagaagtcaacgaaaagtttatttatcttacgtgataatctttttcagcttatttttatttaacgcaagtgtgcatcaaacaagactctctacatttggacaaagtgatatagttcagtttttgggtgaacatgaagccggaattcatatgaatggtaaaggttaccacttgatatggacaaaaagatcatttctaagtactgtgtacttctacaacttgtatgaacgtcgtggattattcttttatcgcgttaactctaaagtcatctattatacaatacatccatctagggaagttgaccacggtgctgtcaagacattcctttattacactaaaaaagaaggcaagatagtagattaagtcggtgaattcatggtcagtcgctttggatactaactttaacgaatcggttaaaggacaagaatgtcaataggtcggacccaaaattagggcataagcaaatgcgtctatgtctgacttagaacaattgttttataagacaggattctatgctgtcaattatcgaacaaataaattttatccgtaatgatagcataggagactcgttaaagcctaccctaacggatcgtccagaaacatcttgaaataaggcctaaaatccgattcaaataagtgacccgaaacgatttctaagatcgtttcgggtatttttatgggtagtcgtgtgtagccattgctataattgacattagattgcacgagatgaggacagccatatgaacaaaacagtcaaagagcttgcggatgagctaggtgttagcaaacagacaatccagtatcactaccaaagactaccagcaaataagcgacaaaaagatagccaaggacgcaatctgatcagctccgatttagaaaggattatacgcaataaagtagcaaagactttgccaccaaataaccaccaaaaagatcgccaaacgtcgacaaatagcgacaaaaataatattgacattattgctactatgaaagacgaaatcacttatttgagagcagatcgtgacaaacagtttgccgccaaagaccagcaaatagaaaaattgcaaaagttgctcgatcagtcacaacagcttcagttgatgaccgcacaaaagctcaagcagcttgaaaaaccgaaaaatgagcgtgagagtgattccaaagaaaaagacgagcaaatccatgcacgggcctcaggagtgccaaaagcggttgaaaatagtgccgataaacctgtaactttttggcaacgcttgtttggtgagcgaaataacaaatgacctctacacttgcagaggtcatttcatgagttagtgcgttagaaacgctgtcagagtgtgttgctataggcacttcctttgacttttcataaggtacaatgtttgcctttaggtaaacattgtagttagcagtcattgtgtcgaccaatagcggtcgataatgaaagttgcctaattttagaaggcagttaagaagttataacctgctttttggtatactgattcagtcgctacgccttttcgcgtgataccgcgccaaaaggtggtgattactcgtgagtaatttcgatattgcgatcatcgcgccactacttgttggtgtcattctgctcctagtagaagacaagctgaacaatcacaagtagtgtaagtagcgactaagttcagtcgttggcaccggccaccatcttctagcagagatggtggttttttaattaaaaaaacccgcacagctagcagactgtgcgggttagtgatactcatgagtaatttcgattaactgtattctagcataaattttgattagttgcatttactgatatcgcagtgattttctacgtgcgaaattgttgtgaatttcaatctgtactaccttacggccgcgtcgtgcctgcagcagctctagttccatatcattgattttgcagttgatttcttcaatggctggattaagcaccttatttttaagatatttgtactgatattttgaaggagaacctaaccaagccatatattcttccggtgtcccttgaaggattccaattgattgaccgtgatccttgtcaacttcacgcataagcttatacagaagaattgcatacttgcttttcagacgtacagtatcttcaagaaaatactgtgtatagtgaccactatctttaagttttaaaagaaaaggggcaaattgtttattgattcgcagctttacttgtccgttctcccaaatgtcaactacttcaaaccaaccggttagggttagccgtcgttcagagggattatagattttaacgctttttgcccgcatatcctcaagattttgagcaagttgtgaatatgttcgcccactgcgtttaagatcgagtacacgcgttaactcatacattgaggtatcaatcaaattaaaatgctcatcattaggttttattttagatacgacgtaatccataatttttaattcacgggcattaagatcgtgtcttgctttagtgattaaatcgttgtgttctgcaacaagaaaatagcgttgatccctgatttcatctttattgaaatcccgatcgcttgtccaaagaattctcccagcactaaccataaattttcacctcagagacactttacatttaaaggttacaagaatcaacacaactggtacttttggtgacctatcgtgtgctttttggtgacctatcgtgtgctttttggtgacctatcgtgtgctttttggtgacctatcgtgtgctttttggtgacctattggccattttaaacgcgtggttgagccattctcgtcgccctaagtacttaaagtatttagaagtatttagaagtatatataatgcgcgcgaggcttgtgtttgtgttttgcttgttaacaaccacaaaagaccttggggagaacctctccccaaaccccataccaacccctggtcgcttcgctccctacaaaggtgtggcttcgccacgtttaactccggctatgcctgcgcgcctttggcttgccctagcgcgcttcgcttgcgtggcttagaagagcctcagctgaagcttcggcagggctagcgccattcaccaacaaaagcacgttgcctaaatttgattcatcacgaaagcttttcacttgtgccatgaacatatgctgataaaaacggcttagaacgcttatatttgcgttctaagccgtttttgatgtaaagagcattaattgtacccgtcagagtaagaaacgctagcacgggccctttagcgctttttaaaactcactgttttgataaccaatcctcaacgatatttgatttggtcactctgacat

SEQ ID NO: 35 - DNA, 4618 bp, Lactobacillus paracasei
atagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttatgggtggtaactttaattatgcaatctaggcacgaataatatttgctactttttcacgattaatcgtgccaacaggtttaccatcaccatcaatgataatgaacattttttcaggggataggattattttttcagttacttccgcaaaatcatcagtattattcacgaccgaaaattcagattgaatgttaatctttcgtgaaggctttttatcctcattctcagaaatacgctgtttttctaaaaagccaatcggttgcgaattattgtcaacaataaccacaacattacttggcccaaactcttctgaatagtgttggccttcctgcatatattcatcattagatagcaccttaatgggattggcaacatcctcaggcgtagtatctgactgcttccgtatccctaccaattctttaacgaactcattggcaggatggttaaccacactgccagcagttccaaactgctcaacctttccattgttcattattaagaggtagtctgaaagtcttcttgcctcagccatatcatgtgtgacaaagattactgttttattcagatcttgctgaatttttttaatcatgtcttgcatggttgagcgagtaattggatccaatgcaccaaacggctcgtccatcagaattattttttgattggcggcaagtgcccgaataactccgatccgctgttgttgccctcctgataattctttaggcttacgatcaagtatttctttaggtaaatcgacccgtgctaataacgcctcagctattcctgcttgctttgttttagaccacttcaacaagcgtgggacaataaggatgttttcgcgaatgttcatggttggaaaaagcccaatactctgaataacataacctatctgtcttcgaagctgattgtctccgatgtcggatatgtcaactccatcaatcaagatagacccatccgttggtttaatcattttgttaataagccgtaaaagtgtggtttttccactcccactcttgccaataatacatacaaactttccatcaggaattgtgagatttaagtttgataatgcgtctccttcagcatatcttttggatacatttttgaactcaatcattttgatcacctacattacatttctacggttatttaaaaataaagagtccatgcatcttctcagaagtcatggactctcattttacctttcagactcccagctcaaccaaacatttcaaacgtttttttaaatatgggatctgtttgtggtctcactttcgaataaacattggtataaaattgttgatagagcttatgcgacttcgtatcaggaagaaaagttttgtctactttgaccattttagcgatcgcgtccttaaaatttgagtaatatccttctccgacggctgcacatattgcagctcctataccagcagcatcgttgacaacatttcttgtggttggaattccaaagacgtctgcaaatatttgcataaagagatcgctgtttgatccaccccctgtaataacaattcgagatagatctatgtccagttcatccgtcattgccttaacatttgctcccattgtcattccaattgcttcaaggattgatcgatacatatgggcccttgattgtcgtccatcaaatcccagaatggcaccttttctaaagggttcttcgacaggggccaaccagtccagtattgtgatcagtccatcggaaccaactggaaccttttctgcttctagattcagaacttcctcggcagattttccctttttagacgccgccgcagtatatgcatccccaagcatttctttaaaccaactgactgtccacatcccccggcgaataccattactctcatataggtacctccgcggctcactaccaaaatttgtccagaagttttttgcgctttgtttgtttccggttccagaaaccattcctgtaatgtaagtacccaaggaaataacggcggtatcatcacttaacatacctgctccaagagcttccactgctttatcatttgccgttgcatacactggcaggttaactggaagcccagtgactttagatgcgtaagccgtaactaaccccagtctatccccaggcatcatcaaattaaaaagcatatttcgggttacattaaaatctttaagtttcgattcatcccaatcccatgtgtccgtatcaattggccacatgccttggtaatttgcggcagtatcattgaaatttcctgttaagcgaacagtcagatatcctgttgatgcagtaatataggcaacgtccggtatttttccgtcaaacggtcgagaaactcgatcgtccatccaactaaggactggataagccaaagttccatcggttttcaagtacgcgcgacaaaacctaatactgcctaatccaaccccagcaatgtcgtctaaatcaccggaaaacttagctaacagtcttttaagtgcacgacagagcgactcccaaagtgagtcctccggatattcaactatacctggttggggagtgtcaagtgatggtagtctatcttgaacagagacaactggaatgccttttgcatcaaaaattgtaacttttgtgctctgtgatcctccgtcaataccaatgaaataattctttgtcatctctactacctcaacgaactaagtatccaccatcaactacgactagcgtgccatttacataatcagctgcccggctggatagataaactgctgtccccatcaaatctgcaacatcaacccaacgattggctggaatgtgatcaagcacagtctgattcttttttggatcactgcgtgttgcctttgtaattgcagttgcaaaatacccaggggcaaggccattcacctgaatattatgctgtcccagctcgtcagcatatgcttttgtcaagccggctatgccgtgtttagcagcagcatatgccggtgacatttggcctcccaagaaagagaacagcgagcaaatattgatgattttcccactcttttgcggaatcatcacttttgcagcctcatgactcatttcaaaagctgcagtaagatcaagtcgaatcattggatcccatttatcacgatcaaaatgcaacacatcatccaataatgaaattcccgcggagttaaagagaatatcaacacttccaaaagtttcaacagcttcttcaatcacttgttgtggctttttttcagctgtgatatccgcctgcataaaatgatacttaacacccgcatctgttaccaacttttcagtcgttccatcatcaggagcaatgctcggaacaaaaatatttgccccagccttagccagtgctactgaaaacgcgcgccctagaccagtatttccgccggtaataatcgctgttttccctttaagagaaaagaagttcatgttaaattccgtaatttccatattcatattcccctcgtgtatttattaatagatcggtcaatcgaacccacagacgatgagatcaatccagatacttctctggaatgatacttccagcattcataatattattgggatcaaaagcctctttaagtgttttgagaatatagaaggacgaaccatattcttccttaatccacggagcgcgtgctttgccaacaccgtggtgatgtaccattgtgccaccgtgctttagtgactcttcgacgatgattttattaatagggttatggtacttggtaatttcctcttctggtgaaatcccctcaacatgataataataaacaaagtagatattggtcccattaatgtagctatgtgaagaatgtccaccaatccagatcatgtcaggaatctcttttggaactcgatccacgacagcgtcgaagattctcccaatattttcccaatctgcggcaatctcggttgtaaacccaacatcgtttgttttgagaatatcttctttttcatcctcaacttgtttaggaccccaattaagttgattaaaccacccttcaattaacttactatcgattggggataattcatcatgtttgttggtgatcttttgaattccatcgaaatttgctcgtgagatttctggcgcaccttctgtcatgaataatagaacgcattttccgtcagcaaattttggaaattgtgtcgcagcatccgcttttgaatatacccttgcaacggaaggcttgtaccccgccaccataacttctctcaaaatgtccaaaccatcctgcatctgtgataaatggaatcctaagaaaagattgttttctgggcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttct

SEQ ID NO: 36 - DNA, 54944 bp, Lactobacillus paracasei
gtattccaaggacggacagtgtaggatcgtattgggacatttactcataacctcgcttgcttttggtttcgacgctaacaagcatagcatggacactgagtaggtgtctttttgcgttatccaaaaagggcctacacgttcagtgttgattatttctcaacaccagaaagtgtagacccatttgtataaacggacagatgtcagtataatgtgtaatagtcaagattggtcaaagtcaaaaaggattgaatgacatgcagcgtgagaacatttcggacatcattgaaacctatctaaaaacgatattggcgcaagaagcggctgttgaaatcagacgcgctgaaattgctcgtcgtttcaattgcgtaccttcacagatcaattatgtgatcaaaaccagattcacacctgctcgcggttatatcgtagagagcaaacgtggtggcggtggctatattcgaatcgtgaaggtcaaattgacagatgatcaggatctcattcagatcatgcgacagcatattccaagtcgtttgcggatgcgggatgcccgagatttgattcaggaattgtttgataacgggttgatcgcccgccagtctggcaacctgatgctcgcggtgatggatcatgagacgttgggcatcttcgaccaaggggcagaagagcatctacgatcgcgtttgttccttgcatttttggatcgtttgcggtatgaaagatgaaacagtttatcatcagtttttaaaaaagggagcgtgcttatggacaacttatttacccctagtgctaaaaatgtattgcttttagcccaggaacaagcgaagtacttccatcatcatgctgttgggacagaacatttgctcatggcactggtcatggaaaaagatggtatcgctggtaagacgctgcgtcagttaggggtcactgaaaatgatgtccatgacgagatcgagcgcttcacagggtatgggactgttgatgccgctggtcaagctagtgatagttatttgccttactcaccaaaaggtaaagaaattttggcgtttgcgggtgacgaagcaaaacggttaggtgctttaaagatcggtaccgagcacgttttgcttggcttgctacgtgaagatgacatcttggcagcacggattttgcaaaaccttggtctcagtctttcgaagacgcgtcaaatggtcttcaagaagatggggattgcggacactgcagcaaagcgtcgtccaatggcacgtggcggtgctcgtcaagatggacaaggtacgccaacgctagatggtttggcgcgggatttgacccaaatggcgcgcgagaatcggatggatccggttgttgggcgtgacaaagaagtacgccggctgatccagattctggcacggcggacaaagaacaaccctgtactgattggcgaacctggtgttggtaaaactgcaattgcagaaggctttgctgaaaaaattgtgtctggtaaagtgccggatgacatggtcaacaagcgtttgatgatgcttgatatgggctcacttgtcgctggcaccaagtatcgtggtgagtttgaagatcggctgaagaagatcattgatgaaatttataaagatggcaatgtcattttgttcattgatgaattgcatactttgatcggtgctggcggtgcagaaggcgctattgatgcttccaatattttgaaaccggcattagctcgtggtgaattacaattgatcggtgccacgaccttagatgaatatcaaaagtatattgaaaaagatgctgctttggagcggcggtttgcgacgattcaagtcgacgaaccaactgaagaagaagctgaacaaattttgaagggcttgcgtcctcgttatgaggcgcatcacggtgtcacgattactgacgaagcgctgcatcaggcggtggctttgtcatcacggtacatcacgactcggttcttgcctgacaaggcaattgatctagttgacgaaagtgcggcgaaggttcgcttggacaaggccaatgttgagacgaaggccgacaagcttcaggatgaactggccaagctggtagctgataaagaagacgctattgaccatcaagatttcgaaacggctgcgaacatccggactcaggaagctgatttaaaaacgaagttggccgacacgcctgaaccagttaatgaaagtggcgttcgaactgacattaaagtgacgggcgacgatgtggcagaagtggtttctcaatggaccggtgtgccagtcacccagttgcagaaaaaagaatccgatcggttggttaacttggagaagatcctgcatgagcgggttgttggccaagatgaagcagtttccgccgtcgcgcgtgctatccggcgtgctcgttctggtttgaaagatccgacgcggccaattgggtccttcatgtttctcgggccgacaggtgttgggaaaacggagctggctaaggcgttagccgaggcaatgtttggttctgaagatgccatgatccgggttgatatgtctgagtacatggagaaatttagtaccagtcggttgatcggcgcggcccctggttacgttggttacgacgaaggcggtcaactaaccgaaaaagtccgcaataagccttactcggttgtgttgttggacgaagttgaaaaggcgcatccagatgtctttaacattttgctgcaggtgctggatgatggctatttaaccgattcgaagggtcggcgggttgatttccgtaacacgattttgatcatgaccagtaacatcggcgcaaccgctattcgtgacgataagactgttggctttggtgccaaggatccacaagctgactttaacgccatgaagagccggatgctggacgaacttaaaaaagcgttccgaccagaattccttaaccgaattgatgaaaccgtggtcttccacagtctcaacaaggctgagctgcatgaaatcgttaagatcatgacgaagacagtgcttagtcgcattaaggatcaagggattgacgttaaaattaccccagccggtattgacgctgtcgccgctgccggcttcgatccagagtacggtgcacgtccaattcggcgggcactgcaaaccggtgtcgaagaccagttaagtgaacttttactgacaggccaagctaaaaccggtgatttgatccaaattggggctaaaaaaggcaagctgacatttactgttaaagagaacaaaggcaagcaaaaagaaaacggtgcttcaaaagaacccgttaaagcctagtgttgataatgaagaaatcgcggctgataggttgcgatttctttttggctttgcttgcgcagcacggatcaacctccgcttgacatcgttgattgatacgcgtattatgaatctaatcgcatttcggtttggacaggctgtcaggacgatctattgtccgttctgactaatgaaaaagcaaaaacagcaggctggttgaaggtcgatctgtttttggtttttttttgctcaaaatgtctgcgggatggtcgttgtcatgtaaacttaacaatatttacattatttttacaatcaacctgagccggaaaatcttacaaggggtgaataatttggcaggacacttagtgaattatggtaagcaccggacacgccggtcctatgcccggatcaaggaagttttggatcttcctaatctgatcgagatccaaacgaattcttaccaatggttcctcgatgaaggtctcaaagaaatgttcgacgatattatgccgatcgatgactttcaagggaaactgtcactggaatttgtcggctatcaactgctggaaccaaaatatactgttgaggaagcacgccaacacgatgcaaactactctgcaccgttgcatgtgaccttgcgtttaaccaaccatgaaacaggcgagattaagagccaagatgtgttctttggcgacttcccgctgatgaccaaacaagggacgtttattattaatggtgccgaacgggtcatcgtttctcagttggtccgttcacctggcgtttatttccatagcgaaacagacaagaactcacgtgtcacttatggcacaaccgtgattcctaaccggggtgcttggcttgaatatgaaactgacgccaaagatatcgcgtatgtccgaatcgatcggacacggaagatcccgctgaccgaattggttcgggcgttgggcttcggttccgatcaagacattatcaacatgtttggtgacaatgattccttgatgcttacgcttgaaaaagatgtgcataagaacacggatgattcccgtacggacgaagcgttgaaggatatctacgaacgtctacgtcctggcgaaccaaaaacagccgattcatcgcggtctcttttgtatgcccgcttcttcgacccgaagcgttatgatcttgcttcggttggtcgttacaaagtgaataagaagctgagccttaagacccggcttttgaatcaggttttggcagaaacactggccgatcctgatactggtgaagttattgcgcaaaagggcaccaaggttgatcgtcaagtgatggacaagttggcaccatatcttgaccgcgacgatttcaagaccatcacctaccaaccttccgatcaaggcgttgtcactgatccgatcgaattacagagtatcaaagtatactcacaagtgacccctgataaagaaatcaatttgattggtaacggtcatattggtaaaaaagtgaagcacatcgtcccagctgatgttttggcatcaatgaactacttcctgaatcttcaggaaggcttgggttcaattgatgacattgatcacttgggtaaccggcggattcgttctgttggtgaactgttgcaaaaccaattccggatcgggctttctcggatggaacgtgttgtccgtgagcggatgtccattcaagataccgctacggtaacgccgcaacaattgatcaacattcggccagttgtagcttctatcaaggaattcttcggcagttcccaactgtcgcagtttatggatcagacgaatccgcttggtgagttaacgcataagcgtcgtctgtctgctcttggacctggtgggttgacgcgtgaccgtgccggttatgaagtccgggacgttcactacacccattatggccgtatgtgtccgattgaaacgcctgaaggcccgaacatcgggttgattaacagtcttgcttcttatgcggttgttaatccttatggttttattgaaacgccatatcgtcgtgtttcttgggatacgcataaagttaccgacaaaatcgactatttgactgccgatgaagaagataactacatcgttgcgcaggcgaactcgcctttgaacgacgatggttcctttgttgacgaaaccgttctggctcgtcacaaggataacaacattgaaatctctccagacaaagttgactacatggacgtttcacctaaacaggttgttgcggtcgcaacggcttgcattcctttcttggaaaacgatgactccaaccgtgctttgatgggtgcgaacatgcaacgtcaggctgtgccgttggttaatccgcatgccccacttgttgggactgggatggaatacaaggcagcccatgactccgggacagcggttttggctaataacgctggtaccgttgaatatgttgatgctaagcaaattcgggttcgtcgtgaagatggcgccttggatgcctacaacttgatgaaattcaagcgtagtaacgccggtaaaaactacaaccagcggccaatcgtgacaatcggcgatcatgttgatgttgacgaaatcatcgctgatggaccagccatgcaaaatggtgaattggcattgggacaaaacccgatcatcgccttcatgacttggaacatgtacaactacgaagatgcgattgtgctctccgaacgactcgttaaagatgatgtttacacctcaatccatattgaagaatatgaatctgaagcacgtgacaccaagcttggacctgaagaagtaacgcgtgaaattccaaacgtcggtgaagaagcccttaaggatctggatgaatttggtgtcgttcgtgttggtgctgaagtgcgtgacggtgatattttggtcggcaaggttacacctaagggcgttactgaattgtcagctgaagaacggttgctgcatgcgatctttggtgagaaagcacgtgaagtacgtgacacctcgctgcgggttcctcatggcggcggcgggatcattcaagacgttaagatctttactcgtgaagccggcgatgagctgtctcctggtgtgaatatgatggtccgcgtttatattacgcagaagcggaagattcaggtcggtgataagatggccggtcgtcacgggaacaaagggacggtttccgtcgttgtgcctgaagaggacatgccatacttgccagacggtaccccagttgacatttgcttgtcaccaatgggtgtgccaagtcgtatgaacatcggacaggtgctggaattgcatctggggatggctgcacgtaacttgggcattcatgttgcaacgcctgttttcgatggcgccaacgataaagatctgtgggcaaccgttaaggaagccggtatggcatctgatggtaagtctgtcttgtatgacggtcgaactggtgaaccattcgaaaaccgtgtttctgtcggaatcatgtactacatgaaactgtctcacatggttgacgataagattcatgctcgttccattggaccttacagtttagttacccaacagccacttggtggtaaagctcagtttggtggtcagcgttttggtgaaatggaagtttgggcccttgaagcttatggcgcggcttatactttgcaggaaatcctgacttacaagtccgatgacgtggttggccgggttaagacctatgaagccatcgttaagggcgaaccgattcctaagccgggtgtaccagaatccttccgtgtgcttgtcaaagaattgcaagcactgggtctggatatgaaggtccttggcgcggataaaaaagaaattgaactgcgggacatggacgacgacgaggatgacattgtttctgtcgatgccttggcgaagtttgctgctcagcaggaagaaaagaaggctcacgaagccgcagcacaagcaactgacggtaagtctgccaacagtaccgacgataagaaataggaggttagccctttgattgatgtcaataagtttgaaagtatgcaaatcggcttagcctcgccagataaaatccgtagctggtcctatggggaagttaaaaaacctgagaccatcaactaccggacgttaaaacctgagcgggacggcttgttcgatgaacgcatcttcggaccgaccaaggactgggaatgtgcctgtggcaagtacaaacggattcgttataagggaatcgtttgtgatcgctgcggtgttgaagttactcgttccaaggttcgccgtgagcggatgggtcatatcgaactagccgcaccggttacccacatctggtacttcaagggcatcccaagtcggatgggtctggtactggacatgtcaccgcggtcactcgaagagatcatttattttgcatcctacgttgtgatcgatcctggcgatacgccgatggagaaaaagcagctcctgaccgaacgtgaatatcgtgaaaaacgcgaagaatacggtcaaaccttcaatgccaagatgggtgccgaagccatcaaggaattgttgcaggatgttgagcttgataaagaagttgccgaattaaaggaagacttgaagtcagcccaaggccaaaagcggacccgtgcgattcgccggttggatattctggatgccttcaaggaatctggtaatgatccagcttggatggtcatggacacgatcccagttatcccaccggatctgcggccaatggttcaacttgaaggtggccgttttgccacttccgatctgaacgacttgtatcgacgggttatcaaccgaaataatcggttgaagcgcctgcttgatctcaatgcgccaagtatcattgttcaaaacgaaaagcggatgctgcaggaagcggttgatgctttgattgataatggtcgtcgtggccgtccggttacggggccaggtaatcgcccgctcaagtccctgtcacacatgctgaaagggaagcaaggccggttccgtcagaacttgcttggtaagcgtgtcgattactccggccgttccgttattgatgtcggcccatggctgaagttctatcaatgcggtgtaccacgtgaaatggcattggaactgttcaagccatttgtgatgcgcgaattggttaagcgcgacatggctagcaacatcaagaatgctcgtcgcaagattgatcgccaagatgatgatgtttgggatgtgcttgaagatgtcatcaaggaacgtccagtgctgttgaaccgtgcacctaccttgcatcgacttgggattcaggcatttgaacctgtccttgttgatgggaagtccatccggttgcacccgctggtctgcgaagcttataacgctgactttgatggtgaccagatggcgatccatgtaccgctatctgacgaagctatggctgaagcacggatgctgatgttggctgcacaccatattttggcaccaaaagatggcaagccaatcgttacgccatcacaggacgttgtgctgggtaactactacctgaccatggaacaaaaaggccgcgaaggtgaaggcatgatctttaaggacaccaacgaagtgttgatggccttgcaaaacggttatgtccacttgcacagccgcatcgggattgcgactaattcctttacggacaagccgtttaccgatgatcagaaacaaaagatcatggtcaccagtgttggtaaggcgatctttaacgagattatgccgaaagacttcccatatttgaatgaaccgacgcaggataacatcgtcaatggtgtgccggataagtatttcatcgataaaggtgaagacatcaacgactaccttgaagatgcaccgttaatcgatccattcaagaaaggcttcctgtctgacatcattgcgcaagtcttcaaggtctataaagttcaacggaccagtgacttgctggatgatatgaagactttgggctatacgcagtccactaactctggcttgactgtcgggatcgcggacattactaacttgaaggaaaagcctgaaattgtggaagctgcccataagaaggttgccactgtttccaagcagttccgtcgtgggttgattaccgacgaggaacggcatgatcgggttatccagatctggaatgatgccaaagatgatattcagcagaagctggttgattcgtttgacccgaacaacccaatttcgatgatgtccgattcaggtgctcgtggtaacatttctaactttacacagcttgccggcatgcgtggtctcatggctgcgccaaacggtgggatgatggaagtgcctgttatctcgaacttccgtgagggcctgtccgtcatggaaatgttcatgtcaactcacggtgctcgtaaagggatgaccgatacggcgctgaagacggctgattcaggttatctgactcggcggctggttgatgttgcacaggatgtcattgttcgtgaagaggactgcggtaccgaccgtggcttagttgtcagtgctatccgtgaaggtaatgaaatgatcgaaccgttgtatgatcgactggttggtcgtttcaccatgaaggatgtgctggatccgaagagtggcgaagtgctcgtcaagcgcaataccttgatggacgaagatactgctcagatgatcgtggatgccggggttgaatccgtcacgatccgttcggtcttcacttgcaacaccaaacatggtgtctgccagaagtgctacggtcgtaacatggccactggcgaacaagttgaagtcggcgaagctgtcgggactgttgctgcgcaatctatcggtgaacctggtacccagctgaccatgcggaacttccatactggcggtgttgccggtggcgaagatattacgcaagggctgcctcgtgttcaggaaatctttgaagctcgtaaccctaaaggtgaagctgtgattacggaagtgaccggtgaaattacggcgattgacgaaaatccagctgagcatacacgggaaatcacggtcaaaggtgaaaccgacacccggacttacagcgtgccatatgcttccagtgtggcagttgctgaaggcgaccacattaatcgtggcgaacgcctgacgggtggttcgattgatcctaagcaattgattaaagtgcgcgatgtcatggccaccgaaaattacctgctttctgaagttcagaaagtttaccgtatgcaaggtgttgatatcggcgataagcacgttgaagtgatggtccgccagatgctgcgcaagatccgggtcatggatccaggcgacaccaacatcttgccaggaaccttactcgatattgctgactttaaggaaaagaatacgcaggcaattatcagtggcggtatccctgctactggacgaccagttctactggggatcaccaaggcttccttggagaccaacagtttcctgtctgccgcttccttccaggaaacgacacgggtattgaccgatgcctcgattcgcggcaagaacgatccgctgatcggtttgaaggaaaatgtcatcattgggaagatcattccggctggtaccgggatggcaacgtatcgacacgaagaaccaaagagtgtcggcaccgtttccgacagtgtctattcgatttcagacatcgaaaagcaaatgaaagcaaaagacggccagcaaggcgatacggacaaaaagtaatcgcgtgaactgacagttaaaccaaaaagaagcggcgtaaacatctgaaaagatgcttgcgccgcttttttggtgagcgcgagtaggagcgtttagaaactggaacgtaagtggccttgaagctcaatgacatggggtggtcactgagcttcaaggtccttacgtgtaggtttctgcgactgcgagcgcgttatagtccgccattgaccaaagcaaagcacgcataaccagccgctaaatgactgatcattggcaaactcggcggacgagcagctatccaatgcaggcacgcggttccgcaagcaatcagtgtcacgattaacgctgcctcgagtcgtaaaacgcaggccagcaaggcaattaacatcacatccgcactcccaagcccttgcgacacaacggctaaaccgccaatcatgacagcaagtagcatcatgccgaaaaggtcatggggaaaacaaaccagcaaagtcaaacaccaacccgtaaagctaaagaaaggaaccgttcgctcatgccagtcagccacgctaaagatgattaagcctgaggcaagcaaaaaagttaaccaagtatggatgcttaatccaaagaggacggctaatagacagtgaaagcaacgggttgtcaagctgtggtgacgaactaagtacagaacaatgagcaaaagtacggttattagcatagcattcacctcttcataaagcagatttcgcatttgtttttcttcttgcaaaagtaaaaagcagatgataatgggctaaaaaagctctattgttaacgctataaacttctgggaaaatcgatatttaataaacctgtctaacagtacattttttaattggctgcaacacctgatatgtaaggatttaaaagcaaatcaccactaggcgaaaagaataaacataagcatatatatttaatgaatattctttataatcccttcaatatttatagaaatgttatacaatgatattgagcggagtgtaaattaatgtatccataaattataggttaatggtctcatggggagataccaagtaggtttgtaaagaggaggaagaggagaaaaatgagggagttaggtggcaagaaaaccgggcacttcatgctcaaagtggggatttacttaacggtgatccttggcatgattgtacaactgatttcgccagcactagcccttgcagccgaaaatccgacacaggcagtgactggtacgctcacgatcaagaaccaagatgaacaaggatcaccgctaaacggcgctaagtatgagattcaaaatgaatcgcatcaggtagtggcgaatagcgagattagtaaggacggccaggcgacggtaccaaacttgccggtcggaaattacacggcaaccgaaaaacagtctgtttccggttacacagctcttgagcagacgaaaaatttcagtgtcacggcatcgggcaatgtgacactactgtttaagagccgcgcatcagccacacttgatagcggcagtagcagtagcacagccgcaaaaccagcggcagcgaagacgccagaagctgaaccaagcgcgacaccggacgcaaaggccgatactgagctgcccaatattttcacgaaggtggcgctgaaggacggcaatgatcagcctttgggaacggaagtcgatcagcaaagtgctgtgaagatggagatgacctttacattaccggcaacgagcaccccgtttccggcaggggcatcctttacaacgaccttgccaaaggatcagattgcttttcctgaaagcggcggcggcaacttttccggtgatgtcgcctcgtactattttgacgcaaccacaggacagctgacgatcaaacttttgaaagccacgagtaatggttcttggttagtgcatattgcagcaagctttaaggctttaactgctaatgattcactcaatcagacactggttttccatacaaaagatcaggacacaaagtttccaatcacgtttaggtcgaatgccaagccggtggtggtgtatgcgcctacgacgacaccacaaagcttgaatccgactggcattgctgggaccgcgaagtttaatttgaacgggaacgaaaccagcaaaaccgatccgacaaagtgggacagtgatccggctaaacgatcaaagaacgctgacatggcattgacactgacggcacgaggcagcgggacagattatctcaaatcgctgacctttaacgacagcgacctggcgaaaatcaaggtttcatcggcaccagtcaatattctcggcggcttttctgaagaacttaagccgttagtcgccggccaagattttcatgctgttttatcggatgacaaacgaacggttaaaatttatctgacaggcggctttaaaaaaacaactgggtatcaggtagattatacggccacgattgaccgatctttagacgataccgggaaagtgggcagtgccttagttgaaggctatcgttacttaactggttcacagtcgtctgacggttatgactatgatagtgtcaccatgcgcaactccggtgtagcgatcaccaaatctggcgatattaccaataacttccgagcacttaactggaaaattaattggaattacagcatggataccatgaaggctggcgccacgctaacggatcgctttggtaagcaaaccagcgggaaagatgagcatgatcaacccaacatcgagacagatggcaatcaaaccttagacacgaagtccctgaaggtctttcaagtcacgtttgacgagtgggcaacgccgattgtttccaaggtcgacatcgcgcagtactttaagctcactgaaaaaggcgacggcgagttcacactaacttatcttggcggcggcgatctcccggaaaatgcttctttccagattcaatatcaaacgaaactgaagaacacaccgaaaaatggcgacaacttaaccaatattgtgaatgatcagaagaatcattacgatcatgcgacctatccagttaggctgccaagcgggattacaaaagtaggcggcaagattgatgcctacaatggtcaaatgacgtggcggatcaatgccaaccgcgttttccggaacatgaagaatggtaaaatcttcgaccttttcccggatggggtcgataagctggacaacgatccaacggccgataacatcaacaccatctccggtgaaaatgtctcagcaaatgttgacgacggcgctaatgacggtattcttgtctacgcccagaatccggacggcgcaagaacgttgctgaagccggggactgattacgatatgagtacccaagacgctgacgttcaatctgcagttaagcaatataacgacaaggataagaccaatccgattaatgcgaatggtcaggaaaaaggcattcgcggctttgtcgtcacgctcaaaggggcgtatgcagaaacagattcgcaaattgtgatttatacgcatactaagctggacatgttgaagctaggccaagtcggtcacgacccagacgctttgaaaaaggctttaaataatcgcgcatttttcttctttgacttgccaccaggtgatgatgacgttgccagcggtgatagtagtagtacaccaacaccagaagaaggggcctttagcggagccttgaagaattcttggagtgatgcgcccgatacccagtattggggtgtcttggttaatcaattggggcttccatatggccacatgcacctgaccgatattttgccgcggtttgatggcgttaattacgagttgattcctgattcgattaaattctatgaagtcacgggaccagacggagttgatccatcgaacacaggtgatccagcttcttctaacgatgtgaaagaaatcaagacgagcccatattatggaaccggtggttggtcatcgacagcacttaaggctgaggatgctgctcagcaaagtctgttaccaaccaacacgccaaatacatggctcaaaaacaatccaaatttagcgcaacaattggattttgattttccaaatatcggcacggggcgtgtttgggttgttttcaagacgatgcgcgctaaccagtggaactataacgatcctaacttcgccaacaatgcgactgtgacagataccgaaccgaccacggcaattcctactttcaacccgtcagcttcgaagtcggcgcaaagttattggacaccaattagtaaaactgtcagtgctgacgccaagttgaaaaatgtcttgaattggcaggtaaatctgatcaatatccaagataaatatcggccaatggtgaatccaatcattgaggataccttggatccaagaggtactggggcggaaatcaatgccaccagttttgtcgtgaaattgaaggttggcattgccgatccgattacgttaaaagaaggggatgattatacccttgccttagatggcaataaatttacgattacctttaagcgaacttttgggaatctgacgcaagaggccaatagcccacttaataattaccaagtaagcgtcgactatgccaccagtagcaagaactcaggatgggcatacaattcgagtagcgttgaatgggatggcagccaaacgactcaaaagccaagcgatggtgtccctcctgatgcgcgaattgcaaacgcaaatgggtacttgccttattggggttccggtatcagcggcgagaccctcacgcaattagccaacttagtggttgaaaagaaggatagcgtcagtggcacgccaattccgggcgttaagttccgcttaagtgacggcacccatacatttgaagccaccacaaaacttgattcgaccacgaataaggcactggcaactttccaaggactgccaattgggattgactatacgttgacggaactcagtacgccagctgggtataagccattggcaccacagaccattcgtttgaacgcaacttccgacacaggcacggcgattcaaacggaggcggttgaaaacgagccttatcagatcacgctgtcgaagtatgacaaccgcgctaagggccaatcagaaacagataacaaacactatctgcttcccggcgccacttatgacttagtggataccgatacgcagaaaacattgaagtcgggcatgaagaccaatgctgacggcaaaatcaccatcggaacggctagcagcttttcaggtcagtatgctggcgacaagttcacccctgacttgaaagatggcgaatacgtccttgaagacttgaagccaggcaattacaagctggttgaaacgcaagccccagatcattattgcggggatgcgcatgatcaagcgacgattaccagcggacccgacaagcaggtttgggaagatagtctgaaagccggcagcgtggcggcgatcatttctaacaaggcgccgtccgctacagtgacggcgtataaccagaagaaacctggtcaactggatatcaagaagcaggcagaaacgatcactgacgacaagttccctgatcgccagccaatgaccggcgccgaatttaagctttatcgttacggcgatgacggcaaggttgatcaaagcaaatcttgggacgcaacgatcattagccaagatggtacctttatcttcgattcacctgatttgtatgaaggtaagtatcagttagtcgaaaccaaagcgcctgaaggttatgtcatccccgatgaccttgccaaaggtgttgacgttaatatcactggtgacgagacgctgaagctgccgacgatcacggagccagtttaccgacgcgccttgcaagtggctaagacggatggcaacttcggcaacccaattgccggcatcacgtacgcgttgtatcaaaacgatgggactgagatcgccaaggacttagtcacagatgaaaatggacaggtcaacttgccatttaatttaccggccggcaagtactatattcaggaaaccaagagtttaccaccatatcggccaaacagcgataagcatccgtttgaagtgaagcagacagatcaaacccagacggcaggcaacctggagaccgaaaacaaagagcatccgattaaagtcaatgtgaccaattatcaagccaaaaccctgaacgtcaaaaaggttgatcgcacttacgcaactcatgtgttgccaggggctgtcttccggctgacgaatagtgctggttacactcgcgacgtgacgacagatgaaaatgggattgcctcatttggcgacttgctgttgggcagttactcgctgactgaaatcaaggcaccagcagggtatcggttggacaacaccgtttatccaattgcgttgtcctctgccgaaacgccgacagcgattacggttaataaggagattgctgacgatccttatcaggtcaatctgacgaagtatgataatcgcgtcaaaaaggatgatccggtgagtcaaaagaagtatctgttaccaaacgcagtatacaaacttgtcgacgtggcggccaacaagaccttaaaggccgacatgaagaccaatgctgatggccaactgacctttggtgcggcaagcagttttgactcgccgctcaaggatggcgaatacgcaatcgaagggttgaagccggatacctcatatcggctggtcgaaactgaggcgccgaagcattatgaaggcgacgcagcagatcaggcacgttatccaagtggagaacacaagcaagattgggaaagcagtctagcagctggcagtgttgatttcaccatcaaggctgaccaaactcagctgaagctgaccgcaacgaaccaaaagaaaccgggtcagctggatcttaagaaacaagctgaaaccatcaaggatgaccagttccctgatcgtcaaccaatgactggcgctgaatttaagctttatcgttatgacgaagctggcaaagttgatcgcagccggtcatgggacgctactatcactaacaatgacggcaccgtctcctttaaggattcagatttatatgaaagcaagtaccagttggttgaaaccaaagcacctgatggctatgtcattccagatgaactggccaagggcgttgacgttgatatcactggcgatcaaaccttaacgctgccaaccatcaccgaaccggtttaccgccggacgacaagtgtggcgaagaccgatggtaactttggtaatccaattgctggcattacgtacgcgttgtatcgcgaagacggcactgagttagccaaggatttggtgacagacaaaaatggccaagtcaatgtcccgtttagtctgccagttggtcattattatattcaggaaacgaagaccttgccgccatatcggccaaatacggacaaacatgcttttgaagtcaagcagactgatcaaacgcaaacggccagcagtttagcaactgaaaataagcaacaaccgattcgcgtcaacgtcaccaactatcaagtcaaaacgctgaatgttcaaaaggttgaccgcaattacgcagctcatgtgctgccaggggcgattttccgattgaccaacagtgctggctacagtcgtgacattaccactgacgaaaacgggctggcctcattcggcgatctcctactcggcagctattcgttgacagaagtgaaggcaccagctgggtatcggttggacaagaccgttcatgcgatcaccttatcctcagcgatcacgccgacaccgatcaccatcgacaagcaaattgccgatgatccttatcaggtcaccttaaccaagtacgatagccgggttaagaagaccgatgatgcggcaacacgtaagcagtatctgttgccgggagcgacgtataagcttgtggatgccgtaaccaacaaaacgttgaaggccgacatgaaaaccaacactgatgggcaattgacctttggcgcagccagcagctttgacacctcactcaaggatggcgaatacgcgatcgaagggttgaaaccggacaattcatatcgcctagtcgaaacccaagcccctgagcattatgaaggggatgctgctgatcaagctaacgcgacaagcggcgtccagaagcaacgatgggaagctagtttggccgctggtagtgtcgatttcaccatcaagactgatcaaacccagctgaagctgaccgcaactaaccagaagaaggctggccaaatcattgtgacgaagaaggcggacaccacaaccgatgatcgcttcccgggcaaaatgaccatgattggcgcccaatttgcgatgtatcgttatcgcgaagacggcacggttgatcacagtcacgcatggaccacaacgatcaccaaccagaatggcattgtgaccttcaatgatcatgatctttatgaaggtaagtatctgctggttgaaacgcaggcaccacgcggctacgttatcccagatgatctggccaaggggattgatgtgaacgtcaagggcgaccaaaaagttgctcttgatccgattatcgaacccgaatttagacgcgccattcagctgcaaaagacggatggtaattttggcaatcatttggccggcattacctttgacttatatggtagcaatggcaatgtccttgccaaggatcttgtcacggatgaagccgggcagatcaacctgccgtttaacttgccaatcggcgactactactttgaagaaaccaagaccttgccgaaatatgaactgaataccgacaagatcgactttaaagtagaacaaaccgacctgacgcaaaccgtgagcgcgctagcaagccagaataagcagcagccggttactgtacaggttgccaactatcagatcaattcactcgtcatcaagaaggtggatgctgctgatagcaatcaagtcttagcaggtgccgttttccgactgacaaatgacaaaggttatagcaaggaattcacgactgatgtcaatgggctggtcacctttgataacctgaaactgggtcgttactggctgaccgaggtcaaagcgccggctgggtacacgattaatccggactacgcaaagccggtcgcagttgatattaagagcggtgatacaatccgcatgacaatcgccgaccagcgccatgttctgccaagtacagaaggtgggaacaatggtaacgatgtgcgccatgaccaaccgtcacgccgcttactcttcggcagctttggtgatcgagatgcgattacccttgtccttttaggcatcgtgattctcgtcatcgccggcagcaccgtgatcctgcggcggcgtaagcgatcataatcaattgacacgagctgttcgagactgaacggcatcacgttacaatagttccgcgaggtgagtcttctagccggagacttgctttgcggagctattttgttatggttaggggtatggcgcgttcggggccgattaaagcggttgataaactgtgtttattgaaaaagtaacaacttagttacaaccgcgaatctgctatttgagaacggctcatcacttctttgattggaactaaagtggggggatgctgatcttaaaaggtatgaattcaagaatagagccatgagagctggcaaagcggcgagggggctcagccgtgatattgttcttaaacgggtggttttcccgttttagaacaaggccagactttgaaatcgtgcgggctttgcgcgagttcaaagctgtgcccacagctctagcttcgcggtcgccagccctcctcgccgcgtagccaactcggacaatcgagaacacgcgactcaaatagaactaatacaaatctttgagtttgtcgcgcgagtcaccccgctctttctttttctcttgacactcagccgcaaaggatagtacactatcaaaggtgcttttttccagtttattcgggttgcccggacgtgctgactgggttaagagccgttgccgttcggttggccatttttttatcagaaaaaatgaaccgcctggatgtgtggacttataaaatgatgtaaattaaggaaggagaagcttaatgcctactattaatcaattagttcgccaaggtcgtaaatcaatttcaaccaagtcagactctcctgcgttgaacttcggttacaacagcaagaagaagagccttaccaataacccagcaccgcaaaaacgtggggtggcaactcgtgtcggtaccatgacaccgaagaagccaaactccgcattgcggaaatatgcccgtgttcgtctgtctaacttaattgaagtgacagcttacattccgggtattggccataacttgcaagaacatagtgttgtcttgatccgtggcggccgtgttaaggacttgccaggggttcgttatcacattgttcgtggtgcgcttgatacggctggtgttgacggccggatgcagggtcgctccaagtacggtgcaaagcgccctaagaagaagtaattcacgatcaacattaaagatcgctattaaaaatttttagatccgctatgtgcggtatagacagagcgtgagctggtgtggtagaaaccggagcataagtgggcttgggcgtgatggtcggtttttgaccattgcgaccaaggtccttatgtgcaggtttttgcgctagcgagcgcgtttaagaggaggcaaagtgcatgccacgtaaaggcagtgtcgcaaaacgtgatgttttacctgatccagtttacaattcaaagctggtaactcgcttgatcaaccacttaatgattgatggtaagcgcgggaaggcatcaactattttatatgatgcatttgatatgattaagaaacaaaccgggaacgaaccattggacgtttttgaagaagcaatgaaaaacgttatgccggtcttggaagttaaagctcgccgtatcggtggttctaactaccaagtgccgatcgaagttcgtccggatcgtcggaccaccttgggcctacggtggatcgttcagtattcccgtcaacgcggtgaacatacgatggacgaacgcttggctaaagaaatcatggacgccgctaacaacaccggtgccgcagtgaagaagcgtgaagatacccacaagatggcagatgctaaccgggcatttgcacattatcgttggtaagatgatttggctattatatccgcggcttggtatatagtagccattctttgtataaagccagttgaaacaagagaggagcaatacgccacatggccaacaaacgtgaatttccgttagaccgtacccgtaatatcgggatcatggctcacatcgatgccggtaaaacgaccacgactgaacggattttgtattataccggtaaaattcataaaatcggtgaaactcatgaaggagcttcacagatggactggatgccacaggaacaggaacgtgggatcaccatcaccagtgctgctactacggctttctggaaggatcaccgggtcaatatcattgacaccccaggacacgtggacttcacgattgaagttgaacgttccctgcgtgtgctggatggtgcgatcaccgttttggatgcccaatccggtgttgagccgcagaccgaaaacgtttggcgtcaagcaacgacatacggcgttccgcggttggttttcgtcaacaaaatggataagatcggtgccgacttcgattattcgatgacgacattgcatgatcgtcttcaggctaacgctcacgccgttcagatgccgatcggtgccgaagataagttcgaaggggtcattgacctgatcgaaatgaaggccgatttgtatgacgaagatgaattgggtaccaagtgggacactgtagatgttccggatgactacaaggaagctgctcaaaaagcgcataacgacttgatcgaagccgttgctgacgttgacgacggcatcatggacaagtaccttgaaggtgaagagatttccaatgctgaattgaaggctgcgatccgtaaagcaaccatcaacttggaattctacccagttttggctggttctgccttcaagaacaagggtgttcagatgttgttggatgctgtgattgattacttgccatcaccacttgatgttcggccatatcatgcgaccgatcctgacactggcgatgcagttgaattgaccgctggcgacgacaagccgtttgctgccttggccttcaaggttgcgactgacccgttcgttggccgtctaacctacatccgggtttatagtgggacgcttgaagccggttcttacgtgctgaacgcaactaaagataaccgcgaacgtgttggtcgtctgttgcaaatgcacagtaatcaccgtgaagaaatccctgaagttttctctggtgatatcgcggctgctatcggtctcaagaacaccactactggtgattccttgactgatgttgaccacccgctgattcttgaatctctggatgtgcctgatccggttatccaagtttccatcgaacctgactctaaagaagaccaagataagctggatgtcggcttacaaaagctttctgaagaagatccaacattcaaagctgaaaccaaccctgaaactggcgaaacattaatcgccggcatgggcgaattgcatttggacatcatggttgatcgtctgaagcgtgaattcaaggttgctgctaaggttggtgaaccacaagttgcttatcgcgaaaccttcactaaagaaacttccgcgcaaggtaagttcgttcgtcagtctggtggtaaaggtcagtatggtgatgtttggattgaattcactccaaacgaagaaggcaaaggctttgaatttgaaaatgccattgtcggtggtgttgttcctcgtgaatacatcccagctgttgagcaaggtctgaaggaagccatggccaatggtgtcctcgccggttatccattaatcgacgttaaggctaagctttatgatggttcttaccatgaagtcgattcttctgaagctgccttcaaagtggctgcttctatggcattgaagaatgcctcgaagagtgccggcgcggttatccttgaaccgatcatgcacgttgaagtggttgcccctgaagaatatcttggcgatgttatgggacaaatcacggctcgtcgtggtcgcgttgaagggatggaagcccgcgggaatgcccaattggttaactccatggtgccgcttgccgaaatgttcggttatgcaaccaccttgcgtagtgctacccaaggccgtggtacgtttaccatgacctttgaccactacgaagctgttccaaagagcattcaagcagaaatcatcaagaaaaatggcggcggcgtcgcgaccaaagactagtctttgattgttaccagctgcatgaacgacgatgccttttaggcatcgtcgtttttttctaaaagtgcgccagaagtcaaaatccgaaaataagcatgaaaatcgtgaacctgattgctgggcttgggaaaagattatagtatactgatgttattctataagcgttagggggcgaagcagcgtgtcgagtcaggagcgtattacgaccattttattgcgcttgctgcgaggcgatcaactcaataagcaagcgctcatgacggaattcaataaggatgaatcatcgattcgccgtgatattagcgtcatcaaacgtgcctttgacgatgtgttcagtgaaccggcgccatttattgctgcaagttctggggattatcgactcaagccaaacctgcacgccgctggccgcagtctggacgacgggcaactgttggcgattgccttgatactgacggctagccgcggcttgtcgtccgtagaaatgaagcaactaatggcacaattattaccagccggacccgagcacaaaggattggatcggcttaccaaaaatccagtttttgagtatcgtggtgtccccaaaatatcgttgactaatcggttggcccgattgagccaagctatcgttaatcacgaactgatcagctttgatcacgtgtatcacggcgaaatgcggcactttgaccggcgactgccaaccggcttgttttttggcgatctcttcttctatcttattgttgatggcagcgatgaacaggcggatgatgatccagacgagggcaaattcgtccgatttcggctcgactatatgcgcaatattacctatcatcgtcagcagccgacccatgatcatgatgagcgattccgcggcggacgcttacagaatcacacgtggtatccgtatctaggcaaaccgatcaatttggaaattctctacagttatgatccgcagtttgtccttgatcgctttcccgaggccattgttgattggaaaaatgtccgtgatcgtccgtttattaagaatccatacgcaagaaaggtttatcacattacgattccggttaacgatggttttggcgtccggatgtggctccaagggcaaggggatctcgtaaaagtcctggttcccaaacatattcgtgattatgtggtttgggtcttgcgtaaaagtttgaagaattatcaaaacgaagatgatactggcaagtatttatagcagttgtgcagccgggtttgcgaatgaatgcagactcggttttttgctgagggcgaaccaacccgatttctgggaaggcaagcgcatgatgacggcgtgacgtgaacacatattctcatatgccttattataggagatcggcatcattaaacgggtaaatgtggccaaagttgactgccgacaaaaaggcagaattttttggcaatgcttgataattgcataaggaaaaggtacggtgaatatgtaaataataatcattctaaaaatggaggtaatatcatgagctatattggccaacatttaccggcgtttaagttgaacgcctatcaacatggcgatttccatgaagtcagtgatactgatcttaagggcaagtgggcagtgatttgtttctaccctgccgatttttctttcgtttgcccgacagaacttggcgacttgcaagatcactatgagcggttccaagctgttggagctgaagtctattctgcttctgaggataccgagtttgtacatatggcatgggccgaggcgagtcccaccattaagaagattcaatacccaatgcttgccgatcctgcaggtaaactggcaacggcgttggatgtccgtgacgaagctagcggtcaagccttccgtgggacttttatcattgatcccgatggtgtgattcaggcctatgccgtcaataactttggcattggccgtaatgccgatgagattctacggactttgcaagcggcacaattcgttgctgctcacggcgatcaggtttgcccagctaactggcaaccgggcgctaagacactgacaccaggggcagacttggttggcaagatttaaaacggtgttttgatcagctaacagtcaatatatcagcgcttggctaatcagcgacgcacgcaaaaaaggaaccgcaatgattttcgctgcggttcctttttgtgtgtataaatgaagatagaagaaacgagaaaaaacaaagttaaaagtgttggtcaatatcaacgtttttaccatcctgcgactgtttgaaatcgccactgacaaacgaaaacaccgtgagtacaccggctaataccaaaatggccaaggttaaaagcaaggtttcagtcccgcggtcatgcagcacgagtagttggcgtaagatagcggtcattgaaattaaaataaggtagcggataggaatgtgatgaccttcctcaatgtagcgaaccagcatgatcacaaattcaaagagcatgaagaagctggtaacttcctgaatgactttgccaaacaaagcagtcgaaagtggttgaaggatcagactaccgatatcgagaatgtagcgtagcataaaaattaccacgacaatggctaaaaaaccgagtagaatatctaaagttgagttgacgagctttttgtaatggtcaaatttcatcaactgcctcccttctttctatggttattcaaaagttaaggctttaatttgaatttagcacaagcagctgttcaaaggaataagtttgcttctaacatattttttgtaaaccgaaagaaaaccttgtaatggcgggggagattttgtatactatcaagagtgctgtttctcaaaggggacaactatgcacttggttccaaaggtgaaccagagtagcgcggatgtgagaggttgcgacacgcccggccgctttgccacggcagcgtgttggtaattttcacggagctagtctactaactgataatagacgaaggaggtcacacaatggcaaaacaaaagattcggatccggcttaaggcttatgaacaccggattctcgatcaatccgcagacaagatcgtggaaactgcaaagcgcacaggcgcaacaatttcaggcccgatccctctgccaacggaacgtacactttacacggttctacgttccccgcataagtacaaggattcacgtgaacaattcgaaatgcggacgcataaacgtctgatcgatattgttaacccaacaccgaagacagttgatgctttgatgaagctcgacttgccaagcggcgtcgatatcgaaattaaattataattcttagaaaataggaggtgtacccatggcacgtaaaggaatcttaggcaaaaaagttggcatgacgcaggtcttcaccgataacggcgaactcgtacccgttactgttgtcgacgtaactccaaacgttgtaatgcaggtcaagaccgttgaatctgacggttacgaagcagtacagctgggctacggcgatatgcgtgaagtcttgacgaataagccaagtgtcggtcacgccaaaaaggcagacacgacccctaagcgcttcgttcgcgaaatccgcgatgtagcgcttagtgattatgaaatcggcagtgaagttaaggctgacgaattcgcagcaggcgacattgtggacgtcactggtacttccaagggtcacggttatcaaggtaacattaagaaggatggccaatcccgcggtcctatggcgcacggttctcgttaccatcgtcgtccaggttcacttggggccatcattaacaaggtcttcaagggcaagaaattacctggtcggatgggtaaccacacccgcaccatgcaaaacctgcaagtcgttgccgctgacacagagcacaatgttctgctgatcaaaggtaatgtcccaggggcaaacaagtcctttgttacgatccgttctgctgttaaagcagctaaataatacgaagggaggacaataactaatggctaacgttactttatataagcaagatggctcagaaaacggcaaagttgaactcaacgatgccatctgggcagtcgaaccaaatgaaaacgtcgtgtttgacgcagtcgtgatgcagcgcgcttcccttcgtcaaggtactcacgccgttaaaaaccgttctgctgtttctggcggcggtcgcaagccttggcgccaaaagggtactggtcgtgcccgccaaggttcaatccgcagcccgcaatggcgtggcggtgggatcgtcttcggaccgaccccacgcagctatgcatacaagctgccaaagaaggttcgtcgtttggcaatcaaatccgtactttcacagaaggttctcgatagcgacttggtcgttgttgacggtttgaacttcgatgcacctaagacaaaagcttttgcaactgtcttggatggcttgaaggttagcgacaaggcactggttgtgttggaagacggcaatgaagttgctgccaaagccgcacgtaacctgccgaacgtgaaagttgttcctgcagagggtatcaacgttttggacgttgttgactacaagaaattaatcttgacccaatctgcgctccaaaagattgaggaggtgcttgcataatggaagcacgcgatatcattttacgtccgatcgtcaccgagcaatcgatggctgaaatggataaccgtaaatacacattcgaagttgcactgcatgcaaccaagccgcaaattcgcaaggctgttgaagaaatcttcggtgtgaaggttgtcaacgtcaacatcgcgaacgttcgcggtaagaagaagcgtcaaggccgttacgaaggcatgacgcgtcgtcgtcgcaaggcattgattgccttgagcgccgattccaaagaaatcaagatcttcgctgacgaagataacgataaaaagtaacaaaaatccgttataggaggtaaaacacgtggcgattattaagtacaaaccaacaagcaacggccggcgcaacatgtccgggtctgattttgctgaaatcaccaagacaaagcctgaaaagactttgctggtcagccaaagtcatactgcaggacgtaatgcccatggtcacatcaccgtgcgtcatcgtggcggcggtcacaagcaattctaccgtgtgatcgacttcaaacgtaataaggatggcatggctgcaacagttaaagcaatcgaatacgatccaaatcggaccgcaaacattgcactgctgcattatgaagatggggttaagtcttacatcttggcacctaagggtctcaaggttggcgacaaggtttattctggtgaagatgtcgatatcaaagtcggcaactcattgcaattgaagaatattccagccgggacaactatccataacatcgaactgaagccaggtaagggcgcgcaattagcacgttcagctggtgtttcggcccaattgttgggtaaagataatgataagtacgttaccattaagttagcttcaggcgaagttcgtctgattttggctgaaaaccgtgccacaattggtgccgttggtaacgagcaacatgagctgatcagtattggtaaagctggccgcaagcgctggttgggcttccgtccgacagttcgtgggtcagttatgaaccctaacgatcacccgcatggtggtggtgaaggtaaagcaccaatcggccatccatctccaatgtcaccatggggcaagaagaccttgggtaagaagacccgggatcacaaggctaagtctgagaaattcatcgttcgtcaccgcagagcgaagtaaacacattgaagtgttacatcgattaaaggaggtcacaaaatgggtcgcagtcttaaaaaaggaccttttgccgacgctcatctcctgaagaagattgaagcgcaggcagataacgacaagaagaccgttattcgtacatggtcccgtcgttccaccatttttccaagtttcattggctacaccatcgccgtatatgatggtcgtaagcatgtcccagttttcgtgagtgaagacatggttggtcacaagttgggcgaattcgttcctacgcgtaccttccgcggtcataacaccgacgacaagaagacaacagcacgctagaaaggagcacaacattcatggctgatcaaattacgtctgcaacggcaacggccaagacagttcggattgctgctcgcaaagcgcgcctggtaatcgacttgattcgcggtcgcgatgttgctgaagcattggcaatcttagaattcacccctcgatccggttcaccgatcatcgagaaggtactcaagtctgccatcgctaatgcagaacataactatgacttagatgcacaaaacctttatgtaagcaaggcttacgtcaacgaaggcccgaccctcaagcggttccgtcctcgtgccaaggggagcgcatcaccaatcaacaaacggacaagccacgttaccgtggttgtatccgaaaaagaagcataaggagggataacgcgtgggtcaaaagattaatccaaccggtttccgtgtcggtgtcatccgtgactgggatgccaaatggtatgcagacaaagactttgcagcctttctgcatgaagacattgaaatccgaaacttcattaacaagaagctgcaagatgcttccgtatcacgtatcgaaatcgaacgtgccgcaaagcgcgtcaacatttccattcatactgctaagccgggtatggttatcggtaaaggcggttctgaagttgaaaacttgcgtaagcagctgaacaagctgactggccgccaagttcacatcaacatcgtggaaattaagaaacctgatctggatgccaagcttgttggcgaaaacatcgcccgtcagcttgaacaacggatcgctttccgtcgtgcaatgcgtcaagcaatgcaacggaccatgcgagcaggtgccaagggaatcaaaacccaagcttccggtcgtttgaatggtgcggatattgcacgtcgcgaacattacaatgaaggcttagtaccattgcataccttgcgtgccgatatcgactacgcatgggaagaagccgcaacaacttatggccgtatcgggatcaaaacctggatcaatcgtggtgagattttacctgaaaagccaaagcaaaatagtgtgaaaggagggaaataatcaatgttagtacctaagcgtgtaaagcatcgtcgcgaattccgtgggaagatgcgcggtgcagctaaaggcggccgtaacgtcgacttcggtgaatatggtttggaagcattggaatcccactggatcaccaaccgtcagatcgaagctgctcgtgtcgcaatgacccgttatatgaagcgtggtgggaaagtatggatccgcattttccctcataagtcctacaccagtaaaggtgttggcgtccggatgggtaatggtaaaggtgcaccaactggatgggttgctgtcgttaaacgtgaaaagatcatgtttgaagtcggtggcgtttccgaagcagtcgcaaaggaagctttgcgtttggcatccaacaaactcccgatccgtaccaagatcgtttcacgcgaggaagtaggtgggcaatcaaatgaaggctaaagaaattactgcattaaccactgctgagatgctcgacaaagagaagcaatataaagaagagctgttcaacttgcgcttccaacaggcgactggccaattggaaaacaccgctcgcttgagtcaggttcggaaaaacattgcacggatcaaaacggtccttcggcaacaggcactcaataaataatcggaaaggagacatttaccttggcagaacgtaattctcgtaaggtttatcaaggccgcgtggtctcagataaaatggacaagacgatcaccgtggaagtcagcacggtcaagatgcaccctgtttacggcaagcgtatgaagtactccaagaagtattacgtgcatgatgaagacaataccgctaaaactggcgatatcgtgcggatcgcagaaacacgtcctttatcacgcaataagcgtttccgtttattgaacattgtcgaaaaggcagttatcatctaatcaatttttcggatgaaaggaggaccattccgtgatacaacaagaaagtcgccttaaagtggcggataattccggcgcgcgcgaaatcctggtgattaaagtacttggcggttcataccgtaagactggtaacatcggtgatgtcgttgtcgcaactgtaaaacaagcaacaccaggtggcgttgtcaagaaggctgacgttgtcaaggctgtcattgtacggaccaagtctggcgcccgtcgcgctgacggttcttacatcaagttcgatgagaacgcagcagttatcattaacgccgacaagagccctcgtgggactcgtatctttggacctgtggcacgtgaactgcgtgacggcgatttcatgaagatcgtctccttagcgcccgaagtactttaatcattctgaccaaataggaggtgcgatacatgaagttcaaaactggtgacaaagtgcgggtcatgcgcggcaaagatgccggcaaagaaggccagatcactaaagtcttgaaggacgctgataaagttgtcgttgaaggcattaacatgatcaagaagcaccaaaagcctaacaatgctaatccgcaaggcggtattatcgataaggaagcgcctattcacgtgtccaatgtgatgcttcttgatccagataccaataagccgacacggatcggttctgaagttaaagatggcaacaaagtgcggattgctaagaagtctggcaccgcaatcgataaataatagggaaggaggacaaactttttcatggagaatcgtcttgaagaacgttatagcaaagaaatcgctcctgcattggtaagcaagtttaactacaagagcaccatgcaggcaccgaagatcgaaaagatcgttttgaacatgggtgttggtgatgcgactcagaacgccaaattgctggatgaagcagttgacgaactgaccctgatctctggtcaacatccactgatcaccaaggctaagaagagtatcgctggcttccgtctgcgtgaaggcatgccaatcggcgcaaaggttaccctgcgcggcgaacgcatgtatgatttcttggataagctgatcaatgtctccctgccgcgtgtgcgtgacttccatggtatttcccccaagtccttcgatggtcgcgggaactataccttgggtgttaaagaacaactgatcttcccagaaatcgattacgataaggttaatcgtgttcgtgggttggatgttgtcatcgttacaacggcaaatactgatgaagaagctctcgaattgctgacgcaagtcgggatgccattcgccaaataagggaggtccgctacttggctaagaagtcaatgatcgctaagaacaatcggcctgcaaaatttgcagtccaggaatatacgcggtgccaacgttgtggccgtccacattccgtttatcgtaaattcaaactctgccggatttgccttcgtgagttagcacatgccggccaaattccaggcatgcgcaaagctagctggtaatcactagacaaaggaggttaaatcaatggtcttgaccgatccaatcgcagattacttgacccggatccgtaacgccaacatggtgcgtcacgaatccttggtcgtacctgcatctaagatgaaaaaagacatttctgagattctgaaacgtgaagggttcatccgtgactatgaagttattgatgatgacaagcaaggcgttatccgcattttcttgaagtatggtaagaataatgaacgggttatctctggcttgaagcggatttccaaaccgggtctgcgctcatacgttaaaagtgatgctgttcctaaggtcttaaacggcttagggattgctatcatctcaacttccgaaggtgttatcaccgacaaggaagctcgtgccaagaacgtcggcggcgaagtactcgcctacgtttggtaattcaatatatcaaaaaggaggtgccgataagtgagtcgtattggttataaagtcattaaagtcccagccggtgtcaccatcacaaaagatggcgacaacattacggttaagggcccgaaaggcgaattgacccgtcattttgccccggaaatcgaaatgcaccaggaaggcgacgagatcaacttcacgcgtcctgatgattcctacaaggctgtccacggaacaatgcgggccaacttgaacaacatggtcgtcggggttaccgaaggctacaagaaagaaatgaagttggtcggtgtcggctatcgtgcacaaaaacaaggcgaaaagcttgttttgaacgttggctattcccatccagttgaaatgaccgcgcctaagggtgtcactgttgaagttccaagcaccactcagatcatcatcagcgggatctcgaaacaggttgttggccagtttgcagccgttgttcgttccgtccgtgcacctgaaccttataagggtaaagggattcgttacgttgacgaacatgtccgtcgtaaggaaggtaagactggtaagtagtcttaaccttcaacaaatttaacaagaggtgaacattgtgatttctaagccagataagaacaagactcggcaacggcgtcacgcccgcgtacgaggcaagatttctggtacgagcgagcgcccacgcttgaacattttccgttcgaataaaaacatctacgcacaattaattgatgacgtagcgggtgtgacgctagcaagtgcctccactcttgataaggacattaaagatcctgaaaacaagactgctgcttctgcacaagttggcgcgttgatcgccaagcgtgctgttgctgatggtcataaagttgtggtctttgaccgtggtggttatctgtaccatggtcgcgttgctgcgttagctgaagcagcacgtgaaaatggcctcgaattctagaaaaaaggaggataaccaacacatggcatcatttatcgatccaaaccaattggacttagaagaccaagtcgtttccatcaaccgtgtcacgaaagttgttaaaggtggacgtcgtctgcgttttgctgcgatcgcgatcgtcggtgataagaatggtcacgtcggctttgcaactggtaaggcccaagaagttcctgaagcgatccgtaaagctgttgacgcggccaagaagagcttgatcgaagtaccgattgtcggcacaacgattcctcatgaagttatcggccattttggcgccggcgaagttttgctgaagcctgctgaagaaggttctggggttgctgctggtggcgctatccgttccgtcatggaacttgccggcattgctgatattaccagcaagtcactcggccgtaacaccccgatcaacatgatccgggcaacgatggacgggttgacacaactgcgtacccgtgaacaagttgctgaattgcgtggcgtttctgcgtcatcattagaagactaggaggtaaacacatggctcaattgaagattactttgacccgtagtgctgcccaccgtcttcctaagcaacgtaaaattgtgaaggaattaggcttagctcgagtaaatagctcagtgatcaagcctgacaacgcagccactcgtggtgcgattttccagatttcacacttggtttccgttgaagaaatcaaggattaataacattatttcgacaaggaggtgcccaagagtatgcaattgcacgaattaaagccgagtgtcggctcccgtcattcccgcaagcgtctgggccgtggtacttctagcggtcaaggtaagacagctggtaaagggacaaagggtcaattggcacgtcagggcggcaaaacgcgtcttggcttcgaaggtggccagatgccattgttccggcgtatgccaaaacgcggtttcaacaacattaaccgcaaagaatatgctgttgttaacctttccgatcttaaccgcttcgacgatggcgccgaagtaaccccagcagccttgatcgatgctggtatcgttaagaacgaaaagaacggcgtcaagttgctggcagacggcaagcttgagaaaaaactgaccattaaggtagcaaaggcttctgctgcagcgaaggctgctgttgaagcagctggcggttcgattgaggtgatctaatgctgaggaccctgaaaaacgcgctcaaggttaaagacatccgtaacaagatcctcttcactttagcggttttattggtctatcgattaggtacactgatcgcagtgcccggggtcaatgcaaaggcgctgcaatcaatcggttcgacaggcctgatctcactgctggatactgtcagtggtggcggactggcccagtactccatcttctcgatgggggtctcaccgtacattacggcacagattgtggttcagctgctgcaaatggatatcgttccgaagtttgttgaatggagcaagcaaggggaagttggtcggcgtaagctgaatcaggtgactcgttacttaaccattatcttcgggttctttcaggcaatcgggattacggccggctttcaaacgttaagttcgatgggcttggtcaaaaatccgtctgttagcacctatatcacgatcgggatcatcttaaccggcggcaccatgttgctgacttggatgggtgaacagatcactgataaaggtcttggtaatggggtttccttgctgatcttttccgggatcattgctcgcttgccttctggccttcaagagctataccgcgataacgttcaggtatactctggtgccgaaatctggaaagggattgccttcatggcagccttagccattatcgtgattctagtgatcacgtttgtcacatgggtacagcaagcgaattacaagattccgattcaatatacccggcgtgtcaccagcgcaggcagcaacagctacttgcctttaaaggtcaacgtggccggcgttattccagttatctttgcgagttccttcatcgtaactccgcaaacaattctgatggcttttcaaaagaatcatagcggtgatggctggtatcaagtcatgaccaacatcttcaatatgcaaaaacctgccgggactgcgatctacacgcttctaatcattcttttcacgttcttctatgcgtttgttcaggtcaatcccgaaaaggtctctgagaacttaaccaaacaaggcagttacattccaggcgtttggccaggaaaagaaaccgagaattacatctcgcgtttactgatgcggttatcaaccgtcggggcattgttccttggcttggttgcattgctgccacagttagctgccaacatttggggcttgccacagtcaatcggactgggcggcacaagtctcttgattgtcgtcatgacagcgattgaattggttcgtcagttagacggcttactcatgaaacgcgagtatatcggtttcattcgcggagacttgattaaaggcgacagtaaaaaataaacgtcatttaaacagaacgtgggtcagcttgattagagtcaaatgtgtaagcgaatctgagtatgatgaccgggttcggttattgtgtttaagagcgtttatacgtcaggttctagtctggcgagcgcgtttagaggaggatgcaacgtgaatctcattttaatgggacttcccggtgcagggaaaggtactcaagcagaacggatcgaagacacttatccgattgcacatatttcaaccggtgacatgttccgagctgcgatggctgctggtaccgcattaggtaaagaagcgaaaggtttcattgataagggtcaactcgtaccggactcggtcacgaatggcattgtcaaggaacgactcgctgaatctgataccgatgctggttatatgcttgatggcttcccgcgcaccatccaacaagcagaggcactcgaaacgattacagccgatctgaagaaaccgttagatgctgtcatcaatatcgatgttgcacctgcaaaattagtcgatcgtttgtctggccgttttatttgcaagacatgcggcgcgacttatcacaaaatctacaacccgccaaaggttgccggcacttgtgatcgttgcggcggtcatgaattcttccagcgtgaagatgacaaaccggcaacggttaaaaatcggctcaaggtaaacatcgaaatgaacacaccgctgttggacttctatgaaaagaagggcctgcttcacacggttaatggcgaccaggacattgataaggtgtttgccgagatcaaagcgattttggctgctgtggcaaagtaagtgcttggacgattgcacgcccctcatgactgttttcaaagtcgaagaattatggtacaatatcgcggtatgcggtgagtgccaatcggcctcacccttttcgcgcgttaatagaaccaataatttttaggaggaaacacttcgtggcaaaagacgatgtaattgagatccaaggcaccgtgacggataccttacccaacgcgatgttcaaagtcaaacttgaaaacggcgcagagatcctcgcccatgtttccggtaaaattcgcatgcactatatccggattttaccaggagataaggtaacggtggagctctccccatatgatttgaccaaaggccgaatcacttaccgtttcaagtagttgccaactcaaggaggctaaattctcatgaaagtacgtccatctgttaaaaagatgtgcgagcactgcaaagtggtccgtcgtaaaggccgggtcatgattatctgctctgcaaacccaaagcataagcaacgtcagggataatacaaactaattcaataggaggtgtcattgtacatggctcgtatcgcaggtgtcgacttaccacgtggtaagcaaatcgtcattgccttaacctatatttatggtgttggcaagacaaccgctcaaaaggtcctcaagaatgccggtgttccggaaaacgttcgtcaagatgacctgaccccagaacaagaagacaagattcgtgcagccttagactccgttaaggttgaaggtgaccttcgtcgtgaagtaaacctgaacatcaagcgattgatggaaatcggttcatatcgcggcatccgtcatcgtcgtggcttgccagttcgtgggcaaaacaccaaaaacaatgctcgcacccgtaaagggaagaaagcaagcatggcaggtaagaaaaaataattaaaggaggtcattgatcgatggcaggtagaaaaactacgcggaagcgccgtgtccgcaagaacgttgaatctggcgtggctcatatccactcaacattcaacaacaccttagtaatgatcacggaccctcgcggcaatgcgatcgcttggtcctctgctggtgcactcggctttaaaggcagtcgtaagtcgacgccttttgctgcgcagatggctgctgaagctgctgcaaaggaatcaatggaacatggcatgaagtcggttgaagttgcggttaagggcccaggttctggccgtgaagctgcgatccgttcacttcaggcaactggtcttgaagttactgcgatccgtgatgttacaccggttccgcataacggttctcgtcctccaaagcgtcgtcgtgtttaattgttacccttcggccgctttaacggtcaggcagacaaatcttcacttctcgttttgaaaggggtacaaactagatgatcgaattcgaaaagccgaacattaccaaagttgacgaaagcaccaactatggcaagtttgtggttgaaccgttggaacgcggctacggtactactttaggtaactcgttgcggcggatccttctttcttcattgcctggggcagctatcagcagcatccaaatcgacggggtactacatgagttctccacgattgacggtgtgctggaagatgtgacccagatcattttgaatatcaaaaaattggcgctcaaaatgaacactgatgaagacaagaacatcgaaattgatgtcaacggtccggctaaggtaactgctgctgatatcgtcgctgatcctgatgttgaggtcttaaatcctgaacagtatatctgtactgttgcagatggcgggcacttccatgtacgtatgaccgttaaaaagggtcgcgggtatgtggcagctgaccaaaacaagtctgatgacatgccaatcggtgttttgccgatcgactcgattttcaccccgatcagccgggttaactatcaagttgaaagcacccgtgttggccgtcggaatgatttcgacaagttaacgctggatgtatggactaatggctcaatctcaccacgagaagccatcagcttagcagcgaagatcctgacagaacacttggacatcttcgtcaatttgacggatgaagccaagaacgctgaaatcatggttgaaaaagaagagactcacaaggaaaagatgcttgagatgactatcgaagagcttgacttgtccgttcgttcttacaactgcttgaagcgtgctgggatcaacacagttcaggagttaaccaacaaaacagaagccgatatgatgaaagtacgtaatttaggtcgtaagtcacttgaagaagttaaaaacaagttggcagatctcggcttaggattgcgtaaagaagactaatttcgaaaaggaggccaatccatgagttaccgtaaattagggcggaccagctcacaacgtaaggcattgttgcgtgacctgaccactgatcttttgatcaatgaacggatcgtcacgactgaagcccgcgctaaagaagttcgttcaactgctgaaaagatgattactttgggcaaacgcggcgatttgcacgcccgtcgccaagcagcagcttacgttcgcaatgaaatcgcgagtgtcgaggaacaagatgacaacagtgttgttgtgaagtccgctttgcaaaagctgttcagtgacttggcaccaaaatacgcagatcgcaagggcggttacacccgcatcttgaagactgcgccacgtcgcggtgacggtgcaccaatggttatcattgagctcgtctaaacacagttaaaaatggatggcccacgcggtcaaccaactttgatcatttgatcgatggagcgttacgatgatggcaggcccagttcctgcttagtctagcttgagagcaccgggcaaccggttgtctccatcattaaatgattttttttgtggaagcgcgagccagcccgggtagaaaccggagtataagtggctttggtcgtgatggctgggttttggccattgcgaccaaagtccttacacgcaggtttctgggctggcgagcacgttatagaacgcgcagaagctcaatggtattgtcaaggatagaacattcctacagtagcatgaaccacagaaaacctgaaaaacctcgcagaaaaccgccaaaattggcggtttttcctgtatactgcaaaataacggaggttaacaacatgcacaattggcttaaacaaagagcaccatggcagattggattatatgtcatcggcatttggtcactgattgccattgtttgggttctcctgttggtcttgttaacaccaccaaatggcagcacaggtggtttattgatgccgggagtggatcaccttgctaacggcagcgttattgtgcaatggctgtcatatgcttggctcatatcgatgttaagtggttatctgacgggacgacaatatcgcaagcaaaaactaacccctgcattgcccaaaacacttataccactaacgactttctgggtcatcattttgcttcttgctcaatggtatccactgtcttggttgacgaaaccacactcacttgacggctttctgctgctggcaatgcttagttttgttgtcattatgccagtcgggatctgcgccgcatatgcaggactgtttgtgaacggttctcggtatttaacagtcattttccttgtgcttttgctgatgacaatgcacactaatcaattgatcgtgaatggcaacagtcaatttggtatggtgatgttgaatgcgactccaatgcgagtacaggcttggatgttgttggttggcagtttgatatttagtgcggtttttgcattccttagtactaatcccgatatcgttaaaaataatttctagcaaacctgtttttcatggatgcatgattttcacccatgtcgtcatggcttggaaactgcaagacaaggggagcctaactcccatcggctaagtaaaatatggtatcattatccggtatacaaagcgtaggaagaaggggcatcgtgggcaacgtcattcgtgttcaacatttgaattacacttatcctgaagccaaacagcaagcgctgacggatgtttcatttgatgtggccaagggtgagtggctggcgatcatcgggcacaacggcagtgggaagagtacccttgccaaaaatctaaatggtttgctggcacccgaatccggtactgtgcaggtagcaggcatgacgttgagtgaagaaaccgtttgggatattcgcgccaaagtcggcattgtttttcagaatcctgataatcagtttgtcggtgcgacagtcgcagatgatgtcgcttttggcttagagaatcgtggcgtcccgcgaccggaaatgattaagcgagttgacgaggccttggatcgtgttggcatgacggcttttgccgatcgggaaccgtcacggttgtctggcggtcaaaaacagcgggttgccatcgctggcatcgtggctcagcgaccggaaattattattctagatgaatccacatcaatgctggacccagctggtcggcaagaagtgttgggtgttattcgggaattgaaagacgaacttgggttgacggttctttcaattacacatgatattgatgaagcggccgaagcacaccggattattctcttgaatgatggcaaaattaatgagattggtaccccaagcgagatcttttcgcatgggatggagttattacgactgggattggatgtcccatactcggagaagctgaaagatgctttggcccagcgcggcattgcgatgccgaaagactatatggacaatgaaaggttggtagactacctgtggacattacattcgaccatgtgagctttacctatcaggcaggtacgcctttcgctggtgatggcattaaagatgtgagcggggttattcgagacggcagctatacggcaattatcggtcacaccggttctggcaaatcaaccattctgcaacatctgaacgcgttgttgaaaccaacttccggcacggtgacgattggcgacaaggtcattaccaatgaaactaacaataagaacctcaagccgctacggcaaaaagtcgggatggttttccaatttgcggaaaatcagttgtttgaacaaacagtcgctaaggatatcgcttttggcccccaaaattttggagttagcgaaaaagatgccttagctttggccgataaaatggtcaaaatggttggcttaccgcatgatgtgttggaaaagtcgccgtttgatctgtctggtggtcagatgcgtcgtgttgcgattgcaggcgtgttagcgatgcagccggaggtattagtactggatgagccaacggcgggcctggacccctcaggacgccatgagatgatgcaaatgtttgaacagttgcaccgcgagcaaggacaaacgatcgtgttggtgacacatcaaatggatgatgtggcagactatgcggatacagtttgggtcatggcagaaggcaagttaatcaaaacaggaacaccgcgagagatctttgctgacccagcttggttaaaagcgaatcagctagggctgccaaagacggcgcaactggcgcaacaattagcagctaaggggttccactttgatccacaaccgctaactgaaagcgagttggcagatcaattggtgccgcaaattggaggtggccagcgtggataaattactgctaggccgctatattcccggcgactcgtgggttcatcgattagatccgcgaaccaaacttatcgccagcttctactatattggaattgtctttttagccaataattggcagacatacctaatgatgtttgtagcgacactgttcatgatttggttatcgggtatcaaaatcggcttcttccttaagggggttcgcccactgatttggctgattttgtttacggttgtgctgcaggtgctattcgttcgtggtggtacagtttactggcattggggctggttatggattactgaatttggtctgataaacggagcctttatctttgtccggtttgtgttgatcattttcatgtccactttgctcaccttgagtacccagccgctgtcgctagctgatgcggtggaaagtctgttgaagccactgcgggtcattcgcgtaccagtaaccgagctggctttggttttgcagattgccttgcgtttcgtacccacgctgatggatcaaacgaccaaaatcatgaatgcgcagcgtgcccgtggtgttgatttcggtgaaggtaacattttccagcagatgaaggctgttgtaccgttgctaattccactatttgtctcaagctttacgactgccgatgaattggctactgctatggaagcgcgtggctaccaaggcggcgatgaccgaacgaagtaccgtatcctacgctatcatcggcgcgactgggttgcagcaggcgggatgcttgttttaaccggtctgttgctgttgttgcgtgcttaatagaagggacatcatgacgcattacaaggtaacactggcctatgatggcaccaactttgctggctatcaggttcaaccaaaacagcgcacagtccaaggtgtgctgcaaaaagctttaaccaaaatgacgaaggggcagccagtgcatgtcgatggttcaggccgaactgattctggtgttcacgctttaggtcaggtgatcagttttgattacccgggaaatattccggctgagtcgatgctgaaagcgatgaattcgttgatgccattagacatcgaaattcttaaagctgaaatcgttgatgccgattttcatgcccgctattccgctaaaggcaaacggtatttgtatcgagtggctcgtggttactatacaaatccgtttaaccgcctatatactggtcattatccttacaaacttgatgtgcaacgaattgaagtggcattgaaggacctagtcggcacacacgactttacaagctttgcggccagtggcggcgtgattgtcgataaagttcggacgatttatgaggcaactgttcgagaagatccagtgacaaacgaaattatttttgaattctatggcaatggctttctttacaacatggttcggattctcgttgcgacagcgcttgaaattggtaatgggcggcgtgatgttcacgactttcagcgtttgtttgcagtcaaagatcgtcaacaagcacgcggcaccgcaccagcatcagggctgtacttgaaggaagtttattattagaggctgacgctgcggcgttggcttttttttatgaaaaaagagcagattgatgctgcgtattgcatcaatctgctcttaggaaagattcgattaaattaccgcgtatagtgccgcacaatcgcatttaacgtttcagccgctccggctttgccggtgccgtcttcgtaatacttgctaaaacgtggatcggaaacatacatcgcagctaaaccgcgatgagctttttgtgaatattgttcagaaggccaggtcatttgtagaaattgcttgtgcaatttgaagacgcgttttgcctccggggtgttgaaatcggtggtgccaactaccggctttaaggcatccaaaatttcctgttgtagggcagttagttgcgcaacctgcgcctgtgacatatcgcggaactttttgttgctggcttcgacaatatcatccccatattgttgccggatttcttcaccatattgttgttcgtttgctttgatggattgatctttaaaagcggcaaatttttcgtcatcagtcattgtatcgactcctttttctaaagtttgatcaagggtagtgagcagtaagcttagttgatcgcgtttggcagtgatgcgtttgcgttgttgcttgagagcggcggttaagttttcagcaggaccgtctagcagcaccttcacttgggcaagcggcatctcaaataattgtaagaagcggatggtttgcagacgatcaacctcagcctgagtataaacgcgatactgattatcaggatcacgttgcgttttcagcaagccaatcttgtcatagtagcgcaatgttcgtggtgtcacaccagccaaatcggctagttgctttgtagaataggtcatcacttgcctcctaaacgcgctcaaccagacacttccaagggcaatggccaaagatggccaaagacccggccgatgtccttgaagtcgcttatatgccggtttcaaaccgacttggttcgcgcgctcccttaatcaactataacaataaaccgtgacgtaaggtcagggtcaagcgcaaaagaaattaattatttggcggggaggacttcctaaaatttgcaaaaaaaagagccgcgacccgatagtgcgatccgcggttcatgatattcagttgtttgacgatggttacttcttgaggaccttttcggccaaagctttgacttcgtcgtcggacatatctaagactggcttcatttcttcttcagtcttaatggtgtcgcggctgttcttttccatgtaataatcccacagcgcatcacgtacaggtgcttcgctgtcgctccagtcaaataccttgttcattggttcatcgagaaacaatgtcttttcaggatctactgatgccataatgattacctccatgatttatactcatttttgatacaagttcattataatccttttactaggagatggtgcaaatttttagcactgtttttaattgagtgctaatttttaggagtgtttcttcgttgctagccgatagctggtaacagtcagtgcgtttacgacagcaccttttagatggcacttgcctttattttccgcatcccttcgtcagttaacgtctttaaatggccgtcgcgcatttcataaacggtgtcgacagcatcaagtaagcgtgtatcatgggtaatcatcatgacgccgcgttgagaatggtgtgcgatatctgctaacaaatcaacgacctgcaaggcgcgcttagtgtcgagactggcagttggctcatcggcgaggatgatcgacggatcgttgtacaatgctcgcgcgatggcaacgcgttgccgttcgccgccagataaagctgcagggtaattagtaaccaagtcgctaatgccaagcatgtcaaaaagtgccgacatggttgtttcatgcttatgatgatgattgaaccgatcaactaaggtgagctgatctttgacggttaaaaaaggaatcaaattgctagcttgtaaaataaaaccaaacgtattgaagcgtaaatcagttcgttggccttcattcaaatgggtggtgtcttgatgattgacgataatctgaccgttgcttgggcgttgcaggttgccgataatcgtcagcaaagttgttttgcctgaacctgaagggccaatgatggccgcaaattcaccggcctttaaagtgaaatcggtcgggtacagagctgtgaccgcggtatggccagtaccgtaagttttactaacttgtttcaactgaataagaattgccatctcattcgcctccaatcgctgctaatggatcaattcgtaaaatgcgtcgaagtgaaaatagtccaccaataagcgacatgacgattaacgccgtcgcaatgctgaaaaagaggatactattggcataaaatggcattgttttgggaagtatcagctcagtcagcatcaacaggcctgcccccaccgcaacgcctaccacagcgagcattaggatttggcataataatgcggcgatgatggcacgcgttcggataccttgcgcccgcatgacgccatacatcgagattttttggatcgtcaagatgtacatgaaaatcccgataatgagcaacataatgccaatcatggcaccaatcatcaaagcaaatgtcgaagtttcggcggtataaccggggatgttgttaatcaacgttgcccgggtgacttgctccattttggcgggcacctttttgaaggcatgcgggctaatcaaaaccgaaacgttctggacacgactttggccgtattttaattgccgaaaagtcgttaaagttgtgtagaatacaggtacagtgtaaaaaaggcgatcatgggtgagtccgacaatgtgatacttttgatcgctgccattgagcgtgatatggtcaccttgatggaggccgtaatgaagaacactgtcgtcagccagtacctcattgctgtcctcgggcattcggccgctggtgacaggtggcttcaacttgccactaagattgacaccaaaaatattactgttcaccttttgattcgtcttggtgttttcggcgacaacggacacttgaccaagcagcgctgcctgatgagtgtctgcctggtcgacttgttgcttagtgacagtcgagcttaacagatttttatttgcgtattttgacatgagcacatagttacctggtaaggcatcaatcgcggttcggttgttccgcgctaaaccggttgccaggccagtcagaaagaaaactaggtaggaaattagcacaaaagtcaccaccactaaaaggtaacgggccttgttgtgcgtaatctctttataggcaaggaacatcttgttcacctccaggtttgattttgcacaattataatatcactcatttatcaaatgataaacgaaaaggacttaaaaaatgaatcaacgtgaacaacagaaaaaagcaaccatgcaacgcattttgacgacagcacaaattttattcatgacgcacggttatgctgcggtcacaacgcggatgattgccgacgccgctgatgtccagcagccgttgctttaccactatttcaagactaaagaggctttgtaccttgctgttgtcatgcatgtaagtgaagcaatggccgcaaaaatcgtgcatgaacaaacagatagtcaacattttgtcgccaacgtcaatcggctgggccatttgttaactgacgacaatgatatgaacttgcagttggtgctccatgatattggcaacttaaatgaagcagcgcgattcaaagtgtttcaagcgtggcaaaaaggcctgttgaatcccttagacagtttctttaccgtttttaaacaacgactcgcgccggattaccaaattcgggaagtgacgttgtattttttgacagtcctatcagtttatctccaaccaaatgagcgtccgactagcaaccggataacattcaaacgccaattatcgcttgatcgcgcgttgcaaatgttttgtacaggggtccagcagaaaggaactatccagcaagactgataagtgtgctggatgatggtgcgtcctttcaaaaacatagcatgagaaagctgctctagataaggcggttcggcactactggtttgctgagcagtcgacagtttcgcggcgatcgtttttcgatttttacattgacttagacgccaatcgttggtattctagtagctggtattgtttgccccacgataagccccggaaacttaacgtgttcaaacaagcacagaattatggaggaaacaaatcgtgcgtacaacatttttggctaagccaggtgaaatcgaacgtaagtggtatgtggtcgacgcaacggatattccgctgggccgtctctcatctgtcgttgcttcgatcttgcgtggcaagaataagccgcaattcaccccaaacgttgatactggtgacaatgtcatcattatcaatgcttccaaactgaagttgactggcaaaaaagcctcagacaagatttactatcaccacagccagcatccaggtggtttgaaacatgaaatcgctggggatctcttgcgggataacccagctcgtctcgttgaatactctgttaagaagatgctcccgaccaagaatacacttggccatcagcaattcttgaagcttcatgtctatgctggggaggaacacccgcatttggcacagaagccagaagtactcgacatttcaaacttaatctaaggaggcaattactgtggcacaagtacaatacgcaggtacaggtcgtcgcaagaactccgttgcgcgggtccgtttggttcccggcaccggcaagatcacgatgaacggtaaagacgttcgcgactaccttccatatgaaaacctgatcactgatttatcccagccgttcggtatcaccgaaacaactggcagctatgacgtgctcgttaacgtcaatggcggcggtttttctggtcaggccggcgccactcgtcacggcattgcccgtgccctgttgaccgtcgatccagacttccgcggcccattgaagaaggccggcatgcttacccgtgaccctcgtatgaaggaacggaagaagtacggtctcaaaaaggcccggaaagcatctcaatttagcaaacgctaatatcgagaaagtcaaatgttcagaaacgctgttatggcggcgttttgggcagctatcgcgaacagaacgggtacgcctcaaatggggagtgcctgttttttttttacccttcaaaatgtacggattgtgtcatgcttttttggaaggtgcctgttggtccattttaagatgactgattcaaccttgccttactttcatatatccgtgggtttcaccggaattaaatgaacttgttttcatcagcaatcgccttttcgcgtgcttctgcgaggcgagcagcgaacttatcgtgtgcgtccagatcaatgatgtctggggtatttacataaattcttgtggtcttgatattgccatgggtcagcgcttctgaaatctcttgaataccggcacctccttggcgagccaacgtagcgaaagtgtgccgcaacttgtgtggcgtcgcccgtaccagtcggtcagcatggcgcttgtagatagaattcatgcggtagttgagatagtccgcatggagtggttgattgatacctcctcggaaatttgtataggtgaataggaactgatcggggccactcttgatcccgacattgcctaattgttggtcttgcttttcttgccattccttcaacataggaatcagaaatggcggaatcacgtgcgacgtttccttgccggtctttgttggcccaagcttgcccgactttttcagcgcctgaatgattaagacattaccctcacggagatcaacgtgtttccattgcaacccataggattcagccttgcgatcaccgagattgagcgttataaggaagaggagataatcctcgaacttcagcttaccaacctcacagtctaccttagcgcagtctaaccatgcgatcagttgatcggcggtcaggtactcaccgagcgcttttcgacgttcggccagacgtttttgcttggggctacttatttgtcgcagtggcttctccatgcggttgacatcgatgtactccgcaatctcggccgtgtcaaacatttggttaacgtaagacttaacggtgcgaatatttgcgtacttctccgacatgatagtcagttcttgcatgacgaacatcgggttgagattcagataattcatagaatactcgccaaacattgggttcaagtgtagccggaaaatcttcgcggtgttgtcttgggtttcttcagacgggatcgtccgagagcgaccagatgcaccagccacgtacagaggccaccagatctttttatagaaatctttgaacagtatctcgccgttcttgctgatcgtacccgcattcagcttacgttcagcatctcttatctgctttttgaccatcttctcaagcgttgtcgcttcgagcttggttgaaacagtcttgcggtaacgagcttcatcagtaccgaggacggtacgaatatctttgggatagaacacctccaccttgtaactgcctgtggttgttttagtaattgccattatatttgcctcctgtttgagagcggactccgaagcaagacgcaaagctacaacgacatattaccatctctccatgcgagtttgcacccactgatcgatagcaacacgatcgtaacggacagttccacagacgttgatccgtggtagccctaggcgtagccacttgtctagcgtgttgtttgaaattttgagataggcacagacttctttcttcatcagatagcgttcccgttgtaccgcgtcgttttgagccttttcgactgcctcggtgaaaagggttgaaagggcctgacgaatggcgataacgtgattgtcatctaatgggaagtccagaccatcatgggtagctattgcttcgatgttgtgtcgctcctttctgtgagcactaccttctacataacttcaatgcttccatcattcagcccgggtccgaccggctatcgaggatctcaatgagagcctctctccctcgtttcgtcagggtgacgtgcaagtatccggctcactgggtaaatcgctcgctcgtgagaggtcatggcgttgtggagccttcgttgctgaatgatgctatttagttgtcaaaggactaagcaggcaaaagaaaatcccgcctctgcatatacagacagcagaagcgggtcgaaatgaaaccatttgttgaataaagttgaaaaatttttatttgcgatgttttcatgattttgatctagcggacggttgtgctaagtgtttagccacgtcgaatcgcggtacactgaatacaaacttgatttgaagttgctgcctcaagtcgggatcgacatagctttttccgaatgcagcttcacgatcaaaatcgtggctgaacatatcgagtagtttggacattgcttcatcgtctccgtcctgcgctgccaagataaccggtactaggttatcgatctctgtataatgcattgaatactcctccttgtattctctacatgtttgcgtaagcgtctttgatacgctttattgcccgtcgccgccgtttattcaccccctgacttgattttccggtgcggctgccgatctctaccgcgttaagctccgaatagtaatactcatataagacaattttatcagctgtggaaagggttgcaacagcctcggataattgatcgtcttcgatgaaatcttcgagcttggcgacttcatcattggtcaatttaaagtcgtccagatgataaggttcggcgatttcctccaacagccaatattcgagtggcatctccttaatatcattaagatgcgcattataaatattgatacgctcatttctaagaacccgttgcatgtacttgatgaacatacgtgaaacttcgcgttcgctactcaaagtgattacctcctcaaggcttaattttctggtctcatatatacagacaagattttgacgagaaaatgaaaccgttagccaaataatttcgagattcaatttttgctaataagttaatttgctgtagaaaaaaaccattggctattaaccaatggttgaagtagtcatgttccggtatcaaaagctgtgaatagttcttaatcattgtcgggtgaaagaaattaggaacgagcgagaaagcgatacgcatgttgcggtgggtaatcaatcaggataatgaagttgaaatatcccaatagcatacgtgtgtaatacatcgatgtcgcgagccgtaatggccatcatcacatttttcgattagtatagcaccgataatgttttttacaatacttatttacggtaaagagtaacggcactcttgatcagaaaaaatatgcaatcagaatgttcggcaatcaccattgtccctttgtaagcctgacacaatccaaaaaaagagacccgcaagatttagaattgcgagtccctcgtatataaaaaaggttatccggtctgttagttcatattgaatcgaatttctattttgagttctttcgaagatccttctgtttttcgcgtacgagtgatgccaattcgtcaatttcagaggtttcggtagtagaatcaatgaaatgcgaaactaaatttttgagtgcagatggcgacatgatcttcttaaagtaatcttcttgagataaagaggcgataaaattacgagtgtgaacagttccgctctgtccaataccatcaacctcaataacgtgttcactgaggagtttacgaagcacggcttggactgtgttctgactgagattatcagagagagacgttatttctcgaaccgacaaggccgtagccgaattccaaagtatttgcatgatctgcaattcgcgttttgtcaacatgcctattttcaaaaaaaatcctccgatacgtttttacaatttagacacagtacatgtctgaagtgcacagtgtatttgttgcggtttaaaaacatctgtatggaactaataaagcaacgttcaactcaattttattttacccttcatagagatattctgccactcgatacgtcattgtgttttaaaagagaaatactaagcaaaacatggtacattgctactcctgataaacctaatatattgatgatacgaagaaatatgagagcgtaaaatatcttgtgtaaacgcacaaaagatttctaaattgtatagaaatagggaatgccttcccttatgattgtcaagggcggttttgaaatgtaggtttatggcggtttaaaaatgtaggttttcggcggtcaaccgacacctttcaagcggtacgatttgccggtaatcttcacaacgtggacatggtgaacaaggcgatccagtattgctgcggtaacggtgggattttgaaaaatctcaacccaacc

SEQ ID NO: 37 - DNA, 82946 bp, Lactobacillus paracasei
  misc_feature (28898)..(28921): n is a, c, g, or t
catctgcagtgtcaattgaggccgcttcagcgtctgaatcaatagttgtcccggcaaggaccgcctatatagaaagatacgataacgatctagactgattgatggtggtgcaatcatattaccatcgccgcgtcgcagtaatggtgcagcgtctgactgcatcgtgaccaagtctgcggcaattttttccatccggcgtcggagttggcggtaactctcaccacgggttatggcggtggcagcaatatccagccggtgccccggggcctcccacaacgtgctgtagatattgatgcgatctcgctcttcccgatcgagaaataattcatcaaagaccataaagaaggcctcctcgaaagcgtttgctacagtatagcaaaggtagcaaaaaacccgataagatatgctcatggttttttaagctttttttacggtctcaactgatttttatcgcaaatatttttggtcggtttttttcgtcaataccgtgacgttgatacaaagttgctcttcagcttcaacaaatagttgacgggtgcgactggttttcgccatacgaacttggtatactaaaagtaagcaaaagtgtcagccaataccatacacttggggtattcaaaaaaatagccccaagatatggtatttttaattgacagacaccccaatattgagtatcctaagctacataagataacgagaaaggatgatacctatgcgtaacatcaccttattcacacgcaatggctgcccgcaatgccggatgaccaagcgctaccttgacacccataaaattccattcacggagcacaacatcaacgaagaaccgcaatacattgattacttaaaacaaaaggggttccagcaggttcctgttctcgaagcggatgggctcgattcattctccgggttccgaccggacgccttgaagcaactggctgtttgatcagccagtttttttatcgcatcacaacgcaaccagctattataaaacgcagcgaaagcagggtttagcatgtcattaaaaacaattagtccggatcaagtcacctattacgcgctcaacaacgagatcaacattcctgtgaatgaccagattccgttgaacaaagacaaggaagcgttgcaggcatttttgacagaaaatgtagcgccaaatacgatgcaatttgattcgctggctgatcgactgaagtatttagtcgataaccactattatgaagccgactttttgaacaagtatcagccagcttttttggaaaaactggatcaatttctttcagcgcagcattttcagttcaaatccttcatggccgcctacaaatactatgcacagtatgccttgaaaaccgatgacggtacccagtatttagaagattttaaagatcgggtttttgccaacgcacttttctttgcagacggtaacgaggacttggcggttgaccttgctgatgaaatgattcatcaacgttatcaaccggccaccccttccttcttgaatgctggccgggcccgccgtggcgaactggtttcatgttttttgttgcaaatcactgatgacatgaattcaattggccgggcgatcaattcggccttggaattgtcacgaattggtggcggcgttggcctcaccttgtccaacctacgtgaagccggtgccccgattaagggcattgaaggtgccgctagcggcgtcttgccagtcatgaagctgttggaagactctttttcctatagcaaccaattgggccagcgacaaggtgccggtgttgtctatctgaacgttttccatcctgacatcatcagtttcttaggtgccaagaaggaaaacgcggacgaaaagtaccgggttaaaacactcagtcttggcgttgtcgtaccggataagtattacgacctcattaaggctaatgccgatatgtacctcttctccccttactcggttgaacgggtttacgggaagccgttctcttatgttgatatcaccaaggaatatgacaacatggttgccaatccggctattaagaagtacaagattaaggcccgtgatctagaaaacgaaatctccaaacttcagcaggaatctggttatccttatattatcaacattgatacggcaaatcgcgccaacccaatcgaaggcaaaatcatcatgagtaatctgtgctcggaaatcatgcaggttcaggtgccttccaagttgaacaataaacaggaatatgaagtgctgggtactgatgtatcttgcaacttaggtagcacgaatattcccaacctgatgcatagccgcgactttggccgcagtgtcgaagcaatggttcgtgctttgacttatgtcacggaccacagcaacatcgacgttgtaccttccgtccagcacggtaatcaccaggctcacagcattggccttggtgcgatgggcttgcacacttattttgcgaagaatcatatgttctacggttcgcctgaaagcttggacttcaccaatatttacttccttttgctgaattactacaccttgaaggcatccaataaagttgcccaagaacgcggcgaaagcttccacaacttcgaaaacagcaagtatgcggacggtagctacttcgataagtacaccgagcaagtatgggcaccgaagtatgacaaggttcgcgcgctgtttgatggcattcacattccgacgcaggctgattgggaagcgctgaagaccagtgtcatgaaagatggtctctaccatcagaaccgcatggctgttgcgccaaatgggtcgatcagttacatcaacgacaccagtgcatcattacagccgatcgttaaccgcattgaagatcggcaagaaaagaagatcggcacgatttactaccctgctccagacctttctaatgacacgatgccttactatcaaagtgcctatgatattgatatgcgtaaagtgattgacgtttacgctgctgcccagcagcatgtcgatcaaggaatggccatgacgttgttcatgcgcagtaccattccggctggcctttatccttggaaagatggccgaaccgataaaatgaccacccgtgatttaaatattttgcgtaattacgcacatcataagggcatcaagtcgatttactacatccggacttacacggatgatcaagaagaaatcggcagcaacgcttgtgaaagctgctcaatctgataatcttttaacagggggagtttcccctgtttttacataagggagcgtaaacatggcaaaacagtacattgcgatcaattggaacgcgatcgaagacgaagttgataaagcaacttgggaaaaattgacggaacaattttggttagacacccggattccgctgtccaacgacttggacgactggcgatctctcaatcatgacgagcaatgggttgtcggccacgtattcggtggcttgaccttgctggataccctgcaaagtcaggacggcatggcaagtttgcggcagaatattcgcacccagcaagaaacggctgtgttgaacaacattcagtttatggaaagtgtgcatgcaaagagttactcttcgattttttcaacgctaaacacaccagcggaaatcgatgagatcttcgattggaccaatcataacgagcatctgcaatacaaagccaacaaaattaatgatatttatcataacggttcggcgttgcagaaaaagattgccagtgttttcttggaaaccttcttgttttattcaggcttctttaccccgttgtattacttgggcaacaataagctaactaacgtggcagaaatcattaagctgattattcgtgatgaaagtgttcatggcacttatatcggctataaattccagctcggattcaacgagttaccggaagctgaacaacaaacattgaaggattggatgtacgacttgttgtttgatttgtatgaaaacgaggaaaagtacactaacgatctttacgcgaagaccaactggacggatgaagttttgactttcttgcgttataacgccaacaaagccttgatgaacttaggtcaggaaacggcttttcctgacacggctgatgacgtcaacccaatcgtaatgaatgggatttcaacgtctaccgccaaccatgatttcttctcacaagttggtaatggttaccggctgggtcaagttgaagcgatgcaagatgatgattatcagttctcaactgaagatgaagaccacgacaaataaagccgtcgcggcaacaaaaaaagccactgcaatgctttgcggtggcttttttgttttggtctgattaggacgatgatcattcactgtctttaatggtttgcttcatcatactaagaaaacgttgcgcgattctggacaactcgcgatcacgtttccagacaagcgctactgggtccgctaatgctggtgctaatggtcggaaggtcaatgatgtgttaggactttgggtggccaaatattcaagacacaaggctcgtcctaagccgacagcagtcatcccaagcgcatcgacggtcaggtcataagtcccaacaatgtaagccggatccatgccttggcctaaccagtgttcaaatgtgttgcgtgcgtgcgtggcccgcggcaggattaattcactgtcgccaatgtccgttggtgtcatcaataaattatcagttaacggatcatcactggtcatcaaaataccccaagcatcacgaactggcagtagcaaactttcatactgcgtctgctgcttgccaggccgcagtatgaaatcatacatgccggcctcaagattggccaccagcccttcatccgagccataggtaacatgaacatgcaaaccggggtattgatggcgcaattcttgggcaacatgaagaaccaaccgtttgccgctggtttcgcctgcaccaatgtaaaggtcaccaccaagggcatgtttactttgcaaattattctttgtgcgctcggcaattgcggtgagttcacgtgcccggtttaacaaataggtaccatcttcagttagcgtcacacgtcgattaccacgaactagcaatttaacgccgagctctttttccaagtcttttaattgacacgatagtccgggttgtgaaatgcccagcgttcgtgccgccgcggtaatactgccgtggtcagcaatctcaatgaagttgcgcaacgtctgcagttccataaactcccctacttcctatcagccttgtttatcgcaaacggcttcctataacaattataccctatccgacaacgattgtattccctttcacacagcaggacgcaactattttgtaagtcacgctcgccacgggtaatttatttaaatctagtcactcgcatctcttgcaaaagatcccagcctgattcaaaaaaagcaccggctgcaaatgagccgatgctaaaggattaccaaatttgaacacgtttttcgggtggcaaatacatcccatcacctggttggacatcaaaagttgtgtaccaatcatcaagattgcgtggctgaatgttcgcccgcaattcgtgtggtgcatgcacatcaaccgctagtagcattttttgccgttcgaggcgagactttgaacgccaaattcttgcccagttgatgaagaaggcatgcagatcaacgtccggttctctcttggctgtatctaaagccgcagccaagccgccagcatcagcgatgttctcagaaacaacgagtttgccattaactttaccggcttcagtttcaagaccgtcaaattcttggatcatggcttcggtgagcttgttaaagtgagcataatcagctttttgccaccagttcaccatattgccaagttcgtcaaattgagcaccgttattgtcaaaaccatgggaaatttcatgggcaatgaccgcgccgataccgcccagattttcggaagcactttgtttcagggaatagaacggcgcctgcaaaatggcggctgggaaagtgatgtcgttcttggaaggatcataactggcattgaccaagtgacctggcatattccagacggtgcgatcaacaggcttggtgagcttgtcgaagttgtactgaagctcaacaagttgcatcgcgttgatattatcgatcagtgacttatccggattaacgtgcagcaaatcgtagacgtcctcaggtttatcgggataacccattttgagcaccatcttgtcgagcttaagaatcgccttgtccttggtcggttgtgatagccaatcagagttgctgagtcgccgtttgtaagtggcaatcattttttggacaagttgtgttacatcagccttcgccttttcgccaaaataagtgcggccgtagtaaatgccaattggttcgctaaagaaagcgttggctaatcggtaggcgtgtttggtttgatccggtgctttgggcgcaccggatagcgcacggctaaaagtaccgcctaattggcgcaatggttcgcttaaaagactaacaagactgtttagccgggtgacatacaaccagtcgcgataattgctgaagttagcttcgttgaacaactgcgtaaactcatccaagaaccgcggatcattcacaacgaccgtttctggcacctgtttaaagatcttttgcaagaagtcagcaaacttgaatggcttgagtttttcaacgacctccgctgtcggcatcgggttgtaggccttagggtaatctgcccactcttcagaactcttaacatgtttcgcaatttctgcatcaaaggccaaggcgccagctaaagttgccttttgcgtagcatcgtcaagatctgtgtaagctaaaagcttagccatcatatctttgaaaatggccatcaattgttcgccgttttgattgcccttggcgtagtatgtggtatccggcaaaatggttcgtggacccatcaaattaatcacatttttgctggtgtctttcatgtcagcatctacgtagaaattaaatggcgggtcaatcagatgctcctgaagcagttcggctgcccgttgattgtaatccgcaaggtctttaatgccagcaaccaaatgtagttgcggcaaggctggtgcaaagcccgctgcgtctcgggtcttgaaatccttggcttgtttgtacagcgtcaccgcagatgcaaaatacttgtctggcgccgtttttttgccgtcagcaatcgctgaaaaatcagccatcattttttcttcgacttcatcggcaaggtcctgaaaaccgccagtactgcttttgtcatcaggaatgactgcctgatccgtccaagccccgttaactgcccggtacagatcatcttggtagcgcacttcactagtcattaaaaagcccctttcaatatgaacagatatgtcataatcttaacgcacttctcatttgcgtgcacggttgaatcgcttttcatccatattccttttagttgagaacaatgaagaactgattaagtcaattgttcacaatcgaaatcgctttctttttaatgattaacccgctaaaatggagcatgaagtcaaatcgatggctagtcgtcaatggcagtcatcattcaggaggattgaaaatgtattatgtcattatgaagtctcatgatattcgtgagaatctggcaacagaacaatatctcatgaactcgaaacaatttgatgaaccgttactgctgttctactatgaaaagtcgagtgtgattgtgggccgaaaccagaatacgcttgaagagttgaatcaaaaatacgtggaggatcataacattgttgtgacgcggcggttatccggtggcggcgcagtttatcatgatctcaataacttgtgcttctcgtttgtggttgacagtgactctgaagaatttggtgacttcaagtccttcacacagccgattgttgatgcaattcatactttaggggcgactagcgctgaagtttctggccgtaatgacatgctggtcgacggtaaaaagttctctggcagtgctatgtatacacgtaacggcaagacgttctcccatggtactttgatgctggatgttgacatgagtgtgattcctaacgtcttgaacgtcccagaagacaagatcaagagtaagggcattaaatctgttaagagccgtgtgacgaacttgcggccttatctagataaaaagtatcaaaacctcactgttcctgaattccgcgatattcttttgactcggttgttcggcgttgatgacgtcgctgaaatcaaagacaaagagtatcacgtcaccccagaagacgaagtcgaaattaaaaagatttacgatgatgtttacaacaactgggattgggtatatggccatagcccggaattcaccaccaagaagcggaagcattttgactatgggacgattgatgctcgtttcgatgtcaaggaaggcaaaattgctaacgtcaaattctatggtgatttctttggtcctaaggatgttgcggatgttgccggtgcgttaaaaggcaagccttacacgtcagcagccattaaagacactttagatgccatcaacacgaatgagtacttcaccaatatttctaaggacgatgtggttaacctgctcgtaccataatcgcatcattttttagaacttaaggcagcacggccaaatgctgtgccgccttttttcatgcaaaaaggacaacctttaacaggctgtccttcgatcgatcaacgattgatcgctcaattatatttaatttgactaatggcgtacgcctgaatccttttcgctccccgacctgttgccacggtgatcacgccgcgttcattataaggtttgacagtcgcggcctcaatatcgaccacgcgtcccttgaaccgatggcgatcaatcgtattgatcgcgacctcatgctgcgtgtgcaatgcatcttgaagcaagttggtaatttcttccgggcgttgtgccataagcaattcctccttcatctaagagcagacgagcgaaaaacctgtccgcagatgtctcaatgcgcatcgctgctagccgcggtgaacatcagtcagcgacgatgcagtgactgaaatcggttacagcttcagtataacggttgtgtcgaaaaatttcagtatccgcgcgtgagatcaacttgatggcttgccaattggccgcttgatatcaaggttttgaggttatcattaaatattttaaaaactttgtcgcgtaattgtggcaccgtgcccgaaatatgcggcgtgagcaaaacgttcgtcatgccccataatggtgagtcttgcggcagtggttccggatccaccacatccaaggcagcagcactgatttgcttgtttttcaatgcctgcgtcaaagcagccatatcaactgacggaccacggccaatgttaatgaaaagcggttgtttgctagcggctgcaaagaatgcttcatcataaaagtgttttgtatctggcgttaatggtaacgcgttgatgacgacatctgctcgccctgctgcctcatgggtcgccacatccgtcatcacttggtcaaatcctgcagctggacggccatgtgcactcacgccaattgtgtgcaagcccaatgcttggagtttggtcgcaatcgttgatccaatatgaccggtgccaaaaatgactgctgttttgcccttaagcaatgtcattggcggtcgctcttggcgtaatgtccacatgtcgcgatctgctcgaatggctggcaaaataccgcgactgatcgtaaacaaggcgccaagcacatactccgcaatgggttcggcgtgaatgccgcttgtattagccagcaagacatggtgtttagccaactcagccaatggtaaataatcaacgccagcggacatcgcctgcacaaactgaagtcggtcaaagttcacgcgggtagccgcagcattccaaccataaaccacgtcaatttgttgagccgtggcatcatcaagcttgtcagcatcgatgacggtgtgtcccactgcttcaagtgtttggcgctgctccggcttcagactaaagctgtttagaatcttcatcatgtcgcactccttttcaaaaaacgcgtacgtaggcgcagaaacctgcgtgtaaggaccttggctccaatggccaaagttcggccatcacagccaaggccgctcacttacactccggtttctaaccgcccctggtcacgctctatcatggtgccagttaggtttgccccaatattggaaaagatcggttcggatagtcccattatacagcttgcggcgcttggttgccttgctgccataagccttttcaaagcccatgtcacttgtcaaaatgtacttgctccaagtggtcaaaggcgcaaatgcttggcccatttctgcgtataattgtcgaaccatggcctgatcgttgagccgtttcccataaggtggattggcaacaatgaccccgttttctttggtcgtcgaaaaatctttaaccgccaattgtttaaactgaatgctatgcagcaagcctgcttgttgcgcattcaacttggccatctcaatcatgtcaccgttaatatcgcttgcctgaatatctaattcacgatcaaagtcagcttgatccatcgcttcatctttgacggtttgtaagactggctggtcaaaaaagccaaagttctcaaaagtaaattggcgttgcagacccggtgcaatgttatggccaatcaaagcggcttcaatcgcaattgtgccggaaccagtggttggatcgacaaacggcatatccggatgccagtttgtcaacatgattaacgcggccgcaaagttttccttcaatggcgcctcacctttggcaattcgatacccgcgtttaaacagacttgatccagtcgtatcaagcgtcaatgttgcaatatcttttaaaatcgaaacttccagcgggtaagtcgcgccagtttccggtaaccgcgtcgtgcgatgataaaccgcagacattttttcaacaatcgcttttttggtgatggcttgaacgtccggttctgaatgtaattgcgaacgaaccgctcggccctcaaccgggaacgctgcgtcaagcggtaggtagtgatcccaaggtaacgccttaacgccttcaaaaagcgcatcaaaagtcagcgccttgaattgaccaacaacgattttaattcgatcggcactacgcaaccaaacattggttagcgcgattgtcttatcatcgccttcaaaataaaccttaccattttctgttcgggtttgaatgccaagggctttcaattctttagttgtcacagattcaagtccggcagccatcgtggcaacaagttgatatctcatatgggttttcctttcattcatgcagcgtttttagtggttagttttagtttacaagtttttgagatgatttgggggaaaatggtacttgagttggtgattagaaagtggtcgtgatgatcacaggaatttttgtgtaaggaatttgaaggtaaaaaattcgtggttcttttaaacgcgcaaacaaaagcagaaacctgcacgtaaggaccttgaccctaatgaccaacgtacggtcattagggtcaaggccacttacattccagtttctaaacgcttttgtttccgctcttaaaaaaacagcccgggtttccccgggctgtgcctgcatgtagatccctataagccatgttttgttccagaacttgttcaggcacaagctccttcagtcatcatctatctcagcgttaccgctgtattgccgtcgcttcaatttgcttggcaaaacgcccctaccaaaagtttgggttactcgctcgcggggtttacccgttccaccgctcaggtttccctgatcgtttcgtcactgtggcacttttcagacctactagcgcatagctgacgccttagcgcgtttggccgccgtagccgtttacacggcccctaagcttattgggcttagcacgaacactacaagcatctcagcttgtgcgggcatggactttcctcagcctgcaaaagcagaccgcgatcactcaggacctacatgtgatcattaatattggtcaacgtcggaatggttgccgtcatcatgattgtcaacactgctatcagatagctttgagccgaacacatgacgttccagattactcagacgtttaagaatatcataatttgtcgcagccgcattggtttgcggtgtctgcgcactgacattcttggaaacactcagctgtttggtcagctcgtcgacccggctaaacagcttggtattttcttccttcagtcgatcaatctcattggtgaaagcttcgtaatcgcgaatgataccatccaagaattcgtcaacttcatcaggatcataaccgcggaccttgtttttgaacttcttgtccaaaatatccttaggcccgtactggatgctaaactttgtctctttgttactatccattccgacacacctcattgttttcatggaaccaaactactaattagcttaccatatctcaatcattttgaaaatgctcattttcagcttctgccattgcttgcgctgtttcttctaaatcatccatggtaatgagttgaactggataatcacgacggtcagccatcgcctctgctgcttggtaatcccatttagctttacctggaaattctggatcataaaccagcagcgctgcatctgtatggatggtcatgaaccgggtatagccctgcaactgcgctggttgttgatacggtgcttgcgaaaccgcatcagaaaagtccacttgtccacgtagggccgccagttgaccttggttatcttcattccactgcttgccaaagtctgtgaatggaaccatcatcgcaattttaaaatctggatacaatggtttgagtcctaaagcaacctcgactgcccactgctccacgcctaattgcccgccagtaattaaccattccaagccttcatcaagaaactgcatgagcgtattttttaatgaagttttaagtaccttaagttttgggtcattactgccaaaaacgttgagctcataggcacggtaccccgtgacccataatcgttttccaaccatgacttacctccgattattaggccaaagcggctgatattggtataatagcgcaaggagtgtgatcgcatgaccattcattaccctaatggtaatccatacaaagacgggacgcaattttcatcacaagctatttcgcgtccaactatctatggtggacgcggtatgacgttggaagaagaattgaacatcagtaatcaatattaccgcagtattgataaagcggtcgtctacaagaaaccgaccccagttcagattgtgaaagttgactaccccaagcgaagtcaggctgtgattcgcgaggcctattttaaaacgccgtcaacaacagattataatggtgtttatcgtggattttaccttgactttgaagccaaggaaactaaaaataaagcgagcttcccgctaaaaaactttcatcagcatcagattgagcattttcggcgctgtttgaaacaaagcgggatctgttttgtggtcattcggtttgcaaccctgaaacgtctctttgttttccctgctggtcgactgattgactgttgggaccgacaaccagacggcggtcgcaaatcgattccattgaaggatattgtcacaaacggattcgagcttcatccacaactacagccggtcatcccctttcttgatggggttgactggttgattgaaacgaaagtaggtaatgtgcgtggctgataatcaaaatatgtcgcgaatggcccgacgccgcgaagataagttcacgaaagaatctgcccctaaaccgccaaaacgattatggcggcgaattcttaagtggacgttgctcgcgatcctggcatttttcattctcggcgttggcctgttttcttggtacgctaaagacgcgccagaagttactcaggcaaaattagagtcaggcggttccagtaccatttatgatcgatctggcaatgaaattacgacacttggtttggaaagtcgggattatgtgaaggcctcggaaatcccgcaacaattaaaagatgccgtcgtctccattgaggaccggcgcttttatgatgagaaattaggggttgatcctgtccgaatcatcggggcagcgtttaataatctaacaggcactagcgatggtttacagggcggctcgactttaacgcaacaactgatcaaattgtcggttttcagtaccaagtcctccgaccaaacccttcggcgtaaagcacaagaagcttggttggccatgcaggtccaacaaaaatatagcaaggatcagattttagagtattacattaacaaagttttcatgaactatggtcaatatggcatgagcacgggtgctaagttttactttaacaagtcactgaaggatttaacgcttgcgcagactgcgtttattgcaggcctgccgcaaagcccagccggttatgatccctatgaatatccgcaaaaagcaactcaacggcgcaatgccgtcattgatgccatgttgcgtgataaaaagatcaccgcgacggcggctaaacaagccaaagcaacaccaatcactgatggcttaaagccaaaacagcagcaaaccaataccgcaaccaatgacaaggtgattgattcttacctcactcaagtgattgccgaagttaagaaaaagaccggcctcaatccatataccgacaacttggatatttatactaatatcgatatgggcgctcagcgtcggctttatgacattgttaacactgacgaatacgttaacttccctgatgatgccttccagaccggtgtcacgatgaccgatccaaacaatggtcaggttctcgcacaaatcggcggtcgaaaaactggcgacgtccgcttggcctataatcgtgctgcacaaaatacacgtagcaatgggtctaccatgaaaccgttgatggattatggaccagcaattgaatatctgaattactccacttacgagcagatgaccgatgaaccgtacacgtatccgggcacgagcatttcactttatgattgggacaagaagtaccaaggacgcatttctatgcggacagcacttgaacagtcacgaaatattccggcggtcaagacccttagtactgttggcatggcgaatgcggttaaattcctcagtggtttagggatcaatttgccaagttcggaacaatatctctcaagcgcgatcggtgcttctgtcaataccgttcaagaagctggtgcttatggcgcctttgccaatggcggcacgtactataaaccgtactatgttagcaaagttgtcaccgctgatggcaatacccaaaccttcaatagtcaaggcagccgggctatgaagtccagtaccgcctatatgattactgacatgttaaaaggcgttctgaccaaggggaccgggacctcggcggctatttctggactgtatcaagctggtaaaactgggacgactgactatagtgatgccgaactccaacaaaaccccgcattgaacgcaactggcattgccaaagatgcctggttcacaggttatacacgtagccgagtcatttcggtttggaccggttatgataaaccgacttcacacgggattagctatgctgaacagaccatttcacaagaaatatacaaagcactaatgacttatacgtcacagagtctgaccaatcgtgattggaccaagcctgatacagttgagtcttataatattctcaagggaagtaatccaggaacggccattaccggcggatctggtgatacgactaaagaactctacgtccgcggacacggcccaagcagccgcaaagcggcagtcgagtcctcttcctcgagctcaagcagttctgttagctcctcttcacgagaaagtattgaaagctcaagttcagtttccagctctgagccggtagtatcagcctctgcctcctctcaaccttcaaatcaagaaccaagtgccagttcaagcgaaccaagcacgccttcgggttctggtagcggcagcggtggtagtaacaacccctgataacgactaagctgcttcagtaaaccctaaaaaatagcctcatccgcttcttgcacctgcctaacgacggcaatgcaagaatcggatgaggcttatttttgtatggcaattattgttggctgagtcgcacaacatccaaatgatgctgctttagcaaggcttcgccgtatggatcgttacgataatcttgcgcataaaccacgcgcttgataccggcctgaatcaaggctttggtgcaattaagacagggaaaaaagtttacgtaaacagttgcaccatgggtactgacaccgttagccgcacactggataatcgcgttcatttcggcatgaattgtgcgaatgcaatggccgtctcgcatcaaatggccagcctcatcacagtgcggatcgccactaatggcaccattatagccagtcgcaatgatccgatggtcttgcaccagaacagccccaactgtggctcgctcacaggttgatcgttccgagaccttctccgctaactccaaaaaatactgatcccaactttcccgatgaacggttcgtttggatggcacaatgctatctgtcatgatttgccccctaaaggtaaataatgtgtttctaaaaacgcccattgcgtccctgctggcacttgcggatcactggcgcgcaaatactcccggccaaaacgaattaggctgcgatgaagtttaatccattctgacgggggcatcaaggcttccagtcgcgcctgaatctgaaccggtgtcgcattttgcgggacgagtcccaacccctttacaattcgactaacatgcgtatccacagccacacctggaatgttgaatgcatcacttaaaacaacggtggctgttttcttgccaacgcctggcaaacggaccaagtcagccgctttgttgggaaccttacctgcatattccttaaccaaaatatcactcaaagctttcaaatacgcagctttagtacgataaaggcctagccggctaatgatcgcagcgatcgcctcaaccggcgctgcagccatgtcagcaggcgtcggataagccgcaaaaagctttggcgtgaccgcattgacggccacatcggtcgtttgcgccgataacatgacggctacaagaatctgaaatggatcctcggcgtgcaaggttggttgcggatcaggataaagtgccatgatctgatcaaatagttgtttggcttcagcatcggtcacaaatggtgcctcctcttgggctaatgatgggtgaattttcatataagattttcctggcgcttgtcattgcggctttgtcacagctcctgatgacgtctaatatctgcctgaacctgctgtggcgttttaagattgcggcgttcccagttcaacaaaatgcgatccatatattttagcgaataagccgagttcaatacagcctctcgtaaagctagtaaaatgacttccggtagataatgatcggttgtaagccaatcacgaatcgtctcttgctcaattggcgatagtggtcgtccgaattcaatctcaatttggttgaatacattggtttgcgcatcaacatttgcttgcgaagttgccggggttggtgtgccaccagctgaggttggcagtttagccaatattggactgagatcataatgatcacgcatccgaccatgaccatccgggacactttccaaagcaatggcttgtttttgaataagcgtctcaatggcactataaatcgcatttggggcaacgttcattcgggcagctaacactttcaaatccggtgcctgatgatggcttgcctgccactgatcaatgaacagataagtcatgaactcggtttgggttaaccccaaggtggcgtagtgatcaaacagcaggttcgacagactgaactgccctgcctcaagataagttttgaaatccgtcatggtgcttgccctccaaaaaaagccggcgcacaggcgtccgacttttgattgtcatcatggtttcaaacggttgatcatccgtgggaatggaatcgcctcacgtaaatgatccagcttgcagacccacgtaattgcccgttcaagtccaagaccgaagcctgaatgtggcacgctcccatacttgcgcagatcgagataccattcgtattcgtctaaatcaagtccagcatgttcgatagcattcttcagtgtgtcatagtcggtttcacgttcagacccaccgataatttccccatagccttcgggtgccagcatgtcggcacaaacatattgctgatcatcttccggatctgtcagcatataaaacggtttgatcgtcttcggatagttcaaaacaaacaccggttgatcaaattgatcagacaggtaggtttcttccggtgaaccgaaatcgtcaccatacttgacgtccataccggcatcttgcaacattttaatggcctgcttatatgtgatccgcggatatggcaatttggtgtattgcttgagtacttctgggtcgcgatcaagcaagtgcagcggataggcgcaattatccaaaacggactgcacgagataggcaacgtagcgttcttggaccttcaaactctcttcttggtgacagaatgccatttccggctcaatcatccaaaattcggttaaatggcgccgagtcttacttttttcagctcggaaaactggaccacaggtgaagactttgccataagccattgcccctgcttcagcataaagctggcctgattgactcaagtaagcttttttgtcaaaataatcggtttcgaaaagttcggtcgtaccttctggtgcggaatcggtcaaaatcggcggatccattttgataaacccttcgttattgaagaactcgaacgttgctcggatcatttcattgcgaatttgttgaatcgcaaattggcgcttagaacgcaaccatagatggcgatgatcaagcagaaattcgatgccgtgctccttcggggagattggatagtcgtgcgaatcaccaaccagttcgatgttacgaacctcgatttcatagccaaagtggctgcggctgtcttgatgaatcacacccgtaatccacatactggactcttggcgcagttctttagctaagctgaaaacctcttctgggacatcagcttttgaaacaactccttgaaaataagctgaaccgtcacgtaactgtaaaaaggcaattttccctgagctgcgtttgtcggtcaaccaagccccaattttaacttcttcgttcacatgttctttggcatcaatgatgcgaatctgttccgtcatgcgttaactccctatttctaatttaaataattacttgcccacaaattctcgaatacgtcgtgcggcctcgcgtaagctgtctagatccttgcaataactgatacgcgcatggtcaggcataccaaatgcgcggcctggcacgattgcaacgccggtttccgcaagcaacgcactgataaagtcatcgacggtaccataatgactcaactgtgccgctcgcttgatgttcgggaataaatagaaggcgccttgtggtttatctcccatgtcaaaccccggaatttcggctaataaatcataaaaaaggttgagccgttcctcaaatgcttgccgcatggtttcgacaatctgctgatcgcccgtcaatgcggccactgcagcatattcagacacagctgctggatttgaggtggtgtggctgataaaggtcgccatcgcctgcatgagtttttctggtccggcagcataaccaatccgccacccagtcattgcatacgatttggaaacaccagagatcaaaacggtgttggccacaatgtcagggttgatgctgatcattgccgtgaaggttgtgccgttgtaaattaaatcgcggtaaatatcgtcggtaatgaccaagatatgatgttgcagtgcccagttaccaatcaatgtcagttccgttcgcgtgtatacaaccccgcttggattttgcggtgagttgataattaaggcacgcgttttgtccgtccgcgccgcctcaagatcatcaacactgactttgtggccttccgatggcatgaccaaatgcggcgtcccgctagcaagtttgatttgttcctcgtaagaaacccagtatggtaccgggatcaaaacttcatcgcctgggtttaagtaaacttggaacaaagcatataacgcaaactttgccccagtcgtcgccacaatctggctagctggataacgcacaccatcttgcgagaaaatgcggtcgctaatggcctgcttcaattctgggatcccagtcgcggcagtatagaaactagcattcccggcttggatggcagcaatggccgcttcatcaatcgttttcggcgtctgaaaatcaggttgaccaatggacagatcaatgacatcggctccttttgccttcaaagccttagtttgattgctcaatgcaagcgtcgctgatggtgcgacgttgaggattctttttgctaaatgcacgactgcgcctcctacagttccggcagtcgtttgcgctgccgaatcacactttatttataagtttttgatcgcgttcagctgttcgccactgcgaaaactgtacgtcacgtagtttagtttaccagactttgacagatagccaatatcccaaacgaattctgacccacgttttcctaatgaagcattcaagattttctttggcgaagcactttgattaatttgctgcaacgcttgctgccgagtgatgccagatttctggtttaaaatattgactttgcccgttttttcttgaatcacaacgtacacagcttgatttttcttggtattacccgcaacagtcagataacttttgtcgcggttataccaccaaaaaccgttaatcgttttcagatttgcgcggtttgtcgcgattttctcagcttgcccacgtagttgttgataaggtgagaggcttttcgcgtagacgccaatggcaccaataattaaaacaatcaatccagtaatcacaaagaacttaacccagtcaaatcgacgatgacgcatggggtgcctcctttcgaagtatggtcagatgatttttgatagctgacgagatacgtggggtaattaaaatttctaaaaaagcacttgctggcacaaaagtctgcatatcaggctttgaaagtaatgaccaaagttttctcggccatcaagctgtggcgcttacagatggcctgctcgcaacttttggctaaaacgcgttcgcaggcgcagaaacttgcacataaggacctcaagcttaaatggccaaagcccagccatttaggcttgaggccgcttatgctccggtttctaaacgcgcctgctcacgctctgtctagccacatcttaatgtaccccggcatgtcagttagtggcaacgtcattggcttaatatttggtaaggatttctgcatttttcgaccgtagcgtgtggtgatgaatcgggggtcgaggacaatgaagataccgcgatcggtttcggttcggatcaggcgcccaaaactctggcgtaatcgcaaggttgcgcgtggcaaagcatcctcagtaaatggatcgcggcctgctacctgaagtcgttcatatcgagctttggtgatggcggcttcgggcgcatcgaacggcaaccgggtcaagatcaccatttcgagcaaccgatccggataatcaatcccctcaaagaagcttgcggcaccgagtaataaactttgatcaccgaccgcaaaacgcttggcgatcttttccgccgaaccagtcaccccctgagccaataactctttatgatcggcaatcggtcgatgagcaaggcgttggtaaaccgcggcaatggtcgccagtgaactgaacaatacaatcgtttggtgtcggttatcagccaataactcaatcgccgcggcaagataatcggcataggcttctgcactcaccgcaccagccgcaggagcgtccgtggcgacaagtacttttgcctgatcacgataatgaaaaggactgcgtaactttagaaaagctgtctctggtaagtcatggtaaccaagctgagcggttaaaaaggcaaacgaacggtcagtggttaaagtcgccccgacaaacaccggtgccgtaaaccgctgtagcaactgctgaatggctgatccaacctgaaaaatgtcccaacttaggccaagactgctaacatcatgcatttgccgcaacgtcaaagaagccacggcagtttggccggcaaccagttctggcaagcgcgctaacagtaatttcaagcggtcacgttgatcgatcagggtgactgtcaacgcggctaaggcttgaaatcgttgaccgtcacttttcaaaaagaaatgttgccggccattgaaatctgcatctagtttagtcgcaatgacctgaatgcgaccaatgactttgatcaatgtcttaatattgtctgtttgggacgtgactaaccaattaatagcagcttgatccaagctcagactcacaaacccttgatcagccgttgtcttgccgttaaagaaatgccgatatatttggtgctgcaggatttcaatcgtttcctgggccgttgttgttagagcgttaagttgcgccaacacaggcagcatctgccgatcattttgatagacgttaaccaatgagcgatcttcatcgggatcactcaatcgccacaaatgtcgcaactgccgccgaatctgcgctaagtcgatccgttgcgcaaaggcagcggcggtattatcagcaaaatgttgcgcttcatcaacgaccagaaatggcgcctcaaggtccaacaaatcagcgtggcgtgacagaaaagcgtgattcgtaaccacgatagccgcccgatcaatggaagcacgcagccgccgataaaaatcaagtgtgtaatacgggttgataaatggtgtgcctgaatcaccagtatgccgaatttgcatgaacaatggtgcccgataagttgttaagtgcaactcatcgaggtcgcctgtggttgtttgtgtcaaccaaaccagcaatttcatttgcaataactgcgtttgccgacttggtgattcttgatgcaaactagccgcgaacttgttgagatcaatataatgttgcggacttttaacctcaactgctggcaagtctctgcctaaaacagcggctaaagtcggaatggccgtctgaattagttggctttgcaaaacaagcgttgatgtcgcaaccactaacttatgttcggcggttgcgacataagcataaggcagcaaatatccaagcgttttgccaagaccggttcctgcctcaatgaaaagtggctggggaccaccctcttgtgcatgtgcaaaaaccgcatccatcatccgcgcctgggccttgcggaagcgatagcgcggttggagcaagtgccgtttttcaagatccgttgccggataagctgctgacgcaaacgtctcctgggttgctgtcggcactcggcgcaagaccaacgggccaacttgaacaaacccgcgttttaacggtttcaacggtttagcgattgccttcaaataatcaccggtttcccgcaacaagccactgccgcgcgcaaccaacgcctgttgcgtcggactgggcaaggcctgaaagcgagccgccagctggcgcaacaatttagccgtgctaatcgcgtcactatcggcttgatgcgggttatcgtgctcaatttgtaagtaactcgttaaatcaggcaagcgaaaactgctaatctcaggcaataaaatttgcgccaattcaaccgtgtcgatcgcagctaattgcagctttggcagccccactcgctcaaattccgcatttaaaaaaggataatcgaaattaacgttgtgcgctacaaaaaccgtatcagtcaacagctgatgcaacgttttggcgatttcttcaaaataaggggccgcgactaatcgattgggatccaagccggttagtcgctgaattgccactggtaccgaccgatccggattcaccaactgagaaattgtctggataattttgccgtgctgcattaaggcacatccaaactggatcatccggtcgccgtctttgacgctggtcccagttgtttctaaatcgaccacagcaaaaatggtctcagcattcattttaaacattcccgtctaaacatactgttcatatcatactatttaccagcacctgatgctaccagatcgacaacggttccggtgcgcaaaaagaccagatagcgatgcagcaccggtttgggttgtaaatcctgcaaagcttgtgcatataagtttaactgtccacgataacgatccactaaaacggccgtgttcgggttatgatcagttttgtagtcaaacagcgtgacgccttgttcatcactcacgtatccatcaataatcccgtgaatcaagacgtcctcgcctgggtcatcggccaatgcttcaaaaacttggtcagcaggcagcagcatggaaaacggaacttcacgatgaacctgctgcggcttagccaataacaaccgacctaaatcagtttcaaagaagcgaataagtgccgtcaaatcaatgtgctttgccacatcgaccgcaatgacctgcgtggtggtcaattgatcgcgcaaagccctcaagctggccatggtgatcggcttggcgagatccactagctgcagcaatagatgcgttgccgtcccaatagctgctgggctgatgccactaggggtttcggtcagaaacgctggcgccgttaaatcccgcatcggtggcttaggaccgaggaaacgatctgcattgaccagatcaatggtatctggatcatcaaatgcgcgtttaatttctgaaacactttgaaaacctgtcgtagttgttgctgcttggaaaggataggcctttttaaaccacgcagataagtcgaccattgttcctgaatcgtcagaaactttttccggagttgcagtcggtgtgacttgcggattcacgtcaatttcaattgtaaactccgtttcatcaccgacgagcgcaggtttgatagttgtttcggctaacccacgggcctgtggatgtctgatcaaggccggtccgatccagtcgagatagctcgttgccccactgcggacttgcggcgccaaaacaagcgcttcaccttccgccgccgcagcccatttttcgaccgttttatcagcagacgtcagctgattgccactcatcgttgcgccaaccacgtaaagtcgctgttgcgcacgcgtcagagcaacatacaacaaccgcatctcttcagccaaggtctgattttgccgtgcagctttggcagcttgatactggggtaattcatattcaacgcgagtttcaggatctagccatttaataccgataccttgttttgtcaaaatggcagtgccggtttgatcgcgcatattaaaatgtttgtttgcctgcatcaaaaagacaaccgggaattccaaacccttgcttttgtgaatggtcatcaacttcaccgcatcattatctggatcgacttgggcaggcattgccaaatcttgatcctgcttctgcatcaaagtaataaagtgaataaaggcaaataaccctttgaagccacccgcttcataagtgcgggctcgatcaatcaacgcttggagatttgcctggcgctgactgccccctggggtgccgccaacatagtcaagaaatccggtatcctgatagatagcccacaacaaagtgaccaagtcattttctcgggccaagtcgcgaaaatggctgagctggttgaagaagtgcgtcagcatgtcatgcgtccgctgagcaagtggcgtttttggttcggcttgtagaaatgctgtcacggcatcataatatggcacctgttttgccgctaaacgaatcagtgccaactgatcagctgacaaaccaacaatcggcgaacgcaacacagccactaacggaatatcttgtttttggttatcaatcacttttaaaagcgccagcataaccatcaattcagttgttttgaaaaaattcttggtatcggccacaaacaatgggacgcctgctgcagcaaactgtgtttgaatcagactgttttgactggtttgacgtgtcagtaatgtgatatcgcgatagtggatgcgccgatactcctgcgcctgacgatcccatagttgcgcatcgggatcgttgattaatcgctgaatttcggccaacactagctgcgtttggccagtcgcaatgtccacgggctcgttatcatcagcatctcccggtaactcacttgcatcagaagaatcttcatcagatgttgctttgctatacaacaacactttcactgccggatgcgcatcaccgtaatcaagcgcaccatactttaaagccgctgcgttgtcatagctcaaatcgccaacttccggatccatgatttgactgaaaatcagattggtaaacgccaacacatttttggtcgaacgaaaattctcagctaaaataatccgttctggcgcggcgggatcggtcggtgcatcttgaaatgtttggtatttatgaataaatagttgcggatcggccagtcggaagccgtaaatactctgtttgacatccccgaccatgaaccgatcacctggcgtagtggtgctgacagcggcaagtaaagcctcctgcaacggactaatgtcctgatactcatccaccatcacttcatcgaaactcgcgcgatagttatcggcaattggtgcaccggtttgtggatctttttgttgcaaaatgcgtaaagcattatgcgcaatatcactatagtcttgaacatgccgagcggccttttcagcgatcaacgcgtcttcaaactttaaggccacattagctaatgtggctactaaaggttgagcttcccgcaacaaatcgccaatttgctcagcagctaaggcaaaagttggtgccagtttgttctgccaagttttctttgcagcatcacgtagatcttttgccgcgtttttagtgtccttatctgcgtcatccagtcctttactgatgcgcgaccaagcagcaaattcatgggaaatcaagacactgcggactgtatcgtatgtgggtgcatttgtttctaatagtgtttgcaatggggcaagatcagcctgaatttgctgataccaaattggatttggcagttgattggctaacgctgacgcctgagtcaaactggtggctatttgcagcaattggcctttaactcgcggccagatttgttggctaaaggtcgcttcccatttttccggtgcatacggcgttgccaatccttccaaataggccttgggatcagttgtcgcaccggcttggcggatcaactcaaacatcaagtcttgcaaaccgctatcatctcgatccccgctaaaattagccgtgagttgttcaaacgcaggtgcttcgtcactggcatataattgttcacgcaaatcgtcccaaacgcgctcttgcagcatgtagcgttcagtttcatccgtaagcaaccgaaaaccgggatcaagatcaatgacatagtagtaagtttggacaatttgcaaactaaaggcatccagcgtactgattttagccgcattaaccatggcaatttgattggcaagatgacgccgatcctcaccactaagctcatgtcgtcgctcggtgagtgccttcttcaaagccgtctgaatcttggttcgcatttcggctgttgccgcacgagtaaatgtcacgatcaacatccgggtaatgtcggcatgctgtttgagaatcttttgaataattcgctcaaccaacacggtggttttcccgctaccagcagaggcggaaaccagcacgtcatgcccgtcgtgggtaatcgctgcttgttgagaggttgtaaattgggtcatgcttgcgaatcctcctgacgatgatgcggaatttgtgtgggatcagttgtgacgcggccaagcacctctttgcgtttcaactttggcacatgattgtaatgatcaaacccggttgccggatcgaacagcataatactttgataatcgctgttgctgataacggtggattcctgtccatattgaaacggcgccaaagcgatatccccggctaaaatccgactggcagcatcaataatcaatgcctgattgtgcaaaagataggcacttagatcttctggtgtcagaatgtttgactgattataattgaaagcaccgtcttttttaaaaccaagtggcaccatcatgctgcgtccaccggtttctgctgaaatggttttgtctaccgccgccaagtctgccccatctttagctaccaagaaacctagatatttaaaagcttttagtcgatcaatatcgaggtcaagatcggtactgaatttgaacttaggatcttgtaagtgaaaatacagtgctccggctggcacaaatggcggatcagctgggacatttgccattgcttcaacatacgtcaacatctgtaaggcaatgccatagtacgcgtcactgtcatcgaaccgatgttgcgtgctcttgtaatcaacaaccataaatcgctgcgcatctgattctcgatagacatctagtcggtcaattttgccgcgtacattaacgcgaccaccatgcggcagcggccaagacaagccaggtaagcccctggtatccccaattcggccaaactgcaactcagtgcgcatcggacggaacccggtccggcgttgctgctggcgcatgttcgtcagcacttggatcaataaccgacttaagcgactcgtcaaataagccatccgatgggtactgccaagaatttcataacccgggcgcttcgtgatagccgcgactaatggcgggaccgccgcagcgacatctgccgcggtgacatcggccaatgtctggccggcgtcgcgcaactgagtcagatattgatccagcaccgcatggaaaagactnnnnnnnnnnnnnnnnnnnnnnnnaattcaggtcgcggctgtaaaagcaaaccatacttcaaaaagtattcaaactgattacgataatacgtctctaatcgcgataccgagacattcatgtcccgaccgtacaattggactgctaatgtcggatcaagacgtccagggtcattttgataggtcaaactgcctgctagcttctgagctaacggtgccagcttggtttgtttgagactggccaaaacgccttgccaacttcgactcaaaggcaatttctgatgctgagcttcaccagccgcgcgaacaaaatcactgagcatggcccgcggactacccagaactgcttttagagatgtccccaacccagccggtgcccaagtagcaggtgtcaattgcagtgcttgggctaattgtctaaagtacggcgaggcttgattttcactgttttcctgcgtattttgcatggggtaactaagtgtcagtttttcagaagctgccataaatccaagataattgatgaaaggatcgcctaaggttgtggtcggaccttgttcaggtaaaaaacggtcatctggaagctgagccgccaacagttgccgctcttcgctatttaagacaccactatcgttaggcacatcaggcatcgcggtgtttgttgcgccaatcacataaacgtgttttgccttggccaaacgaaccaaacccgtttcggaaataaccaccgagtccagcgtcgacggaatctgcgtgtaggtggcactagcaaagccggccgccaacagttctcgaaactgatcacgattgaagtcagcttctcccaaaatggtcgcatagtcatttaacaattgggtgaaggtatcccaagcctgttcgttggcttgactgcgacttaaatcaccgtcagcgttagcggtttgtcgccacacattcagctgatcaatcacaccagtcgtttgcagccattgatataagctggccgcggcttcgcgaccagttttggcagtctgccattgacgcagcaattgcggaaccgtgtccgcaaccaaagtcttgattgcattaatttgggcagttttatctgcctcgggatcaagttgcgaatcgtcagcgttaggattgcgctgaaaatagcgccatgggtcggtctgtgtccaccgttttttgccggtaatgccagtgcgaacaagatggttatctgttgtgtctaaagcatcacgaaaagccgcgatatccatattctcaggtagtaacaactcggtatgcaaaaggcgcatgacatcctgatattgataatcgtggtcttgtatggcaaaaagactttcaatgagtacgactagcggatgatccttcattggccgttcgagatcagtaaattgagggatgttgaattcttcaaagatggccggaatcaccgctgcgtatggatccaaacgacgggctaaaatcagaaaatcgcggtaacgtgcaccttgccggacggcttgatagatttggcgggcaaccgtccgtaattcatgatatggatcagtcgccactgccaactcaacttctttgttctgtgctgtctgtgcaggcgcctgtggttgtaaattggtactcgtttgccaccaatcagcaaggtgcttcatgccttcacttagcggacgcggtttagcaaaacgatctagccggatcggtactttcatcgttttggctttttgataaaggcggtgatacaaccggcctgcaggtaagaataaattaggtgccactggcggcgcagccggatacggcttgttcagcactaagctaacggtcacctcagcagccgtttcaatcattgtttcgaccaatccagtctctgaagctgaaaagacgttgaagtcattgagataaatgaatgtgtggctcaggtcctgattgcgcatcacctgttgcaacccacttagtaggctggcattagtggcataagggccgatttccgcttcatagtgatccagaatgatccccagatctcgcaatttagcacggtgccgatcgcctggtgttaaagcggctactgtcgtattaagatcttctgctgtgatacgaccggtcactaattcgcttaattgatccgccagttgtgtcacaaacccagtgttatgcgcttcgccagcataaatcgttagttcttccttgctttcacctagtatctttgcgaccaacatcgtgttactggcccgatcaagtcgtggctgttgataaagcgcggtgtttttcaggaaataccaggcaagtcgtgagaaagacagcacctgcactcgattttgcgcatatacaccattgacggatgctgcttgcgcccgcaaccgtttcaacaagtcgacttcggcttcaaatttgatatgattagggactaaataaaaaatttggttttgtgaatcggcttgcagattagcttgaaccattgtcgccatcgtgccagcatgatccgtcgttgcgtctcctaaaatgaattgcagccccatgcgctacctacctccttaaacgcgctccccagcgcagcaacctgcatgtaagcaccttggctgcaatggccaaggtgcttacactcgggtttctcaccgggccagctcacgctctgtctaaacgcgttcgctgccgcagaaacctccacataaggacctcaagcctaaatggccaaaacccagccatttaggcttgaggccgcttatgctccggtttctaagcgcggctgctcacgctctgttacattatgctttagtctagcatatctaagtagtgtctgacgggcgtttgcgctatcattaataaagaatattgacgaggtgtttatatggaaatcgggacgggaaaaagttatgcaaaaattattctgcttggcgaacacgcggtcgtgtatggggaaccggccattgcactgccagtgaagagtgtcggcttgtcagctcgcgtcacgcctcagccggatggcagacaaactgtgacgtcttcttttttcacaggaaatttaaatgctggtcaattgaccaattttgccggtattgccatgcttattcgacgtttattgatcttctttaacgccaagaatcaaggatttcatttaaccatcacgagtgctttgccttccgagcgcggtatgggctcatctgccgcaaccgctgtggcagttgttcgcgctttttacgatgcatttcaaacatcgctatcacacgacacattactgaactgggccgctgtctctgaaaaagctttgcatggcaatccaagcggtcttgatgctgccacggctagcgctgagcggccgcaatggttcgtccgtggtaaggcgccgcgctcgatcatgatgccacgaaacggtgtgttgctaattgccgatactggcgttgccggacaaactaaaattgcagttggagcagtggcagatcgtttaaagcaggatcccaaaatgtaccggccgctcatcaaggatatcggtgacaccgttcgccaggcagcattggcgttggcgcaagatgatattattaccttaggccaactgttcaatcgcgatcaggccgatctgtctgcacttggcgttagcagtcctgaccttgaccgtctcattaacgtggcgattgataacggtgcttatggcgctaaattaacaggctcagggatgggtggttgcatgattgctttagcagccagtgatcaagcggtagcgattaccacggcgcttaaagctgctaatgcggctaaagtgtgggaataccattttgaatcgaaatgaggctattatgacgacttatgcacgcgcgcacacaaacattgcactgattaaatattggggaaaagccaatcgcaagttgatgctgccagccacaagcagcatttctttaactttaaatgacttttatactgacacagcagtcacatttgatcctagtctaaatgatgatcgcttcatgcttaacggtgaagaacaaaacccggttgcggtcagccgctttttggatcgggttcggcacttaggaaaaattagcacgtacgctcaagtcacttccttgaatcacgtgccgactgctgccgggctggcaagttcagcctctgcttttgctgctttggccactgctgccagccgcgcggcaggtctaaacctttctccgactgaactatcaagattagcgcgccgcggatcaggttcggcaacgcgctctatctttggtggtgccgttatctggcatcgcggccataacgacgcctcttcattcgctgaaccactcgcgattcaacctagtttgccattacgaatgcttgtggtcacggtatctgctgaaaaaaaggcggtcagttcacgaaaaggcatggccaacacagtggccacaagtccctactatgaagcctgggtggcctcaaatgaaagtttaattgaaccaatgattaccgcgttggctgaagacgacttagcgctgatcggcaaattgacagaattgtccagtatgcgcatgcatgcggcgattatggccgaggaaccgccattcacctactttctgccggaaacattacgggcgtggcaattagtgcaagaacaacgggctttgggtattcccgcgtttgccacgatggatgcaggaccaaatgtcaaaattctgactactgaaccttacgtggacattttattaaccgccttgcgccctgtgttcggtgatcggattttgagcacacgccttggtccggatgccagcatcatcacaaaggagcaatttgatgacacaaagtcagcaatcgcatcgcaaggatgaacatgtttttctagctgaaaaatactttcaatctgttgctcatgcgggtttcgatcaggttcgtcttttgcatcgagctttgccggaaacaaccatggctgcggtggatctaaaacctgatctcccgtttaattggcaatggccgatttatatcaatgccatgaccggcggctcgccacaaaccggcaagttaaacgcccagctaggccagctcgcccaagctttgggggtggcgattgccagcggatcgcaatcggtggcgttgcgtgatccgcaactagtcccgacttttgcaacgctgcgtgatcatgatccaaacgggtttattttagctaatgttggcgccggtcatcatgcgactgctgccgaggcggcggtggcaatgttaaaggcgaatgcactggaaattcatctcaatgctgctcaggaagtggtcatgcctgagggcgatcgcgactttatgtggcaggctaacattaagagcatcattgcgactagccaagtccctatcgtcgtaaaagaggtcggtaatggctttattcgtgaagatcttcagtccttacaacagctgggggttcaatttgttgacgttggcggtcgcggcggaacaaactttgccacgatcgaaaatgctcgtcgttcgggccacgattttgcttatttacaagactggggacagacaacggttgaatcattgcttgaagcgcgcggactcggtctagccatgcttgcaactggcggcgttcgttcaccattagatgttgtgaaggcattgcggttgggcgctcatgcagtcggcatgagtggcctggtgcttcatcacttgattcaaactggctatgaagcgacgctggcctattttcagaattttctgcaccaattgcgccaactttacgcgttattgggcgtcaccaattggcaggagctgcaagaagccccaatcgtgctaagtgctgatttggaacattatcgtcaggctcgtggcttaccgggaatttgaccctaaaacaatccaagtcatgattgacttctggaacttttattcgaaaggaataatgctgcaacacaattctcagtcgacaagtaaaaacgaacgattttcctaatatcggaaaatcgttcgtttttacctatccatagattaattgctgagattttaaagaccgtagtgccaaggcggagcaatcgtaggccagatgaggctcagccgtgcaaacaaaacagcgaccggttttcggagctgatgttgttaggcgacttcgagaccgcgggctttgcgggctcgaagcgccgtctccgctctagctacgcgtcgccaccccatctggccggagattgcaaagtttggcacggcaagggactattagcctagcaccttcctacgactattcggaatttaatgattcacaagtccgatgagcaaataatggctcagcctcgttcaccggatgtgagttatgctccgaaccgagtcttctttactaaatatcaaacacgcaatccttttggataataatttttgatggtaccattcaccaatttaccaattgcaaatggcttatgctcgaatgtcagcaggacaaaacgtttgccacttaccttgcttggcaacgtttcaccgtgccgataacgtgcataaccgtccgcatcaacctcaatcacagtttgaaaatcatccggattaagagcagttgctaaactatgacttggttcaaatcgtttcttccggaaacttccgagtcccagaccggcacgcaccactttcacgtgctcaaacgggatcatcgttgttggtaaaattgaaagaaaatcgccatgccgataaaataggccgccgggttgcttggttaggcttgtcgctacaaacgcatcaacttcatccttcgccggcttggctagcggtttaagcggcaagcgggctggttgatgtgatgctggtgcccctgctaacttcagcttagcaacaaaatgcccttcgccacgcaatcggtgaggaaacagtcggactgttttggccagttccggattgccatcggcccacgctggccgcccagcttccatccccggatattgcttaatcggcgtaagcgtgaacgcgttattggtcaatagccaggcaatgatttgctcatcttcttcaggactaaaggtgcaagtcgagtaaatcaacgtgccgcctggtgctagcatcttcacagccgttttgagaatctgcttttgccgctcagcacattgtgcaggatagtccgcatgccaatactggattgcatccggatctttacgaaacatgccttctcctgaacaaggtgcatcaaccaaaattcgatcaaacatttgtggccacgcttttgccaacgtgtcaggatcattattcgttactaaaatctgccgagtaccccaccgttccagattgcctgacaaaacttttgaccgcggaccattgatctcattgctgaccaaaagcccagtgtcgcctaaatagcaagcaagttgggtcgatttaccgcctggcgctgcacacaaatctaatacccgttcacccggctttggggctgcaacagtaccgacaaactgcgcacttggctcctgactataaacaagtccggcaacgtgatcaatgtcgttgccggcgaccttgccataatagccccacggactccaaggaattggttcagttaatgactcgtccaatggccacggcttggctggatcacgccgaaagccactttccgcaggtgcttcaaatgtcgctaaaaaagcagctgcttcatcgcccagcaaacgagtatatttttccttaaatgcttcaggtagttgcactagctttatcctttctgtgaatcaagtaacggaggaagaaaatggcagcgatggtcaaaacgacaagaaagacccaaatattagttcgcgtggtgaagtagaaccaccagtttgcaaaaaggccaccaagaaaaagactgacgccaatatgaccaccacagctagataaaacgccgcgcaagtaacgcgcccgcatattcaaatccaaaccagctgtttgcaacggccccattaagaccaccatgagcatcgtcagcaatcctgcacccagcaataagaataagctgaacaatgccgtttgaccataagcatgccaccaagtcgaagcattactatcgctaaagtggacccgatgaatgttttttgctttgaaagcggtttttaaggccttgctatgctgactggcgccgtcaacatagattttgacctgctttagtttcagcttactattggtagtttgtgcggaggcgttgagaaagataactttatttagcgggctgcctttgcgtgtgcccaccgttcccaatactgggacatattgaccattcacttgcaaataacgctgattattactgccagtatacagtttatcggcaagatcgcggccaaccaccgtcaccggcagactggaggcaaaatcgccagccgagaaccactgaccactatcgagtggcaggctcgcaactgtgccacgctgataaacgtacacgacttgtttagcaacaaactggacctgataacctttgaaatcagttttatcgagctcgcttatcgcggtggtgatgctgcgcgaacttgtcgtgacatattcctgagccgtttccgacatgccgaggtgatcaagctgactggcatattcattttgatcatgctgtgaccatactaaaccggctaatatcgctaagccgatccataaaagatcaatcaagaataattttttcacgtcatcctcctcaagtcctgcacaaataagccatttgccaacagtacggggactattgtaatcggtaaactcgttcgtgaatcgcatcaaaatgaccaaacgcacgattaagcgcgaataatcgccgatccggaacggttcgggcttcttgccaaaataaccggctattggttgcaccgttgcgttcgccgatcacgaataattgtttagtgggaaaatagtgttgcataatatgcaggaaccggacatcattaggatccttatctgggctccaagccatcacaacagcatcgacttgttgggcgtagaggaacaacgccgcgttggctgtggcggttttaactggaacaagcggctgacggccagtgacattttctttcgtccaagtgtgcgcatcggttgtgatcgttttgtcgccttgtgcgcgcaaaccagcactcacgtaaccattaccagctgccacttccaagtaccgctgaggaccataaagtcgatgccaggtcgcaaacagatcttcatgaacaaatgaccacatgccatcatgaaaggcaatgtagcggcggaaattatgcaatagatgatctagttgaagcagttcttgcagctgcgcctgtggctgggttaaagcggcatcaatttgcggcgtgctaagtcccaaccaaggtaacgcatgtgctggcaagacaccagccgcaatagatgcttgccaattcttcatggcagttagttgtgatttaagcggtccaatgcgcgcatattgtttggccagccgatttaatgtgctccaatagtccatgttcaccctcgtgatccatcgctttgactgcctgaaagacagtcaaaagccgccttaaacggcggcttttgcattccgtgtctaaacgccggttaatgaatgcccagcgccattttggcataccgactgaggcgttctggcccccacgctggataccaaactaaatgaatttcaacgctggtaatcccgtcaatcgttgtcagtgcccgtttaatatcagcatccaacatgtctgtcaaaggacagcccatcgttgtcaatgtcatttcaacggtacatttgccgctttcatctaaatcaaccccataaatcaagccgaggttaattaagtcgacaccgagctctgggtcaatgacggtttccaaagcgtcaagaatttgctgtttcattttatcaaaataagcctgatcttgtgaggctgcctgatcgctggtgtctgccatcgttgaacccttcctttctgtgacccggtactgattgctcaaagccagccgttaagccttatctgatgcaagtacaccggcaactgaataatgttccttagccatttcgttaagaacaatgtgaatatgctcagcgggtgcgccagtatctttgacaatggcatctgtcacgtctttcacaagggctttcagttgctccggtgaacggccttcaatcaaatcaatgtgtactaatggcatggtattcgctcctttggcggcaaaagccgacagttaatttgctttattttagcatgagtgtaagattttcgcacctatgctatgtgttttgctctttgtcaattctatttaaaaatcgcatttactggaaaactttcccaatcacatgaaagtaaacggatcagtcgatagtttagatggtatggctttgacatcccatccttctgcatcggcccattcgttgatcaaagtcgcaactttgcctttcataatcgactcgatatggtggccgggatcgatcacgggcaggtcggcggctagcatatcgtgaccggtatggtaatacacatcgccagtgataaagacatcggcgccagcttgcttggcatcgttgaaggcatcaccgccatcaccgccaagaatagccactttttgaactagccggtctagatcgcgggcaaccacgcgcaaccctttaacgttataggctgctttgacttgttcaacaaaagcctcaaggcgaattttgtctggtaacaagccaattcggcccatgttggcgccctcaccttcattgataaaaggcacaacttgacttaatcccaacgcttctgccagccagtcattcatcccgtcttggacgcgatcaaggttagtatgcgctgcatagaccagcaagtcatcctttagaatttgggcgtacatggcattctgcggaacccgcaaatccaagttatgcactggtcgaaacatcgctggatgatgagaaaagatcatatcagcatgaatcgcttcggcttcagtgaccacttccggccggacatctaatgttacgaggacggttttaactggtttatctgggttacctaattgcagcccgcttggatcgcgttcccatgccaaactcaggggggcaaagtcttcaaatcgattaataatctgtttaccgctcgtcatgtgcgtctaattcctccttgattaatgataaaattttttcttgttcgcgaatcttttctagcggcaccatctgtgcatcagccaaaccttcaagcacggcctcagttttctcagcctcgcggtgcatttttttcataaaagttggactcttttgccgccgtaaaatcggcccgaagcgtaaatcagcttccgaataaggcacatccgggcgcgttcgaccagctgccatcagttcgtaaatatggccttcatcttcaacgatgtcctcgccgataatgccataaccatgctgatcaagccataaacggacatcgtattggtgtcgattaggagccagtaccaaggtttcggtaccgtctagttgtggctggccagcttcaagaatatccgtcatcagctgaccgcccattccagcaatgacaactgttgaaatggcatcgtcaggcatgatacttgccaaaccgtcagcttgacggacgctgatctgcgcagttaacccagcatccgcaacgttttgcttggcaattgcgaccggtccggcgccaatatcactggcaatcgcaaaactgatgcgttgctgctgcaccaagtaaatcggcaaaaaagcgtgatctgtgccgatatccgctacccgttcgcctgcctcaataaaactgctaatggcctgaagccgttttgataaatgaatatgatccatgactatactttctcctcatctcgttaacagttttcattataacaaactacgccgaacagttagttaacttttctgaaaagcgggttacgtcctcagaaacatcaaagatttccggtattcgaatctgaatgaggggcttcgccacatgatgacgtacgaaaaagccgcctacctcactaatgaggcagacggctttatcagctaacaaacgttcattactcaagaaaatccttaagttgcttggaacggcttgggtggcggagcttccgcaatgccttagcttcgatttgacgaattcgctcgcgggtcacgccaaagaccttgccgacctcttccaaggtacgggtccggccatcatcgagtccaaaacgcaatcgcaaaacattttcttcacgatccgttaaggtatccagcacactttccaactgttctttgagcagttcataggaagcatggtcttcaggactggtggcgtcttggtcttcaatgaagtcgccaagatgtgaatcatcctcttcaccaattggcgtttccaaggaaacaggttcttgcgcaatcttcaggatttcgcgaaccttttcagttggcatgtccatttccgcgccgatttcttcaggcgttggttcacgaccaaggtcttgaagcagttgccgttgaatccgaatcaatttgttaatggtttcaaccatatgcactggaatccgaattgtccgggcttggtcagcgatggcacgggtaatagcctgccgaatccaccaggtggcatacgttgagaacttaaagcctttccggtaatcgaatttctcgaccgccttcatcagccccatgttcccttcctgaatcagatccaggaattgcatgccgcgaccaacataacgtttagcgatggaaacaaccaatcgcaagttagcttcagccaaacgttgcttagcttcttgatcaccttgttcaatcttcaaggcaagggcaacttcttcatcagctgtcagcaaggaaactcggccgatttccttcaggtacatccgcacagggtcattgattttgacccctgaaggcgcggacatgtcactcatttccttcttggaaaccttcttttgcttcttcaagctaatcgctgctggctcgccattttcatcaacaatagcaatcccattatcctcgatcttttgcatcagatcgtcaatggcaccactcttgagctcaaacggcttaaccaacttgtcggtcaggtcatcttcagtaatttgtttcttcttcttgtaatctttaatcacggccttgacagcatcgtcgaatgctttcgttgtcgttttggtcgtgcgtttgctgctagcggtagtcttcttgaccgtagttttcttcgcggtggtcttttttgccgccgccttgacagcggttgtcttagccgcagtttttgctgctggcttagccgttgtcttctttgtggtcttgtctacttcagttgctgtttttttatcagccattaaagttcctcccctagccttgttgttgtttcaaaagtttcatgagattcacatactgcaccgttagctcgcctagtttctgcttatcgccaagtcgctgtgcctctgtgatggcctgcttgatagcctgcagccgttcgacagttgaagcggacgtgatcgtctgaatcaactcgtcaatcgttgcctcagtcgcctcaggcaaaacctgcatcgccaccgaagccgccaccccgctcagatccggatcgactcgatccaggaatccagctaactcgccatcaggctgctcatggagaaaatctagccatccggtaaagagcgtctgaaaatgtggcgctggaaatgtgaaagcagtattttttaaacgctgcatcactaaatcatcgtgccaaacataatacagtaattgtcgttgggctgcagtgtaacgatcaattggccgaactggttgattaaccggcgcggtttgatagctcacaggagccgacgactgttgttgcacggcttgctgcggcgctggcaggctttgattcagagcgctctcaggcacgccagtcgtgtcagctaactgcttcacataaactgcacgcgctaccggattcgaaatcttaccgatggtttttaaagccgcgttcagatacgtcagtttagcctgatcattgttcatgtcaaccccgcgcgctaagaattgcaggataaacgcggtcggcgtcaatacggatttgacttgcgcttggaaggcttcggcaccacgggcacgaatgaactcatcaggatccatcccgtccggcaaaacgaccacatccgtttgtaatcgcggatgatcagccaacatggcaaccgcacgttcaatcgccttttgccctggttcatcaccatcgtaacacacggttaatcgcttgcttaagtggctaatgatgtcaacctgctcagtagttaagcttgttcccatggaagcaatcccggtttttacaccggcttggtacgcagcgatcacatccatatagccttcaaaaagaatcggggcgccatcacggccaaaatcagctttggcacgatgaagattaaataggacatcacgcttgttgaaaagcttggtttcgggactgttcaagtatttagcttgggtcttgtccttgcttagaatccgcccggaaaaaccaatcacttgaccatgactgtccgttagcggaaacatgacgcgatcgttaaaccgatcgaacaattttccttcttgattctctacgaacaaaccgctggcacgctgatcttgatagtcgactttgcgattattaagaaacgctactaacagattacgttcttcaggcgcataccccagttgaaaagcttcaattgtgtcatcggttaagccacgtttgtgcaaataatcaagtgcagtctgacctttctccgtattcatcaaaatatgatgaaatagatcggccgtgtcttgcaaaatatgctgttgcttgctgatctctggatcaaccggtgctgcatgacccacctgaacatccagtggcatgccagcaaaatccgccacttttttaactgcctccgggaaggtggcgttatcatagtccatcacgaatttaaaaacattgccgccgcggccgcacgaaaaacagtgaaaaatctgcttaggttcattcacagaaaatgatggggtgtgttcttcgtgaaaaggacacaagccaaacagattctgcccggtcttgcgtaattgcacatattggccaatataatcagcaatattgacagctttaaggactttgtcgacagtagcctcaggaatcattccggcgatgtcagctcactccctttcatgacatgtgccgcagagctgtttgccagcctgcagacacccaacacacgttacccgaaatagcggtaaaaagtcgcacttctgagttgaaatgcgactttttgatagtctatcggcataataatacaaaatacagtatagcctgtttaggcttggaatgcaaggctacttaacaatgacttgactcacatcgccaaattgcttgatcaatgcggcaagttgaagcaaagctgccaagcgattttggcgaatggcttgatcgtcggccatgaccattgtggcatcaaagtacgcattaattggatctgcgagtgccttaagcgcctgataatcggcttccgtcggttcatcatcaaacttcttggcagtcgccaccgttgcatcatacaactgaccttcgctcggattctcaaacttcgctgtatccacatcgacttttacctgctgcttcttggtaatccgcaacacacgtccaagtgcttccatgacaggtttgaaatcagtatcgtccgcgtgcgcagaaaggatcttggcagcatccaagataccggcaagatcggcatcagcgcgaactgtcactgcatccacaatgtcatggcggatcttctgaccttgcaagacttgcttggcacggtcaatcatgaatgcattcaaatcctgttgatgcgcagcaaaatcaagattattggtttttcctgctgccttcaaggcatcagcaatcgtcgtctgcagttcagcaacagcaaatggccaatcatgtttggcgatcattcgaacaatcccgtaagcttggcggcgcagcgcataaggatcgtttgagccacttggaatcagatcaaccgcgaagaaactcattaacgaatcgaatttgtccgcaatggcaagcacggtgccgactaagctttctggcaacgcaccatccgcagaaatcggctcgtaatgctcagcaatagcctgggcaacagctggtttctcacctgccaattgcgcataatgttcgcccataataccttgcaattctggaaactcaccgaccattgaagtgacaaggtcgaatttgtaaatcgaagctgctcggtccagatcagacttatcagtcgcagataagtcaaaacgatccgccaacaaatcggcaataatccttgttcgggccattttgtcgtacatggaactgattttatcgtggaaactaacagctttcaaacgatcaacatcgtcagcaatgctgcgcttttgatcttccgcatagaagaaagctgcatcttccaatcgcgcggtcaataccttttcattgcccgcaatcacattggccaaatgatcagcattaccgttacgaacaccaataaacgcattgaccatctttcctgacgcatcccgcgcatagaagtaacgttgattatctttcattgaggtgatcagcacagcttcaggaattttgagatacttttcatcaaaattaccagcaaatgcagttggccattcaacaagattattgacctcttccagcaagtctgcatccagatcaatctgccattgatgatcagcggcaatttggtgaatctgatcgctaatcaattgcttgcgcgctgccggttcaacaatcacaaattgtgcttttaaggccgcaacatagtcggccgcattgccgagagtcactggtctgccaaggaagcgatgcccttgagtggttctgccagcgtcaacatccagcaacttcatcgggacaatcgcatcatccagtaagctgaccagccaatgaatcggccgaatgtactcgaagtcataagcgccccacttcattcgggttgggaaggtcaggcttttaatgacatccagcatacctggtaaaatagctgctgctgttttgcccttgattgccttatgcagataaacgtaatccacacctttgatcgttttaaagacaatgtcatcaggggtcatgccttggccgcgagaaaagccgatcgctgccttggtccagttgccatctgcatcttgcgcaattttcttagctgggcctttgacgtcttcttcgacgtccgcttgcttgtcagcgaggtcgtgaatcagcaatgctaggcgccgcggtgttgcatactggtcaatcgcgccgtgatcgagatgattttctttcaaaaaagcgacggttttatcgtgaaactgttgcaaactcggcgtcaccacatgtgccggcatgtcctcaagcccgatttcaatcagatattgatgcgtcatgttatttcacctccgtttgatgttgcagtaatgggaagccaagcttcttgcgttcagccacaaatgcccgagcaactttgtgagccatcttgcgaatgcggctcatgtaaccggcccgctcagtaaccgagacagctcctcgggcatccaaaagattaaaggtatggctgcatttaagaatgtaatcataagctggatgaaccagaccgagatccatcaaacgccaagcttccttttcataggcgtcgaagaacttcagcagcatctcttgattgctgacttcgaaagcatacttgctgtgttcgtattcaggttccttgaaaatatccccatacaaaacaccgtcgccccattcaagatcaaagacactgttcacatcttgaatataggaggcaagtcgttcgaccccataagtgatttcgctggtaactggcgatacttcaagtccaccgaccacttggaagtaggtaaactgactgacttccatgccatcaagccaaacttcccaaccaacaccggcacagcccatggatggattttcccagttgtcttcaacaaaccgaatatcatgttctaatggattaatgccaagtgcggccagcgaatccaagtaatattcctgaatattttcaggagatggtttcatgacaacttggaactgatggtgctgaaacaatcggttggggttttcgccatatcggccgtcagctggacgtcgagacggttcaacatatgcagcattccatggttctggtccaatggcgcgtaagaaagtgtacggactcattgtccccgcccctttttcgacgtcataagcttgcatcagcatacagcccttgtcaccccaaaatttttggagggttaggatcatcgtttggatgtccatcttttttgtcatcattgcctctttcccggtgaattgaagtgggattggcttcgggacacgaaaaagtccctacgccaattaatggcgtagggacgcttatgcgcggttccaccctacttcagatagaaaaaactacctgcggcttcatcatttggttcgaaaacgccaatcacaacaaccattatcaggcttacactttccccgactcgctttaataggtttcgttgcgaccctttttctcatcaccgattcaatttcaaatcaattctaccatgggcattcaggctgtcaatagattttctgaaaacacctaattgtaagcaattttcccatgttttccctcatgttatctctcatgttttccctgtcgtctgtaccccttgtgccagtggagctacagcagttattttttaccggtttttaaatactttgccagcttctctgcggcctccacttcttgttcctgatggacacgggcatagatttgcaaggtgattctggggtcagtatgtccgaccatcttttggaccgtactaacagcgacaccagcaatcaaaagattagagatatagcttttacgaaacttgtgcaacgatataaccggtgccaagttgttgttacgaataatggtactaagccacatgcgcggtttatcaacacgaaaacggttgcctgtcttagtagtgaacagaagttggtgatgagttgaaagcctgacatagccatatacatagtcaggttgttcaattcgccatcgctttagccaattaatagtttctgaatcaactgggacatcacgcctacttgctctggtttttggcggattaacaatcagcttcccatgcacacctagtgaaacagttttgttgacactaattagtcgctttttgaaatcaatgtcttcccattcaagcgccatagcctcgccaattcttaaaccggcataagcaaggatacgaaacagcacgtacttgtatagttccctatcagggttaatacaattgaaaaatacttccaattgacgtctatcccagaagtcgtttgtggagccaatcttgtcttggacacgtggtaagatgatgcgtcttgcaggattgtgtgggatatagtccctcagttcagcataggtaagtattcggttgatatgaacaaagtaccgtttaaatgccactggagactgtttaaaccatttattcaccgcagtttggacatcttgtggggtgatcttatcaatgtacatgtcacctagatcaggcaaaatatggagattgaaacagtcacgagtcttggaccatgaactttccctgactgttagcttgtatgattttagccattcttcatagacatccttaaactttcttgcaactttatcaggtctcggtgcagccgtaagttcaccattttgaacagctttctccaaatcacgccctgctttaatagcatcttgtcgtgtaagcttacctccttttacaacatacttcttacgtccagtctttggatcaattccaacataaacggataccttccaccgtctttttccactatcaagtttgtaactcctgattgaagccataattttgtcccttcattgccagcaggctatgtagagagctaactatttacgctgatcaacaagagttttagcaataactttaataagttctacctcagtaggcctaagaagcgttccttcccattgaaatctagtatttgcatccgacaactcagctagaagagttgcctgagcaggttgttcattaaggggtttaatacgcttgaatgctagagaaattttggactcggctgccttagtgatactacgtgtgccgtgctcatatgaattgattgatccaactgataaccctacctcttttgctaattctccctgtgtaagtcctctatcaattcttccttggtgaacttcttttgctgtcattaccacagtaatcacctcttctcagtctaaatgaatattttaaacattttgtagttgacaatattcaaatcataggctatgcttctcttgtagttaaataataacactttgtatgtggctattctacatagtaagggaagtgaaaataatcgtttattttgtgtcttggctaattatgcatcagatcacacttgcagctttatgctttgcaactttagcaggaatctttattggtgctctgattcaatttcttgaagacaacaaaaaagctaccccgcacgccaatgcgaagtagcctatagctaacttaatagccgaaacaatcaacccacgtcaatgggtcgatatacttatcccctagaaaggacaaaataagtgtatcatgattgttatgttcgtgccacagcatacctgcgcacggttgaaataaagtcaggtggtcagctggagccgatgctataaagtccagccggtaagtgccctagtcaggttccctgtcgtcaaatacttggtgtctacggcctttcggacttaaatgataaatggtaggggtggaacgtcttgacagctttaacgagctgtgaggtcatccaaccatgtgttattagcggtgttttcaggagttagaccgcacagttaacagctaaataaatctcaaactcatgcacatggtactctgggcaggactagagtggtaactggatgctggttattaacaacgtgattatcatgggttaataactaggctgtgtatgcaattggtggtgaagagccatccacagtcactttttgtggcaagggggaactatcagcaattacctaattccaccacatgattagaagactatagaatgcaaacaaaaaaaaagccccctaccatgtctagtagagggcactttgttatcaggtgtatcagtattcttctccgtcccagccacgtagaccaggaagaccgcaaacggctgatttatgctccaaggccattgtcacagactgaatggaggcaacagcatctataagttcatcagttgaatgcttgtctgaagcggaatccagcaactctgaaacggctctcattaagtcacgtctcacataactttgctcaataactcgtgcttgatcaatttttttagacatatgcactcaccttatttaattttctgtttcaacggcaacccattacctgatgtacaggctttcacctgggtaaatcaggctgtagattgacttgccattgttagccgccagtgtgtacatactgatgccatactttcttgcaatactccagaagctgtcaccagagcggactgtgtaataagtgtgactcggtgcgctatagctgctagaacgtgagccatagctttctccacccataacacctaggcatatgtaatgataccttccagagtagctaagataccgtgcccatacataaccattgtggatgtacacatggtcatacatgaggctttcaccgggtgcataagtaccaatggatgcatagccggtgcccgcaccagtgcgaatgttaagtgtcgcagaaggcctaaatatgccattctgggcgtaatctgtatcactagatgtacttgcttgtgaaggtgtagaaggcactgtggtcgcttgtgctggctgtttagagtaaccattgtcggttacaccttgcaagtcaacattgccatccaggccacctaaagcgtgcatactggtaaattgccagatagctacaccgggaaggcttggaaagtaactgtatagtggcaatgcacgaacttggtagtcaggataaccagcaacccaaatggaattaggaaactggctaagtactcgattgtagtcaacatgggctactatgtaaggcttgtaactgtagagcatcggggtatatcctgcttgggcaatccgttgcataccataaataatggcatcagtgttcgcctcaatagacccactcgctccatcctcgtaatcaagtgccacaattgatccctttggtgtctgaatacgcggcaggaaataatcaagtgcttggcgaccaatatcagaactaccaccaacaccataccataggtaactatggactctaagcccgtcatcattagccgctttgatttggctactataagttgactggttataaattgtaccgccttgggttccacctatttgtgcaatagcaaaacggtcaccctcaactgtcttgccactgttgccctggtaaaccgaccagtcaacaccaatatcattcttggctgctttaacgggtgtcggtaaggcaaatgaaaaggcagccataatggctacccctgttaatactagtttagttttaaatcgcaatcttaagcccccttagtataggttgcttcaactgtgttctttaagtcggcataggccttctcaactgcattttcaacggtctgttgatcaaccttggtaaatcccatggctttcaattgagtttcaacagagtctactgctttcgacttcttaacagcccctgttactgcctgactaacacctgactgctcagatgcggtaacggctgcttgtgctaatggttccaacacttgcaccaaggtgagtgcctgtttatttgctaataggacctttgccacccatgcacccaaaataggtatcactgcaacggcaatttgtacaattaaatctttcattcttactcctccttacaaatacttttcaatgatatacacaaatagggtgactccaatcgtcccaccaagtacgccccagattgaccacaccattttctttagactgctaatgtctctggcattatcttggctggcattgtatgccctatcggccttgtcatctgtacttggtaggccagtcaattgttgcttaatctgggcaatatcttccttgatttccattagcatttttgtttgttcgtccacaatttcaccccataaaaatagccgctagcttttgccaccgacatagtccttgcctgtaatttgcttgtattcgtctggggtaatcattaccggtacataaggtgttagatcaattccccaactgtaaaacagcacacactgatcataatcagtcacttgattttgccgccttcatatgcgctacttcaagagtaagcgcggcaatcatctgctgttcaggtgacggtccggggagtggatgatcattagccggatcgtaaccctcatcggcaacgattttgccgtctacaagagatgcgtgaccctcaaaaaactgagacacgtcatctgcttctatgatttgttgaccgtcctctgttggtcctactttggcatcttccgcttcataggcccagttggtcaggcggttttgctcatctagccaaatcttaatcttcatcttaattcaccaccgcatcattggtcggatacgcatcatgagtaataaagctcaagctgccagcatacccgccttgtccacgccatggaataatgtaaattccaccagctgaaacatacaattcacaggccgcacccgtatacgacatgctaccgagtaaccttgctgcatcatcattattaaatgggctatatcctggtcgaatgttggcaattttgacccacccattaccagttttcatttcaaaagcaatcccaatggtgacatttgggccttttcttgaatatgagatatttaagttcttgacatcattagtttccagccccgagtctttgtgatagtaatcaactgcatcatgagcattaaaagtggaagtgatgtatttggcagaattacccaatccgctgactaggtctgtcagttcaagaacacccatcgaaatcctgctggtacgcatttgtgttgttccatctgtctgcgtaatgtatgacagtaatccatcgggatttacttcagtgtgatagttttgaccgtttggcttgccattggtatcctcaacattacctgaaatgacatatgaagcaccatttaaagacaaagtaccagttgacttaacatttgatccttcgatactaacatgtgaaaaagggacatttatcgttggagaattaatagttgaggtatcaacctcaatcgattgcagtttcttgatgctaagcactgcctgctgaatgctctggtcaacccaagttgacccattgtaatactgcaatgctgtggcatcattaagcgttgtcccatgccaccacaagtcgcctttcttgggactagcgggcgtgcccaactgaatgtatgtgtatggcacatccttgcttccgggaacaccttgcggcccttgtggtccctgtggtccctgaggacctgtgtcaccctttggaccagttgcgccagcttgtgctaccgaataaccgacttcattggtgccgtcagtgtatgaccatgttgtccgtgtccacatgaattgtccaggagcaatgcttggaatggttgctgaccagcctgtggttggcttagtgacaccatttgacgaaacagcatattcaatcacggttgacttgatacctactccgtccttaccagcaataccattagcgcctgtgttaccatctttggcattgtaactgacagtgtaaccagactcgccggtgttatctgtatacagccaagtagtctgtgtccacagatactgccccttgattaacgtgggaacttgtgcagtccaaccagtagtaggcgttgcggtgccagaagtactctgcgcatacataatctgcgtggacttaatgccaacaccgtctttacctgctacaccatctttacctgtgtcaccctttggtccttgtactaattgccaactataagcggatggattagtgctgtcagcttgtgtgaaatctgtataactaccaatgtacttgcgagagcccggagtatccagtgaaaagttacttttaccgtcactgctatcggcataggcaatatggaagtacgatgtttttccatcgacacctgctttacctggcaccccatctttaccatcagcgccatctgcgcctttaatcagtgaccagctatagttgcttggattcgtgctgtcaccagatgaaaagtcgctgtagaagccaatgtacttgcgattagaatcagttgttgaaaagtcggtattgccgtcttggctgtttgcgtaagcaaagtgagtataggcagtacgaccatcggcacccttggcaccgggcaaaccttgatcgcctttgggaccaacatcaccgtcttcacctttgaaaagtgcccaactgtaatcagccggattggtgctgtcggcctgtttgaagtcactgtacgtgccaatatactttttgccatcgccaccggataccgtgaacccgctttgaccacttacatcattcgcccaagcggtgtgaaaatagcttgtacggccatcagcacccttggcacccggaacaccatcagcaccgtctttgccttgaatcaatgcccattgaccagcataatcagccggattgtcacttggaacggatgacttatttgaccaaacgattgccatgtactttttaccagttgggaaggcactcatgttggtgccttgattgtcatcggcataacgaacccacggatagtattgaacggttttagggatattttcaatcttaaccgccatatccttaagcgctgaatacaaattaggctgctcatttgcgtaatctcctaaagtgagcttggtataatgaccagcgcggctgcgttcaaccgacaacactttcgcagaaagaaatagattctggttctcgtcaacaacgtgtactgtttggttcaatggcacatagggcgcatttgccaaatcaacttcatagttgacatttggatggttatacttttttaagtctgccaaagccgcttgcaaaagtgccgcctgcgagcttgaatcaaacgttttaacccgattccagtcagactgtgttgggttaggattgtcattgcttaacaaacgtgaatatttttgcacagcaatggtatcgtgcaagaatccgtactggtcaagtacaaattgtccggttggatcagtccaactatacccaatcaaattaattggatcgtttgaaccgtcaggtgtagcaccataggccttcaccgatgtttccatgtcgtagatatcaactgtctttacgatattgttgatgtctttgttcatctcaaaagaaattaaactgtcggaagtttcctcatgtctgatattgataacacgttttacggcagtcgtacctacaaaaacaaagccaaagctaagcactgcatcaaaatcttttgcgactgatttaatgcggctgagtgaagtgtcttcgtctgtccatgtaagggttctgacgtctgtaggaaattcattaataccgatctcccagccagaatcatttgtaaaccttgtgatgtagtcagcgatagtataggctttgtcagcggtataggcacccaccacttcattcatcagatcgttacctgcatccgtgcaaacgactgtatgaatatgcgctagtgtatcgtgagtaacactggcaataaccatttgatgtccattgccttcttcatcctgatataagacaaaattgttttcagccgccatttcatcaatggcctgctcttgctcagttttaaatggaattgtcagggtcaaggcaatggcaggcctatcatcagttgtttttacttcactatcagcgctaacaagccattcgccttttccggttgtacgtgcaacgcccatgatgttgaattttcggtctgagaaatagtattccatttacagccacgcctccttcaaatcaacttcacacgcaaacggttgtgcccagcttgatggcataagctgaatgatggtatctccgggtggtaaaagaaatttgtcccactggttgcctaatgtatgcaaggtgcgatcttcattgccattgaaataagtcttggtattagccacatcaattgcaatcacattgccattgctgaaacgatttttaatatccgtataccaactgacgttctgccatttaacggtggacgcaattagatacatagtcgattcgccccatgtcttgtctcgcataaaccacgctgaaaattgcttagtctcgacacttgcagcatccgcaaaagtgaattgacgggtaatagtcgtctctcgtccttgattgccaacccatggtgaaactcggaaaacaactgaattaccaaatttctgcaattccaactgaatgaacttgtcgttagtgaagatactacgatcaagctgttcattgacgactagttgatttttgtagtaacacatccaccatatttggtcagacagcgcactgttgtcttttaaaatcatttgaaagattggcttaccgtcactttctaacgttgtttcgagtgcacccacctgtgctacaccagtttgaaagcgtgtcataacgtcccatgtgagattgctcttgaagttaccgttgtgtgtcttgataaggtcgtgtttgattgaaggaccattccaatacttatggtcgccagtaatactgggccaattaggctcaaccttccagccatcgtagctgtcctctgtccaaatcgcattgccgatctgttcgttcggcgtagctgggttgtctccccagtaaagattattggaagctgcttgattatccatgtgtgagccttgaacggctgccaaattcaaggccacttcactttcttcgcttgtataaccatcaacttcttcagggttgccaaattgaagcacaccgccctgactattagcaaatcctagaaatccgttatcagcgtgcatagttgccgtaataactggctcaacaggataagtgccgccattgtgcaccgtaatggtgttggtatagtattcaggatcagctgggttaggcgaccatggagaaacgacagtgcctgttgcaagcttttcttcttgccagtaaactgttgtttttgaactagggactcgtgtcacaagtcttgcagcatttgcaacaatgttatcaactcccgaaggaatcgtgaacgtaacagatgaatagccagaagtgccagccttaatgatgttgcccacatacgtgactttccatgctgttcctgaaaaagcatcaataccggcagtcaagtcaacggtattatgatttgttataaaaatttgatatgcaaacttttgaccagaagttactgaaatatttgggtgttgactcggggcgttccaattattgagatcaactgttgcacttgtctcctgatcacttgtgcctgccaacaaattcaatggtgaaccggtccatttaggatccttgttgtcaaacgtctgcgtggctaccgagtgggcgatgccaccatccggacagacaaagctgattgagattgtccctgatcgaaagccttcggtgaaggtaggctgactgtctacgatggctaaataatatttgtccggctcatccccaaagattagttgctgtggttcgtccgtatcaatagcggcggccaaggaacgccttagtggtaccaaattgtcattcataacgatcccagttaccacaatcgtcttgacgtcccgtgacatgtattgcagcatctgaccatcgctgatgccgaccttttgcattgtgttgacgtgattagtccctacatcacgttcgaccatctgcacatacatccactgggtaatatctaccccggagtatgtgattttcatgcctgcttgtttcaattaaacggttcctcctttccaataagcattgaacctgtctcttctgtcgttgtactgcttaacttttggtgcaacttttggataaaactggtcgtcaccaacttgcagaacaaagctaagtttcgtgagaagatcagcaatattgtccagcttctttcctaaatcatctgtaccgctgctttcgctttcagcaaccgcaccattacccaagttgtgattgatgttggtaacagcctgtcccaatagttgccaagcacggctcgttttagttaacggcagaattgtttctggaccatcttcgccaacaagcgcatggattggctgtgtgatcaagccaccattagcgtaaccttcagggccactgacacgagcaaaagcagagcttccagagccataaatggccttcatgtagtgaataccggcaagcagatcgtcatatccgttataaacatcgttgtggccggggaacttatacgcattgaacgttggcccaatggtttgtacaagccccattgaaggtatgccggctttagcgttgctatcccacaggttaattgccctaggattaccattggattcacgctggataactcgcatccatgcagcaacttggtatgccgaggcatcaaatccattggcctttaaagctcgaataacatatggcttccaacgttgcactcctgagccaccgggattggccatggaatcttctatttttttaagctcttttttgatccaagcgccaattccgctatatgcatgtttaaaaatgccttcgccgagctgcccaaatgctttaacgggtgccaagttaactaatccgcttattgacttctcaactaaatcagttacatgcttaaccgggtgagcgatccaatctacaattgcttcgaacttatcaccgatccatttgccaacatcttcagccttatcgactacccacgaactagcgtctttaacgccgtcccacacactgccgatgatgccgccttgtgcaaagccgggaatgccatacatatctgcaatggctttactttctttgccattgtaaatacggtcgccggtctcaagtggaagaatagtgttgcgcttttcagcatatatccactgatttgtgcgcttcttgtgaatcagttccttgtagttattactaccgtcatcgttgaccatagccaattgcgtaccatctttaccaacttcgccgcctttggcaaagtgtacgtatgatggcagaccaacttttttaacaccgaagaatcctagaacaccattgacggcaccaagaccggttcgaataacatcaatgacaaagttgatacctgactgtgcagcttttttgataccatcccagatgccactgaagaagctaccaacgccaccccatacatctgtccaaacatttttaatgtccttgatgacactgccaattgtgtcagccatgccatgaatgattggtgtgaagaatttaaccatgccgttccaaatgtttccaaagaagtcagagatggcaccccatgttttattccagacattttgaatgaaatttaaagttgcgctgattccctttgaaatggtgtttgatgcattgttatagatcttaacaatgccattccaaatatctccgaagaaattaaagattgctttccaaatactatcccagactttttgaactgcatttaagaaattcgtgacattcttgactatccaattggtagaggaagatacaatcttgacaattgaattccacgtatcagaaaagaacttagaaatagctccccaagttttatcccatgcgttttgaattccttttgttgtgctgctaatcgttttgctgattgtgtttagtggaggcttaacaaactttactaagccattccagacatccttaaagggcttctctacttttctccatgcaagtatgaaaagaccaacaataaatgccacaggatatacaattatctttttgagatcatctagtcctgtttttgcaattttcacaatattcttccagatagaagacatttttttgctaattggattccaaactttagaccacgctgttgaaagtgactttccccaaccgttaacggtctttagaaaaccatcccagcctttaccgacacccttccaaaaatcattccattctttctgcgcctgcttattagctgcttcttgctgtttctgctgctttttttgagctgcatcagtggacttgttaatgccatcccaccatttgactacattgttagtcatttgacgagcatcccagccaagaccacctagccaactattagccggctttttcttagcattccagccatcagtaaacttcctggcagcatcaccagcccatttaccagctgttttgccaattgttgcaccaaccgctgcgcctaatgggccaccaaagaaagcaccgatgccaccaccaatcagcgtcccggcagattcaccaacagcagaaaacttttggccgacagtacctcctttagaaaaagccttagttaaatccttaatgtctgaaatggcatcataggcaattgtgatagtcgccatgctcttgccaatccagccgctatttagtttgcctaatttagttttgataatctcagcaaactttgaattagctagttttttaaggccagaatacatacctccgatggttttagtgaatccagcaattgcagcaatcggcaacactttaccggccaaattcaaagcaataaatccagctgctaaatcgccaaaaagtttagggtgcttatccgcaaaatctcccaaagactttaacaatgggttgagcacctttagacctgacgtaagcgcaacccatgatattttagccatagctgatccggtggttgaaatcgtagtgaagaatgtcttgatttgaccagcgtggctagcaattgattgactaacttttgtaacagcatccgaaagcttgcctatcattttgtccattgctttagggccagaagatagatcaaacgcttttgcaaacgcagatgtgattgtgcttaggcctttgctcattgcttgacctaatttgccaaactctttatcggtatttttgtcctgtgaccatcggctgatagccccaagcactgggttttgagccgttaaaaaaggcttttctatgtcgccaattagagctgggatgcgagacttgataacccgagtcatgccggggatagtttgcatcaagttgtctgatgctttggtatatttctgccctaattcttcaataacgttagtggcgtcttgagcactaatcttgcctgcactcatctgtgcacgaagatcagtcatagttagctgagaattatgttgaactttcttctcatattccagcattgcatcggccatcataggaaacgcatcagttaactgattgaagtcgccaagctggacaatagatccagatagtgtatgtgtgaagtcaaggccgacctgttgaatacggtcactggataatccaatcgcatcacccattgtcagaaaggcggaagttaaagcttcggttttgggctggttatcaaagacatgataaaactgctggtttagttcgtttaccaaatcagtatcttgaccaaacttgacggcaagtttgttagtcatgtcaaccattgcttgccctttttcagcattaccagttaaggttagccaaatggcattcatttgatcttgctgcttttcgtattccataccagcagcagtagcttcttcaattcttcctttgagcgtttgccagccgcttgacaaggcgttggtgataaggccaccttcaacaattttgcgaagcaaacccggtgtcttttcggcttgcttgtttgttcccgatatagcttccttaactctgttgaaaacagatgggttagccttgtccatttcagtttgcagtccggtcatagaagacttagcctttgctaaactggtagctgtctcatcaacacgcgtcttctgtgtacgccaagcatcggagtctttgccgctagcactggcaatcttatccaactcagctgactgcttggacaactgttcattaagattggtaatggaggacttataaccatccatcttggccttgttagcttcttgctgtttgccttcagcctctaagcgagtcacataagcttgatttgcccgtgcagcggctgtgtactcttgctgtaagccagctaatccagacttttgatagtccattgcttgcttggcacggtcttgttgagactgcatactagcaagttgcttagtggcaccatcaatttgttgctgatactttaaaaactgttgagcaacatcggcagtattgcccttcaactcagcttgtttggcttttagagcgtcaatcttagactgttgtgactcaatagacttacccaagccatcatacttggcttgagcagcgccaactgcatcaccagcagatttcatctccgcttcttgagctttccaagcattttgactcgagcgaacaaccgctgttaatgatttgacggattcgcttgccgacaatagatcaagggcaatcttggtgctcattgttgcattaatttgttgtgccacttcaatcaccctttctcttggtattgcttccacatgattgccggatcaattggccgatctttcttatccttggcggacatcatttccaacatttcaaaataatcagcatcatcaaaatcttgtattgaccagtggaaatacatgactgcttgctttttcatccatctaaagtcctgtagctgattttcaagctcataaacttttacggctggattaatctttgcttttgctggcatcctgcttcttggcagctaagtcaatatcctcatcactcatgcccatcatgcgttcaaaagtgtaattaactgcctgaatagtgtcggcaaattctaggtctccaagcttttcaatttcttgcttgttcagatttaaaactgttgtcaagaagtcaattgagtcatgcaacatatcgcgttgcattttaataatttctaccggttccatatcggtaacatcgtctgccttggccatcagtaactggagatcatacatcttttccatgttgcgattactggtctttacctcatgtacacggttgctaagttggctaactttaattttcatttgtaataccatcctctgtatttgataaggtcgctgtggtgaatcggacaccaccaagttcaccagaaagcgacttttgagcataaaaaatagcgcacgttcgtgagccattcatcagttgttgctatgaaattgcgtcagattgcgtctgtcagcaccggcttattcgcctgctggcggggttggcaatacatatccgccgaacacttctttgtacatgttggctttatcaaacccgctatcaagatcgctataaatcttgtacggctgattgttaaaggccatagtagtaagtgctgtgtaagtcaaagtgtcatccgtacgttgttctgctgccgcatcagtccgaatgttagctgcggtttcggtcatgatgccatcaccaaagccgtaatagacaaagtgtaaacggtcaatggtttgggtggtaataagcaaggccacatgagcctttaaattctcatccgtataaccgcccttgctatcactaacaaaacccttgacttgctgcttaattgcaaagtccaagttgttaatatctagagctactgatggctctgaagtaccaacagtaacgtcctggacgttgttgttgccataggtcttagcaattgtacctgctaagttagtaatgttggcagttttagcacctaaatctttgtgatcgacagtatagataccgtctgtgcctaatcctgctccagtgccagaaattaacttttgttgtgcatcaaccaaagctagctgaatttgatataaacctactgttgccatttaaattcctccaatgttctttgttctactgaaataaaatgtgttaaaaagttgctgtgtgtctgggtctaatgttcgttgtctaaccgcggctacctgccaatgttgatgagtaaaagccttcatcatggctatctcaatggtttctgggtcagtttcaagctcctgtgagtaccaaatctgtacttctacttcctgatttaatgcccagaaatcgttgtcaccatatgcggttggatcattagcagcatcagtaatcaatacaactgttttgttgagattatcgactaattcttgcggcaagttattgcctttaactgcattgatattggcaattttggcttgggtaagcatcgttaccgcatcacctacagcgctcatctatccccaccaccattcaacttggcgataattgcttcatatttgtcttgctcggctgcaaatacagcatctttggcatcatcacgagcattatcaacaaaatggtcaccgtgaattttctttgtcccatcattaaggaaacgtgcaacgaatgccttatcaccaaatccaaccgttgagctaccattgtgatcaccgtcaatatcgccttttttaccactaatgtcctcgctcagatgcccatacttgccaccagtacccttagtatttgggtgtttttctttggtggtctctgctagcttcttggcgtaaacatcagcaccagccttggtaatcttctcttggtcgctaatagacaattcggcagcttttgatacttgctcaagccattgttcaagtgcttcgtccatttccatagctatgccccctttgttacttttgtgagggtcaagtagtcatagcgaatggcgttgtttgaatcatctgggctaatgtctgaaatatcgtaggtaataccatcaaggcgtgcctgtttctgctcaatatttcttgcatcgtgacgaacaataatcgtgattgaattatccaagcgtgtgcccacaagcgtgtattgctgtgtgagagtccgtttctgctgcttgtaatgcagtttgtaagctggtacaaagctagtgatattaaggccagcgccagttgtgtgtgattttggggagccaagctcaacggttcgactaaagtcacttggtttaaagctacttaccattgttgtcaccaccactactagcctgtaagtgtgctagcatcatcagaagacccttaggcattccattggttaatgacctgtcatagtatgtagcctgtgtgagcgttttgatggctggaatcgtcaaggtgtcgtcctctggtgcatcacttgatctattaatgatattgattgcagtgtttaccagactggtaattgttggcaattcagactcatcaaggtttaactcggtcattaaatcactagcaatcttgtttgggtctattgttgcttctgccattgatacacctccattcggccgccgcttagaatcaagctactatgcttttttaggcgaccagtttacttagttagttgccagaggtagcagttgatactgtaggggtaactggtgcagtataggtaatgaacttaccggcggctgtatcagcagctttaaagtctgcccgcagtgctgccaaaagtacctgttcaaaattctcgttacgctgccaagacaggttaatgttgcccttaacagtttcaaccacaaagtttttaacactcccaatgaatgcctttgcgtctccagacttgccaagcacatcatcagcaacaactaccagcggggcaccgaacaattgtttgccggatggagaagtgatggaatcttgtaacaggtacctaccttcagcatccttttgcttatcaattgcggcaaagaatgattcagatacaacaaacattcggtcagtgtagttgctcaagccaacgttgaatgcatccttaatatcatcaatgcttgtagcggcaactggagtagctgtttgcaatactgcaccaattttgtgctgctcagtttggtccttaatgtcattaacgtactgagtcagtaaactggtgatatttggatagtcctgagtcatttcaagggaaattggcagtgaaccacgcaaagtctgaacatcataattgacctgtgttaaagaggcatttgcaagttgagggttgtcagccaattcagctgctgaaaccagttgtgcagaagccttagacaaaacaggaatcttgccagtcggtgcagaaacctgaactttagttacatagccgcctaattgtgctgggtccttaggctgactcataatgtccaatacttggctaggcaatactgcttcgccagcgttgctatcaaaacctgtggaatctctcttaatttcgccagtcttcaaaaactctttgaagtcacgtacttcttcatcttcaactttgtctgctgttaaattttttgccattttttttgctccatctcttttattttcttgctcaacatcttgtgctgtagttacttcatctggattgccatcatgcttttcagttttagctgtttcttgctttggctttgcttcatctaaaacaacattattgtcatcatctgggacatcatcgtccatttgtgatggcgcttgttggtctgccaattgctgacttaatgactgaatagcagcttgaagtgttgctatcatgctgaccaaatcaccagaagtttgttgagcagtagtttcatcgcttgccatatctggtgtagcgtcacgcttttcttcctcaggcttgtcaataacaacctttgtttttacttgtgcttttaaatctgataactgctgttgtaattgttcaattgaccgcttttggtcatcaacagattgttcttctttttcctctggcttttctgccatcttcacaacttctttcttacttgataaaaattgagccaaatcccgttgcacttgcacacttgtttcggtatatgctgggataggagtcagcgacagttcaaacacttggtcaattttgttaattgtgtggatcgtgttgccttgtgagttgactgaccaactatctccaccaggcgcaatcttaaaaccgaacgacatgcccctgatattgccatttagtatgtttgtgtatgtgtcatgccccaactgtgtgtctggtaattgggcattaaagtgtaaaccatcaggctgaatgcttgtttgtaatgttccaacgtctacacgggccaaaatgttagaaaaatcatgtgcataaagcagcaaaacttggctcaaatcgacgttatttagggcattttggtcaacatattcggtaaaatcgcctttaatcgatggctgattgaacactgccgcaacgcctgaaatatccatattttgtccattttcagcctgattgttgctattttcattggctaagcccgtttcagctcgaattttgacgtcaaatgtacgtatatcctcatttttcactaaatcacacccctttttgccagcatttgttgggcttgcaaaggcgtgatggctggtgttgtgccacttagcaacttctgtatctggctaataagtaggtcattatcagcatctactgcttgactttcatcaatattcactggaattccaaatttggctgtcatttctgactctattggctttacatagcgccttaaagtgttgctataaagcgatttagtcatatctaatgaactttgttgatcaccttgaccattcaaatagctatctggaacaccaaaaaccttgcctatctgtgtcttggaccagtcattgctggtcaaaaacttgcttacgtcagcattaattgctaaattttgtacgtcataaagctggtcaagcaccataggccgtccagcattgtcacccgtgttagcattttcaaaagcttttcgtgtcgcttctttttcttctgggcttagtgcaccctcagcaactttaatgacggtgcttggattaatagcatttttaatagttgatagtgtcaacttgtttgcataatcttgaatgttgacttggcttgcaattgattctaatgggctaataccaatgtattgctgaccattgctaccactagccatcaatcggaagtgaagcatgtttgcactcggataattgattgtgcctctctcgtctccccagttaaccgcatagctaatatctgcactgctgtctgccaaagtgactactacctgtgccgccggtgccatctctagcctcataggaacattgttgctatctcttgtaatggcgatataggcgtttcccgtaagcaacatctgaactacagctgattgccaaaagttaaacggagaaataaggttgttcgggttatttatcaccttgtcaaatggtgcagccacttcaaaacttgccgatgcaatatcactacttagaaggttggtaacagcatatagatcagaattatttaaggccgtactggcatcaaccaaatgatttggcaatacttgtccaccacttatgatgtaacttgacaggttagttgatggtatcgtcatacttcttttctgcattcgttcatacggattccatatgctcatctactaccacctgccttagatgtaggcgtgagtagccaaccgcaaaagagcaatacactgcctagtaccaacgttcctatggtgctattaaaaagataagcactggtgacaatagcaattaagccggatacaaataacactgttggcaacagttccttaagcattatcaatttgctcacactcgcacctccctcagattctttgtgtctttcattgtttttacctctcactatatatacgtatgaagtgcgtcatttttgaccaatattgaccttcaaacgcaaaaaaatatgtagacttttaaaagcctacattcatcaggaatttatggcgttcttcatcactcataccagacaatggggaacggttcttatcattatctgcatctgggtcgaagtctgaaaaggcataataggcacggctaaatgcatcaataactgcatcaacagcatcaatttttgaagttgcacgatccttatctacctttatgccagcgcttgagccaactataaccgcgttggttagtgcatactttaaaattgggtcatcgtcataatgaactcggccttcccgaattgctttcttgaattcatgtgttggtttatctaacttatctgatgtttgttttaaaggcatcagtggaaatggttcttcttggcttaacttatccaaaacatcgctagttccccagcggtcaaatacaaagaacttaacatttaagccattctcttctatatagctcataatccacgtggtaacactgtcttcatctatgtagccaaagcgtccttttgcaatagtggcaaaacccaattgctcagcttgacgataattaattccatcttgcttttctttttcggcaatacttccacctgtgtgagataagggtacccaactgtgctgttggatataatagtgtgtctctccagccaactggtatggataaatgaaagcaactgctgtgtcgtctgcaagtttgcttaagtcgaatcctatataaacatcatgaccagaaatgctgaatggtggcttattagctactgcattctcaatgtcatgtatgtttaaatagcgattatcagaagccttaatccacatgttcaggttcttgttcttgaactcatctaatgttccgtccagctttttcttgtctcgttctgaaactaaactaggcaacatcgtatcctttttcaattcaagaattgggtttgattttgtccatgaggatgggtcatcaacttcatcttcactatcctgactgtagttaattagcaacacatcgtctaactctcgtgaataatccttttgcattgcttctcgtgccaacttttcatctagataaaaactgctggtgctgtcagggtaggctgtcgagatagaccaaaactggtgatcatatacttgcacctgcccacttgtaatcttgccaatgttttctttaatggtgccaatccggccgtcatcaccactctcatcagccacagcaagccgaaaatggtagctatcaaattgaccagattcatgtgacaaacggagcaactgatttcgcgtctttttacttctaacgacatcatccaaagtctttatctgctgggttttatatgttctctttacatctgtaagttcacctaatctgtcaaaggtaagttgaatgtaccgccatcctttttttgattgtgcaaccacaggtgctatatatcccatgtcttggttgtacatgccatcagatgcaatcaggtagtcatatgcaagtagaatatttgtgatgtatgtcttcccatttgttcgtgccacagaaaattgaaccctatgaaatctacgctcacccttttcattccgccacccttgacttgaacagagcagtgctttctgccatagcattagcggaagtggtttgcctgtatcaacgtctggacaaatgctggcaaagtttagcacttcatgacacttacctaggtcatacgtgtaagggaagtcatcactgctaatccgtgtcaagtcttgcaaatgcctccagcaagcaagtttaatatcttttccggccatggtagtaccttcaagcacctgaaaagcataggcagtcatagggtcatgatacttgtcagcaatctgatcgtaagcaccattgtctctctgctgtttataagctcgttcaacagtccaatctggcaatgttaaatcatagtctaccaactcttgtcacctgcctttaatgcttgcttaagcgttgggccatcatcgtcatcttggttatccaagacaattgaagcgcgtgcttgtggactgagacccaaagcatcactcaaagacttaatcttggtggttgcatcattcaaaatagcagcggcagggttctttctagttcccatgcttaagccattctcatttatatcctcatatgcctgtcttgataattgaatctgttggcataaggctattaccagtggcttgtcaacttgtttgcataatcctgctgcgtttaacagaggtacaagctctcgccaagctgtataagcatatccttgcaaaaatcttggtggcgtaacttgcaatggctccattccacttgtcttctttgctagttcctcagttcttgcgcgttggtcggctctatctgatgcatcttgtgttattttcatctttctgcccatgtctgctgtacctcccttcgtttcttttctatgtaaaagcttatgcatcaatgtatgtagcccttcttgcgctgctatcatattcatttgctgtacttttataagtgccataaacgttgatatatcggcatttatcgtgcctagagtagggcatataaaatatttttataattgcacattttttgagagaagaccattttgttatgtgcggtcctcctctacgcctacgggggcgggcattacagctttttttattttttgaatatgttattcataatttgcataccattatttattgtttatggttcatcattttaaattctaatggtttaagcaatggctgttcaaggcaatcaattgttacctgctgtacccctccactatatatacgtcacgagtgcgccgttttctgtcttggcatatgaaaagagccaaccattggctgacccttgcttatgtactacttgagctttaaggttgcttgtctcttgttggctaagcattgcctctccttattcttctccatttcaaactgggcgaaccctggcataagtgtgtcaaagaaatcaattaaagctttatcagattcagttagcttcccgtcataatctttgccattatcattatcctttgtcatgttcctgatgacattcaaccgtttcttgtagatacctaactgtttatcttcaccagcttgttccggagcttgttctggttgcttagtacctatcagttgatcaacaatgaaccgtggcatgatgtccttgtcttctatgtattttactggttcatcaatccatgccttaacatcaaatgcttgttcgacgtctggtgtccttggcatcacatttaaactgctgaaccctaaatgattgtcctctggttgctggataaagtacacctgactaatgctacgactcaagctgtcaccagcaatcaccacgccatccataccacggattaagtaattgaacaatagaaacggtattgatctagacggtttcccctcctgcttcaactcttcggccacataaaaatacatggatggcttatagctaaatggactatgcttgcgtctattttcatcccaattggcgatagttagctggccggtgcctgacgcaacatcatagtttgtcgcccctaggtttcttttggtggcttcaacatcaccatttgtccgtgccacatcaaccagttgcgttgctaatcggcccagttcaggtggcgaataataggacttatgcttcttgctgatccttgtcatttcctgactgtaatatcgattgaaccagtcataacttacatctgtttcaaattccaaaaactggcgaaatagctgctcacgtttgtctttgtcaaataggatacccatcaagtattcacttgtggatgctaaatcgtcaccgtgcaaaagcaaagcaattgtcttctggccatcctctgtttcaaagtatctatctgtcattagtgctattccacctttgctttaacatcgacctatggatgtcaactgtgattgttactacgtcattgccatagtcatgagtggtagaataccagccggattcgaatagttgtttggtaacctcgttggctaataggtcgttacattcaatgtttatgtcttcataacttgcctgtgctgctgatgatgtcacttgactattgaagtcacctaacactttcataacacccttccaatagtagtcgctatggtccaactcacttggtctaactaattggttcatttgtgtgctcctttgaattactattgatgcttcaccatcgtccatatatcgaacatttacagtgtcataggaatacttgctttggtattgcatcacagctcgtctgatgtagcgggcacttttatgcccagcacttaaggtttgccattgccaagttgactgcctcctatagcttaacaactcacttgcaagctggttggtatgatgccatttaatagctaacatttagtgtcctcccgaaaggtattcaaagctatcacagtcgcttataacagccacaggtgcacctaatctttccaccatatcagcttgaattgtgtcctttatgctaggcgttaaggccatgttgacgatgaatacatactcattctcatcagccaagtaaaataatttgccattcattgtttgttacctcttttttctctctaaacactttgttatagtgctgccaatgtgctatacacaatcgcgacccagaatagtgtttccatgatggacacacccgttgcaatgattgaccatgttttatctttggtgttctttgcttttgcaatccctatcccaccaaatatgatgccaagaatggaaatgattgagaagaagttgagtaaaaatccgactgaggccatcacgattcctgttattgtaaacccactaagcttattaccggtgcttgtttgtacttcattttgcttgtctatcattgttatttgtcctctttcttttctcttaaaactttagtccaccacgcacgatccaaatgcttcaacttattgtccccattgggttgctgactgattatttgttccaatttggtcttgcgataatgtgtttgatagctgagtacccacaaattgttactatctaaagcctgcttggctgtgcatagtctaaacgggattatgtggtctacaacttttctatcacctaacacctctcccgtaacttggtcagtcgccatgtctcgtacatatactgcgtctcgtacctttttccattgcttgctatgataaaatgccactgcttctgggtctcgctctgtttggtcatattgctttgcttgctgtgctttaatggctcttgctagcttgctcttgtgatatgcatcctttttagcctgccattcctgctcatgtatggccttatgctttgcacagtacctttcgctgattgacactactgcatggcacaatggctctccacactcgtgcacttgttgtcgatgcttagaatggtaactcatcgtcagtcaccgtcacttttgctttgctacttgctgaccttaattgactattaagtgaatggaaagtggcatcggatagctttgttgatgcattgtttggcttagtggatagaaggtagaaatggtcaatcacaacactaaaaccatgctcagtttgtccttgttgatttgtatatgtgctggttttaatcctcccatcaatgccaatcttgtcaccttttttagttaacctatcaaagttgtctgcttgcttgccaaaaagtgtgatgggtataaagtctgctgtttggttatcatttgatttgtagatgcgcttgatggccaacagacttgataaaacattgttacctaattttgcatccattgctatccgcccaattccactaaagttattcattatctatctttctcctatctaattcctgttcacgttttgccattaaatttaccaatatgtatttatctttgcctgcatgtgcaaagtccttaattaggtgggattggtaggcaacctgagggtcatcaattacttcatctatgaaatcctgatggctgttgataaaagcctgtatgtcattgtcacttgtgtctgggtcggccatgatggaatcccattcgctaagtatgtgcaattccttcgcgttgctactaggtttcttagtctgccgatggctacgagcatatttgcacaccttaactagcttgttggcgaactgtctaggcgattgattgaagcgcgccatggtctctttttgaccaaatcttaaaatgcttccacaccaatccctagtattggcattactgaatagatctggtatcagctttaaggcttccaatacttcatctgggttgctcggctgtggctccattcctgccagcatctgtgctttttcaacctctctagtggcatcccgatggctcaggcgaacaaggtcttttctggcgtacttgatgcgccattttaggctcggtaggtcacgttggacagcaagggtcacgtcatcgttgctccatgacttcaggcgatgatcaagtaactcaagtaacaattcttggctggcggtttcgatgttgtcgtgaagcatgtaagccagctttgaaacgttgcttatgaaacatggcatgctaaccaattgcttgactgtatcctcacttagcactacttgtcacctgctttgtgtgtccaaaggccaattaaggcggttaagatgcctagggctaccgaaataccaagcaatgccagccagtaattggtaatggctgtccaatcggtgctaataacacctgccatccttagaagggtcaatgcccaaccaatgttggctaaggttgaaaagatgttgatgctaatttctttatttttcatatgtatgctttactttctttcttgtctagtgttatgatattcttgggaagttggtactaattttcatttggcaaaacaaagtgaaaaggcttgttgagatgtaacgtgccattagccgagccagagaccgatgtgttgcttaacccatttgcctcagatgctgacttaatgctcttgtaatcttggaatgtgccatcatcattaactttccgaaccgaacgaccatggccaccagctgttttcatcaattctagacgatgagccttgttcaagttgtctttgcgcgttatccactctaagttagaagcgttgttgttcaacttgtcatcgtctttatgtgagacttctgaaaatccccacttattgtcacagaatgtaagggctactaacctatgcacgcctgtacacttcttttgcccattgtcacatgtgatgttgataactgcgtacccacaattgtttacacgctgcctaagtacccggttgagtttcctactataaaccatgccagacttactgactgaatagttgctaaacggcgccggacactgatgaaattcttcatcatccagtgatttaatctgtgcttttaaagttgctttgataaagtattctaaatgggtttgcttataaattgtattttccattacttttttctcctgtcgttttattcctatacttctattataacacgtttttataacattcttgccagttttgcatcactagattaatctatgcctgttaaaaatcgcccttatcaatcctttttacatatataatttagcatcaggggataaaatgagcggatattgggtacctaatgtgtggcttaaacaaatcttaacatttgagcctattaagtcagcattcctaattctgccaataaaaaagaggcctcattgtgagacaaaaaaaagacagccatttctgactgccttaagtagctagagctaatcctccattcatctatctatgcatcctagtcttaagctcttttttaagcttgtcatttttgccagctaccttttccaagcataggcgcagggcagcggctgtcgttgacacaattagcttttcagccggcttagtatccttataaccgccaagcacataacccagccttttggcatcagattttgacattttttccatttcaactggcttagcgttgcaaacttgatcagtgtacaggcgtgctgtcctgtccttgacgcttgttaagctactaatagtatccgctgcagctttggccgacataatgacctcattggtatacccactttgagctttgagagtcatgaaaaagtctatttctgtcttcccaattccaccatgtaggtcgggaaagtagtcacttgcaaccttctctccaaatagctggataagcatttctttgctgatttgggtattcaagttgagattaaagttatcactcaccaaggaccaatcagcaatattgaaatcaccaagtgtatagacatgatgtgagtttactagctttccatcgtgattaaactgtgtgagtttaagccctgaatcggttaactcactaggttgcattaaatggaccgccccagcaatcctcattaaaataagcgcgttcgcaatctttgtcttagttgccttctctgggtgttcaagcatgtccattatcaaatccttagttacatagatacctcggcctgactcaagtgaaagttgatggccagttacttgattggcggcaattaggttaactgcttgccatacgtcagtcatgagcttcttgtcatcccgccaagggtcgaacttattagctggtacaaataaattcttaatcgcttgtgacgcccctgagcctcttccactcggcatctgtaggatgttagacgtcgcaattgaacatgcttgcttgtaatcctttcgctgcaatacttccgggtagaaagcccgaaggaatgctggcagctgttctggtgatcctaggcattcaatgaaagctgggacaacattggttgttagtttatgtatagataacatctttttaccatcaattttatgctcggttgcccctaggattttgcctgtactgacagacgtaagtagttcgttaagacgtgatttcttagctgttcgagtggtgctgtgcttagttaattcagcaaccttgtcaatgttattagcccagtttgttagtaactctttattcttgtaccccataaaaaatctcctcatttatccttatgtcttcattataccacgttattaaaaaatataggtagttataagcaacctgtatatcccctttacctgcatcacaccctttcacttaatagtatagcgtcaggattataacggacaaaagttggaaaagtaacggataatccacaagattagtggcaattgtttataaacgttgctgtgtaggcatctaaagggggtaaaagtgtgcaaagtaaggatggaaaaaagttgtagttttaagatcttaaaaatgcatgccctaaatagcttaacagcagtagttgtaagcgcaaacatggcctatttggcatgcactatatctttaactattaaacatgcaaaaccattagtaggccttttaacatgcacattaagcgtggctggaacagacacggttaagggtgccctacctggccttttaacattctgctacttaacttgaaattaattggtatgaatctgttaattagcctgttacgatctttgtaactggctaaggtatccagcaaccatgctggtgaggggagaagcggtcttagcttcgggggcgaacagccccaacacttagcaagtaacctatctagtaactgaatatgtgttagtaaagttacaagccattcagagtaaggccaattaagggcaccaaaggtgtctttagacaccactaaccggaagcaacgcttcccatacgtgtgcctagttacaaggcctacaattgtttatgtatcaatttcaattcaagttatgatagtaacctttgcattctgattactttattcagttacttaataaggttacttaatcgatatagggctactcgccccgaagcaaagaccgcttctccctcgtaagctgtatcagcttaagcatctgactaaccaaagaccggttagccattttaaagaatttaaaagattaagaacatgtatccgttgcatagtgaagttacaagccattcagcatcgctacgttctacttcattaactgtcagaataggcctagttaggcacttaaatggtgtctaagacaccactaaccggaagcaacgcttccatttattgtgcctagttacaaggcctacaattatttatgtaagagtgttaaagagatatagcaatttcaaaatggattaataagtcaagttcctttgctgtcttgtgaaatcttgagcattatatcctttactgtcccccaatttaaggcaaaaattatgcccgtctactccactttagatacgtgatgcacaattgccagcatcgatgccagcttgtcttagagagtcaatatgagcctcctgtaggcactgcagaagctgatggcctcttttgtacacatcagtgtgactctttgttctccttgttaaacttcattagttacatcaggaccaaggcaatcatttgtactcctctttggctctctggcgccttgataatcaggcttcccacaatgacaccaagagacactagaacgtcttagagagccaatatgggccttctgtaaacatcccgtggtgtccaactcaaatcacaatggtgcccacttcccaatcaggtggaactggtagacactcttgtgatgctcatttaatgccacacagcacattatggaagaataggtatgattacacgttcaagatgttaggacatcttaggggcgtgtgcgtcctctggaatagttgtaatagaaaatgatgcaattaattaaaaaagcaccctcacaagtcatcaagaggatgccacaatgtctatttagctagttagagctttcccaattccatatcacattgccacctgtatccaaagcaatgcttaatgatgttgcgttttgtacagcattcccaaaaaaattagggtagttatgtgtttgcccaggttgaattgtgatggctccctctttaaggacctcatttggaaccttcaaggctggtccataattgagcacgggcataatggctcttggatcaatcgtgattggcttatccgaagtatttgtgaaggcaaaggaagaaaactgtgcagcaggtgtcactttaatgtttggactattattttcaccaattgtattggatgaattacccttgttttcttgtcttgacgggatggcttcttcgctactctgatattggtttgtagcgccacggtcagcagaagaacggtttttatcatcagactgcagagtagattcgttcaaagttccaatttgtgtcagttgaactttgtcaacaatcgaatggtctgcgtcaaaaacaaaggtttctgtaccagaaagagtcatgttaaaaagaccagatatcttatttatggacataaaataatgttgcaatgtgttgtcttcaagatcttgcgaaattgccagcccgtttggccaatccaactggtaaccctgtttgcttgaactccaagtaacccctttttcttcagacactttggtcaaatcgcttgcaagtttcccgcttttattccattcattgattgaatcatctgactctgtcaagtaaaaaatgacaccatagccttcttttgcagtgccaaataccacgtgtccttgcatttcagtttttccatgagtttctacttggtaagaaaatatttttccttgaacaatttttgcaggagtatttctattatgaaaatgaagaatacttatcaatactaatacaataatcaagactagtcccgataccgttcctgttttcccccatcttttgaatccagaccgggatgtctttcgactatatcgcattattttcctccgaggttcaaataatattgttttctaaaaagattgtttactgtttaacgcttgtcttttacactttgtcaaagatataatactaccactaatctcagtttaaccaatgatccggttgccccgttgccggattagctggagaaaagactcgtccattgtagtggacaattacgtctgcataggtcatttggggtccaacctgccagccatcgcctacaggtgttgccctgagaccactggcgtcatacacattaagaaaaggggcggctatttgtttggcttgttcagcactattaacaacgtgtacgggtgcactgcttgcctgagattgttgagtcggttgtgtggaagcttggcttacctgttgactagcttcgctggcaggtgcacttgtagcagcttggctttgggtacttacggcagaggcagatggtttcttagttgcggccttgttttgggcaatcagtgaggccaccttaagattatctgttgtagcaccggcagctttatccgccccatagctgtaagccagtaagaagtctcggcttaagtagcaaaattcgccaacaccattaaagttggccgcagtcgctgaatcaaacaaccctgtaactgtcttcgttcgcattggtgcaatagtaagatcaccatgcttcactgatttgatgggtgtcccagtattacttgtgcttaaaataaacttactaaggtcaaacttgagctggcttttagtgccatttctgaccttcatatcaacgatgtacttcccgccgtcttgggagtcatctgcaacagctttaaaagtaaagaaaacctttgactgctcctttttatctagctgatgatagtacttgctagcaatttcaacggagctagtcgacttgggcttatcattcgcggacggtgacccacatcctgccatagtaagcgcaagtaaactgaaaactaccattttctttaacatctgtatcccccattagatttgatgaatagatagatcaacaacagtatagcgctcgctattgaccaccagcaattgctttctagcaaatatttgaggccacaaaaaaagccctaccaatttcggtaaggccaacatgcctgctggtgttattttattttgctaaatcttatgtgatctcatgttatctaggtgccgaataaaatgttgaaaacagccatgaaacaagctactttttcgactatttgaaacaccattcaggcctctaaaccagtaaatacagtaatgaaaccatagttaaataactagatgcgcggttccaccctacttcagatagaaaaaaactacctgcggcttcatcatttggttcgaaaacgccaatcacaacaaccattatcaggcttacactttccccgactcgcttcaataggtttcgttgcgaccctttttctcatcaccgattcaatttccttattagtatagcatcgcggaaaaacgtgtcaagcagagaagagcgtgagccaccccgggtagaaaccggagtgtaagtggcctcaggtgtgatgaccgggctttggtcattgcacctgaggtccttacacgcaggtttctggggtggcgatcgcgttttggagcaattgcaggcagcactatttttctattctcggtcgatagtttcttatactccgagttggctccgcggcgattcggggtggcgaccgcgcagctagagtggtgggcaccactgagcccatcgccgctccgccaactctctgctttctattttcagattgaaatactgataatcgtgggctattggttaaaccaacaaacaatcatttacaaaagttccttaagtgccagaaacttcatcgatccgttccttgctattcttccacaattcttcaggtgtataggtgtctttgtcgaagagtgtcaaggtgccgtcttcggcaatttgcggatttgccccaaaccattcccatgttggggcaattatcaaattgacgcgtttgcctttgcctcgcgtcggggaccaagcatccaggtagtctttgatgaaatgtgaacgcatataacgagtctggccgttatcaaactcaatggccaatatattggcggccagccagactttgacggcttttggtgttatttctgacataacgcacccttctttacgtaatgcaaaacccaacgaccatttattgcattaaaaaaacgcttactacatgatagtataccaccgtagaccaacaagtgatcgtgcatttgtctttgtccaaaaaaggaagccaattcccgttggcttcctttatcggaagattgctaattaatgcaccccagaaacttcataaatctgcgacttgctattaccccaaagttcttctggcgtgtattgatcgtgtccaaatattgtcaaactgccatcaacggcaatgactggatttgcaccaaaccaagaccatgttggcgcaacaagcaacagcttacgcttgcctttccccttcgttagtgaccaagcagaaatgtattgatcaataaaatgtgagcgcatataccgtgtttgcccattatcaaattcaattgccaataaattcgctgctacccatactttcacagctttcggtaaggttcttgccatgacgccctctcctctcaataaaccaaaaaatgctatgatctagtcaactgtttacgagttgaatataccatagccggcgaagatagttaatagtttctataagaaattgagaaatatggaataaataagtatcgttattccatctaaaagcgacatattacgataattaaattaattaagtgtttgtttcggagagttatccagtcaaaaatatgttgatagtaaataattatgccactgatatcaaccatcattccgagtcatcaggcaggcgatcctgccattgatgcatctgatccaaaaaacgtttggctttcggggtcacaccgaccatatcagtatagata

SEQ ID NO: 38 - DNA, 21856 bp, Lactobacillus paracasei
atgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggaaatgcccatttgaatgaacggccagacatacgtcagcaagactgctaacatgacagtaactggaatcaaaacaatgaagacaaaccggctgccaccataaatttgaaaggcactgcgaaattcagtatccacaaatttgttatgaatgaagccaaccgttaaccctaaaataatacctaggaagacccccatatcgagaatttgaacgccaagaaccgatgcttgaccggtaccttgaagattctcggccttcgataaaatcccgcgcagttccataaacttgttcatcgcgttaatgaagaccaagaatgtcagcagcgccgtaaacccagcctctgccttcttcttcttcgctaacccaacagccaagcccacacagaaaatcaccccaaggttggttaaaattgacaccaacgatccggacaaaatcaagccgaagccttttgtcaccggattattcatgaacggcaccacttcaagcagcttctgattggtaaagatgttcccaatggcaatcagaatccccgcaatcggcaggatcagcacgggcacgaacatggccttggaaaagcgctgcagaccgtccataactttctgtttcatctttgtcacctcttctagtaatagcaaaataatttcttgttgctctaaacataacagacaagttttatcgtgaaaaccctttcaagacaacaagaaacgtgttccgctgattcggaacacgtttcttgttgggtggttgttttggtttgtctttagctgctagcacaaaagaggtgctactaagcatagaaactattcatcttcgtttggcagttataaattttagttctaaccgcttgtgttgtaacccgtctgactattgctcacgccgttgacgccaaatcattaagccgccaatcagcaaaagcatgcccacacctgccaaacttagccattgaatgaccttatcgccagtttgtggcatatctgcttgcattttctgatgctggccgtttttatcagctggtaacggttgggtcggtggggttttgctgcttggatctgtctgtgatcgtttgacgagcgcgttttgtgcagtaaatacggccttcgtggcgtgatccaccataacttgggtcggctcgtcaagcgtcagaacgtcttttgcagcatcaatcgctgcttgcaagtcccgccatgaagcatcggtataagttttcgcatcaagtttcgccacagcagtcaaagcagcctgaagtgctttcatatcagcagtttttaccagcccatcaatggctgccaccaacgctgtattagcatcatccactgtctgctggtcagtcgctaaatcggcgatgactgcttttgcttccgtcagtgcctgcgttaaggtcgcgaaacttgctttcgtgtaatccttcgccttcaaatttcctgcagttttgatagtcgcagctaaggtagtacggtcaactggtacatcgagcttaaaggtgaccactcgactggcgcctgccaaatcagccggattaaaggtcaaaacatggccgttcgttgaaaagatcgcctccgtctttccttgaagatgaactggattgttaaagctgaagttgattaggttaccggtttgacttggttcggcagccgtcagctgataaacattgttgccaagtgctttgatgatgaccgcggctggctgatcaattgaaacaaggccatccagttgatcggccttggtccaaacattggccatcacctgatcttttgtcttgattgcttgcaactcgccagtatttgcgagaaccgtatagtctggtgacttcgctagctgggcgacttttgtatccgtcgcattcggcacagtgacatattcatacgatccgtttttaacggttgcgccatgcatggctgccaatgttgcataagtatgcttataaaccgtatcggatgggaagtacccattaatatctttgtaggtgcctgtccgcgtcgcctgattgatcgtaacgggcgcattgccttttgcgataatatagccaacattattttcgggatcggctgtattgatatttgcccactggctgactgtcttttggttcgtatacacttgaccatccaccgtgattttggtggttgccggatcaatttggcgttgatcgataatggtttcgatatcggcggcagttgtgccattaatattggcaccgagattaatgatttggtcatcaagtaaaaaccaggatttcatcgcctgcaggttctgaccttcattgactttattcaatgccatgccaacgctggcggtggtcccatcagtcgcgccaccaacccaagcttgcggactttttgaagacgacttcgcaccatccggcagtgacaccgtgtcaactgtcgttccgggaaggcggtacggatcaaccgttgcccagtagccttcaccgaattgattcaaatcattgttatacagataaaccatcccgtcagccgtatgccaagcatggctattttcggtattaccgtattcaaaattagcaattcgattggagtacatcgcgatgccaaccgcgtgcgtcggcgttttttgcatgacccgatccatcgccccataaatattcagcgaactgacgtcatctttctgagctgttgcctgatgcaaagccgttttgagaccatttaatgccgcgtaatctcgtggcttgtcatagaaattgtagcgctcacccacctgtgtaacccaagtggcaacggcctgataaattttctgcttcaatgttgctggcgttgcctcggcaatcaaggtcagattggctaacgtctctttgccagtctccaactccgtggtttccgcgttcgtccctggtgcgcgcgaaatactacgacccgaaaccatcgacggcatgcggccattcaccatcaattgcaaaaagcctttgtcaattaagttaaaaacgttcgcgaactgaacttcactaatagcccaaggcgtaccaacgagggtcgatgaaacgcgcgcaatgcctttaatcatttcgttgccataactgccattgtatggaaaaaaggtgtgttgaacgaaggagccatccgcatagataccatccttggcggtcacaagccccatcgctttaggtaaattctgttgaacaagggcaacccgcttgtcatcttctaacaacaacccgctagccaaaaccgaaatcgaaatgtccgtcaagttagcccctgttgctgtgtaagctggccattgaatattaggatccttggcataacccaacaatggttgaacaaacttgaccaacttttctggatcctgtcggtgcaagtcattgtataacaggatcaaagtatcatcgagctgttgtgccgaaccgatttgccaatcccaccaattgccggtggaatagctcccgttatattttttggccgtctccataaaatcaatcgcatcaatgattgcctgatacacctcaggattttggtgctgttggcttacaggattatagtagcccaatgttaacattttaatattggtaaacatcgaggtataatccgccgaggtcgtgtccgaacttttcttcggccaaagccgactacgattagcacttcgatccatcgtcgcccatagcgtttgactctgcgctgccaagtccgtcaagtaagctttaacattgggatcactcatatccggtttggtcgcaatcaggcggtcacgccatcttgcgcgcatcgtcacatactcagcacggcttgttactgttgctgccttctcgataggcttagccccttgcacaggaacttccgtggcaaccagttcgtcattaacagccttcagtatttctgaactcgacgtggccgacgatggtgttgcgaccgcgctggcactatcatcagtcgcgtacccagtaaccgtcccggtcgaaagcaccatcattcccaataggcctatactgaccaaaaactttttcatgctcttccccctgttaaaatgatttccgatgataggtgatcatcaatcaagacgttgctccgttcagctgcagcagctaaaacgttcaactgtctaaaatagccaacatctaatctcagagagcttatcatcgcataattggaagcgcaatcatcgtgaacttttggtatacaccagcaatcgttttaatattgacgcggtgcttgtaaaaataaaataaattatttttctgatggaatttattagtctacttttctgaatcccgttattcgtatcaaaaaggctatgcgaggtttttcgcatagccacctgtcatttaaaaatttcgatgaagcctaaaactaatcaacgctttccccacttagtaattcgtaaaagaaagatgctattcctgcagatgaacctcccactacgaagaacaaaaaccatcgccacataaaactcatttcaatggatgccgtcataacaacaagaagataaacactaacaaaagtcgtaaggctgacgacaagcatatgcatgccatcttttatgtggttcatgaagcatctgtcctttcgcgtcttgattcgatctcatactgtttttgtcgtgaatgtggtcagataacaaaattccttagctcataaaacgtctaatgatcatgatgcaaacccttgaaaagatcggctaaattggcaaagtcttcatagcgtccattctttaaatcctagagtgaatgatttcgttccgcctcgctgattaatgtaatacctcaaacttaaaggttaaatccatggccagattttgccgactcgaataatcaccgaaatattggcccgacaacgacacactggtcttagcctgatcatctaacgttcctagctcttgattcgctgttgaatcatcaagcgggattttatttgcggcaaatttttcgttgcctttcaaaaataatctggcactttctgaggcgtttactggatcaggatcattaacatgcactaacttaatcgatgatttggttgtggtcttaacttgttgcaaaaccactttgacttttgtctttgaacgattcttgatctcatagttgggtgagacaatctggcctggatcaacatcagtcgaaccaaaggcgagacttttcggaatcgtcaaatcgatcatattgtttgatgctaagacattgattgaaatctcttttcgaagcttaccaatcgctaatgttgcctgataagtaccaaattcaggctttaggtccgttgtgatcatcttgattttctcggagggggtctgcttattcttttcccacgcctgagcttgactttgcttcaaaataaacgccgccaactgatcggatgttttattagctagttgattagaataagcggttatgttttttgccgtgagaataaattgatcatccgattgatcgtctgtatctttgacgacaactggaattgtgtatgtgaagaacaccttattccctgaagtaagcttttcagacacttgcacctttacatcttgaaacccatcgtgagtggtgtccggatagtcagttatcttttcgaatgtcaccgttgcttgcttgtttttatcaatagcagttttaacttccttttcaatcgcttcttttttaacagctggtgggacgaccaaccctttaaaagtcagttggttaatttgcaaaggtcgatatccattttttgtaacttcgaaaaagatttctttaggttgctgatagcggtctaaggaagtatacgtggaatcttgtgtatagccaattttcccttctgcttctttggctttaaaaacatcgccgtaattaacggacagcgtacgagaagcgccccaacgattcaaaaagtcttgcttcttatcatcgccgttcgctttaatgaccatcgttggcgtacttttatcaagtgctaactcggtatgctgattcatgttatacaaagcagtctcaacataaaactttccgggaaatgaagaatgaatggcttcgttatcggtcgacttccccgaagtcgcgataattttcgggttaccattttcctcaatcaaagcaaacacaccagctgaatcacgagggccatattcatatcctcgtaagacaatggcattcccatactttgcttcaactggactaatagaagtgactgttccgcccatggacgcaaagacgagttcaacggatgctttaaagagcttatctattcggtcatctttgagcgcttttttaacttcatcagggttactcgacccgactctgccgtcactgtatggcacatcactgccatcagtgtctgtcgctgacaccatcatccttgaacgattttctgtgttccacttttcaccaagtttataaatagcttctctggtttttaattcgccgggcttggcgatcacggttactggcacttcataaggataactgacttttttgccactcgataaggtttgtgacacgagcactttagccgtcttttcacctgcagtatccacatcaggatactccgaaaatttttcaatggtgatgtttgaattacctttagtgtcaatggtattttgcagttgttgcgcaattgtactttgagaatctttttgggtgaccgagatctttttagagcttaattgattgatggctaagggtttgtacccatttttcgtcacttcgaaaaagatttctttaggctgttgataggtgtctaaagaagtgtagtttgaagcttgcgtatagccaattttcccctccgcttcttttgctttgaaaacatccccataattaaccgacatcgcacgggcacttccccaccgatccaagaagtcctgtttcttttcatcaccgttggcagtgatcacttttgtcgggctttgattagcaagagataagtcgttgacattattcatgctaaataaagcagtctcaacataaaactttccaggaaattcttgatgaattttgtcattgtcgttaactgcaccggaagtggcaatgattttaggactgccatcctcttcaattaaggcaaacgctcctgcggcatctcgtgtcgactcaaccccattttgagcttcaaatccccgtagaacaacggcattcccatagcttgaggtggctttaccaggcgaatctacgcgcccgcccgatgacttaaaaaacagcccaactggcgaatcaatattggcatctattctgccatttttaattctctttgaaagctcatctgggatggtcgccccaatcctgctgtcactgtaattaacaggactaccatcggcatctgtcgccgacaccatcatccttgaacgactggctgtattccacttttcacctaaaacatatttagcgttgcgcgctagaagaaagcccagtggtattttcatttccatagattcgctgtattcaatctcaacaggcgaataattattagaattgacagtataatattgaaagctggtgaacggtcccaactgtcccgctctcatgtcaaacttccaagttaatctatacttaaccgaaatgctaactttagaattagtccctattccccttttaagtcgaatggtcgatttgttaactagcgtagcggctaacgtctcgggatcactagattttacttcgacaatgtcccgcccgacctgaccaacctcaatcacaagattactagcgatcctttcctctttaaatgttgacgatggttttaatgatatgtctactgcttcaccttctttagtgccaacctttgttgatttaagtaatttgataaagtctttccactcgcgattagttttactcagcacgatatttggatatagctcagccgcctctactggacgtgggaatgccgcagaacttaaaacaagggcaacgactagcaatagacttaaaaattttttcatttgctttactccttaaaaaatcagcgttataccaaattttttcgatgactggtatgacgctgattctcatattgctaaggttcgacttttttggtggcattgctggcagttccctgattgccatcttctccttgatatttccttgtccagtacacgaaaattgcaccggaaaggcacagtaaccccaacatcaagaatacctgcgcttgcgcggcatctgcccccagttcgggcatctcctgccttattttgtcattaggttccttgcgctgaacaatcggacttttgccggcatcgtttttgtcagtcacatcaactgactggttgccaatgatgccctccacctcaatacttgcattggtttccgcaaggcctatatgcggtggcatattcataaagaaaaacaaggccatcaagaagaaactaagctgtcctttcttcatcatgatttttactgaacttcgaatttaaggactaatttataatttgctttaactgtctctttggtgaagtcgaaaccctttttgacacttccagccaaagtaaactggattttcccgttttggcttgtgatcgtgccaatctcagtaggaaaagaaggtaccttttgtttgtcagttgaacgcaaagcaacctttttgccgtctgagtttaaatttagatccaagcgatcctctaatttattagcattatcgccatcagtaaaatcattaatggaaactttgacgcctttggctgatagattctggatttcataattcggtgaaataataccttcactgacgtcggtttgactaaacaaaactttggagggaattttgacatcaacccatgctttatgatcttttttaggcgttggtttagccggatcaggtagtttggtaggatcaaatggttcaaacgttccttcagccgaaatcgttgcactgtctgttttcttcacttctagcgtgttagtagcagcatgaggatcattttggccattttcgtaagcgtacacttgggttgatccaagcagtgatgcccctatagctaatacaccgcatagtgtcagaagttttgtctttttcatttttgttcctccattagtttgcttttattgataactagcagactagttattcactgataattgaccgactactgcggtttcgccgacttttgttgaagaatcggcaagttcataataggtaacggtgctttgtgtcttataaacgcctcttttaaggttggctttcaattcaccagcctcaacatattgtttgggcttaattaagccggaatcgtaaatgactttgttctgtccttctaatcgtgtttgcacccgaataccgtactggttgctcgcaggattcaagatattgaccgtcccgacttcatttgcagcattgaaaaccatattcgtatcaagctttaaatgaaatttgcttttgtcggctttttcttgcagatattctttgagttcttcatccgtcatattcttcacgaaggaagtgtcttcagcaccacctccatttgcaacaacatttggaacgcttctatgcaagtacacgtagcttccaatgctgacaatgccaactaataaaagtagtaagcataccagtttcaattttttgttttttcgcatgcaaattttcaaccttcccaattgaattccaaatcgaaacggtgttataatgcacctaatattagcaatttctaacaatgaaagttagtataatctaatttcccgcctagttgaagttcattttttgcctaacgttaggcaaagaaggagagtttatggaagaacttttagaaagcaatttgcttagacactttcggattgttcgctttttacttggccgagaatgggtgacaattggcgaactcgctcatacattgcgtattccatccagaacgattcgccaaagcatcggggaaattaatcaatacattaatcccgctaaaattgaaagtagtcagaaatttggtatccgattgacctatgacgctcaactcaattctttttatatctacgcatcgatctataaacaatcggcgcactttttaattatcgaaaatatttgtatccatcgatatgcaacgctggctgttttagccgaaaaacttttcattagtcagtcaaccttaaaaaggaagatagcggtcatcaatcaaactttggaaaaatacggtttttggattgatagcaagtcagtggacatggtcggcgatgagagaaagattcgctttttttattattgctatttgcttgaaaaatatgatgtccttgatcttgtcgcgcctgagcaggaacttcgtgtcatagatgaacttatttcggagtttttcgcccaatttccgtctttacagggccccgagcggcaggtcttttcctatttgaataaacttcggacgatgctgttcatcagttttaaaaggcttaaaaaagggtgccgcttagatagtcacgatcaaatcgacgaacagtattcccttttactttcagaaaagttaagtaaaaaaatagcggtctgctatcacattgactgcaccaaagacgttcttcatcagttattctttttattcttcaaccgaagatatgcttggtccgctaatgatcttcaaaaaaaagctgaacacgatgaagccatcgcaaaagtccgtcgtactttgctggcgtttttcgcgaagatcgaaaaaagtgaacaactggttctaattaacaaagatgagcttttgttgctgctttacaacgcaacgagctacacctggacttcagctaaaatcttgcataaccctagcgaagacttctttgtcaatctaaatcattaccatgaaggatttgcccgccgcatcaaaaaagaattggtcgcttgtttaaacagagaacagctcgacatctacctggatgattcggtgatcaatcaattactgtttatgctcgttaccgcttggaaaggcttgatggatcagctagaagcgagcgccccacgagtaaaggcggggattttctttaatactagttttgaacacagtcagtttttgctgaacgacatttcatatcatctaaaatctcggcttgatatgacactgatcactgccaaaacgatcaccgagttgcgccaacaatgtcaacatgttgatatgctgattactaatctatctatgctgccatcacctgactgccatattgtttcgatccaagcaaacctcacgccaaaagatttcgaaaacattttctccgtttatagcgagattgtgaacgccaacgtcacagcctcttgacacagtaaggaaagtgaatacgatttatcaacgtaaaaaaagtcagagcacggtccggatttcggagcgcactctggcttttaacatgtcttaaccttctcgtcattatatctgctaataagaccagacatcaacaacgcctagctcaatccagcttctcaacttctccaatcaccaattcaaacgccgccaacatccgtggataaaacagcgaagcacgttggttgagatcgtctaagggaaactcatccgggacggtcagcgtccagtcggctattttagccaatgtgctttctgggttgccagtaaacgctacaattggaatcggcaaactgctgaccaatctcgccttatccaagacactctgcgtttcgccagacttagaaacgactaggaacaagccgagatcttccaaatagttttccaaaagcgctgccgagtcccctggcgtcgagaaaaagcaacgcttgccaagaatttgaaactttttaaacatataattcccaatcacaccggaaaaccctgccgcataaacatacaggtaacgattttcaacagcggcgatacgctgggcaacggtcttgatggtgcttagatcgttgtgactggtcatcgccgtcagcaactgatcctgctggtcgctcgccgctgttcccatgctatcgtgccgcaacatcgtcataagcttatattgtaactcgacaaagccgcgataccccattttatgcgccaaccgcatgactgttgtcgccgatgtatagtttgctttcgccacaccgcgaacgcccatgtccaatacacgatcaatattggccaccatgtagtgcaacacttcctgctcggtctcagaaaggtttttccctgaaactaacttatcgaatttcattacactcaaaaatcccttctgaaaacgacacagccgcttataaaaaagccgccaccttgataaccagtggtcgaccttctacgttagccagcataggttaatgtcgtcacggcatcgccatgcgtcaccggccctgctttgatgggtgaaaagtccttcaccttgtccatgttggtaaaaatcaccacaatcgcagcatcgcgatccgaggcctgaatagcagcaacatcaaccgtcgacagcaaatcccccgcctttacctgatctccggcggcaaccttggtctcaaacggcgtcccattcatctctaccgtatcaagtcccatgtgaactaacacttcaagtcccgcatcggatgtaatcccaatcgcatgttttgtcgggaaaaccgaactgatcgtccccgcaatcggagcataaaccgcttgttcttctggcgcaaccgcgtacccctcgcccatcatcttctctgaaaagacgccatcgttaagcgcatcaagcggcattaattggcctgtcactggcgctgtaaaaacatcacttttttcttttttaaatagcccgaacattcattgccatccccttctggttatcagtcaccatgatcaatttttacagataaccgcggttattgcaaacgtttacttttaattgagaggcaattgcttattttggcagcttggcacgattttctagtgacaactatagttaacttggcacacactttagaatcaacgttattgcgatgcttagattcagcatgctatattagaaacacggaagggagctccggcctgtaacggtacccctgacaaaaccgttgaagacggtcgacattcagttgaacaatcgattaagaccgttaaactctgtcaaaagttttagtgacggtctttttgctgcctcagatttaaaatcgatatcattgcgacgccttgatcctgcatgctataatgaagacacaaaagggagcaccggccataaccagtactcccttgacaaggccgcttaagacggctggcattcatttacagccaaaaagaccgttagacttcagccagaaatctagagacggtcttttttgctgtctaggattgctaccacaatcgtgacgatgagcgcaatcaatgatagtatgaaaccaccaaagaccagcatcagcatcaaggcgtcagcaacggacaactaggcacctcccttcgtatagattttgatcatcgcgcataggcgatcacctcacaatacgttggatttgccaaccgtcattcactttcttgtctcatccattatgccataccaaatagcaaaacgcctagagtcgcaaagattctaggcattttttaattcagcaaagatgcttcaccattcagttcaattaccgttgcaatcctggcaactgccaaacgccattaagacgtaatacatcgtccgtaatggcatttttctctggcataccatagttattaagcgcctttttatcgtccacgtacgcaacctgggtgaaaactggtgccttatcgttcttagatgtattgcttgcaagaacaatgtcccccgccatctgatacagtaaaaatgcccggcgcatgtgggtggcactcgtaatgagtgtcgcacttgttgcccctctatcaactagttcgcgcactgaaaacagggcattttcaacggtattcgttgacaagtcctctaactcaattcgctttttggcgatgccatgggcaaccaaccatttctgcataactgttgcttcagtcagcttattctctggaacgccgcccgccactaaaatctttgactttggatacttcttagctgctttcaaagcaatttcaagtcgctttttcatcgttggttgcatcttaccatttggacttaaagcataaccgagaacaacgaagtagtgatggctatctttaggcaagtcatttggtatcttggtctgaatgtccaacttgccaatctcatcaatttgactaaatgccttcgtgaaagtcgcggtcttttctgcgttctgtgcctgaagtttggcaatgttatcgtcatatgtcgctgtgtcacctgtcaccttactaaaagcagcaagtttaagccgggcgtcaaagttcgtatggtctttcttcaaaatgttctgccacatctttgctgcagctgcattattattttgcatccgataagtagaggctagatccatttgtaaattcagattctgcggatcaattttgattgcttctttgaacaactgctcaatgacatcgaaattactcttgatagtgacgcccttaaaaaccttcttctcgttcttcttgagttggccaccattccaatagtagtaaatagccgcatcctctaaatcgctgacacgctgttctgttggcattgtcttttgaaccgtttcagtaacctcttgggcctgcttcttagtcatcgtgattgcttgactattgactgggttcactaacgccaccgacagtagtattgaagctgcacctatccaaaactttctcatcctaagtcctcctcgtatgacatgaattcatttcaaattgtaaccgattacataagaactgagaagctttttcaaatctattttcatcacagggcgcgtatttaatcaaatatataaatataatcatttatatttatcgcatttcagtgctatacgttctttttatatgaacaattattctatttgatcattaatctcagtatgcagaattcaaataaaatggtgttcctcaataactcataatcaaatagccacgtcacgaacttgtattgaaaaaataaaatttgttctatcaaaaatcactagattgtctaaaattgattttgccaattgaaagcgctaacttacgagctatactgaattgtgagttagacgtaattattatgaagggattgagggcatatgaatattatttacatacacacccatgatactggaaggctaatcagcccttacggttttaaagttccaacaccccactatgaagaattctatgctgacgctctttcgtttcaaaatgcgttcagcgtagctccaacgtgctctcctagtcgcgcagctctattgacaggagtttacccacatcaaaatggaatgcttgggttagcacaacgcggttttgaattggaaaactcactccacattgcccaagttctgagtcacaatggctatctcacggctctctgcggcgttcagcatgaatacaaatattacacagatcacactgaagccgctaattttttaggctatcaattggatcttagcactgataatacgggtatggatgaagaacatttagtggactgggatacaaataacgcagacaatctggtgaaatggttagaccactataatgacgagaaacctttctttatttcctatggaatgcattcaactcatcgaaaatatccacaaaatgtgtccccagatgtttctatagatcaagcacgaccacctattaatatcgtgaatacaccggaaacaagagccgattttgcagcttttgaaaccagcgaaacttatgctgatcgtaatctaggagttattttagaagcacttaaacataatggattgtatgaaaaaacaattattatcgtcactactgatcacggtgttgcttttcccttcgccaagtcaaccttgtcggatgaaggaattggagtcctactcgctattcgcttgccaaatggcacacgcggtacttatgacggattagtttcacagatcgatattatgccgaccctttttgatttgataaacatcaaaaagccagagtatctcgaaggtcgcagcttcgctaaccttcttcaaggacaaacttattcaccggatgaggaaatctttggagaaatcaactttcacacttcatatgaaccagttcgggcaattcgaacgaaacggtataaatatatacgatacttcgatgattatgatcgactcaacctttcaaacattgacaattcaataaccaaaaaattttatgataagcacggtttgcgaaatttcgttaagcctcgagaagccgtgtacgatctttactatgatgtctatgagactaacaatgtcatcgatcttccccgttataaagaagaagtaaaagttttgcgaaccaagctgctaaagaatatgaaaaaaaccaaagatcccctcttgaagggaccaataccaattcaacccggttggaaagtcaaccatcgctcgtcagtaacggctcatgtcagcgatccatcagaatatgaacaaccaagtaaggagtgatttcatggctatcatcattgtaggacacggaaatatgcccgatgcagcaaaattttcaataaaaatgattacaggattagaagagaacatctttgcggtttctcttacacctgatcaaggtaatgaagatcttcaaaggcaactggacgaaattttaactcaaaataccgagacaacaagatggcttatctttaccgacctacttggcggctcacctaataacctggtaactactcatatgtttcaaaaatcgggtgttcaaattataagtggtttcaatttaccgatgttgttatcagcagttcttaatcctaatcaatcctcagaccagttattgaaggaaggcaaaagaggcattaaggatgtgatcaaaaaacttcgcactgtagacacagatgaagaataggagcgctagatatggatattaaaaacgttcgtgttgattcccgggggatccacggccaagttgcaacaacatggattcctctctttgacattaaccgaatcatcgttatcgatgatgactccgtaaaggatactacacaaaaaatggcactaaaactggcacgacctgaaggcaccaagttatccattttgtcagcagataaagcttacattcggttaaccgatccgttagcttatagcggcgaaagaacactaatcctgtttcaaaagatttctacagtcaaatcacttgccgaaaaaggctatcacttcaatgagataactttgggaaatattccaaatcgtgaaggaactaaaaaaattgaaaaaactatcaatttgacatctgatgaaatcactatcgttaacggtttaatagcatcgggaacaacaattatttaccaaatggttccgaaagatcgtccagtaattcttgaagagatcaagtaacataatttcgtgcacagtcgacaatgggtcctgcatttagctggaccttttttctttacaatcgatcaaccgagtgaatgcctgaatttaacaaaattagcttgatagatatcggtatcaaataaactacttgtatagaagacagcttttcctgcggtagaaaaagtaatgtgctcatcttccatcaatggtttggattctttcaaattaagcagtttcatagcccgaccatctgacataaccgctctaagaacttgatgggagtgatcaacggtaatgtgtgccacatgttcgatgtaatccgttttagaactttctaaatgttgtacagtcagactaggaaaatattgaaatggcatatatccgcgctcaaaaacaaagggaccattctcattagaaaccaccctttcatagtaataagaccgaatatctccgctcaacaactctaatttgttgcaaattacagtcggcgtatttaccaattcatatattagaacgctatattggggagtttgaccgaattgcttcagctcttccgaatacgattgaatttgtgcagatcgatctagttgaaatctactcggtgaataaatgacatgtgatccactgccttgaacttttttgatatagcccttttctgccaagatttgtatcgcttgtctgacagttacacgtgatacatgaaactgctttgtcaactgtagttcttttggaagcttgtctcctcgcttaaactgaccatcctcaatgctgctagaaagattgcgagcaatgcatacatacaatggttcactatttttcttcatagcgttgcctctccctttagtacccaaataacgatacgccttatacaactctactttatacattttggttaaaaaaaccaatcaaaaaacttcgtacaagttttatcaatgactataacattggttctaatacaactcaatttgttatatcaaaaaatccgcaatctgttgtaagcgttttatcatcagcctatactctaagcagcagggttgaatattaattttccagctatcattggatccttctcaatcttaaaaggagtgaataacatggcaatatggcaggcagtgctcattgggctatttgcttatctcggtcggaaccaagttccatggttgtttggaactactggtggttggtatgggattggtcgtccgttagtggctggcctcatcgtcggaattattttgggggatattaaagcaggagtactttgtggagtcgctgtccaagcaatttttctgggtcaaatcacacctggcggggcagtgccatcagatttaaatttagcggcttacattgggataccattggcagttgtcagcggtggcagcccagcaactgctgttgcatttgcagtcccgttaggagccttgggagttgggttacataactttaccatgacaatccaagctgcttttccgcatcgggccgatcgttacgctgagaaaggtgatgctcgtggcgtccgaagaatgaacattgccgctacttccgtttcatttttagagcgatttctaatcgtctctcttacttgttatattggagccccatttgcgcaaagtctattgaaagcattaccacaattcgtcctaagttttctgcaagttggtggtcaattattgccagctttaggttttgcaatcctcttgaaacagatcatcaacgaaaagtggatggtgtttctatttatattcgggtgggtctttaccgcttcatttggattaacaacgacttcgcttttatttattgctatagccattgctttgatttacgtcatggccgcctatcgcaaaagtggtcaacttactgtcacccccactggcgttgagagcgcggcttccgtcagaaatacgatagaaagtgagaatactgaagatgatgactatgaggaataataaaaaaactgatcggcaacaaccgatcaaactaactaaaaaggatgtcgcaaaagctaattggcgctggaatttttttgctttaagttcacaaaactatgaacgaatgcaaggcggagggtttgcccacagtatgtccggagcaattgagaaactctatcccgaagatactaaaaatcgagctgctgcactgaagcggagcttaacattcttcaacacagaaccacaactagggtcgattattcctgggattaccttggccttagaagaagctaaagccaatacgcaagattttgacgaggatattattactagcactaaaaatgccttgatggggccatttgcaggcattggagactcaatcctggttggaactctgaatccaattctactaagcattggcatcggattgtcttcaaaagacggatctccgattggtccactattgttcctcatctcttggatgaccattgtggtcacaatgaaatactacctgttcaagcgggggtatacgatgggtctagacgctgtcaaagtcctaactaatgaacgattaaaaaatatgattacaacaggcttaaccatggtaggccttatcgttattggtggagttgcctgcacgactattaaagctcctataatctggaaatttacttctggcaaaatgatcatcaatattcaaaaaatcttcgatggaattatgccaaacttattgccattaggggtcgctttagttagttactacctcgtagataaacggaattggggaactacaaaactgatggtggctttgcttctgtttgcagctattatggttgcgcttggagttatgtagcgtcttcgattggtcgacaaggaaggatcataatgaaatataaaagctatatcagtgatttacacgtcaacttgcatccagatcaaatggagaaactcgatcaatggtaccaacacatgcgcaaggtagcagactttttcactattgcttattatccctatcacatggtatccgtgaatagtgatttcgaaacagaagaagaaattgaccctacactaatgcagaagcaatgggaaaatatcattaactatctcaagatacgtggcaggaaagacaaatttattagttttttgggatatgaatggcaaggaacaggtgaggacggtgatcacaatatctattttaaagagaatcatggtgaaattcttctaatgccacgttatcatgacttggtcgccgcctttaaagatcaagatgtaatagcaatccctcatcatcttggctactctgtcggtaaccgcggtaaaaactggacaactaacgatgacgaattttctccaattgttgagatttattctcatcatggttcatcggaatctgatcagaccaacttgccaatggctcgtcatcaccacatggggcctcgcgtagatggcggcaccgtgaaagagggtattaaacaagcttaccatttcggaattattgcgtccggtgacaaccatgaagtgccagctcttgttaaacatggaagagctggagtttgggcagaaaactacacaaaagatgctctgtggagtgcaatcaaaaatcgacgcactttcggtttcactgactcaatcattaaaatctggatggaagcggctgatcaacccatggggtcaattattgaatccgataacccgacggaaacaattactgccaaagtaacctcaaactcaaaaatagagcgatttgagctttataaagatggttgtatcagtgcaatcgggcttgctccacaaccaacagatacaaataataaagaaatcacttttaagtttaaagtcgaatgcggttggggaccagatgtaaagttcttccccgatctagcggaaaaggattggataggacaaattactacctctggaacatttctgtcagttgaacctgtatataattccttccaaaacgactacaaactgataaatgagcatacagttaacttcacagctacaagtcaccaatcagtaaaaaaagataactggatgcgcgataactcattaaagaatgaaggatttatctttgaagttaccgctcctattaacagtgaaatttctatcactattaataacaaaaagtctaaactgaccgtaaaagaacttttggctaagagtcacctaagcgtttatgaagatgaagctaaattgttattacaggaacgtgccaatctcactgaatattatcgtagcgatagctggtaccacaatgcttacaaagttaagttccatagggctgctacaaagaatgaatacatgataaatcaaacatttacaatcccagtcactgagcatgagactaactacttcgtgaaggtagttcaggcagatggacaaacgggttggagttctcccgtttggatagtggaaaaaaagtagtttcttaaaagcatataggcaacggctcgtatccatcttgtttgttgaaaagatacgggccgttcaatagttatagatacttactaatctttctctctcttattataaattctgtgtgaaaggagatgcccagatgccctcacaactacttatatatcccatcgttatcctcatagcaaatactattggtgc

SEQ ID NO: 39 - DNA, 28854 bp, Lactobacillus paracasei
cagtaatcaccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacatcattttagcaagaacggacaggtcttttttcacattttctgggtggtaactttaattatgcaatctaggtaaagatgggaccataatgatgaacccaacgcatgaccgtggtgtgatgcacactaaccccgcgatcacgtagcaattcaacgatatcacggtagctgagactgaacctaaaatagtagccaacggctattataatgatatcctgttgaaagtggcgtcctttaaagtaattcatgcgcacaattcctcgtttcttgtcactcagtatactagaatgaagttgccaggcaaactttgcaccagagccacgcggtcttgtatgcttgcggaagttttctaaatcaggttgtattaacgcaaattgcgctcgagaaatattgcttggataatctggcatgacaaactcctcagtcggttttccacaattctaccagattcagcagatactagacaggttcttagattttggacgtctttcataggcgaacacctctttgtgattggatttgccaaccgtcattaacttttctgctaataatattatagcacacaaaccgctatattcctagagccacaagggatatagctttttttagtccgcgggtctgcgagctttttggctcaacggttttcggccaaggccgaggagcgtggggcgcctgccccgaccacgcgctccaggcaacgtactacgtcgtctcatataaccaatcaagtttctgttaggtaacggacgagtaaaaccacctcgtctcgttacgtcgagataaggacgccaaaaagctcgcagacccggtaatagaaaactatcgctccaacgcttgatcatgatgcttaggtgcaattctaagattggccgtcaccgccctttcttttgctgctgctattttttgatccaaggtcaaacccttgctctttgaacgctcatggatttgtagtcgatcattccaatcctttggaacgtctcgtacaacttgaaaatcacctttttggtaacgctgcgcaacctctgtgattcgggtgatcaggttgttgcgatttgctattgtcagatccggtgcctgctgcttgaagtaggcttgccagtcaaggccgttaggttgcagataaggctttaattgtttagcaaattcaggtaagtctgcaaaagagcctttggtaagggcatcctgataatgatagccgtttgctataccgtgaccgggctgtaaattgacggcgactttcagatacgccatcaaagcgacggtaggaatggctgcctgctttgcagcactgacaactggcgctagacactcgtgtggaattgcctggtcagctgggattagactcgtatacggcacactcgctaaagcatgttcagccctcatctggtcataaaagacatgaccactcgggtcattgtcgaccccaaaagcaatctctgacggcgcatgaccagttttctcgcagaaataaatcagcccttgtttgaccgtatttggcttcaagccgtccatcgacattaacgtaacgtgattcaagccccgatgcagtgaccaataactcagggcatcaatcggcgcctcaaacattaaaagtcgttcaggcttgcctagtgacaaattgaagccaaagttttcttgtgagtttttagctatctgcttaaatgtaccgcgcttacccaaatgctcatggtcaattctcgtaccttgtaccattgccccaacgattttgtctttccttgaccagacaaagatagcattgccatgttcatcttgttggagaaagcctttgcgatgcagtaagtccacaatctgtggatcaagattccgaaccgtcgttagatacttagtggcctgctcaaagttagggctattcttaaagctgtattgaaacggctcacgaaccttatgcgtggttgtttcaactctttctaaagccgcgtgattcagataggcaaccgcctcgcgaaaactactgatgcctaaataatgctgcacaaagtctaatgcaccgccaccaacatcgcgactattccaacggaagagattcttcttgtcattaatgactaatgagtcatgttcgaccccacgccaatagccattggactgttgcaccagtgcaatgccattcgcttcggcaatcgccacaatggcaacgtgattcgcgtggtcaatcgttgctttgctgagtcgtttctgtttgtttgtgaccatcttgattaactcctttctgcatcaaaaaaggacgcctaggcgtcctatcgttcaatatcatgatgatgttgctgttcttgctcttcctggggcggttcaccttgtaaatcgtccattaggtcagcaatatcctcccacttgttgaccatgatggtttgctgcttgagactttgttctaatgaccgtagggttttttcttggtctgtaatgacactcgccatttcttcgttagtcagtagcgggttaaagtctcggttttgcaaatgtagcacggcggtttgatacatattaatttcatgttggtacttcttagtgagtcggtgttgctcctttggtgaaacgtcctctaatttgtcaataattggttgatattggttgcgggtaaagatgaactttgctaagtcgttgtagttggtaatcttatcgtgaagcatttcaattttttgttgcacgtcaaggagctgcgctttgaccgctgttacctgccggcctaatgactgacggtcagtgatatggttggctctcaattcaccaagcgtggttgacaagcgctttacgtcagcctgctgagcttgcatatattgacgttgccggtttgctattaaccaacgtcctaacatcggctgcgttgactttaatgcgggtttcaacgcggctcctgtcaaactaaccgattttggttctggatcgttcaacgtagcaaagggtgtcgcattgtagtgccagtgattgccaacttgcacagtgtactgttgatgcaaacggtcataactcacggcatcattagggaaaaagacgcgttcataaccggcatcaggcagcgtaatcgttaatcctttgtcggagtgaccaaagacggcttgaggaggaactttcaccaattcaggattcaatccttgatcaaggtcaatcgcatgtatcaatgcttcaccacggattgaaacagcacgtggccgttttccagattgatccgtcaatgtgtagtaatagttcgcctgtagggcaacttgcaaatgatcaggatcaccgcgcaattcgtaacgattcaagtgaactgttagctgtccttcattaggcacttctagttgaaccaaagcccccttttcatcaacacttagcacctgatcatcagacaagtccatcagcgtttccgtattggtcattttagatttggtttgttcctggtactcggctaaaacatcaggtactgccacctttgctttgagtgcactggggtcatgccaatgttcattcatatagtttagttggtaggcaggtgggagaagttccgcgggcactttagtaccatcatgaaatgtgaattgatagctaccattgcgctgccttttgagggtaacatcatgttcctgttgcagcataaaagttaaatcatcaaggctatcacacattggataaacatcatcaatcaaggctattagtcgtcgctggttgtgagcattctcagcagcggtttctttaatgcctgcggacgtgtaggaaccaatatcagataggcttttgtcgcgaatattgcgctgctggtcaggcaaccgataccccctgtcttgaccacgcttcgttgtcgtgatttctagctgttcacatagttggtcaaacatttccggtgacgttgcacgagacgcaacaaatcgcagtcggcgacgcaattccgcacggaatgattggtgaacatccttctcgtgaacaaagccatttttatcgagttgttcttcccgttttaaggacacggacaacccatgctcagcagtcaagcgattactgatctctttgatccgattagccgtgatgtaaggttggcttcggaacttttttaacgtcgtcatcgagtatgcgttaaagatgatgtgattgtggatatgatccttgtcaacgtgagtcgcaatgacgaactgatagtcatcgccgattaattcgcgcatgagttgtagaccgatctcgtgagcctcctccggggtgacatgatcgtctggtgaaaaagactgaatcaaatggtaacttttggctgtttttcgcaagtgttggccttcaacttgacgaccgccaacacgctcaaagttgccattgtagcgatgtgacatatcagctaacatttcaaattcaaacgatgctgttggagtgtcacaatggacgccttcaactaactcaccgtttcgagttttgagcgcgtcgataatgtatttgattgcgtccttcgttgaacggttaattgcgtgtattttcgtgattgccatttaagaccacctgctcataacgatgaacaacgtcaagacgatgtagcaagagatcattcacagccaaaaacaaatcgtagacttcacttttaaccacattcatttgttcctgggtaagtgattcactctcgttagctacgtgtgccaattggttcaagttatttccaattcgagccatctgttctattaattgtttagtgtctgtgaaatcgatatgaataatctgactagctaaaagagattgaattgaaaaactgttgaatcgaggattaccagccattgccatacgcaatctgagagcttgttcctcgcgcaggttaagcctcgtgtgcttttgaatagttcgttccctttgctcattgtcttctgccatcatgaaaagccctttctagttatgttatggaagttcacattaagtcgaacattgaaatacaggcccttctgccatttttttcaaagtagcattccgggtgtttttctactgtcgcgagatttgcaagagggtacccttttgcagaaaattgacgattaatcagctccgctgatagtcaattttgttttgggggcacgcccccaatcccccgttattttgaaggggtccgcgacaccctccaaaatcaaagttcaaacccttctaagttctcattttggctcagccatttctgataatcctcgaccgaaaggtcgcttaattttcggatcgtttcgtcgtaacattcgagggtaaattctttctcaattggatctgtgatacctgtcaggtcattagaaatatcatcacgtactgctttaaccttttgtagaattgccggcggtgtatcttcgctcacaaacttgcgatgaagtaagataatgtcacgatcaaattcgttcatttcgtcaatgattttcatgttggtaattcctttcttgggtgatcaagggctggagaaaagcaagggctggagtgtcctcttgagtgagagtattcaacaaatgagttagcgtgttttctcctgcgttgcttgcaccagcccttgctctttttttgcgatgttttccgttgtcgcaatggttttagcgcgttctattttttgatcaagcgtcaacggtttctcacgaatcttttcaaggttttgatcgacggttttattgaatttttcggcggtggattggatacgcgttaagcttttggagagctgggaaagatccttatctttcgaccaaacagcaaggtaaggaaacgtataatcactcgtgtcaattcccaaatgttgacaaacgataaacgcggtactttcagcttccaattccatggttgaacgatccaattttaacttcggatcacagtgtaattcgctgtgcgcgagttcatgaatcagcgtcttaatggtttgcttctcgctcataccggaacgcaattggatttcttttttgagtgggcgcgtaacacccttggtttcgctgctcggcatctcatggctaaagcccacatgaaagtcagttgcttgaacaagtttgctataaatagtggcataatttggtacttcaccagtcagctcatgtgtgaacattttgataggctcaccactggtctgagagtaatcaaagacagctgcaggtcggcagaatactttgctctcttttacgcgtttaatggtgccatcaggttgccgaactctcttttcgtacttgtgttcaccacccgccaatatcctgatacctttttcgtgttgattaacttgtcgatggtactgatttttccatgtgtgataccctgcaacaaaagtggcatgtggattctgtaaatagatgagtaactggtttctgacactgtattgatgaaacccactgatgaactttaaatactctcgatactcgtcagtagagaagacttttttggcgccatcttgcgccaacgccagtaactctttggtactctttggtggttgcttttcttggcttgatgttggcatctttatcacgctttcctttacgagtttgtgctacgactttcgcccagtgttgagagggcatgttcaaatgttttaacggtttgcttagcttgttgtcgcttctctgctgattgctgtgggtcattggcaattttgttaaaggcatcaatgccagcagcatatttttcaccgacctcaattgcttgtttaatcgtcgaatccttaaggctgtcattgatctttttagccttgtcaaagtctttctgacgtacgtaaccaagagcaatcacttccgataaggttttgctctcgagttgctcgttaatcagctcggcggcatcgaattgcttagtgtgaacataagcaactgcgagttcgatttggcgctcttgagacagtgctacctgactgctcgttttgatgacctttgaccaattatgttgtagatacgcaaggtcaaacgctgtctcagcttttgggtaggagcgttgaaacttaacaagttgtttaacgttactttgatctgtaaggactttacgcacatcgtctcgtcgattcggatacaacttacctgcttgaagatagtcccccttcttaatcagggaggtgtagcttgggggtgcgttgtacgcatcaacgactagttttgttccaaacaaaaaaccgcctgctattatcagcaaaacggcaatggttatcaggtgtttgagaaacgatcgactaacttttggtaatgaaattgaaggtaatttgatagcagttcgtttcggttttttggcaacggttctatgtgattggttacgtgtcctttttggggttgtatcagccgctaacgagtcagtagaaacaggttcagatgcagaatccggttcagtttcattcgctactgaaacgtctgttgctggtggtgaagttacctcttgccgctgagaaattaagtctgtgatcagatcttcaatttttccttcaatcggtagcttaatcttgacggaaaaggcaacttggtcacggtgataggccgtgatttggcagctaccatgttgcgctaaatcaaacaggtgatcactagccgcctgcaactgtgctagcccatcatcaaacggttgcgggtcggtagctaacgcgatcccctcttgattggtaatcttgatggtgtcagtctctttatcttttttccgacccacatcagtccctcctttccatgtcttttacatcatcattaatgaaacccaggggcttcatcatggctttcttttttaagtagcttcgcaatgtcgtcataagttagatggctctcagataacaatgcgtcaaccttatcggcttttaagactttgagatcacgcctagcggccgtcagttgttgctgcacctttttttgctgctcttctagttctttgatccggttctctttactcttgattcgcttttccagactcgtacttgccattattgatcgctcctttattagtcatgacttgcctgtgattgattgagacgatatagcgtgcacccaattatcttttgctgcttcatcggcaagcgcagcactaagtcgttttttattctgttgccatcgctggtgatagtgtatgctaaccgcgccattgcgattgtttcggaacctacttgtgtataagtaacctcgcgatcctggtacgtcaccttataagacagatccggaccaacacccgctttaccaatattagccggtggtacgatttgatcagctatcgctttggtcgatagcttctcaagctgatcgtgtcgtttttgttgatccgcacgatatccaaaaactaaatccgcaaaaacaaggactcttttatctaccttttttgattcaccgcctgttattgcgttcagatgcgtttttgtttcttgtaagacgctttgactgtccgaccaacgataccagcctacgaccatcaaaaccgttattagcacggcatacagcggtaatagccagtggcgccatctgtgttcttccatcgtcttcctccttttaccgtgggtgaatataggtgtaagctcccacgtttcctaacgtttgcaaatttggccctggttgctgcttgaagcccgttcctccctgagagatggtaattgtccctttatccgaatcaactgattctacatacgccacatgcccgtataccgggtctgcctgccaattaccaaccatttggcctgccgcaaagctcactaaggcaccctgttgaggggtatgatcgacactgaatcctgcggcggctgctgagctaccccagtcagcaccattgccccagttattagcagcccatccggatctggcttttgcccaccacgtacactgacctacaggataagaattaccaccattatgcagcgtgatattaccgattgagtcaccactcttgaatccaaaaatggctaaaagtttgttgacgttgggtacccagttaagattcagattgttagggtcattaatggcgccaataggtgcataggcggcgcctaacttctggacagtattcaaaccacgggtaacaactaagttatgcaacgtgttcccggtggcatcaataccagcttctagcgatggataggcaataatggttcccccgctcatctgaccactaggattattagcaccacgtactgctgcactggttccccaagaggactcagttcccatgatagcggcaattagagcgggattgacgcccgctttcttagcagcatcaattgagtagctttctttgtctgctaaaacgccattagaaaaatacttaacccaggcagcgtgaaatttattagcatcgaaatcctgaccagttaaatcgcctccacttgtaactagtccataggtagtcgcatacgtgtatttcacatttggtaaagcaaaagcaggatttaattcttcctcaacgggtggcaaaggtgctgaacttgccgcaacggttgaactgaaagcggaggaagagttttttgaagataaacctggtgcctgagagacgctttctgaggtgcttgacaatgatgacgttgatgaagactcgtcaggagcgctctgctgcgtgattttgataagctgaagagtgatgttcttttcgctaattccgatttgatctcctttcttgatttcctggtttggtttaaccgtcacggctttgagcccaccggtcacggttcgtttaccatcagttgcgatcgtcacacttccatttgaacaggcagtcactgtgccggacatcacggccacaatcttttttccagtctcgcttgaaatccgaatgtgattagacatgttcttttgtccgccacgcattcgccaggcgtaccggtcgttgaccatgatcgttgcattctgatcttcaaagggcgatcctagaatctcttgcgtgcgatattgacccacttgacccattgcatctagccgatctttatcatcttgtgagagtgctttaggatggttcttctcccactcatcaaagctagacaaattgacggtcacagtttttgaatcaactgtgaccgacatcatttgatcatgtaatttttttatcttttgtttgaacgcatcgtcgactgtaaagtcatcatatttaatcgacaagtaggccaactcacggtcaaagtccgagattagttcaatcccatctgttgttgcttcctgaccattgataatcagtgaacgtccgtttccgtccgtgttagccatactgtcaatgaccttcttagtgacatcagtgtccaactccgtaatgtaactgtaggcgtcagttaagggcttagaatcggctgtcgtcgacatcgtaggcaccaaccagccaaacatggaactcatcaaggcgatcagaccaaacacaagtcccactaataggagaatagccatcgacttgatcacgactggtagcatcagaatggcctttaacagatgcctgattgaactaataggatgacgccacgagaaggtagcaccctttaaagcacgctgcttcatcatttttctgacggatttacggctgtatgaagtttgaactggcttacctaacttttttgctagtcgcttgcctttacgattcctatggcgcttcaaccgggcttttaagcggctccctccttgcgttgtctttgacaacgtttggtaggttggatcgttttgctcttcattttgctgaccattggtagctgccagtaccgtactcttcttagccgtttcaatcgcgccatgttgaagcgcttctctactacggtgccgaaagcgtttgacccaactagcctgtttctttttatgcttagcgttttgtgctaaaaggccacgcctaaactgccctttttttcggacaaaacgtttgccaccaaagccgccaacgccttgtatgcgatatttgttaccgcgcaaggctttcttaaaccggctcggatcactactgactaaagcgtctttagggtcatgatgctgcttattaagcagcatgtctttccaattattcgccactcacctcgcccccatcctcatgcagtttcttgcgggaaatatattgctccatgtcctctggtttcgtggacataatcttataaagcttggtctttttcggaaagtcattctcaaatggaatgacggcgtcacccgcaatcattaagccatggccggagtcggcattggtgatatagccttcctcctgttcagacagatgcagcatttctgtgagctgatcacggtcattggcagcttggtcaagcaaaagcacaaattcactgttagacaacattcggcgggcattatcactcagtagcaaggtttcaacgttttgcgtaatcccagtaggcaacgcgccccatttacgggcacgcgaccacaattcaaagaagtagttagatgcaaattcattgctcaagagcagctgcatttcatcaacgtaaatccacgtccgtttgcctgagttccggttctttgtaatccggttccagatttggtcaagcacaatcaacatacccattgaccgcaggttcttacctaaatccttgacgtcatagacaaccactgaattgtcgttgtctacgttcgtttgatgcgcaaaaacagacaacgacccttcaatatatggctcaagctcaagcgcaatttgctttccctcttcttcgggctgttgtttaagggtatttgatagatcaaccatcgttggcatcgctgtatgctgctcaaaatagcgttgatatgttaaccgacaagcacgatcaatcaaagtccggcgctcagctgacagaccgtttttgccaccgagtagcatgtcgcacatagacaaaatgaagtctgttttgaaaatgacagggtcttcatcgtcaccgtaatcttcattgatttccattggattgatatgcgctgcggcaccttgggagatcggtatgacttcgccacccagcgcttgtgcaacagctgaatactcacgctctggatcaataatcaacacttcggagtcagcgtcacgtaaccgtacagacagcatttcctgcttgctggcaaatgacttaccagcaccgggacgacctaaaatcatgccgttaccagctttcaagttccgacgatccgcagtcactaggttttgagtaacttgattgacgccataaactagaccgctactgtcacttagctcttgagcagtaaatggtataaaaatagcggccgctgaggttgtcagtgtccgcgatactggtacataattttgtccccacatgagcacagaattaagggcttgttcttggagataatcgagatttgcaaattcgcagctatgtctacgaccggccgctttaacttgctcgataatctcatcaagctgttgatcggtctttccctgtgccatgacgaggaatgtcacgtcaaagagttgctggttatcgtcttgcatctgttggagcaagtcctcagcttcatcaaggctgtgcgtcaggttctccggtagaatatcaggatcataccccgctttcatcgccttctgctgctcatcagctttctgcttctgcataaagcctttcttcgtctgcaccatcttcatgccttttactggatcgatagggtgaatttgaatggcaatctccaagtccgccataatatccgttaaatcagtaatcagacgatcgctgatttcgggtggataatctcgcaagtacaacacttgtgcaacttggtcgcccattgtaaaacgattctttgcgtgtttgaaattgaagctggttggtgcaattactgagtgtgtcgtcaagccactatatttgagatcgtcatagtcaaaatgcaacacactgccaggcctcaatgtggcattagcaagttggagtcggcgcaaaccattcaacggacgcgctgttgatcccatttgatgaaaactggtaaccacattcgcctgtagttgattcaaactggttttagcacgttgtcggtcatcagcatgttgcgtaaaggttacgtacttctcctttaggagactcgtattgccgctttcaactctttctcgcatgatgtggttcatctcatcacggagcgcgttgagatcatcaggtcgatgcttgaaggacgtctcctgcatgaactggcgaatgtcctttcgcctattgatgatgttaatctgaacagtcgattcactgtcaaagccattaagaaactctgcatatttgctaaagatgtcactttgatggtcgcgatcgctaatttgatagttaatatcggagatcgcaacactcttagaaaaaacacctggtgccacttcacagaggccgtcttcatacatggcacgataagctaaactgtcttgagttgctcttgatggtgcatttttccgctcttgcttgccacgttcctttttgtggcgttgtaacaacttcaaggctttactatggcctgtcttctttgtattctttgatctttcctcggttcttgtgaacatgaaggctaacctcccttcgattttcataaattcttagcccgttcatttgttggtaatgcaagatgatgccgatatacttttctaatggcattccttttggcctgatccagccaaatgccaacactggcatatccaatgggattagcacattaccggcactatccattgaccagtgcaacttccagaccaggaaatagataatgcccgctgaatagatgaatgcgatcgtggcacagattagttgccgcaaatccattgtgcctatgatacgttctttgtaggtcttgatttctttgggtactctcacgcgtaaagccactgttactcactcctttcctacattgctgttgtcagcgacttcgcccaagagtttgtttggaagaccgcaaaaattagtagaattgaaaatcccatcaatgatgctattaatggaaggacgccacttttatcgacattcgcaaatgctgttttcatgaggaatggatagaacagctgcaccatataaatgagggttccttgtatggatactgccatgaagctcttgaagaagtttttagcaatccctgaaaactcatgatggggcatggttgcaattggaataggtgacacagccaaaaacacatacatctgtaaaaaccggccggtgacaacaacattaactaagactgtggcaagcatggtaatgagcatgacaaaaagaagaagcaccatgatcatcagcttcgtccaaaaaccttcttttactaagggactataaatatcatcaacgctaataatggtgcccatatgtccagaattcactaacttaccgatatcctgtgatagcgtgatactcacttgcataatggcattcatgaataaattcatgctatccattgcaatcttacaaaaagccaccttcactaaggcggctgaaatcagcctgacccctgcatctgatccacctcccatagcttctacttgttccgaaattcgatatagttctagcaacgcaaacaacgccagaatcatatatccgaccggcatcatcacattagtctggatcgttgttgcgaatccgtataagtccttgctccaccctgccaacgtttcggtaatgccgttagcctttgcggaaccagaaacggagttcaagataaacttaataaatcccttgatcgtattatccacgcggttccgcctcctcacatcacgttagtgaaatagagttgaacaatgctccagcagcaatgattaaaccgccaccagcaatcgtccaaataccactttgaataccaggcccattgtgatctttcaaagcaccaccaagaccaaccaagccccaagcggcgtaaatggaaccacctgcaatagcaaattttgacattaaagaaatagcttgagataaaacgttcatgtgttgttcctccttttttatcgatatgtgtctaatagattgacatcagtcaggatatccgaaccctgttcgttctccttgacgtcatcatccttggtttcctcttgactgacattagccaggaaatctgactctgatttggattcttctgtttctacctcaccacctttgttgttctcgcttttaagttgaggctgatagacatagtctgagtgatccatttgaagctctttataccgtgggtgtttttccaactggtatttttgcgacaaaaatggcggcacacctctgagcatgtaaatactctggtcgccgccgattcgatcgacttcatcaggcgctaacaaatcacgcgcgattttgtcgtagttttggttgaatgaaccattattgcctttggattcaccataacgttgaacgtctatcgtccctttaccaaggatttgggaaatgtactgagcggtttcactgtcgtgtccgccaaggtacagcagtgaatccgaagcaccaagaatcgcctggtatgacttcggatagcgttctttgagctggctgagttcctgcacaattggcacgcagaaaataccccgtgaacgcaaggtgttgatacgcttgtcaaattgcggaatctgtccactgtttgcaaactcatcctgccaacaaacgacggtttcattaagccggccgttcgcctgatggtcagcatgttctaccaaagtagtaaacaatgtttggtaaaccaagctgaccaaaaaattaaacgtttcgctttgatcaggtaggatcaaaaacagaatccgtttctcatctcctaatttttcaagttctagtgtgtcgtcactggtaatatcaataatgctaggcacatcaaacggtgctaaacgaacaccaagtgaaatgacgatactcatggctgttttggctggtgcgagcttgaagataccatattgtttaagcccaaacgcatccgggaagtcctttttgaagtcttcaaatattaggtcaagtggcgttgtgttaccgccagcatcttcctcaattgttgctgctctgactaagtccaaaacattgggtacgttggcaaccacacggttgtcaggattgccagcttctaaacgtaaataatcaaacaaggcttgcatcaaggccttctcgcctttatcaaagaacggatcgcttttactttgcggtgaggttgtgttttgcatgatcgcattcacaacttcaatgacgtcatcctcattgttgatataagcgaatacattaaaatgatcagtgtgtttgcgagtcaccaaatcaaagaccttaatcttataaccagacttctcaaaaaagttacccacccatctgagcgtctgtcctttggtatcagtaacaacataggagctagagcgctgcaatagattaggtacgacaacggttctggttttaccagaaccagcacccccgatgaccgtcacaaattgatttcgctgcagtttcattggccgtttatgatccaagtcattcaaatatagcttttccgtggccgtcataatcaggttgttatctgggtttctggtatcctcaaatgggagaatatccttatgagtcccccattttgcgctcccgtgttcctcacctggtcgataatttttcttattggtcaaggcatataaaactaccagcgctacaaccgccagtagaataagaccacctaagaatggtttgccattgaaagtcggcggccaccaagcaaccttgccaagattgttagacacgtacagtattttgtcgagtatagacttagcgtctttgtcctggacgttatagacggctcgcgttaaaccactgccaacgatatataccgcagaactaccaatagccaccaggccgaaattccaggctaggtttttcgctttttctttgtccatcagcgctcacgttccttgctacgctgtcgcggctttttctctttttgattgcgttcctttgcggtcactttagccttttcaatcttttcttgaagcgtttggccgtgttcgggtgttttgtcaaagtccttaacaaccttctgcaaaacaagttgaactcggtctacatcagcacccttaaaaaagacatggtacatgcccgtttccttgtctcggcggatagaaaagtcaacgtgatactttttaaacttctttccgagcgcgcgcagatcggttttaataatatccacgtgttctagcgcaccccttttttgcaattccgcaatgttttgtttaccagtcgtccgctgatgatggattgcttgtttgctcatatccattgctttacttggcaacttgacggccagtgctttaaggagcgcttgcgcggacaaggtgcttaaccgtagaacatactctgctgcttggttgtccatttgattcacctaccctttttagaccgtttcactgactgttacggtcaaattttgcgttgttgtttggccgaatttatccgtcacggtataagtcagcacatagctgccaggtttactggtatcaaccgaaccttcgacatcaacagtgacatcgccataagaactggtagccgtaacactagcctttggatcaaagtgatcgccaactttgagttttgtcggtactttagacagatcaagggttggcttgtcagccacaacgttgatagttacttccttgacggtcttctgtccaaacttgtcagtggctgtataagcaagctcatagctacctggcttgctggtgtcaactgatccatctacagccacaatcacatcgccataaggactaaccgctgtgacattggccttcgggttaaactggtctcccaccttgagttccgttggaaccttcgacacatcaagtgtcggtgccgtggcaaacaccgtaaccgaacgtttcagcgttgtcacagcaccattcttatcagtgacggtataaattagttcgtaattaccaagtttgctggtatcaacgtctcctgcaaccttgagttccgttgtgaggtcaccatcttgataatcatcagccgtaacaccttgtaacggatcaaaggcatgaccaacctcagtttgattgttccccgagacatgaataacgggagcgtcattagtcacgacaacatcacgcgtagcactcgttttgtgccctgcgctgtctgtcacttggtaggtcacttgataagtcccctccgtgttaacgtccacagtgctgccatacacaaccttgttggtcaaatcaccatcttctacatcatgagcacttacaccgtccattaaattgaaggatttttgacctaaatgcagatgcaggtcatcagcaaaggatatggtcggggcttggtcaactggtgctggtgttggattcggatctggcgttgggtttggctctggtgttggcgttggattcggatctggcgtcgggtttggctctggtattggttccggcgctggatttggtgttggactaggttccaccgatggcgtcgtcttggtatcagtcgtctgtttatctgttaacggtttaggttcaggcgttgttcctgtattgtctgccgcttttggcgtgttctgttccgctgttgcctgatctgccaacgaaataaggctttgactattactcgactcaagctgtttgctcaaatcatttttactgaaaggaaaggcgactactgtttgatcacttttatcgctattcggcagatccggagccagggcatcttttatggtctgatcggctttgttagaggaaggttttgtgttcttctgtttttgctcgaccttttttgacggcgtccgccattgcttagatggagtgctacttttcttgactgattgcgaagcgggggcagcatttaactgataagccgtatagccgccgcctcccaagacaatcgcacttatcagcaagattgctgctatctttttcttctttgccattgctgaatcctccttctattccttgttaatatgcttcaataaatcgcttaaactcgttttgcgggcgaacataagccacgatcacgcggtctttactcggcaacacccgcacaatctcaccaatacaagttgtatctggcagaataggccaaccagtctcgatgcttagcaccgcatgacgtaacttcaacaacagagccttctcctttggatgtggaaatctaatttcaagaaggccgtttttccgtttagcttccttgatgtcttttgtttgaagaaccaaattgaacatacgatcacctcctatatcaagtttttaggaacggacttaatgcgctctccgctaatcactaaactgccgtctctttttaattccgctgaccccacctttagaaccaaaacgtttttcagctggttaggcggctttatattgccaatcactactgtcatacctggcttaattggataatccgtgtggtccttaacccatgaagcttggattcgataagaaagagcatcatgatctttcgaaatcaacttcaaattgcgatcatgtaaccaaatacctacaggttcagccatgttcagtctcctttctttaacgcaaaaaacacctgcaattagctggcatttggcgttcattattttggcattagccaaggccgcttcgtggaatcgaaccacgtttcccagtagcggcatttgttgtccagtgacacaccattaaattgcgtagcagagcacaactttggtaaaatggaggtacgttaatacctaataaaaacgcgccctagggcgcgcttttttcttgttgaagatgcttttcaagagcttcctgtcgttcctcttcacgagaacacaatccgctaatccgaatagctgcaagttcacacaaaaggatgaagcctagtaatacccagaaactgcatttaagaatcacccacagcatgtcattcgctcctttattttttgacttttgaattgtaggacggtagaaaacctgaatcataaagccgcttttctgttcatatcaagcgccgtatcaaggttgatggacgttctttggtagcctggcaaagtgcgcgaagctgcgctttttcctctggtgttatggtgatttggtaacgttgattatctttgttgactgtcatctttcctccattcaaaaagtgccatcacttctcctgactaagtcaagaaagtgatggcacttatatgttgtgatttaacgcattttataactaagtaacatggctttccttgtatgaccaagcttcacaaaaagtcgcttagcaaactgtccgaaaaagtgctgacttccccgttcaattgcggttgtcccgctgttttgggcgttgatgctttagcctgattaccacatccggctaaaagtaacccagacactaaaatgatcccacccgtttttaccatcattttcatttgtttcagcctcctgttcggaatcttcttatacatgatgcttatagcaaattgctatcaatgacgatcgtccttgcatcgtcctcacccttcaaggcttgcttttccttttgaactaattcatcatggaaatccgccaagtcatctgcttctagcagaacctcagcggcttgatcaagcgatacttcatgtggcatcaaatcatctatcgcatcatcaatctcattttgatagatgcgcttagcctcttctggagtgtctgccgcaatcaacgcataataattatgatgatcaatgttaaattcatagaatcgcatgatgattgcctcctatccgccattccttaactggatggtgtcgtcgatattcccatttctgctctggcaactctggcttaatctcctcagtctcccctggtcttaaagccgtcatgtaataaccatgatcaacaaaagtataacgcacgcccttttccaaatgtggtagagtcttccccacaccattaacaaaagggacttttgtctgtttaagcacacaaactcaccgccttcacacttgatcctaataccccatgtcgtacgacgattcgttgatcggtcttgctttctgctaagatctcaatccattcacgttgtcgtaccggatcgtggtcatataaccgtcgcgcccgatcataagttgcgtaatcaatactcgtcagccgatgttgttgcataaacacaagtaactggtcgattgctttcatctctagattacctcatttcaatttctgaatgaacagcgttttggtgacgtttcccctttaacctgacggtcttactgcgattgagccaggccattaacaagtggcgttcttgcagactcaagtcatgcatatgagcgcggcgatatttaaaatagtcttcaaccgtcgtgatcttgccaagtttagtcatgttgacaaactcagtcacaacttcatgttgctgtagcttttttcgctgttgcatggcactactccttttggttcaactaacaatatgatgcctacgcatgaagcataggtgaggtctgacctcatggtttcttaaaaagctaataaacgtttttattgcgtgaaattctcgagttttctaggcatgaaactcgctaaacctcagcgtctatgacgctcgattgacagctctaggcatatgctgacgacctttccagccattcactaccacccaaacaagaaaatcttgctgacactcaccatcgagtgattcacggtctggttctaagccgcagcaaagaacggtcaaacacattatgtctcgcccgctttgatggagacacggactactggtggcggcacggaataccgaggcgttcctcacccacttgatttcgcgggcaaccatctccccttcacataccggctgtgaggaacaccgtcgaaaaaggccggagggagtttaaggctattcagatttcaaagagctaaaagtgtgcgttcacacgcacgcatcatattgtgagttgagcttgtgagattaggacagcttgtataaagccgcctgtgggtgcttgcgcttggcaatcatcgtatggtcgctgttgtaaacactgcgaatcttggggtaaagctgttcaattgcctcaaccgaagcaagatcgcgatcgtaaaaggtaccgtctgcgtgattaatgagcacccgttgatcaaacgttcggacacaaaatgcgtgtctaacgacccctaaacgtgctaaaatagccattgtaacaactcctttcttaggatcagcagcaccaagagaaacaaaaaaataaggggcgcgctgcctgctggcaacgcgcccctcactcgtcttgtttggctgctattttgacgtctcttactttcgcctaagacttctctaagagaagttccacagcggtcacaaggtctgttaaaataaacttgccgcgcttaacgcggtgaagacggcagttgctaggctaggttacgctagttctagtaacagtcacagtgcgcttatcctagacttccaatctaggtcagtgctgtgatgctgtcttatttttttgtgttccccttgctactgttgatgctaaattcaagataacacttgaatttttcgattgcaagcattagcgtgtagaggaacaaattaggtaaggcaaacatgtgttaaattgagcaggaaatcgaacaaacgtttgcctatttttattatagaacctggttcctttttagacaagaatttttctaattcttgtctttctttttgcctttttctaggttagctaactctttgtgaaccctatgatggcggcgaattactttacgaactcggttatgtttttgttgtgcagaatcaaatggccctcgataatttttctgccgttgccgctcggttccttgtccttgtttgacttgcacagacgaggcatattgatttgtgaactcaatcataaattgatctggtataacccgaccatcttgtaattgccgctgcttttgtttggtaacataaagtaccatcacatcctgtagttggccatctttaccgcgaacgtgcgcaactcgccctaatggccgatccggaatgactaaatcatcagggactagccaatagtatttggtcggtcgaatgcgcttaggcgtcatgaaatagcctgccatcatagtaactttgccgagtaccttgacgtgacgattacgatgctgtgtaaagctttttaactcagtatcagtctctgtttgttcctgggtcaagcgttctttgatggcggcatagctgtgctttttagcttcttcggctcgttgattagcggttttttgtgcctctgccagaatatcctctcgttcatcaggatcactcgtttgaatcatgagtaaatgcagaccggcacgttctgcctcagttagctctttgaggtttttgagcgctacctcttccggaaaggcttcacgtttccgttgattaaactctttagaattcatcagggtcgcctccattagctgtcatgagtgatttgttccagtatgccaccaaggtctctttcatagcaccaaacaagtaattttcgacattgttaatttttttactgtcagaacgtaaaacgttaaaaaaccggcgcatagtcttgttgatcatttcttggcaccgcggatcatctaggacaattgccgttccttcatgttccctttctacagcctttttggcatttagaataatgcctagaaagcgacgcatttgtttaggcgagcgacaccaaagccctagtagttcaacaccttctttgttgagaaagaggccgccatttgctgtctcaggtaaataatctttggcgttttggacaaggtcttgattttgttttcgcagaagttcaggcgaatattggtttgtggaaaaatctagattctctgtctctttattgtctctaggggttatatctaagtctttatatagattgtgaccgattttcggaagtctgcttttatcaagggtttgagactcgttagtagcgaactcatactgacttctgattttcggaagtcttttgttaccaaggctttgagcggtctcatactgacttctgattttcggaagtctgcttttatcaagggtttgcgctgtttcactagtttcttgtgagcgtaaataacgatcctgtggattaacggccaggtcagctaaatatagacggtttggtaattgacgaccagcactaggctgaaaacccatgcgcttttgatgtaaaagatgagcggcctcaagctccttcttaattttagcaactttggtgttagaacaattgaataagctctttagttcctcgttagtaaatataaaatatacatgattttcttcgtctactaggtgattcttgagagaatattcgagccgatcctttaacaccatgtaggctagtttggtatcactacttaatttggaatattggctaccgtacattaatacttttggaaattggaaaaagagattaccgtaaacactatctgcttcgtaatatttgaacgagtcttgggccatgattattacctccggatttactgatttgttgttcagttacaaaaaaagactgaacagctttaccagctatccagcctccgcgttttcgaattgaaaattagcagcatttctgctaaagttaactcataagcgaaaaacttaattgttgagagtgattttaccgggaagtcaaatcactcttaactgatagctggtagaaagctatctttcaggcacagctctgtgagctgtgctttttttgtcatatatttaatataatgttagctcacgtaccaaaaaaaggcaaagaaatcttttcataacggcctctataggacttataaatgttattatgtataaagccatatatgtcattgttcacaataacatatatacatataaacgtaaatggtattttgggaggcgcaaacattatggagggcgcaaacttgcttaataacatttatgtataataccgcttatctataaagccacttatacataagtggtattttgtgcaaattgcacggagactagaatatgccgaaagtggtactaagccgaaaatcgtctttgatttaaaaagggtacacggcttgatgttattgtgtacaaatgttattatgtaaaagaacatttatacatattcatggaggtgtattgctgtgcaacgaatcgtaacagttttatcgaccaagggtggtactgggaaaacaacacaaacatataattttgcgaaatggcttggatctcaaggacatcaggttttattaatagatcatgaccatcaaatgaatctttcaaccgcgttcggtatatttaactcacccaatacaattgctggtgtatatgacaaagagtttaaagaccccaaaattttgaatgtttctaaaaatgtggatctgattcctggttctatgcacttagggtcaattggagaaacactcatcaatcggacaatgcgagaatttattttgtataactggctggacaaaaactatgaggcttatgatcttggcaagtatgaatacattcttcttgattctcatcctgatgtatcaataatctcaaaaaatgcaattatgattagtaatcatgttctcagttttgttgagccttcccaatttggaggctttgatgcgatggatagtttaaaggcgagaatgcaagagttcaagtcagaggctgtagttccaagaacgcagcagtcttatgtaacagcggacacactttttgtaggtaacaaggtcgcatataacacaaatgccagtcatgaatttagaaagtctgtttctgagatgaaagacgtggtagcggtaattcctcaaaaggaattgttcaacagatcaacaatcgagcatcgcatgatttttgagtatgaagatggtgatcaacgaaatacaaagttttttcgtgacctgagaattgaatatggaaaaataaaacaagcaatcgataaacccgaggaggaaggaaactaacaatggcatttcaaaaaaatggtccaaaaattcgtgaaaccttagaatcgcaattggagaagaaaagagtgcaacaaccaacatctgataaacgcaaaattaaccgtgttgctgacacgcaaaatattcgtgtttttaacgagacacatgaacgaattgtatttattgcaaagactcttaaaaaaggacgtccaatttataaattgattgacgaaatgctggaaatctacgttgagaagggactatcacctaaggaacgaaagctttatgcttcactattcggagacaataatgatcaatagaacaactgaactcgctatgaacttagttagtgtttgtttgaaagttatggccatgtattaagtcttgttgcacctctgtgtctggaagaattaaatgattggtatcacggtattcaatgcttaggttagaatgctgcttcaaagaagaaagaaaatgctcatactggcctttatcacgtttaaagcaggcaatctcatagcttttgatcaactttgctttgaaccgctgcatgtagatgaagaatgagtagcagtcttcaaagtggttatcgaccaccaccaaccaataacgagtgtgcggcgcacgggtgaagtaatgatcgtactgtgacagcatcgatttaatgccaagccttagttcggtttccttatccatgatgcccaccaaccaatccggcgcgatcaattgcggtcgcgcctttttctttggagtagccccgcacaattgctttgtagccatatagctgacgaatcttgtcaattgtttgatctaacaaaacgtttgcttcctccttctctgctgattcaaatagactaagctgcatcgagcttgcttgactgatgcgattaacacgaactgaaacatttctgacggcatggccgtcccacttactatggaagagatagcgagcggcgcgaatcaaatcgtcagtgtggtttgtgggatcaatcttcatttgcgcaccgaaaccggaggtgcccgcctcttctgcatcagcataaccaattccaacgctaaccacttcaccttgtacttgatggtgacgaagtcggccggcaacctgatcagcaatctcgctaagcacgacttcaatctcccttgcctgcgtgtaatcccgcatgagtacctgactattgccatagcctttgttctcagcgcgtggcaaatagcgacgagtcaaatccgagtaatcaataccccacgaatggaaatacaaggcatcgccgagaacgccgaagcgttgatgtaataaaagccgatcggtgtgtgcaagatcatagaggctgtgaatgcctattgcgttaagcttttttgcggtacggctgccgattgaccagaaatcggccaagtcatgtagttgccatatggtttcgggtacccggtcgtaagtccaagtggcttgccacggagcggctttcttggcttcgttatcgagagccagttttgccagtagaggattctgaccaataccaacggtcgtgataatgccaaactgatcgaacacctttttttgaatttgcgttgcgatttcttgattagagccgaagagattatgtgagtgggtgacgtcaataaaggattcatcaatagaataagggtaccaatgagcatcgtcagtaaactggcgataaatacgattaatcccgtagttcttgcgaatataatccgccatccgtggttcggccagttcaatctgcatgtcgtcccgcaattgaaagcggcgcgtgctcaagccaacatggtaacgtttcttgcagttgggactagcagctaacaccaggccgccaggggaatcgcctttgctaagcacggcaatatcagctgccaacgggtgaatgccgcgtcgaatggcctcaactgatgcgtaaaaggacttgcagtcaatacacatgatgtcgtgtactggtagtctcgttggatcatctagtggtgtggtcatgctaacgcccaccaccgatcaggattgagcaaggctacgttacgaatgtcgactgcattaattgattgggtgtcgccgtttttgagttgtaaataaacctgatcgtcccaatgaccaataacggcgccttcaatatctggtagcaaccgatcatcgtagggtgtgccaatttgaacggccacgatttttgcattttgccaggcatcttcaaggatgttgctaatggtttcttgagactgttctggctttggttcgacaggacgttcagaaatggaagctttctccatataggcagaatgatcactgagaatccaaccgagccatttcttcatgcaacggtcaggataaagccactgttctctaggtacattgttttccatcatgaacacctccacatcataattatacgaacacatgttcgattagtcaatgagagctgcttgcttatatcctaaatgagatatataatttagaggaggcaaaattgtcaaataggaggcagatattgaagctgagagacaaaatacaagcgttgcttgacagtgatgctacgtcctatgcgattgctaaagaaaccgggatcagcaattcaacaatcgtggagctacggcatggcaaaagaaaactcagcaacatcacattgaaggttgctgagcgattaggggaatattatgacacgcaccaggtaagatagaaggtgccgtatttgttatacctatggatttttcactagcgaatgatctactctaaccatcttgaaagatgcctgtgttgtaccgccctgcacggatcctgaaattgtattaccgtcagatttttgaaatggtaaatactgtgtttgggttattggaatctgagctaataagctcgaattgagaattgctcagatatttgacggagccaagtttggatgtaagctgattcctgagacaacttttaagagagggtataatgaataaatcgtctctcaaaaggaaggaatttttacatgccaactcgttacgacaaagaattcaaacaaaacattatcaacctatataagcaaggcgaatcagctgcccaactggccagagaatatggcattggctattcaacagttcataagtggatccagggccaggccaaaactcaatccggtaaat

SEQ ID NO: 40 - DNA, 18250 bp, Lactobacillus paracasei
ctgcggaactgtgccgtcttcggtactatgctgctcatacactttgtagtcgcctaagaccatctcgaacttatcaggatcgtatccacacaactccatcaaagttcgtgggtctttatttggctcatgcttgagtctcattaaggccgtgactgtttgactaccatcagcattaagagccacttttctgtcagctggttggctctttctatctgtttttgctgaatcgtattcattcttgactggcttttggaactcgatgctaagccgtcttgctttgccctgaagcgcgtcatagctaattcctagcttgtctgccgtctcacgtctggtaaagccttcagaggcgagcttcctaatgccgctaatttgttcatctgtccattgcatctactcgcctcctgaaatataataattgtgagccacatgcaatcatgtgctgctcttttcatttttattcctcaggctctcggactcgtccccgagagcttttttgttgccttaaaaatttgagtgagataaaatgagcttgttccaacaatatactcattttcactcctctttaatgccccgctctttaggcacttggcccccaaccgagtgcttttttagtatcttctataaggaatgtgctaatatatatgcgtgagcagcggcttttctcctccaagtcaatcgctgctgctcactagtggatttcattttttccatttctccggccctcagacgcttcgacctctgagggcttttttaatccgatttattgctacatgtgttatactctttttcggtaccgttgtttcacctcagtaaacaccggtagctaggccctcagttaatcgctcagagggccttttttgttgcacaaaaatagcacctcaccgtttggcggagtgctatcctgtcacgtttattagtcaattatttaacacatagctgtgcttccagtgcttctgtcgcaactgccgatacgttaacacccttcttcttggctaacgagtttaaatattcgggaattgtaatgtttttcctaacagttctagaaaactttttcctaaatgctgtcatgtcaacagccacgtatacaagcttttccccgtctttcaagctaattgcgcttggttcagacggcttgggatatttgttagcatcttctagcaggtttccaatgaggtcttgtgccatacgcatggcgtcaatttcatcatttccttgcgtgtatcctccgtcaatgtcaggaacacgcacaaaaatataatctccatccttagatagtactactggataaattacaacatcggccatttgttacacctccttgtaacatacctggctaattttgagtacactaaagagaactcatctctttaggttagcttcactcaaaatcgcctgttctagtcccttacccaactccttagcgtgaatcggaatcataaccgttttgttggtcttatggttatacatcttaaggtgagaggaaccattttgcgacttttcatgaaacccattttcctttagcagtttaatcatctgcctgggtttcataggcataaagtcaccttctattaagttttggtacaaccaaactatacacatgatatacgcataaagcaagaaaaatagcacctcacgagaagtgaagcactatagtcgttttgctcgctcgcccattgtcagctagggtcatcgcaagctgtgtccggtcgctaaactggacaatgtggcatgcgggaatcgaacccgcctgactatcacggtcagtccatttgccacgccttgccacagctttatcatcactgaggctcggaggaaaaacgcggtgtctcaggtttctcacctttggcacaataacatcatatgacggaaaaacagttgaaaggtctcacaaaggtctcatctcgatttcaaccaatggacaaatctcagcgaatgcgattaacgcttctcgttttgttcgataatactgggcttttgataaaaacagcttgtccattatttgctggtcactatatcgtttggttaagtaagaacttgttagtataagccgatgattcgctgaatccagagattcgatagcaccttcacagcacgctatatagtacagctcgtcagcgtgcgatattaccttgtcctcggctttgttcccatagctaggtgacttaggcatgccgtccattacggggcttctgagcgctattttggtgcgttgagcgagccgcttgtgatgccagtagttccccaagacctctttggcgttttcaattgttttgtcatgatcaattgggctaaaatatctcgttactcgcaccactgcgtccactccttatggtataattaaatttgtaaaagtttgggggataagcgtgccttcgtggtgcgcttttttatttgtcttcaggaggcctaataagctcccacgggtcaagacctgctccctgcgcgattttatccagagtgttgagtgaaacactgcccctgccagagattgcatattgaagcgtagtgatgggtattccgatctcttttgcatatgtggcttgtgtcatgttcagatcgtatatattcttcctaaggttttcggccaatgctcgtttgctgtccaaatcattcatctccgtcctcattttcggtgtaccagtcgtcactgtttaatagccaatagcttatttccctggcttgcttgtagattgggtcgacacgtgcagtcatcgcgtcagtagtccatttagaccaggcaatgtcatgcaatagcttagttgcaagctcggccttggcacaaagctctccttgaagatacacatcaatatccttacttttactcatgctttccctccagtagctgtttgtcctcaaagatgttgccgatgacctcacggcttgtaatctcgctgaaaaggtcaattgcctcttgctttttctcattttcgatgagccacgatccttcccgcatgattacttgcccaatcatcggctcaggatctccaatattgtctttaccggtgcgcacgacatcgccttcgtagatttcccgcccgttattgtctgtcaggccggtaaactgttcgacaacatactgatcattatccaagaatccggcaaagcactcttcgtcataagcagcattctcaccattttcatacttaacacagccgctcagcatgtcatatgctccctgcacgtcatacaagtaacactcgtgtgccttatcccacgctctgaacttaatctctcgtttcatcttgtacctccctaagaacgacaaccttgccgccccaataatgtgcggttttgtatgggtcggtttctcccttttctccgtaccacttgatggctcctgacagatctaatgtctgtccttttccgccccatccggaattgcaaaggtattcgccgctcggcatacggataaccttaatctctcgtttcatttttccgcctcctataagatcacgtggtctactagaagcattgatggcaccttctcgtctaggcttttttgaacctcttcataagtaagaatgtccccgtcttctgtctttgcaatcgtaaggtgatatagtgcttcttcacggcttaactcttgaaatttatcggggtcatcttgatctccatacatttgacgatagattttcttggcttcatcagcattgttcgcaacaatcaagctgtaatagggttcttttgtatcaaagtatttcatttttcttcctccaatttcacgatttcgcctgtctcctcaacgcgccatacacctagcacccatgcacgggcaaagactgaatcgttgccataatcgaagccctttccccaaagccattccgagatacaactagcattctcaatcccagatgtcagcgacatgtgccccctgttagccttgatatattcgcccaccgcttgcggaatcaccggcaggtcatctggcaacgcggcgtcataacgcttcttgtattcgtctattgcctctctaggccaaccattgaagaacacctgatagccagcaagacggttccaaaccgcctcgaacacgtcctgcttcgtctcattgctcatagcacacacctccagccggtagtttcgaacattgcataggaatcatcggcattcttcttttttaagtaattaagttgaagaactgctcgctcacggttgaagtagataggcgatacacggtgtgcatttccaaaatcagacaccttggccacgaagtaacaagctctcccaccgctttttaggttcacttcttgtttattcatcgtcagtcacctctttattcgcattattgtttgcaattcgttcaatatcggcttctgttacaccaacgccaaagcattttgctgtttcaaagttattttcatttgtgatcaccggctgtttgaaataagccagcatttcagtatttgagatatatgataccgctgatagattgagcaactttccgctgtctagcttaatcatcatcatcagtcacctctttcttctcgcagtcttgcaagccgaaatgctcgatctctgattcggtgaattgagcaaatgacctgtttgtgacttcattagtaagaatccatgagacggttccgggataaaccgaagatcggtacgcttgggcaaattgcttgtttttctgtttgccaccaagttccttatataccagatacttcttctcctttgccacggtgtagccgtttgttagtgcacttttaagacgagtaacatcctcgggtcttctgccccgaaacaataagttaatattgtttaaaaatgcatcttgtaaattagtccacaggcagttcttcactaattttgcttcttctggactgacggtaactttttcaggcacctcaacgagcgcgacaacgtgaccgccatggtcatgaatcacgtctttggcatctagctcgttatctgtggtcgggcaagatgcgtagcttagttcccagaaatcgtctcggtcttcaaagtcccagtatttgccttcatcgttctttaccgcgtacagtttttcttcgctcatttttcgtcctcctgtttgattgccactagcttatagtccacaccttcgtacatgacgcctacgaccttacctgtttctttactgatgtagatgtcatcgaacgtgtcgtctcctgttttcattgatcgttctccttacacgctttttgtgaagaacctgtttgcatatcgtttgaactcttcacgctttgcctcgggcatgccggtcctctttgcttttggaagccttcccttttttcgaagatcgtaaatcttggcttttatggcatcatatccccgattgaaaagcctctgtaattcctcgtaattctcaacgatgccataactatcaaacttgacactttgcaacaaagcagtttcttcttcatgcgtccattttcttgtacgggcgtatccattgttacgccaaaattcctgaataccatatttggttctacccgttattattgctatttcttcgtacgtgtacttttgctcaatcagactggcaatcatctttttctcgcttttggagtaaagactgcgatatttttcttgctgattatttctacaaaattttggaagctttccttgttttctgagatcattcacaacatgttcaacgctagatattgtcctgccaaacatttcggcaatttcttcatagtttaggatggcgtttgtatctgcggccataatcacttcatttttcacacggtcaatttcattttgcgtccaaaatttgtatactctaccttgtttcatatcgttcacctcacaaagcggccattaattgtccgatctttgcatctgccgaagtctctgtatctttcagcaaatggatatagaccttctgggttgtcagcgagctagaatggcctaaccgttttgcgacagcctgtaagttgatgcctttgccaatcagcaacgatgcatgtgtatgccgcaatccgtgtgccgatataacgggaacgcctgcattctcacaatgacgtttcaagatgtcattaatggtctcgttgtatatacgcttgccgtctggcacgaatattggcctatctttcggcaaattctggatcagcattgcaaactttgctgcagttttgtaatcaattgcaatcgttcgcacagatgatttattttttgtaggggcaaacttacctgttgtgcttttgtaatcccaagttttgttaatccttagtgtcaaagagtcgaaatcaaaatctgccggtgttagcccgagagcttctgcaaatcgcagtcccgtcttggcaagtagtaaaatcatgtaatcgtaatctagctctttccccaagttaagatcttggagaagtttctctaattcttctggctgcaaaaacttaatcttgtgttctctatgcctagtgccgccaataactgcacgcaaggttgggtctcgcttgatcagtccttcgtctagaatgtcctgaatcacgcattttagctggtgatgaaagtccatgcatgtttgatgctcatgtgtctctgcatactggctaagaagctgttgatagcttctgcgggtaagctgtgtcacctttagttgcggtgccaacaatttgagcattcgctcggtgttctcccacttgcgataggtcactggcgtcacataattgtgcttgtatgtctcaatccactttttgaaataggtctgaaataactgttcatttctcttcaagtttgtcctcctttcccgctgttaatttctgaatggcttcgttgtaccttgcgggtatctctgttgattcaatgtgattttgttcaggttctagccattgtcgaatatcaaattcttgctcaacgtctttgctgtgtggcatcacattcactgtgctgaaatgcaaatagtcgtcttcatcgttttgaatgaaatatacttgtctagcagcacgtgtcaaactgtcaccatgaacaattgttgcgttcatgccgcgaatggcacaattgaatatcaaaaacggcaacgtgctatcgccaagctcttccagatggtaaaaatacatgcttggccggtagtcccacggtttgtgctttaaacggtcctgctgccatcgttgaatcatcattgatccagtcccagcagcaacctcgtaatactcgctactgtcgttcgatccaacgagcatgttcacgagcttgctaatgctttcaggggtgaaatcttgtttcttgtctttgcgatcagcttgaacgctcatgaaatattctgagaaccagtcatgtgatacgtctgtgctaacgtctagaaattgcttaaaaagctcgttacgcttttgctgatccatgacaatcttcatcaatgctgctggcgcctgctgtgcctcacgaacacctaatagtttgtgaacgacatctgctgtgaatttggtcgtcatttgtgtgcctctcatttcgcgctgactgacttcacagcctgatctgaatagtccttgatgctctgtgcgtctttgatggcctgtgataagtcattgtttgcctgtttggcggcttctaacttagatgtaaggtcattgatagtctgctgctttgcgtcggcctcaggctgctgctggcgtggttcaggctgatatacagaaacatctaggcctctgacaggaactaaccacttcatttcaacctctacagggtcattcgcctcagctttgaagtggatcttttcaacctgtccaacctcaatgccattcacaaaaactttgccgttttgaattcgtatgctattcatcatgatttttctccttaatcgatttcttcgacttcaactctcgggttagctttgtcaataaagaaccgatctcgcagttctacaatgtgatcccaattatcattttctaaaaatttagccttttgcatgccgtcgaagataaacttgtgctgaaacgcgatgttgtccgggtctgttcgcttgtcataccagtaccagtcgaagcttagaggtttcccccattgaaatttcacgccctgattcatcgcttttctcacagccaacattaccgtttccgttgcttgtttcttgacttttgctccgccgaacatgttgcctcgttcaaccttgatgtactggttaagagtcatgaggggcaatggaataataatcctgttcacgctggcttcacgtccttcagatagtattgacgttgcttgccgtcaatcatctcaaccgttgtgattagctctttgggtgccttaccatcaaaagcaactggcttgttgatgtcttggcttgcacatctggcgttgtatcgctcgattctgatgattcgtgccacaccgccgagatcacgcacgcccatgaatactcgatcaggaaccacaaccagatcaccgaccatcatttttgttttaattgcttgcatttgaagattcctcctgtagttccttgtattcttccttgctaattggctgttttagcttttctagcgatatccccatggctttagctatctttgtaagtgtgatcatcattacctctttaccactaagaaaactagcaatcgttatgcggctcacaccagcaatcaaagcaaaacgatatattggcaagctgggatgatcgtcaataaagttgcgaagtcgttcacgggcccaatcttggcctgcattgttagtttcatcctcatgctcaatcatgcttttgcctcctcaaaacttttgcttcggtaagttcacatttagctttttcaagtatcctcgccaaatgtcgtatgtgttttggcagtaagctcgcgtgacaggatctgtttctttcgtgggaagatacgcactagtttctccataatattctgactcagccgtctctaacgcatcgaccaatgtcacgtacgcccactggtaccaaaacttcttcatatcagcatcggcttgttgcgccttttttagatattccatggcttcatcaagctgcagaatgatgaacagcgagtattgataatgtccctcctgcatgtactcattgaactctttaagtgtcatagttggataagccatttcaatacgccaccttaaactgcaactttggcgcgaaaaagcgaaaatcaatgctaccaagtgctccttcacgatttttggcaattgttaaagtcacagtacggatatctgatctttcgttctgccggtcactgttccaaaggaatccaaccgcattgctatcttgttcaattgatcccgactctcgtaaatctgagagtaccggttgcttgtcctgacgattctcaatacctcgtgataattgactaagcaaaacaatcgggataccaagctcgttagtcagcactttgaattgacgggttatctcttcgatttgcagacggcgatcggcttggctacgaacaccaatcagcccgagatagtcaacaatcgcaaggtagcctttatctgcatcagcggctcgctgccgcattgttttgacgatctgcggtaattccacctgcttgtcgtaaagctgcaagtgatagtctttaaggacgtttcctgccttttcaacctcaaccttctcagcatcgcttagacttttctgtgggttgatgaatttaccagcactgataccagtcttgcaggccaacaagcggttgtagttttctgcatttgacatttcaagtgaaaacatatcaactgtcaattccggctgctgtttcaaagcctcaatgatgagattgaccgcgaatgctgatttaccgacaccagggcgcgcaccaatcgtcaacaaacgtcccggcatcaaaccaccgccaagaatgttgttaagagtgaagtacgttttaatcccattttcagtagcaccgtgtatcattttgtcttccatgtccgctgccaaatctgcaatgctactttcagttaccgtctgactggcagcagtagcattctgtgaggcaaccatcatcgcggtaagattgtcctcgcttggttcttccgagtacgcttgtgctgtttgaatgagctgactacggaaataatcccgtttaagcttgcctacccaccagtcaaaacgcgaggtgccaaaatcgctagtcataatgtattgccaatctgttactgacatcacgccaggatgggctgtatcgaaaccgtcttgcaattccagcgtatcgacgtcacccggcaacttgttcatgtaggcgactaccgcagcgtattgctggctgctaaaccatttaggatcaatccattcagacttgatgagttccggcttcgtatataagccatacatgacatgtggttcaggattgctagggtcataaagctttttcgtcaagcttgctgcctcccttcatcgtattcagcaatgtaacgtttagcatcttctggattgatcggaataccctgcgcttggatttcttcaagcactcggtcaggactgttgtagtcgatatacattgcaatagcagttttcttgggattgaacttaggctttcgagcgtcctgctcatctcgttcttcctttacgacctcaaggtaatcgttccatgcctcttggttgaagaatgtactaccgtctttgacaaaccgtttctctgtgcctttgctattgattagctgtcgataagccacaatgccatcctgaatttgtctgttggtagcagggttcttctttctactcattgctcgtttgtaagcagctaacgctggcttcttgccgatcttctttggatacagtttccagagcttttcgaagtcactctctaacgtgctggatgcacgtatgtttttattagtacttgtattattctctctaaagtttttttgggtaggggtacccaaattttcttgtgtaggggtacccaaaatccttatatatctcttgtcaatttctttagaatcatgcttataattaacttgtcgagaaatatacatgccattttctaaggccttcaaccagttttgaattgtgaccttgcttactttatagacgtctgaaaaatatccatctgatgcccagcagtatccgttcttattgcttagtgccgtgatctcaccatacaagagcttggctccttgtggtatctgtttgtcatagcgaacgcctgctggaatgatggcatagtaactagggctttcattcatgatcgtcaccgccttcagggaacaaattagaatggaagatcgtcatcgctaatatcaattggcttgccgttgttggcaaatggatcggctgtattggtttggcttgcttgtgccggtgttccgaaagacggattagaatttgaagaagattcatctttgctatctttccaacggtgctgaatctgcgggaaggccgttggctcccacttcttgatatgcggataggttttaccgttgtattcttcgtttttgacggtaactttaacagcatggcccgtaaaatctgcaagcatcgccgcaagatcagcccacgccttatggtctggaatgccagcatttttgccaatcatgaataggtatcccattgcatactctccggtgtctttctttggatattggttgtcgaagatatgcttgttctgatatttctgtggaacgtcattgcgtacaattagatcaaacttgataaactcacgatctttgtagttatcaaatccaaatcggttaataacgcattcatatacaccatcttgaatgtcgccatttccttctgctgcttgtgagtagtccattgtgatagccatgttttagtcctcctgtttgactgatttttcttgatttccaaacttgaatagctctttaattggcactaactttcgattgtctaatctgtttttagcaaagattgcatcggttccctcgagaatgacgccacggccatcagtcttgggattaactaccacgcgccctacaacgtctgtcaggcctaatagaccatcacgtacgctgtcacgaattgctggcgcatactggctgaacgattgtccagtttcgcttgtaacgtctcgtgtgttctcccaagctgttaccagcacgttaactggtgcgtccatgaagatcatggtcatgatacgggcaaagtaatttgtccatcttgagtaatcctgaagctcgttgccaatgccgtttttactgtgcctgcccatctcgacaaaccagtctttttcgaacgctgagacgttgtcgatcaccagattgtcatatccggaaacacgttcagccagatttttcaggaactctttccattcttcgcttggtttgcttcggtcaaatggttgcacatcgatgttcggtgcaccggatagcacttttgaactgtcatccagatctagcacgagtgttttgccatcaagattgcggatagctgacgtcttgccgacgccgggcttcccataaatcaaaactcgccagttatttgttcgatcaattgcagatgcatgtttaattggctgcatgatttcctcctacttaatcaataaatgttcaccgcgtggcttaagctcagcacccagcactttttctccggcttctaatcgttctcgaatcttgtctgtatctggttcgcgttttaccttgaatacatcagcctgcaaattgtcttgatcgatgtaaatttgctgttttccgccattcttagcaacactgatagtgaatagcggtgtcttgattttgcgttgattagtttcgttcattgcttcaaccaaccgttgtgaaatagtaccgaggttagattgataagctttaatccgtgcttcgaaacggtcacgttcttttttgttagcttcaatatcggccttgatttggcgaataacccgtgcatatccttcggctttgtcattaattgcatccacgattgaatccatggtgtcagctaatacttcgggatcagttgtcccatcttcagctagttctaataaactcgcatattttccttgtaagtcgtataatgttgacataataagtttcctttctatcagtcgttggcgtgcgggccagcggcttttttcatggcttgcttgataatgaataggatcgcgtgtgcgccatcttcctgacccatcgcatacgtttggtggaaatccgtattgtcggggccataatcagcagcaaccttgcgatatttggcgatctggcgattcgctgcggctagaattcgttcgtattcctcattggtcatcacgtcatccccttagttttgctagtcgtgcacgtagcttctcattctcgacgagtagcatctttgcaattggtgtgtggttgccgcgcataatgtctaacgtcaatttgttatgctctttcagcaaatcaccaatggtacgttctgcttcattcaatccactgcctccaatttccgctgtggcctaagcagtggccaacgatcacgccgaagccaccagcaattagtaaataaccaatcattatttttccttctctctaagtgaccttgaaatctctgggaaccatttgtctaagaagtcgagccatggtttcggatgaaacagatacccctttttgccaggcggtggatatgaaaccacggtatcttgcaagaacttgtggaagcgtgggacgttcaagatattgttaactacccacgtgttgttatgtccttcgacatagcttgttgcggtggtgagtgtccacatgcctcgtgctgctagcttgcgttttaactcttggttctccttgatcatctttgccagttcttcttcatcgaccgctaaatactttttgtttgaaatctgatcatcttcaacaacctgcaacaacggcatggcatttcctcctttcttttggcctccccttgacagataatcaggttatctggtgatggaaggaggtgatataaatggacttgccatacaaaaaagtatttgctcctaccagtggcaatattggcgcggtgttttcttcgaaagatgtagcaattaaaagtgcctactcattcaaagatggaaatgaattctttatgattcgtaatcttattgttaatggtaaagaagaggttctcgttgaaagagcgtccaacgttcttaccgtatggagcactcttcctttaggagacgaaagcaaaggttcctacagtgtgggttaattcttcgtcctcaataacgattgtcaccaggtctcccggttttactgcggggggaaatggataactagtgcgccaagtgtaaagagttacccccgtgctacccatatcagtgcggggctttttgttttcttcgttcatactgttatctccttttgtagaaacttgttgataaaatactgctggcctttgccggtcacctttggggtcttctgaactgttacatggccgtccgagtgactgatcgcagtctctttgacttcaaacaagcctagctccatcgcacgttgtgtcggcgagttatagtcggcaccaatccgtttgatcagatagccttgctcacgtagccaggcgaacaaccgcttggcaccaatgtcaacgccgttctgtttgatcaccttggcaagatcaccgaccaagatggttgtgtgactggtggctactgcgtctgcaaacaacgctttaggcttcattgtttcgttatcagccttaagtgccgccgttttggcctgttcgtcctttagctgtgttgccagattgataatgaagtctgggttatagatggccttctcaatcgtttcaggcgtcatatacgcaccatgcttacggattgacggaaggacttgttcatatacccaatcttggaacgggccagcgcttggcaacttgctttcgccagccaactgataaaggccgggttcggagattaccgtcatcgtttgagttccgaagggggtcgtgattcgcgactcccttttgtactttgccttgacgtgggtcttgagcgcatcccgaaagttcttatatccaattgctgtcgcggcatctttgcctacgaagaacggctcactatcaatcaataccgttcgaagctgatttccttgaaaattgaattcctgtagttcgttcatactgacatctccttatgtcgcgttattgcgacttttttctttaaaaaaatatcaattgcttcctgatcgctaagagggatgaattgcatcattttgaatatttcttgtgccgtgaagtcttttccaccccgctgcattttccgaaataatgtgcttctcgcgatccctaatgctaaagctagagaatcttgggtgacgtgtcgttctgtcataagtccctttaaacgatccaagttcacattaaccatatatgattctcctttctgtcgcattcctgcgacttgatgaactaagcataaatcccttatgagcaattgtcaatataaaaatcgcaaatatgcgacttttattgttgcaattttgcgacgtgggtttataattgtagccatacaggaggtaccatatatgaacgttggagaacgaatgaaaactattcgtaagcaaaaaggcattagcgcagattctcttgccgccaaaattggcgtctctagatcaacggtttttcgatatgaaaaaggagacatcgaaaaggttccaattgaagtagttgcaaaggtagcaaatgccctcgatattaaaccagaagttttaatgggtctgaaagctgacaccgttgtggataagattcatgacacggtggttcaacttcaccctgaacgccagcagaaagtctacacgtacgcggaaaagcagctcaatgagcagcagaaccccgataacgttgtcagcttagacgaggcacatgcagaacgtaatcttgatgagccagcgttcaatgttgaggttgatggtattgtggccgctggatatggtgcctttaatgatgatcgctatgaaccaatggacacagttaagattccagacagtgccattccgtatcactacgattactgctttaaagttgtcggtgacagtatgtctccctactacgaggatggcgaatttgtctttgttcagaaaacacaagatgttactaacggtatgatcgctgtagttgaaattgatgacatgacattcatcaaaaagctgatattagagcaagaccgtctgtgccttcggtcattgaatgatgacgtagatgaaaaaactggcgaacgtatctacccagatttctacgctgacgacacagacaatattgatgtgatcggtaaagttgtcggatcttacgcatttaaataaacttacgtccaaaccctgatcgacgttaaaagctggatttttctggagggatcatttatgaaaaaatctttgttggttgggctatctatactatctgttttcttgctttcgtcttgcggcagtagctctaactcctccgctaacgctaatagcaaaacgcaaaatgcagaaacctcaaaaacgtcaagatctgacactaagagagtgagcggtaaattaacaaaagtcggaacttattcagtccgagatggcagaaaagctactctggttaaaatatttcacccaagtcaaaaacttacttttcaagaaaatcagaagagcgtcgaagtcggttttgacgatataaagattattgaaaatgatattcaagattcatcaataaaaaaggatctagaggacgtctataaaacaagcattcctggagacaaattttatatcgttcaaattgacttcagtttaaccaacaaaactggtaatgatgcatacttggagggcatcagtaccctgactataggaaacaggagccttagtgatggccaattttacgatcccactccgggtgtaacagtatcgaataatgctgcttattcaaacagcattgtagctgtcatcgaaaaaaatgaaataaacttttctaggcttggaattgctttcgaaaacattgacgaaccaggtcaatcaaatatgctaatgaaaccaacatcttcacaatatctcagcttaaattagttccttcccccacgcaagcggcgtccccgtgcaagccggagagtggggctggatacaaaataaaaaacgcctaccccaccgaatgggtagacgccttatagatccatgattgtatggtagatgcaatagcacccgtctgtattgtagcacaaggaggtgtaaatgtggccagtattagtaaacgtggcaaaaaatggcaatatcgtgtctcttacaaggataatgatggaacacgcaagtatgtcaacaaaggcggcttcccctcaaaaaaagctgctgatatagcggcaaccgaagtcgaacgtcagcataatcgcggtgcaaatttggatcttaacaagataacgttaatcgactactgggacaaatggattgagctgtacaaatctggtaagcattctcgtatcaccgaagcccggtataaaacaattcgtaaacagttattagcctattggggcgaaagccgtgaactaaaatcaatttcaaaatcagactggcaggggtttatcaatgagtttggcaaaaaaagggctaaagatacagtcagcaaattgaatggctatgttcgctcaatggctgattctgccgtcgatgaccaaataatatatactaacttcactcataacgttgtcctcactggtaatgaaggccaagcaggaatcatcaaatatttgcaagtaaaggatttgcgcaagctcgtcaattactgcctagaatttgcagactacgagcatattgcttactacatcatcgcaaccggggcactgaccggagctaggtattctgaagttatcgggctcacgtgggatcatgttgatcttaaaaaacacgttgtgcacattactagaacgtgggatcacagatatggcagcggctttgctgctactaagaacaaatcaagtgtacgtgacatcgacatcacgagagaacttgcagacttgcttttacgtctcaagaaggaacagcaagaggtatacgttgctcagggatatcgtgatagcaaacaactattatttcgcagcatacggcataacatgctatcgagcacggcaattaataaggatctaaggacgattcagaagactctcgacatttcccccgcgattactttccatgggcttagacacactcacgtttcctatttgattgccaatcacgttgacattaactatatttcaaaaagacttgggcatgccaatacaatgatcactcaaaaagtctacgctcatcttcttgaagatcaaagaaaagagcaggtatcccagacgctacaagcactttcgagactttagcttgtgcacattttgtgcaccggaggaaaaaaacaaccgaaaataaaaggaaacaaaaatcccgaaatgcctttataccagcattccgggaagctacagaaagcatctagaagcataaaaacggagagtaaggg

SEQ ID NO: 41 - DNA, 568 bp, Lactobacillus paracasei
tagggtacaccctattgtgctcttagtggtgtctcttttttagtcactctttggtaatcaacgattccatatgttttattaacagtaattttaatgatttgccctgatttaaacgggcctatatcgtgctcatctgtttttaacttgagattctttatttttccctgtgcgttcttagcagctccttcgtaagtgtatccttgaatcgatattccaacaggtacttcaacgtttgaaataataggctgactatcaatcttcatgtagtaagaatcaccaccatattgatactcagtgatataaaccgaaaaagcaattgttgcaacaattgcagccaaaaaggatgtcagccacagtctttccttatgattctcattcatgctaccatctcccatgacagtctttgtaaagtatagatatgtagcctatctgatgtatttagcttatggataacagcctttccttgaacttttatttttttaagttgctatgctgtaatgatcgcataaatttctgttcgtaattccagcataggagtctttattaaaaaagtttgttatgaagtctg

SEQ ID NO: 42 - DNA, 185294 bp, Lactobacillus paracasei
  misc_feature (128901)..(128919): n is a, c, g, or t
acataatgtctttttatataaaatcatttacgaaaaattgacgtctaaatttgccaagtcagattcaataacgcctattatttaactattatattagtttctcaggaccagtcttaagaaacttttctgaattttatttacttttatgttcactaagttttctaaaccgcccatatacggttgttttccacctatactagtttctctaaaatttaaatgatggtttatagaatgccataatgattttataagaatttgacaaagattagcgtttgtcatctaattatcgagcaatcactgctgtctgtacttcaagtctgactgtcattaagagcgatttttcaaaggacatgcaaagcttgtcttttcgtcataacgtgaaagcacggcagcatggctggttcatgtttcattcaacgagcatcaaaaaaggtcttccaagaatggaaaaccgttgttcattcaatgtttagttgatttgacttaagcgttcagttagcagacagttttttaaccgccttagtggcaacttaactcatgaaatgatgccaactgtcaattttttggacgtcctcgggcaacgccaaaacttctggccgctcaataaattgttcgttcaccaaatagcgcaatggtttgagtaattggggcagtatcaattgatcaggttcatcgttgatgatagggatgaggtgatcgtgcatcgctggttcattcaccagctggacgaaaagctcgcttgaagcatcaatgtaaagtttgcgatcagtatggagaaaattctgcgtcaaccaccaaaccaaaatcgcattcatatccgtaaacatatgaacaggttcacctgcctgattgttgagccaatactgcttgatcaaaggcaacgcattgatgattggaacgccgccaatattgaaaatcgtcgcttgaatcgtcgtgttggtcagcactggctcaagaagtgaaatttgttggaagtcaggcagttgcgcataaagttcagaagcgaaaagtcgctgatcctcgtcataactatcctctcgagtcaattgacctgcatgaaaataactcatcatcgttacacgtttgcgatcatcatgcgcaatttttaatgcaattcgcccttcatcgtctaaatagcgatccgtccgactgccggctgctggcttgaccttgaactgttcaagcaaatgcgtgccaaaagcagcctgtgttcggttggcagcgccgcgatgatgcaggtcatcataaaaattatgatacgaagtctgcggtaaaaaaagcttcttcttatcccgatagctcatgaagcgcgatgtcgcatcaagttcaagatcgccggtgatgacgcttggtgaaagtgcctctttcttgaaaaggttcatcaccgaccgaatccttgcccacatttcatccggcatttctgtcgggagcatatccaagtataaataatccgttttgacatcatcaaacgagaaacctgccaaatcactttcctgtcgttgtcccggttcaacagcctgcttctttatgttaaagaaactcattgcttgatctccccctttttcctcgcgagcgtcatccaaccagcttgtaagcgaagccttatactgattctagattgacaaacgtgtggtagcgccgataagcagctattgtgcattcggtcactttcatctacggccaagtatgccatagcaaacaaaatttctgccactatttaggtcggtggagggccagtttgatcagcaatttttaagttaacttcaacaagaaatcccgcaaaaagcgcaatctatcttgcgctttgcgaaataaatcagtctgatactgagtcaacacttcttctctaaatgggcgctggtcaatgtattgatcgtatcgtagctcaatttgaatggcggtgatattaggttgatgaccgtagtagcgcgttatgtcaccgccacgaaatggaaagttattttcaactgtgaaatcatgtgcagcaaacgcggcggatagcgtttgtcgaaaaattttactagttgttcggtcatggtcattgcctaacacgattgtttttggcttgataccagggtaatgaggatattgggcaaaactatgcaagtcaattaagtaagcatggccaaattttgcctgtttttgctttaaaatcattgttagggcgtgacgatacggccaataataggttctcaaccgtgattgcagtgtttctggcggtagcggccgcgcgtatagaggatggttgaacgtatttcgctgataaattgtggcagaacgataatcgtgatctgaatctaaggtaacagcacgattgggatcggcgacatagcgattaacacgattgatcagcgtcgtgaagccggtttgcggcaggaagtcataaagcgcaggcaagaaccagtcgctattggccaacacggccgttggcaataaacgcttacgcatgtcagcagggatccaagtaccactgtgcgggaaactaatcacaacaggagatgctgcgtctgcatgcagcaactcaaaggtagctgatagttgttcgttttcacccattttctttcctcctcggtgactgttatcggatctagaacaggtacaggttgagacatacttctaagacgacaaagcaaaagcgaacaattttccatttggaaatttgttcgcttttgcctgctcatagataatttattatgattttaaggaccgtagtgccaaggcggagcaatcgtaggccagatggggctcagccgtgcaaacaacacagcgacggtttctggagctgatgttgttaggcgacttcgagaccggtctttgggctcgaagcgccgtcacagcgttccagccccagctggccggagattgcggagtttggcacggcaaggaaattttagcctagcatcttcctacgattattcggaatttaatgaatcacaagttctatgagggtaagatggctcaccctcttccgcatacaggtgatttttaattacttctggtgtccttcttcaggcagcaagatagtttgactctcgccgtcgtcgtaagccatgactgtgtcgggaaaactcggatcatacgggaatggcagatcaactgacatctccgttgccgcgccattttcactaaaatgaacggtcagcttcccctgattattctgcagatcgaaacgtaacaagttatttagcggaacaaccccttgcagatttcgatcgatgatcatccaaatgctatcaatgatttcacctggcagattcgagatgacgccaaaagtcgcgaaccgactgtgatttgtctcaaacatacacgcgatctccttccttcagtcttgcgtggcaatatccgcaaattgtgcatcaacaaattgcgccaaaattttaggatcaatgccaactgagcgacccactttaccggcagaaacaatgatcgttgcctggccctcagcctcttgactgataaaaataggatacttatgccgttcgtgaatgccgatgggtgtgttagcaccatgctcgtaacctgtggttttcatgagatccttcagcggcaccatgcccactttgcggttaccagagaccttgcttagttttttataatcaacatgccgatcgagcggcacgacgccgaccaccggaccagttttgttgccggtcaagaccagcgttttataaatctgatgttctggtacatccagatggtcaactgttagctgagcaacatcgcccacctcttcagtcggaaattcgtaaggcacataagcgatccccgctttgtccaacattttttcgaccaaggtcttttcaaccttattgtgatgtttagccatcgcgatcccccctaaacgcgatcacagtcgcagcaatctgcgtgtaagaacctcgagtgcgatgggcccaaacccggtcatcacgcctgaggctacttacacgccggtttctaagcgcgactgctcacgctcttgcttaaatgcgccaccttgcgtagccaacctacatgcatgtaaggaccttggtggcaatggtcaaaagacggccatcacgcccaaggccgcttacacgccagctgctaaccgcactggctcacgctctgtcttacgttaatcccgatgccacttaaaatactagggcattttgactgaaaataccactatcatgcgccagtgtatgacatcagcgtgaacatgtcatagtctttgatcttgtcgcggccgtgcaagtcgcttagctcaatcaaaaaggcggtgccgacaacgatgccgccaagctgttcgaccaagcgaatcgtagcagcaatcgtgccgccagtggccaacagatcgtcgcaaaccaggacacgttggccaggtttaatcgcatctttatgcaagtataaggtggcttcgccatattcaagatcgtagctggctttaacggttggccgtggcagcttcccttttttccgcgccggagcaaagccaatacccagcttgtacgccactggacagccaacaatgaatccgcgtgcttctgggccgacgatcatttcaacgcctttgtcctgtgcataagcagcaatttcatctgtcgctgcagcataggctttgccatctgccatcaaaggtgaaatatcacgaaaaataatccctggttcagggtaatcctgcacactggcaatgtaatctttaaagttgatggtcatgattctacctcactgtctgaatgctccgtcagcaacatggtttcaagctgagcgcgcggcatggtctgtaactgttgcgccagatctagaaaggctgtgcgcgctgcataagccttcgccgtttgcagcggctttttcgccggggctgtgactggagaaataaaagcaccctctattgtaacaaaatcgagttcaaaaaacacctgaaccgccaagatcacttgatggacggttaaatggaccgccttagcaatcgctggaatgtgatgcttgtcgaacccaggatgggccttcagaaaacgcaacacggccccaaattctgcccgcgtcggtatagcaaccaagcggcttggtgcgccgtaaaacatgacggcaacaggtggctgcacatactgcatcacctgatgcaacgcggcagcatcttttggcaagtcgactaaaactgcattcgctaaaggcgcttgaacttgagcagcgatggtcgttggcccaccaaaggaaaattgccgctcaaattgttgctttactttcgcatcaaaaaacacatacgtgcggctggctttgaactggccgccgtcaatcgttggcattcgccagtcaatgacttgcggctgtttgacttcatagtctttcaacatgagttgtagactggtatgaccttgccaagtgttttgatccagctgaaccgccaatttaacggcctgtgccgttgccagtgtttccgcagcatcaccatagccaaaaccaatcacattgatgccttggtcgatttgaaaacgcaggtgattgttttctttaccaatctgtttcacattttggataacttgcgggcgtactgagaaaaccggttcgggattgccttgaccaaacggtgctaactgacggatcaattgatagtgattcaatgtcaaatcagcatcttccagcctcgttgagataggcagcgttggtttcggaacagttttcagcattgttgcagcagccgcctccatctgcgcatgaatcgctggtaaatccgttgttttagctgtgagaccgactgccatatgatggccgccaaaatggaccatgtgttcctttgctggctctaaagctttgaaaagatgataagcctcaatcgagcgacctgagcctttggcagtttcgccatcatctgcaatgttcataattaacgttggcttgcctgttgcttcgacaaccttgctggccacaatcccgacgaccccttcatgccaacctttactggccagcaataatgttttggccgcttggttttccggcgcctgtgccatcgtcaaagcttcctgagcgatctttgcaactaatccttgtcgttcctgatttagcttgcctacttgttcggccaactcagcagcaacgtcatcctcaaatgtcgtcagcaacgttacgccaggattcgcgtcgcccatccgcccaagtgcattcaaccgcggtccgatgacaaaaccgaccgttgtttcattcacggtttccggagcaacaccggcttcctttaaaatagccgcaagcccaacccgcggctgagtctggatcatttttaagcctaattgcgcaatcacccgattttcatcggttaagctgaccagatcagcaatggtacccaaagctgccaagtcaacgctttctatcggtggttcgcctaataaagccgttgcaaccttaaaggcaacgccagccccagaaagatcaccgaacggataatcgccatctggatgccgtggatgaacaacggccaccgcatgcggcaaatttgctggcaactcgtgatgatcggtcaccaccacatccatgcctgcagcctgtgccggatcgatgacttcggcaccagcaacaccgttatcaacggtgattaccaactgtgtgccagttttttgcaaataagcataaacttcggcattcggcccataaccatcggtgaagcgatcaggaataaatacatccggatcggcgcccagactttgcaaggtctcaagcatgatggcactgctggtcaacccatcaacatcgtaatcgccataaatcgtgattttttcattttgctcaattgccttcaaaatccgggcaacggctttatccatgtaatgcaaggcgaatggatcatgcaatcgactagtgtctgggtgaacgaatgcatcataatctgcctgatcattaatcccgcgttgcagcaacagggtcgctaaaaatggtgggacacccaatgtctcgctaagagcatgctcatcagctgctgcaggttgtggggcgagttgccattgatactgcgtcatatcgtctcgttcctttctaaccgatccagtataccagagaaagcttagcgaattaaccggtaagcctaagttatctttggcagatgctgaccgacagtaacacaaacagaatgcgtatcggcatgacatgttattgtgtcggacattcaatgcaagccatccgtgcgactcattgaaaacgtgatataattaaattgtgaataagcccaactccagtcagcgacttaagatgtgtgatcagcttaagttggtcatgcgataaggaggaagcaccatggcaaaatctcaagaccaattcaatgaaaaggtcggtaaagaaattaacgtttctgacgaggccgtcgataaagcagctgcccaaatcgagaaagtcggttacgtcactgaaaaggacgttccggaaatgatcgatcgcgattacactcgggcattgtccaagaaggtttcggcaaaacttcacaaagacaatgacgatgattacttctacgaagagccttttgactatgaaaatggccgcattgcaaatatcatgtgggacatggataaaattaagacccgcgaagaagccatgaaaattttggctgatgaacttggccttaccgttcctaagattgtaatgcgtaaaatcgacgaacaggtcttctagtctggaggaccttcacagcttcagtttctgcggttgtggacgcggttcaactttaataaaacaaccggtatcctttgcggagccggtttttttgtgagcgcgaacaaaccacacttaaaaaacggcgcgtaagtggtcttaaggcaaacggtcaaaaccgtggccttatttttcacatgtaagccttttgcaattgcgagcacgttatggcgataatcggcaacatcaggatagcagctagtgacaaggatttttcaaacacatcatcatgcaacggccagcttattgtgtgataatgatgataaagaaaggatgtgaatgccatggctgaccaacaggaattagatgatttttttgcccacgccaaggctgctctagatttgcccgctgacacctatgaagatgcttaccaactcggcggtgcaaaatttgctgataaactcgctgcattggttaaaaccggcaagaaaaccgcaacttcaagcggctttgagctgtatactattgaacaggatccgctacccaacgccggcgtctataatattatcttgaatcgggcggataagcctgttgccttgactttcacggacaatgtttttgtaacgccatttatgaaagtgactgccgatattgctaaacgcgaaggagaagacgatcaatccttagctagttggcgtgaagtccatcaagcctttttcagtcaggaatatcaagcgaatggcattcaatttgatccagaatcatccatggtcgtggtcgaggaatttcatactgtgtacccagtcgttcaaacgaggtgaaagcaatgaatctcaagcatcgtacagcgatcacagaaaagaaagtcacgcaaaagctcgatgacatcccccatcccacacttgatgccacactctacttactcgttttcagcatcactgctatcggcggcctagtttcctatggcgcctatcagctctttaaaccggagcgaaagttagcccacaaagcaaaaacactcgttgatgaacatgaagatgaccaccaacacgaggcataaaaaaagcaggtcacaacggcctgctttttgcttgttttgaagaagatgtgggcaaatcaccaaggtctttgtttctatgaaaacagaactgcctatttaccttggctttcttcatcattcatcttcagaatactcataaacgcttcttgtggaacttccacagaccccactgatttcatccgtttcttaccagccttttgcttctctaaaagcttccgtttccgcgtgatgtcgccgccataacattttgcaagaacgtttttacggtaagccttcacggtgcttctggcaatgactttattgccaatcgcggcctgaatcggaatttcaaactgttgacgcggtatcgtggttttcagacgggcaacaatggccttgccgcgttcgtaagcaaagtccttgtgcacgatggtactgagcgcatcgacaggatcgccattgagcaagatgtccatcttaaccagatcactttggcgatagccggtgatttcatagtccagactggcgtatcccttcgtgctgctcttgagatcatcgaaaaagtcgtaaatgatttctgaaagcggcaagttgtaaatcacattcacccgatacttgtctaaataatccatcgtcacaaactcgccgcgcttacgttgcgataactccatgactggcccgacataatcattaggcaccataattgaggctttgacatacggttcgcgaatttctttgatttcgctaacttctggcatgtcagctgggttgtcgatcgttttttcagtgccatcggtcatgatgatttcataatccacacttggcgcggtcatgatcaagtcaagatcgtaatcgcgttctagtcgctcttggacgacatccatatgcagcaaacctaagaacccgcagcggaagccaaaaccaagcgcctgcgaagtttctggttcaaattccaaagccgcatcgttcaactgcagcttttcgagcgcctcgcgcaaatcgttaaacttggcattatcaactgggaaaaggcctgaatacaccattggcgtgattttgcgatagcccttcagcgccttttctgctggccgatccgctaaggtcaccgtatcacccacgcgagtatcctgaatggttttgatcgcagctgtgatatagccaacatctccgaccattagaaaatcacgtttgaccgctttaggcgacatcacgccgacttcggtcacttgaaattgcttgccattgctcatcagctgaatggtgtcgccgactttaacttggccttccttgacgcgcacatcaagcacaacgccacggtaatcgtcataaaccgagtcaaaaatcagtgcttgtaatggcgcattcaaatcgccagatggtgctggcacatcggtcacaatccgctcaagaatctcaggcacgcctaggccggttttaccactggccaaaatagcatcggaggcatccagcccgatcatctcttcaatttcctctttaacgacatctggctgggcactcggtaaatcaaccttgttaatgaccgggatgatttcaaggtcatcatcgatcgctaaatagacgttggctaatgtctgggcttcgacgccttgggtggcatccacgaccagcaaggccccttcacaggccgccaaactgcggctgacttcatagctgaagtcaacatgtcccggtgtgtcaattagatgaaaaatataagtttcgccatttttagctttgtaatgcagttcaaccgcatttagtttaatggtgatgccacgttcacgttcaagtgccatatcgtctagcacctgcgcctgcatatcacgtttggcaatggtatcggtcaactccaaaattcgatcagcaagggtcgacttcccgtgatcaatgtgggcgatgatcgaaaaattgcggatatgcttttggcggtccagcatttcttcttgattcatgtttagtagtgcctactttctaagcgaatgtgatatgagttctattatagcagagcttgacgctgctcggtagaaacggcagtagcgcgtgaacaagccaagatagaaatcggaaccataagcagccttctcagccgaataatgttggcatgacgctcaaatgccatcgaagacaaagaaatcggacggctcgtttgccttatagtgggctatctcgcttcggcgaacatcttgccaaacagtttcgtggtgcttcatcccaagctgatgataaagcgtcagcgtttggtcaaataaggtagctgcttcagattctgcaccttcgaacaacttaagccagcccgccataaatggcaggaaaattgagatgtcagctaactcagcttttttcgcttctctttgagccaagtttagacattgagctgcctctgcaaaatgtgtttgggtaatgtaggctgtgatagcggtgaaatagacataaaacagctcgcgttgataacccggaatggcggccaaaagagccgacttgcgtttaacattgtcgatgaattgacggttgactgccaaaggaaaaagccgagcactttgcttaaacaagcgcatttcatgcaacccccattgatcaacattttgtaaataataagcaatccctgacaagtacgggggatgtccgaaatgcgcatagccatggcgaatttgcaaaaaatgatccagttgaagactgtaacgtttttcattttgacgctcaagcatggttaagcgctggtcaatggcctcatgatcataaggatgcgacagtcgatcatagctgtagcgaataaggttcaagtaagcttcaatttgctgttcagagaccgacttggcggtgccggttcggattacttggaactcatcaaaactgacagcaatgcggtctagcaaatgaataaaccgctcagtcgaaatatgcagctgatcatgctcaaactgtgagatcaacgaaatagaattaacgtcatccgccacttgttttagcgttaatcctttactgcgtcgcaaacttcgaaaagtcgccccatactgcatatgacatcaccgcctcaactttttagcatactgaaattatagcaccgacacatgtcatcctcggtaccttattcattaagaggtgatcccgatgacattttttcaggaattattacggcttaaatggcggctggtgacctatattggcctatacggattgatgaccagtgccttaactgcgacagccatattgagcgggaatgcgatgacagcactcacgcattttcatcgcaccatgtttattgaggcggcacttttgctggttatggtgacaatcacccagcttgccttagcaacgttgaccaatattgaccaattcgtcctccagcgccatctcaacaacaatattcgccgtcaactcgtcgccaatatcgctaaaatgtcctatctgacttatcatcgtcgcacggatgccgtttatacttcgtggctcaccaacgatatgaacacgatcaatcagcagggactgcgatatttttcttacatgattcaagctatctggcaggttctgcttagtgcgatcgtcttggtgaattatcaaattagttttttaccgactgttacattggcagctactgccctgttgatagtaccgctgctctatcgcaaacgactggcccgggccgctgccgaatttagccatcaaaacgagcggttgaacaagaaaatcagcgatgttttggcaggattcgacaccttgttgatggctaatcgccaaacgttgctgataaaccgaatcactcacgcttctgatgaaaccggtcaggcaaatcttcactatatgcaatttgacatgttcacgcaatttctcattaacctagtcaatttggcaagccaactggcgcttttgatccaggcaggtctattggcttaccaacaccaactggcagttggtgccgtcgtaacaatttacagtcttggcggttcaaccttcagtggcttaacgttgctgagcttctccttaacgaccctcaagtcagtcaagccgatttttaaaaagtttggggcggctgcaattaccttaccgagtactggacaaaagatcgggccactagcgcacgctttgaagatcaagcagcttgattttacttatggcaattgccgtgaaccaatcctccggcaacttaatctcactatttccgcattaacaaaaatagccgttgtcggtgcctctggtcgtggtaaaacgaccttagtcaaactattgaccggtttgttgcagccaactcacggcggtatttattgggatcagatgccttatcccgagattgatggtggttctttacgcaatcaaattacttacattgatcaatcaccatacctttttaatgcaagcatccggttcaatatcacattaggcgatccttttactgatcgccagctcaatcaagtcttaacgctgtgtcagttaacgaccttcgtcgcaaatcagccacacggcctggagaccatcctcagtcagaatggtagcaatatttctggcggtcaaaaacaacgactggttttagcccgcggcttgattcgcaaccggcgtttggttatcacagatgaaagcaccgctgccttggacgaacccacggccatcaaaattgagcaactgctcgtcacattgccaaatatcactttgatcatgatcacacatcatctgcattcacaaatcgctaaacaagtggatcggatcatcaaactgtgatgatggcttgtctccaccaaataatctaagattagttcctgtaaaggatgtcggtttccaactccttaccggatttttcttttctcccgttacactgtaaaattgggatattattcacaaccagcaaaaaggccaacaatttccaaagcggaattgttagcctttttctcatggataatttttattgggatttaaagatcccagtgccaaggcggagcaatcgtaggccagatggggctcagccgtgcaaacaacacagcgaccgggctttgtcgctgatgttgttaggcgacttcgagaccggtttttgggctcgaagcgccgtcaccgcgttccagccccatctggccggagattgcggagtttggcacggcaagaaagtctttgcctagcaccgcaccctatttgcttacttaccgcctttaaaagcttccttaacccgatcgaacagcgtgccattgtgcggggtgacatcctcgccactagcggctgcgaactgcattaaggctgacttttgcttttcattcaaatgctttggcgtctgcacttcaacggtgacaatctgatcaccagtgccattgccgcgtaagcgtggtgcccctttgccgcgaagtctgaacttcgtctggctttgggtgccagcaggaattttcaattcaactgcaccatgaacggtgtcgactttaatctcgtcacctaaggctgcctgggcaaagctcaacggaatggtcagatagatttctgaaccgtcacgttgatactttttgcttggtgcgactcggaaaacaatatagagatcaccataagggccgccgttggttccagcttcaccagcttgttgcaaccgcatttgctggccgtcttcaacaccagccggtactttcacatcgatggtgtgacgttcctgttcgtggccagtgccatgacaagttgggcacttttctttgatttccttacctgtgccgccgcagacatcgcaaacctgccgcgtcatcatggcgccaaatgcggtattgcgttgaacctgaatatacccactaccgtgacacttatgacaggtcactggactggtaccaggtttagcgccgctgccattgcaggtgtgacaaacggcttcacgatcataggaaattttggtgtctttaccaaaaatagcttcctcaaacgttaggtccatgcggtattgcaaatcggctccttggcgcggagcggatggattagcctgcgcaccaccgccggcaccgccaaagaattgactgaagatatcgtcaaatccgccaaaaccgccttgtccgccgccaaagtcactaaatccgccttgaccagcaccagcgccgccaaacccttgcggaccgtcagcagaaccatactggtcataggccgcccgtttttggggatcagacaaaacctgataggcttcattaatgtctttgaacttctgctcagcccctggtgcatggttgagatccggatggtatttcttcgaaagcttgcggaacgctttacgaatggtgtcatcatcggcatctcggcttacaccgagtgtctcataataatctttctgatccgccatagttcctcctcgattcagatcatgactgaaaatgcctgttcagcatagcataattcaaacaaaaagccaaaaccgcgccgcggcttcggcttcttgctcatgatacaacatgttacttcttatcgtcgtcggaaacatccttgtagtcaccattaatggtgtcatcgtcagactttttatcatcgctgccttgagctgcgcctgcatcagttgctgcaccgctggctgggccgccttgcgcctgctgattcttctgggcattttcgtacaacttcacggtcatatcctgaaccagtttgttcaagtcatcccgtttttgcttcatgtcgtccaagttgttttcttgttgagccttcttcaaggcttcctgagcatccttgaccttcttgatgtcttcttcaggtaccttaccgtcaacatctttcaatgtcttatcagtttggaagagcagctgatcgacgtcattctttaagtcgacttcttctttacgcttttcgtcggcatcggcgttttcttcggcttccttcttcatccgttcaatttcttcatcggacaaaccgctagaactcttgatggtgatgttttgcgacttgccggtgccaagatccttcgcagaaacctgaacaatgccgttcttatcaatatcgaatttaacttcgatctgaggtacgccacgtggtgctggcggaatatccgtcaactcgaagcgaccgagtgtcttatcgtcagctgccattggccgttccccttgaagtacgtggatatcaacggctggttgactatctgctgcagtagagaagacttgactctttgaggttgggattgtggtattacgatcaatcagtttggtgaagacaccgcccatggtttcaatcccaagagacagcggcgttacatccaacagcacaacatccttgacatcaccagagatgaccccgccttgaatggcagcacctagcgcaaccgcttcgtctgggttaatgctgtggtctgggtccttgccagtccactgtttaactgcttcctgaactgctggtgtccgagttgagccaccatttaaaataaccttgtcgatgtcagcgttggtcaacttggcatccttcaaagcattttcgactgggatcttggtcttggcaaccaggtcagcggtcatttcgtcaaactgtgcccgcgtcaaggtgcgttccaaatgcaacgggccattagggccagcagagataaatggcaagctgatctgtgtctgggtaaccccggacagatccttcttagccttttcagcggcatccttcagccgttgcatcgccattttatctttggacaaatcaatattgttgtctttcttaaattcagcaactagccagtcgatgatcttgttatcaaaatcatcaccgcccaaatgggtatcaccattggtcgacagcacttcaaagaccccgtcgcctaattgcagaatggaaacatcaaatgtcccaccgccaaggtcataaaccagaatcttttcgtccttgtcgcctttgtccaagccataagccaaggcagaagcagttggttcgttgataatccgctgaacattcaaaccagcaatcttgccggcatccttggtggcctgccgttggctatcattaaagtaagccggtacggtaataacggcgtccttaactggttcaccaagataatcttcagagaacttcttgatgtattgcaaaatcatcgcagaaatttcttgaggggtgtattccttgtcgccaaccttgactttgtagttagcttcacccatatggcgcttaatggaaacaatcgtgtctgggttagtgatcgcttggcgcttggccacttcaccgacttggatttcaccatctttaaacgcaacaacagatggcgtggtccgattgccttcagggttggtgataatttttggctgattgccttccagaaccgcaacagctgagttggtagtccctaaatcaataccaataactttactcatagtttataccttctttattttcagattaattattttgcaacgacaaccatagcaggacgcaacacacgatccttgaggtaataccccttttgcaatacctgcgcgactgtgtcagctggatgttgatcatccgctgcgaccgtttgaacggcttgctgggtattgggatcgaacttgtccccggcaccatcaatggcagtgatgccgttttccttcaaagcgcgttccagatggtcgtaaaccatttgaacacccttcttcagagaagcagcactgtcatctttggcctcggttgcaagcgcccgctcgagattatcaacaactggcaaaatggctttagccaacttttgcccatcatatttcaacagcttttgctgctctttctcgaagcgagcattcatattttgaatttctgcagcggcacgcaggtatttatcttcaaagtcgtcgcgttcttgcttcaactgctcgccgtcatgtttactgttcgaaagttgttcgttaagatccgcgatactttcttgtaaaatatcttcttttaacgaagtctctttcgtatcagcagacttttcagctttctttgcggcgtttgctgcatgctttgctttttgttctgccatggtatcctcctttaacgcgtttcctgacgtaaaagcctgtccataaggaacacatgcacaatgcccaaaaaagaccattgcatttgtgcgccgatttctgaacgtgtcagttcacgctattctttaaacgcatcagttggcttaaaaacaccaactgatgctatttgctaacatgattattgatcaaagttggcatagtagtctgtcaaccgtttagccagctcttcgcgaaaaacgtcgagcaagccgatcatcttggagtacggcatttgcgtcggtcccaagagggcgatcataccggtaccgtgaccaccaacatcataactagcagtgatcaagctgaggttcgctagatcaataggttttaactctggacccagtcgcacttgaaccggtgtttgacggatcgggcctcccagcaactcagtcagatcgccgtgatccgcatcgatcaacgacatgatctttttcagctcgtgaatatccgaatcgccaaggtaatccatcaagttcaaccgcccaccaacataaaaacgttcagaggcagctgactttaagacattgccaaaaatatcaaggaagccgtctgggctggtcaaatactgcattagcatggacgggacatccgtcctcagccgctgtgctacctgaaccaatggcaacccgaccagctgatcattcacaattctgatggctttttcaagttcatcggaagaaatggacggcgggacggtgaacacctgattttcgacattaccattattcgtgaccaaaatggccatgacttgatggttacctagtggtacgagtcggaacccagtgagcttaatattgttgacttccggaccgagactaatggcagtgtagctcgtcagatttgatagaatctgcgcgctttgtgccacaatttcgtccattttgctgtaacgctggccaagcttctgcttgatcgttgccaaatcatggcgagagacgcgcacgggttcaacaagatgatcaagatagtagcgatagccttgtgtcgaaggaactcgacctgaactgctatgggtcttggtgatcagaccggcatcttccagcgctgccatgtcgttgcggatcgtcgcagaactgacgtgaaccggcagctcttgcattaacgtctttgagcccaccggctggccactttcagtaaacaaccggatgatctcttttaagacgagcaattgccgtttcgtcaacattttctcacctcacctttagcactcgttttatatgagtgctaatacaatgaataatataccaagcgaggttagcaaagtcaaggtacgattgctagattgtgaacgtttctagtgaaaattatggcaagtgcattttagcaacacagccgtttcttttagcacttaaacaagcggctcatcaatcaagaaacgttgaaaaacttcgttgccaaggaacttgcctttgttggtcaagcgaatgtagccatcttggcgcacaaccaaaccttgactgaccagttccggcacagtttcaccataaatggcgtcaactgtcatgtggtagcgatcataaaaccgcgcttcactgaccccctgcatcgtccgcaagcctagaaacatttcttcttcgatctgttctgactgtggcaccaaatgatgttcaaggaccggcaagtggtcagcatgtaatggtgttaaatactgcttaataggaccatagttgtggtagcgatcacgaccaagatacccaaacgcgccagcaccgaagccaaagtacttgtcattgcgccaataaagcaagttatgctcacactggtacccgtcttttgcaaaattactaatttcatattgatgtcggccatgtgcttccatgagatcgatcgcatcctgatacatatcggcctcgacgtcttgggtcggcaagcgtaacttgccctgtcgcatcagattatagaagatcgttttacgttccaaaattagggaatacgttgagtaatgcggcagatccagtgccaacgccttttgcaaactagtcagaaagtcatcgcggctttgatcaggtagtcgaaaaatcaaatcaatcgaaatattatcaaacccgacttgacgggcgttagcaatggcagtgtaaacatcttttgctcgatgtatccggccgattcggcgtaatacatcatcattaaacgattgcacgccaatcgacaaacggttgacgccataatcatgtagcacttgcaacttttcggtcgtgagcaagtcattggggttggcttcaaaagtaaactccccttgatcaaaatgtaggatatcatgaataccctgacacaacgtagccaattgtgtcggtgtcagcgtgctgggcgtgccaccaccgacataaaccgtctgaattttttcttcaggatgttcagccatcaccatccgcatttcttttagcagcatggccacataatcatcaactggctggccttcgatgaaaactttgttgaaatcgcagtagtaacaaatatgttcacaaaatggtatatgaagataagcacctgccatattaacccttctttgcggcaaaataatctcggacggcagtttcatcttttttcaattgatcaatcagggcatcagcaccagcaaatttcacttcaccgcgtaaatagtgataccagcgaacttgaacggtttcgccataaatcatttgattaaaatcaagtaaattaatctcaagtgtcacgtctcgatcggcgccaaacgtgacattacggccaatggaggccatgcctaaataccaagtggtgccaactttgaccttcactgcataaataccaatgcctggtaatcgctgttggccaagtgtctccaaattgattgttgggaagccaagcaaacggccacgcgcctcaccatgaaccaccttaccagcagttgtataggtataacccagaaaatcattggccgtatcaatatcactggaatcgagtgcatgccggattcgggttgaactgaccttttgaccatcctcagcgagttcggggacgctgatgacatcaaaccggccacaagcatattttggcaacaaagccatagatgcaacatcccgcttgccataagtatagtcaaaacctgcaactaccgtatccgccttcagaccgaccaaatactgatcgacaaatgcttgcggcgtcagcgcagcgaaatctggggtaaagtgaaccacatacaaatagtccacgcccagtgactgcataattttgattttctcttcacgagtggataaataccgaatatcggtttcggaaaccccacgataaacgacggctggatgaatattgaacgtcatcaccgccaacggtatcttttttgctaaagcgatcttcttgccggttttaatcaccgcttgatggccgcgatggacgccgtcaaagaagcccaaggtcaagacgatgggctgtggcggggccgcggacacctgcaatggcggctgaatatcaattgttttcataaattttcacacattcttttcattagctaaaaacattaaatctggccgatactgatcgtcttctcggcgatagatagccttaagaacgcctgcaaaatgcagacgaacgcgcggagtctgctgatcgagagataaaaagcggccatgactgattgcctcaaattgttctacggtcaaatcaacttgaggcagatcggcaaaagcaatatcaatcggttgaatcacatcggctaaagtccctgccgcggcatgagccttcaattgctcaatgctaaccgcctgcttcaacgtaaacccgccgctttttactcgcgtcaattgactcatcaccgcagcaactcccagcgttttgccaacatccactgctagtgttcgaatataggttcccttagaaacatggacctcaaaccgaaaacgctgggtgccatcagtggctgaaaaaaccggttcatcggtacgtgtaaactgtgacaccgtggcctgtcgttctggccgcttcacagtttcaccggcgcgcgcatattcataaagccggcgaccattgactttgaccgccgaaaacatcggcggaatctgtgtaatgtttcctgtccacgcagtcaatgcagcatccaactgatcagctgtaaacggctgcgttaaaggcgtattatcaacaacttccccatccaaatcctcggttgtcgtcgcaaaacctaacgtgatttctccggtgtagactttcccactggccattaattgcggcaccgctttagtgcctgcaccaatcgccagcggcagcacgccgtccacgttaggatcaagggtaccggaatggccaatttttttgataccaagaatcttgcgggcatgatacaccgcatcagcactggtcatgccagtgggtttatataacggcaaaatcccgttcatggcagttcctttcatggttttgattttttatacatactatgatgatgtttttcatgctcgacatgtcgccagccggcccagatgaaaacaagcaccactaggaccgaaaaaagccagtctggcgttttcacatcaatcattggcagactgagacctagcttaatggcaatgagacctacaagaatataagctgcggtttcaagttccggaacacgatcaataaaggtggtgatgacctgcgccaccagccgcatagcaaagataccgagacaaccgccaatcaaaacaatcaccggattgctggacactgccaaggccgccaaaattgaatcaaccgaaaatacgatatcgagactctcaatttgaatgactgtcccccaaagcccgtgaggtcgtttcccatgcgcccctctctgattttttggatggcgcacttcataaaaataactcgcactcatccagacaagatacgccgcaccaatcgctttgatcggccagaattgcaataagtaagtacctagtccgatagcaatgaatcggaatatgtatgcaccacccataccgtacatcagagctttttttcgttctgattcgaccttgagctgctcggtttgtgcagcgagcacgacagcgttgtcgactgatagcatgcattctagcaagatcaagctgaaaatggtcacgaggccgctaacagaaaatgccagttgccaattatgcgctgagaagaatggtccgtataaggcacctagtaacttgatcgtgatccttcctttctcaatgattattattataccgtgcatgcttaaaaacctaaagctgttgggcggtaaagtctgaaggtttgaattgatgcttctattacggtttagattcaaaagattgtctaggggatatgaggtaagaaccacaaatctttttttgcaccgcgactttggactgtctctgtaaggctccttgaacaccgcagctacgagccggctccgcattcgatttcaaaattcaaaccggatacacaatcctcctattgctgacaaagtatcaattatcgattataaaaaaagacctgaccactagcagcagtcagatctttcttttaaatggtgcttattcaagattcttccgtcgtacttcattgatcagttgatcaatgcgtgcgccgtattgaacggatttgtcttgagcaaactcgatttccggtactttgaataaccggatacgctgcccgacctcgcggcgaatgagtccactggccttgtccagaccggtttgggctgcttcgactttgtcaggcgcatcatcgagaatgctgtagaaaatggtggcatgttgcagatcaccggtcagtttgactccggtaatcgtcacgcctttaacccgcggatcgttgacatctttcaacaagatatcgtcaacttcacgttggatctgagtctcaactcgaccgatacgatgtttcatatctgcctacctccttcaaaacagtcggtatcattaaatcctgagatacgtttgggttagttacttcactggaacctgttccattgtgaaggcttcaatttgatcatcgactttaatgtcgttgtagttctcaatggtcaggccaagttcaaagccttgacggacttccttgacatcgtctttaaagcgacgcagggagccgagtttaccttcgtacttgacgatgccatcgcgaacgagacggacaccagcgtcacgggtaatatagccggaatcgacataaccaccgacaacggtaccaaccttagaaaccggaattgtttcgcgaacagtcactgttccgatcaccttttcttcataggttggttccagcatacccttcatcgcagcttcgacttcttcgatcgccttgtaaatgacactatgcaaccgaatatcaacatcgtcttgttctgcttgggcttttgccagcgcagttgggcgaacgttaaagccaatgatgatcgcgttacttgcagctgcaagggtaacgtcactttcgttaatcgcgccaacggcctgatgaataatattcacccgaacacccttaacttcgattttctcaagactgccagccaaggcttcaactgagccttgcacatcggccttgatgatgacgtcaacttctttcagctgaccttccttcattgtttcaaaaagattatctaacgtgacatggttggtgttcttacgttcttcttcctgtgcccgcttggcccgttcttcaccagcagcacgcgcggtgcgttcatcggcaaagacaacaaacttgtcagccgattgtggcacatcgttgataccagtgatttcaacaggcattgatggcaaagcatctttgacccgccggccatgatcattagtcatggcacggacgcggccgaaagtattcccgacaacgattggatcacctgtatgcagcgtaccttgttgaaccagtacggtagcaacaggacccttacccttatccaaacgtgcttcgatcacagtgccaaccgctttttgatcagggttagctttgagttcgagcacatcggcttcaagtaaaatcatttccaacaattcatcgatgttcttgccaaatttagctgagattttgacgaaaatcgtgtcgccgccccagtcttcaggaatcaacccatattccgtcaattgttccatgacgtggtctggattagcgcctggcttatcgatcttgttaactgcaacgatgatcggtgccttggctgcctgcgcatgatgaatcgcttcaatcgtctgcggcatcacaccatcatcagcggcaaccaccagcacaacaatgtcggtgatgtccgcaccacgcgcccgcatgttagtgaaggccgcatgcccaggtgtatccaagaacgtaattaaccgatcacgcagtttaacttgataagcaccgatatgctgggtaatcccgccggcttcgccttcagtcacatgtgtgtgacgcagcttatcgagcaaggttgtcttcccatgatcaacgtgacccatgatagtaacaactggcggccgtggctgtaagttgtcttggttcttgttttcttcttcgaacactttgtccaagtcggaaatatcttcgtgaaccttttcttgggcgtcaatcccgtaatcggtagccaacaattcgatggtatctttgtcgaggctttggttttggttaaccatcacacccaacatgaagagcttcttaatcaattcagctggttcgcgatgcaaaatcttaccaagatcctgcgcattcatcccaacttcataaatcagtgtttctggtaatggccgctctttacgctgcggcatttccttcttcggtgcgctttgttgccggcgcttgttcttcttgttgcgccggttgttgcggttaaacccgttacgattcccataactgttgctgcggccaaaattactgttcccaccgccacgccggctattgcgattgtcttggctgccggcacttgccggttttggtgctgccgctgctggaactggagccggtttcgtaaagcgttgattggttgttgcagctggctgctcagtgcgcggccgttccgtccgaggttgctcagaacgtttactcgctgcatttgccggtttgaccgcttcctgacgttttggctgctgacgttcagacgctggtttaacaaacttgccaccgttgcctgccacaggacggggattgccattagctgccgtgggacggccagcacgcggcattggccctgtgacgcgttggttatcgaaccgacgattgcggtcattacggttacgttcgttagaccgattattgttaccggaacgattagcattgttcgcagaacggttgttattattgttgtttgagcgatttgaattccggccattagccgtattgttagcgctggctgtattgccgccacgattgtgattcgtgttggtatgcgccgtttgtgtgctgcgtggtcgcaaaattgttgacttgctcaagatgattttgccgtcagaggtcttatttgaccgcgctggcttgttttcttgcttagcagcaggttttgcgtttttttgcgaatgctcagcagcatcagcatgatcgtttgacttggcactggcagcgactggcttcttagcagcctctttgtgtgccgttgaactcgtcttggctgctttagcaggtgtctttgccgcctgtgatgacggtgttttgccagccgactgcttgcttaacatacctttgatcttagcttcctgatcttgatcgatcgaggacatgtgattttttacttcgatacccaagttcttcgcgatatcgatgacgtctttattatcgacgtgcatttctttggcaaattcataaacgcgttttttgcccatttcttcacgctccctgcaatttaggtgagcagctgttgcatcttcttggcgaagcccgcatccacaacggcaatgatcgagcgatcactgccgatggcctgcgatagttccattttggaaaactctgtaaccaagggaacttcataatagctgcttttatccgaaaacttcttgcgggtgttggcactagcatcattggcaacataaaccaatttagcttcacgcgagcgaatcgctcctaagaccagattatctccggtgactaagcgactggcgcggcgggccaaacccaataaattcaatacggcttgtttttgcatcgtcacttgccgaatagttcttgacgagccttttgatgatcgacatacgcgaataggtcatcataaaaggttggttcaatcgtgattccaaatgctgcgtcaatcagcttcttaccctttgctgctttcacagcggctggatcaagtgccacataggcaccgcgaccagcagctttgccggtaggatcgatggcgacaacattttctttgttcttcacgatgcgaaccagttcttttttcggcatcatttgattgcttagcaagtccttgcgcattggaatcttacgctttttcatggctcgcctccttaagcttgcgccggatgatcggttgcactcggcgttacaggcgcttgatcagctgaatctggtgcatctgaggcggttttggcgtcgtcggcatcatctgctgcagcggcatcactgtcaggcgttgtctcagcgtcagttgctgcatctgcgttgtcgttagtttcagcagccgcttcagcctctgcttcaggcaattcatcatcatcaacgaattcaacttcagattcaggcttgatgtcaatcttatagccggtcagcttggcagcaagtcgcgcattttgcccctttttaccaattgccaaggacaactggtaatccggcacaatcacagtagcggaacgatcattggcctcatcattgaattgaaccgcgataacctgagccggattcaaagcgttggcaatgtaatccgctgggtcttcctcccattgcacaacatccatgttctcacctgaaagctcgttaacgacggcttgaacgcgcgcaccacgcggaccaacagtcgtgccgacagcatcaacagcgtcattggttgatcgcacagcgattttagtccgatcgcctgcttcacgagcaatgttgacaatttctaccgtgccgtcaaaaatttctggcacttcctgttcaaacaaccgcttaaccagacccggatgtgttcgactaacgaaaacttgcggacccttgctcgtgttttcaaccttggtcacataaaccttgatgcgatcatgggcttcatacttctcgttaggcatctgatcttgacggcctaagaccgcttcgattttacccaagttgacgtagatgaaccgattatctcggcgttcaacgaccccttgaagaatctcatcttcatactgtgaatattcgtcataaacaatactgcgctcagcttcacgaacccgctgcataataacctgcttagcagtttgtgcagcgatgcgcccgaagtcttttggtgtgacctcaaatttgatttggtcaccgatttcataagccttgttaatcgccagcgcttctttcaagctgacttccagccgtgaatcgaaaacttcgtcagtaacttccttcaccgcataaatgtgaatgtcaccttgcttaggatcaaattcgacgtccacattttgcgcttggttgtaattgcgcttgtaagcagaaaccaaagcggcttccaaagcttcaatcacgacctcttttttgacacccttttcttgctcaagagcgtcaagtgcttggatcatttcctttgacatgcttttcttacctccactagaactcgatcgccaaccgcgctgaagcgatcaactgccggtcaatgacctgatcgaacttgcggctcttatctttgaccgtcaatgtcaactggtcaggcaatagctcctttaaagtcccttcaaaaaccttcttgccgtccagtttcttgaataaagagacatggatatagtcgccaactgcttgttcataatcagtttcatgtttcaagggccgttctgcaccaggacttgaaacctcaaggaaatattgctgcgggattggatcgggatccatggcatctagcttttctgacaaggcttcactgaccatcacacattcgtccagtgtaatgccgcctgtcttgtcaatatacacacgcaggtaccacccgccgccttccttcacaaactcgacatccgtgaggtaaaaatgatggtcgtccaaaatcggtttgaccaaagcggtcacggtttcaacaaccgattgcgtactcaagccaccgcctcctttactttctcattcaagactaacacttctgacgtctccagatgcgaacatggtgacgttcgccaataaaaagagtgagcatcgctgctcactcaccgccagaaccttacattactattgatacaataccatagattgttactacttgcaaactaccagacctttgtgctagtaagcctgtaagccaattcatcgcattttttctaaacattcatgacagtttgcatgaaaccgcattaagcctagaataaaccgtcaaatagcgataattggttttcatctggcaagtcatccaagacatggtttgttgtcatataatcaatcaacgttttcgaaaccttaccacgattagccagatcttccttggacaggaatggtttttcttcacgagcggccacgatttgcttggcaacgttatcgcccaggcccggaacagcacggaatggtgccagaatcgtgtgatcatcctgaatcaagaaattgtgcgaatccgacttcgtgacatcaatcattttaatcttaaaaccgcgttcgagacactcattggcgatttccaaaaccgtcaacaactgcttttccttggtagaggcatccatgcctttatcggtaatctccttcatggccgctttgaccgcttccttgccatgactcatggcggcaagatcaaagtcttcagctcgaaccgagaaatatgccgtgtaatagatcaacgggtaatggaccttgaaccaagcaattcgtaacgccattaagatataggcggtcgcatgtgctttcggaaacatgtacttgatctttaagcaggactcgatataccaatcaggcacgttctcgttttcacgcattgccttttgccaatcatctggaataccgcgacctttacgcacatgttccatgatgttaaaggccattgaatcttccatgccccagtgaatcaagtccatcataatgttgtcacgacaaccaatgacttctttaagcgtgacaatgccttgcttaatcagttcttcagcgttacctaaccaaacatcggtcccgtgagacaaaccggaaatctgtaacagttcgctgaaagtggttggcttggtttcctcaagcattccgcgaacaaaacgcgtcccaaattccggaatgcctaacgtccccattttcgagttaatctgttccggcgtgacacccagactcttggtgccggaaaaaagcgccatgacgccaggatcgtccgttggaattgattttggctcaaccccggacaaatcttgcagcatccggatcatcgtcgggtcatcatgccccagcacgtccattttcaaaatattgtcatggatggaatggaaatcaaagtgcgtggtcatccaggcagcattttgatcatcagctgggtactgaatcggtgtgaaatcataaatatccatgtcagcgggcacgatcaaaatacctgccgggtgttgcccagtggtacgtttaacccccgtgtcaccttgcgccagccgatcaatctcggcaccgcgcagttgctgtcccgtgtcacgttcatacgctttaacataaccatacgccgttttgtctgcaaccgtgccaatggtcccagcacggaaactatgatcctcaccgaacatgactttgatatagttatgtgcaattggctgatagtcacccgagaaattcagatcaatatccggcactttatcaccgtggaagcctaagaaagtttcaaacggaatatcgtggccatctttatgcaaatcagcgccgcatttagggcattgtttatctggcaaatcaaaaccggacccgatttcgccatgagtgaagaattcgctgtattgacagttaggacaacgataatgcggcggcagaggattaacctcagtaatgccggccatcgttgcggctaaactggacccaactgatcctcgagagccaaccaagtatccgtctttattggacttcaaaaccagccgttgcgcgatgttgtaaataacagagaacccgttaccgatgatactttttagttctttatcgagtcgctgcgccacaatgtctggtaaaggatcgccatacaattcatgcgccgtggtcatcacgtcatgtttcagattttcttccaccccaggtacttcaggtgtgtaaagcttatccttcaccggcgtaatatcatcgtcaacccagttggcaatcaagttagaattatcaactaccagctcgtgggccttctcttccccaagccaactaaaatcggtcagcatctcacttgtcgaacgaaaatgcacatctggcaaactgtggcgattgagtggattggctccgccttgactatgaatcagaatctgtcgataaatcgcgtcatgttgatccaaataatgggcgtcgcctgtcgctacgactggtttttccagttccgatccgattttgatgactttttgaataatatcttttagatgtgcctcgcctttgatcaaaccagcctcgatcaaaggttgatagacaggtaatggttgcacttctagataatcatagaatgacgctttggcgcgggcctccgcttcgcctttttgcatcattgctgtgaaaacttcgccgctggaacaagccgaaccgactaacaagccttcacgcagtttctgtagctgactgcgtggcacccgtgggacccgatagaagtacttaacattagacaacgatactaatttgaaaaggtttttcaatcccgcttgtgttttcgcaaaaacaatcgcgtgacttggccgtgcagctttataggcatcccccgccccaacccgatcgttcaactgattgagggtcgtcatgccatacatcttggccgcttctttttccaaagcataaagcagataaccagttgcctcggcatcggcattagcgcgatgatgatgttctaggctgactttgtactgcttcgccaaggtgtcgagtttgtgattcttccgttctggatgcagcatccgcgacaattccaaagtatcgatgaccggattgtcaatgtctgccaatccatgccgctcgtaaccattatccaaaaagccaacatcgaaagtcacattatgacccaccataatggcaccatcgcaaaactgctgaaacaatttgaaaacgtcgacttcagactttgatccatgcaccatgtcatcagtgatatgtgtcaaattaattgtcagttcagaaagtgggaaacccggatcgatcatttcttcgaattgatcaatcactttgccgtctttcattttgacggcagccaattcaatcactttgtcgtaaaccgctgataagccagtggtttcaacgtcaaaaaccacatattcagcactggctaaatcacgcggctcatctgctcggtaagcaaccggcgtgccatcatcaactaagtttatctcgacgccataaagcatttttaaaccggctttgacagcggctgaatgtgcctctggataagcctgcaaacctgcatggtcagtgacagcaatcgccttatgcccccactctttagcccgcttcacatagtcgctaattggattcatagcgtccatttgactcatattggtgtgcagatgtaattcaacgcgtttctcaccttcagcatcatcggttgggtccggatgggagacagtttgaatatcctgtgcattaatcgtcagctcacgggaatagttgtcctcttgaacactgcctcgcacgcgtagccactgacctttttgaatccgcgcaaacatggcttcatcttctggaccattgctgaatttttttgcaatgaagctggagctataatcagtcactttgaaaattagtaactgccgcttagaccgcagttcccgaacctcaacatcaaaaacatagccttcaaccgtcactgaacgttcctcttgcgtgatggtcaccatttgttgcggggcatcggtcattttcatctgccgccccatttgaactgggccgtcagtttgaacttgtttttgtttagccgcttgctgcttcactacttctgcagcagccttggccattttagcggtttcttcagctctttgagcctgaaaagccgccattgattgggctgcttgttcctcatcaacttcggcttgcatccgtaagccagagaagccaacctgacgataagtttcttcgagcttaccgagcccttgctgaatcaagtattgccgaatttgctcattttcggttttgatcacagcacgatcattctcaagtgttggcacttgtttttcacataactcgcgaacaattcctgtcccaatttcggcatgggtcacgacgtactgccaatattgagctaataactcgtcagtaatggttggctgggttacctccaccgataaatcagtcgcagcaatctgttgaaacactaacggcaacttggtcgcaattgcattgaaaatctgaaatggcaggatcgcgtcaaaccccaaagtgaaatcataacgccgagattgttcatgaatggtcacgttttgtaccgtgccgctggtcaacgaaggatcttgtcggacatctgccgccaagtcgagttgatccaataatttttcaaacatctcatgttgggataaagccaaattgtgcacccctcttagatggcaggaaacgaccaaagcagctgcttcagtcgtctcctcagtctatcaattatcttgttcttgcttattcagctgacccatcagaatcttgatcgagctgatcaattcttcttttttaacttcgattgtctcgccggttttacgcagtttcagttcaacaatctcgtcaaccgcttttttaccgaccgtgacacgtaatggtacaccaatcaaatcagaatctgcgaacttaacccctgggcgttcgttacgatcatcaaccaaaacgctgtaacctgcatcttctagcattgtttcaatcgaagccgtcagtgacttttgttcttcgcgcttcagattaactggaatgagatgaatatcaaacggggcaatcgtggttggccaaactagcccatgttcatcggcttgctgttccgcaatcgcagaaagcaaacgggaaacaccaatcccatatgaacccatgatgatcggttgactgcggccattctcgtcaagaaaattagctcccatagtttccgtgtatcgggttcctaatttgaagatgtggccaatttcaatcccgcgtgtaaacttcaggacaccttggccatccggagaaacttcaccttcagtcacaaatcgaatatcggcataggtttccggggtaacatcacgatcaaaattgacgttaagcaaatgcgtgtgcgctttattagcccctgcgacaagattagtcaggtcgcttagactattgtcggcaatgatccgcacgtctttatcgacatttaccggcccaatattaccgacttctgcgtgcatcacggtctgcacttgttcaggtgtcgccatatcaagaaagtcagcattcaacaaattctttaacttagtcggattgacttcatagtcaccacgaaccaaggccaataccggtgcgccatcagccatgaaaaggacagccttgatcaatttcttttctggtaccttcaagaattcagcgacttcagcgatcgttttggcatccttagtatcaacaggttcgagcgctgcctgttcttcgaccccttgttttggcaacgccatgctggttgccatttcaaggttcgctgcatagtcagaactatctgaataaacaatcgtatcttcaccaatatcagcaatcgcggaaaattcttttgaatccttaccacccatggcaccgccgtcaccgatgatcgaccgatagcgcaagcctaaccgatcaaagatattggtataagcatgttccatctgccgataaatggtatccaaatcctggtcattactagtaaaggaataagcatcttgcatgatgaattcccgaccacgtaaaacaccataacgcggacgatcttcatcacgaaacttatcctgaatttgatacaacaccaatggcatccgcttgtaggattttaattcattacggaccaaatcggtgaaggtttcttcgtgcgtcgggcctaagatcattttccggtcctgacgattcttcaatttaaataaattaggaccgtaagtttcataacgtccggattcttcccataattcagctggcaagaggacaggcattttcattttaacagcatcgattttggtcatttcatcgtcaataatggcttcaatccgtgctaaaacgcgttccgcaagtggtaaataagcataaacgcctgcttgaatctgacgcacaaagccagaccgcaacatcatcttatgcgacttggcctccgctgagctcggtacttctttttctgtgggaataaacatccgtgattgtttcatgtcagcctccaaagctagaatattttaaaagtagcgcatgatatcgttgattgtgaccgctagcattaatagaaccatcaggcccaagccaatcatggtcacaacgccttccgtttccggttttaatggcttacggcgaataatttcgatcaggttcaaaagaattttaccaccatcaagcactggaatcggcaataaattggtaatccctaagccgagactcaagtaacccataaagaagagtaatccttgaataccgcctttggcactttgactcgtcatggtataaataccaaccgggccagccagtttattgagtgaaaaaccgccggtcaccatggatttgagcacgtcccaagtgcggacagccaaattccaagtttgagaaaagccaaaaggaatggcatttgctggggacttatcgacgtgtacttcaacaccgatcttgccttctttattcggcttgatcacgatgttcttgcttttaccgttttccttcacggtaaatgtcactgatttaccggcatttttactgacgatctttgaaagatccgtgaatgatgacattttttgaccgtcaatcgtttgcaccgtcgcattggacttaagaccagcttctgcggctggataacctggcacaactgttccgatttggttggtattgagcacctgaacaccaaaaaacagaccgtaaataataaaagctagaatcgcgagtaagaagttattcatcggaccggcgaagttgaccaataaccggcgccaaaccggggcgttttgaaactgaacgtcttctggcgcgatctgaacctcggttccgtcttcttcaatgatcgtcgcatcgtggtcaacctgccaagtttgcaaggctgtttcatccccgtttggataaccttcaatcaccagatccttaactaaatcgacgcgactcacttgaaccggcattccgccggccaaagtcgttttgtcactggcattaatccggacaaccttgccttgatcgttaagaatcaggctcagcatcgtcccgggcttaatctcgtcctcctcatcttgccagccagccatgcggacgtatccgccaagtggtagcaaccgcagcgtgtaggtcgtattgttcttgtgcgacgcccacagcttcgggcccataccgatcgaaaattcccggactagaatgccgctgcgttttgcaaagtaaaaatggccaaactcgtgaactaccacaagaatgcagaagataacgataaaggcgatgatagtggtcataaaatctccttaatggttagacaatgccaaacagatgtagcatcggcaaaaccagcaacaaactgtcaaaacggtcgagaatcccaccgtgccctggaagaatcttgccggaatctttgacgccatagaagcgtttcaaagcagattcgattagatccccaatctgaccgataacggacaaaaatagggcgatccccatcatcggccagaaggtatagtactgcgggaagaacatcagatagatggcggcagtgatcaacgccagtgcaatcccgccaagactgccttcgatggttttattaggactgatagccggccacaacttatgacggcccaacttacggccaatcatataagccccagtgtccgtcagccacacaatcagcaaagcaaacatcaaggtgtccaagccagcatcattacgaacactaatcagataatgaaaaccggtgccaatataaaagaaggacaatactgacacaccaatgtcgtcaaaggtagttttattcttggtcgtgacggtcaggaatagcaacagcgctaccgcaatatatattaaatcgattcgtccaagaaaagcaggcagccagcggaaaaaactgttaggcagaacaaccaccagcacaccaagagcagcgattagataatcagccgaaaccagaattcgtttccgcatgataaacacttctgacaaagcgatcactgctaaaactgcaccggcaatatcaatccaaccgccaccagcaatcaaaatcggtataaagatagccaaggcaacgactgccgtaatgacccgttgtttcatcgtaataaatcctccattaccaaaaaatagctgttttatttttttaacccgccaaatcggcgatcccgtgcctgatattcagcaatcgctgcttctagagctgcaggcgaaaagtctggccaataatcatccacgaataccaactcactgtaagcaatctgccaaagcaagaaatttgaaattcgcagttcgccgctggtgcgaatcaataagtccggatcagctaggtcgccaagaaatccggtcatcaacgcattggcaaagtgacggtcatcaatatcatccggagataactcgccttcctgaacttgtttagcgagcttttgtgctgcatggacaagctcatcacgtccgccataattcaatgcaaagttaagaatcatgccggtattattggcggtgtcagccatggctttttcacttgcttgacgcgtttgcggtggcaagtcgtccagttcgcccatcacctcaactttaacattctccttgatcaagtcaggcatgaagtcattgaaaaaatcaaccgggaggcgcatgaggtaattgacctctgaacccggccgcttccagttttccgttgaaaaagcatataaggtcaaaactttaacccctaagcgactggcagctttggtgatcgttttgacattatgcatgccttgtttatgaccggcaacacgcggaaaaaagcggcgtttcgcccaccggccattgccgtccatgatgatcgcaatatgagccggaattcgcgcgggatcaagtttaactttagaagccttggatgtggccaaaatcggtgcctcctcataacgtcgatggtgtccttgcaccaaatgtctttaacgattgtagcagaaaaagaggcagagcgcgaactagcgcgggtataagtggggatattttattagtaacacggatttggacaacaggtgccattagggtataggaaaagggtgagccataatttcctcgcaaaacttgtgaccattgaatgccgattaatcgtcggaaggttctaggcataaaatatgcttgccgtgccaaactccgcattctccggccagctggggtggcgacgcggagctagagcggagacggcgcttcgagcccaaaaaccggtctcgaagtcgcctaacaacatcagctccacagcccgtcgctgtgctgtttgcacggctgagccccatctggcctacgattgctccgccttggcactacagtctttaaaatcgcagtaaatatttcatgagaaaccaaaaaggaacaatttttcaaatcgaaaattgttcctttttattgactgactgagaattatgtcccagcctttttgttggccgctgaaattaaacttcagtaatttctttttctttagctgcagcgatttcatcgatgcgcttggtagcgtcatcagtagccttttgcatgtctttttctaagcgatgcaagtcgtcttcggtgatgtcgccgtctttttcttggcgcttgagtttgtcgagaccttcacggcgaatgttgcggatcgcgattttggcgctttcagagtatttgccgacttctttggcaatttctttacgccgttcgccggttaattgtggaatgaccaaacgaatgacatcgccatcgtttgctgggttgatgcctagatcactggcattaagcgcggtttcgatgttctttaatgaggacttgtcatatgggctcacttgcagaacacgcggctctggaatcgtaatggcggccatttggttgagcggtgtcggtgcaccataatattccaccgtaatctgattcaacagactggcgtttgctcggcctgctcgaatattgccgagttcgcgttgcaacgattcttcagttttgcccatatttacttttgcttgatcaatgatttgatttgccattagcttctcccttcgattgttgtgccaatcttctggccttcaaccacgcgtttgatgttgcctggctcattgaggttaaagacgaccaaatcgatgtcgttgtccatggacaaggtgctggctgttgagtccatgactttgagatccttattgataatgtccatgtgggtcagactttcgtacttcactgcatgcgtatccttattcggatcagcagagtaaaccccatcaacattgtttttcgccatcagaatgacatcagcgccaatttctgcggcgcgtaaggcagcggttgtgtccgtgctaaagtacggattcccggtaccaccagcaaaaataaccacgcgacctttttctagatgacggattgccttgcgccgaatatatggttcagcaatttgccgcatttcaatggatgtttgaacgcgagtcggaactccttgactttccaagttgtcctgcaatgctaatgcattcatgaccgttgccaacatgcccatgtaatcggcctgcgcacgttccattcccatttcggcgcctgtttcgccgcgccagatgttgccgccgccacaaacaatggcaatttgaaccccaagttcgtgcacttctttaatttgctttgcgatcgtcgcaatgaccggtggcttgatgccgaagccagcctcacctgccagcgcttcaccgctgatttttaatacgatccggttatatttgaccatgtatcctatacctccgttggttgctggcactattttaccatagtcgcagggtttctgcggaaagaagctgatttgaaattgagaattgcggaccgttattttccctcaccacggatcagggtaccccaaaaacacgcagtcacacggtgtatagcgcggaaaagaacggacgtttttaatttttcaagataagtaaaaagggacgctgccgagttgacagtgtcccttcaagcaattaacccttaatctgatccatcacttcatcagcaaagttttcttgtttcttttcaataccttcgccgacttcataacgaacgaagcccttcaccttgccgccttttgcagcaacgtacttagcaacggtttggtcaggatccttgacgaattcttggtccacaagggaaatttcgccgagccacttgttaacacggccttcaacgatacgtggcacgatcttttctggcttgccttcgtttttggtttcttctgtaaagatatcggtttgatgcttcaattcttctgccggtaccttggtccgatccaaatattcaggattgatggcagcaacatgcatcgcgacatctttggcagtgtcgtcatctgcgccttcgataacggtcaaggctgcgatttggccaccattgtgcagatacttgccaaagtgttcgttgtctgtcttttcaacaacttggaagcgacgcaggctgatcttttcgccgataactgtggttaaggcaattgcaccttcgtcaactgtctggccatcactcatcttggttgccttagcagcttcaaggtcagctggcttattagccgcaatcgctgcagcaacattattaacgtagtccttgaactgatcattagaagcaacaaagtctgtttcggagttaacttcgataattgcagcggtattaccgttaaccgcaatttcggctaaaccttcagcggcaatattgccgctctttttagcagccttggccaagcccttttcacgcaaaacatcaatagctttgtccatatcgccatcagccgcaaccaatgcctttttagcatccatcatgccgacttgtgtccgatcgcgtaattccttaacttgtgcagcagtaatttgagccatggatctgatcctccttgatttaaaaaaggctgcctgcagatcttgcagtatgcgaaaccctcagacagcctattgtttaattaattattttgcacttttgttgtcgccttcaacggcttccacgatatcttccatggaatcagcctttttgtcggcagctacttgttgttcctgagcgtcgtcttgatcttcaccctgattgccttctatgatagcatctgccatcttagaagtaatcagacgaacggcacggatagcatcgtcgttagaaggaatgatcacgtcaatgtcgtcagggtcggtgttagtatcaaccatcgcaacgatcggaatgttcagtttttgtgcttcctgaacagcaatcttttccttgcgtgggtcaacgatgaacaacacgtctggaatgcgaggcatgtcttcgataccgcccaagaacttctcaagcttatcttgttgcttcttaagaagagaaacttccttcttaggaagaacatcaaaggtgccatctgtggccatcttcttgatatccttgagacgcttgatccgagtctggatcgtgttccagttagtcaaagtaccacccaaccaacgatggttgacatagtattgaccggcacgagttgcttcttcagcaattgcgtcttgggcctgtttcttggtcccaacgaacaagaagacaccaccgttttgagcttcttctttaacaaaattgtaagcgtcgtcgatcatcttaacggtcttttgcagatcgatgatgtagatgccattacgttccgtaaagatatacggcttcatcttagggttccaacgacgggtctgatgaccaaaatgtacaccagcttcaagaagctgtttcatgcttaatactgccatgcgtttgttcctccattatggttttattcctcttgacgacgtctcctcgcaagtggacttcaatcgaagcaccccactcacgatcaatcatcaatgtggtttgtgcatatcgcacttagaagattatacagacttttctttactttgacaagagcgtgaaccaccccggtttctggggtggtgatcgcgtttcggatcgtgatcaggtttctgcgcctgagaacgcgtttttgaagcaaccgcaagaaggtaatctttgcttcagttctattcttggtgggtaatctccggtagtccgagctggctccgctttctattctagaacctgagcaccagttgaccattgcatcattcgttaaatcatttaattgacatcaatcctgtttatcgccattcaacctgatgatcttccaaaaagacttccttacgatgccgggtctgatgtttgaaatgccattctgccgagagtgcatcatgcttgtccgcaaaggcttggtggtacaacaagcggaccggaagtcgttgggcagtgtatttagcgcctttcccggcattatgcgtggccacacgcgctttgacatcgtcggtgaagccgccataaaaactgccatctgcgcataacaacacgtaaaagtaatacgttttagtcgccattcagcaacctcctcaccgatgacgagtatgtgccatccgcttcgtgaacgatcaatggtggcataattcgaatcccgtttggtcggccggctttgatggcttcgattaataccatatttgcttcgcgatcttcccgtggatgaatgaactgcaaccgtttcggcgccaagccgaccactgtcaaagtcgtcagcagttcggccagtcgttcaggccgatgaacataaaaagctttgccttgatatttcagtaaatcggcactgacgcgcgcaaccgttgcgaagtcagtcgttaattcgtgccgagccaaggctaaatgatcatttggactagtgatactttgcgaactcactttaaaataaggtggattgcaggtgacgatgtcgactgaatctttggcaaccatttgggtggcatcagctaaatcaccgacttgaacagtcacattttgaagttgattcagcgccacacttcgcttcgccatatcagctaggcgcggctgtaattcaaccatggtcacctgctggtccgtgtcccttgccaaaaaaagtccgacagcaccgttcccggcggccagatcgaccacccggctgtgccgcttgacctgggcgaagttggccaaaaggaccgcatccagtgagaatgaaaaaacggctgaactctgaatgattttaatgttgcgactggccagaacatcaacccgttcacctggtaataatgacatcacgaacacctttttcctccgaagtgcgctatacaatggtataatttaccacaaagtttatccatgaaggaagaataagccatgttttatagttttctgcgttatatcattgccggtttaatctggctcatcaatggccacgcccaaactcagaacaaacagcagctacctgaagggccgtttgttttggttgcgccgcaccgtacgtggctcgatcccgtttttctagcactggcttcgtggccgcatcatttttcatttatggccaaaagtgaattattcaagaatcctttaatgcgctggctgttagtcaaagtgggcgcctttccagttgatcgggcccatcccggtcctagcgcgattaaagtaccggttcgtgcgttaaaagacgaacacaaagcgctcatgattttcccaactggctctcgctattcagctgatatgaagggcggcgcgattctcattgcaaagctagccaaagcccccatcgtcccagctgtttatcaaggacctggttctttttggtcattatttaaacgtaagcctgcgattgtgcgcttcggtgcacctgttgaaccgcctaaaggtaagctgaccgacgaagcccttgccgcttttagtgacaagctgcaggaaaactttaacgcgctcgattacgcgatcaatccagagtacaagtatgtgcctgacaagaagaaatatctggaagaaaaagaacacggagaagtttaaggttcgctagtcgaacctttttcctttttattcaatacagaaagtgagcttgattcatgaatctttggaaacagatgacccgaaaacctgatgttcaggccgcactcaatgctgatcatttactgacacgcagtttaacaacgcgtgacctgatcgcgttaggtattggcgccgtcataggtacgggaatctttattcttcccggaacagtagcggcgactaccagcggaccagcgatcacgattgcttttattttggctgccatcgtctgctcgctagcggctatgtgttatgccgaattcgcatcggctctgccagttgccggctcggcttatgcttacggcaatctcgtgtttggtcaagtctttggatggattattggctgggcacttattttggaatatatgctggcagttgccgcggtttcaaccagtttttctgcgtatttcgctagtcttctacaaggctttcacatcaccttgccagcagccattgccggtccgttttcgccgagtcacggcacttatgtgaatctgattgcggtcattgttgttcttatcattggtgttatgttgtcacgcggtatgcaatcctccatggcgattaatcgtttaatggtattagttaagttagtcattattgccatttttattgtcgttggctttttttacgttcagccagccaactggcatccatatttgccatttggtgcaaaaggcgtacttgccggtgctgcgatggttttctttgcctatctcggctttgacgccgtgtctgcttcagcaccagaggtcaaaaatccgcaacatacgctaccacgcggcatcatcggcactttagtcattgccaccattttgtatgtgttagtcgcgattgttttgaccggcatggtaccattcaccaaattagatgtggccgatccagttgcttttgccttgagcgccgtgcatctgcgtagcgttggcggtatcatttcggtaggcgccttggctggcatgttcaccatgatggtcaccatgatctacagctcatcaaggttgatttatgcgatcggccgtgacggactgttaccccgttggtttggtcacgttaaaggccatctgcctgaaaatgcgttgtggactgtggttttgatcattgcgatcatgggcggccttgtgccactcacgcaactagtcaacctcgtcaatatcggcaccttaattgcttttgccctcgtctcaattggcatcatccccttgcgccgacatcaagcctttaacaacgaaggtttcaaggttcctgggtatccagtgacgccgattatttcttttctgttttgtctgctattgatgacccagttaagtgtcgaaacttggattatgagtctgatctggtttgccttcggacttgtcatctacttcagctatggcatccgccacggtcatgttgccgaaaaaagaattgaatgaatctgctgaattaagaaaggaaaataagtcttgatcaatcctcaaactgcaacctgcttggtggacggtaaagtctatgcgattagcgatggccttttcttaagcgatttggagcctaagttggccaatatcatcagaaacgactatccgaaggcgactaagaacagtttcatctgcaatcctcaccttctgacttatcggctagaacgcatgcggcgccaacaacggcaagatgcgcgtgcgcatgataaaatcaatcgaaaaatgtcgcaggctttggtcaaagacaactttcagctgaccaatgtttacgacaacatggaagcgacgattacttttggcgagcgaattgccgatgccgttgctaaatatgccgggtcttggccattcattatcattttttctggttttatgattgtgtggatgatcctgaatacggtcggcattttcggggcgaaattcgatccatttcctttcattttgcttaacttatttctgagcatgatcgctgctttgcaagcaccactcattatgatgagccaaaatcgagcggccgaatatgatcgcttagaagcgaaaaatgattatcatgtcaatctaaaatcggaagaagaaatccgactgttacactcaaagttggatcacattatttcagatgacaaccccaacttatttgagagccaacgactcaccgttgaggttctgggtgaaatggtcaatcaactcactgaaacccgccagcaacttgaattgttaaaggcaacgcaggatcaggccaataaggatatagccattgatcaaaaaaacaaaaccaatgagtaatcatgtcaattcgatttatattgaaaaagatccccggtactgtatgcaagcgcaattgcctgtacatggtactggggatctttttaatgatttgcatttattcggcatgatcgccaatttgcagatgatacatttcatagtatcggccacgcttggctaacaattcgtcatgcgtgccgcgttcaacaattcgacctgcattcaaaactaaaatcaggttggcatcttgaatcgttgatagccgatgggcaattgcaattgtcgttcgcccttgccgaatccgacgcaagccttcttgaataacggactctgtttccgtatcaatgttggccgttgcttcgtccagtacgagaattttcgggtcagtcaccactgtgcgggcaaaggaaatcagttgtcgttcgccgctggaaaactcagtaccaccttcaataaccttagcatgataggtgcctggtagtttatcgataaagcgatcagcttgcacaaactcagccgcctgtttcacttgctcatcggtaatactgtcattgaacaagcgaatgttgctactgatatcgccatagaacatgaatgaatcctgcaatactaatcctaattttttccgcaattctggcatgggatagtcgcgaatgtccacgtcatcaattaaaatctggccttcaccaaactcgtagaaccgcatcataacgttgataatcgagctttttccggaaccggtgtgcccgaccaaggccacggtttcccccggattggcaacgaagctgatatcatgcaaaatatcgtgcttgccatcataagcaaaactgacatgccggaattcgattttgccttgttggatcagcgcatgagcatcaggatgctgcgctggcgcatactcttgactgtcgagaattcgaaaaatccggctacccgcaacaacgccatcctgcaaaaacgaaaggttatccatcatattaaccatcggattaaagaagtttgccgtgtaagtcgtgaacgcatagatcagtccagcttccacgtaactatgcatcgaaatcaatccaaaggcccataaaaccgcaatcaacgcaaaggaatataacaagttaatcactgacgacagcaacaaagaattgacgcgaatcatcgccttacgtgagtccaaatattcctcattcgtcgcttcgaattcttgactgatgcgattttcctgacgaaactgctgaatgatgccgatgccttcaatagattcgttcagttgggtattcaactctgacagtttttcacgcatgtgccgataaaccttggaactgtacgtgctgtaataccagaccactatgagcaaaatgggcagaaaggcagcgaccatcaaggctatctttggattggccgcaaacatgatggcaaaactgctaataactgagaataacccgacgataacagctaaaatgacgttccagaaatcggaaaatgtcattgtgtcattggtgacacgcgacacaatcgaaccagctggcgtttgatcaaaataccgcatacctaacgtgtgcagtttggcaaacagctgacggcgagcatcttctaagccgcgctctgcgcccatgttgaataaaaatgtctgaaaaaattggaaaacagctttaacgagcgtgccaaatgcatagagtgctgcaaacagcagcagaatctgaaccgttgcactttgattggccaaataacgatccatgaactgttggagaatgaatggtagcaaaacgttcatgcctgcaagcaacgcagccgccacaatggcgccaataaactgccgcttatacggtctcgtgtaccccatcagccgcttcataattttgagttgttgtcgaatcggaatacttttcgaccaagcactctcataacccttacttgccaagtgattcaccttcttccgctgcttccatttcttgttttgcccacatttcggcataccagccatgcttggtaattaattgttcatgagtcccgcgctcaatcacctgaccattttcaaggacgagaatctcatccgcatgcatcactgagctgagacgatgagcagcaatgattgtcgtcttatgggcacgatcctgcttcatgttggctaaaatttcttcttcggttttagcatccactgcagacaaggcatcatcgagaatcaagagttcaggcgcgttgatcactgctcgtgcgatagacagccgttgcttttgaccgcctgacagactgactcctttttcacccaccagcgtgtcatagccagccgcaaactttttaatgtcctcgtgaacagcactttctttagccgcttgctcaacatcctgttgtcccttttcgaacgctgaaaagcgaatgttatcggcaactgttgtcgagaataagaagttgtcctgtggcacataaccgatcgaatctaacaaggcgtccagtgaataatctttgatattatggccgccaaactcaatcacgccatcgtagttatcaaactcgcgtaaaagcaacttaaaaatagtgcttttcccggcgccgaccttgccgacaatccctagcgtgtgaccttcaggcagcgtaaaatggacacggcttaaagcgacctgttgatcatccggataactaaatttattgatttgataacgaatatcgccatgcgctggtgtcgtaatcgcgtctttggcttcaaggatagtcgacttttcctgcaacagttcatcgacccgatcataactggcattcccacgttctagaatgttaaacaatcggccaatcgcaaacatcggccacactaatgctgacacatacgtcacaaaggaaaccagttggccaatcgtgatttgtccatgaacgacctgccagccgccatagatgatcgtgatgacataggttaagcccatgatcagacttgtcgttggatcaaataaggcatcaatcatattcacgcgccgattaatttgcacggtatggtcgacaatttgattaaaatctgccgtatcttcggcttcctggccaaatgttttaatgactttaatgccactgacactttcctgcgttttatcattcaaacgtgaaaaagccgcctgcgattcagaaaaagccgcatgcaagcgggtgccgagttttcgtgccatcaccgccaataatggcattggcaaaatggcaacaatcgtcaaccgccagtcaacgaccaacaccatcgcaatgatggtggtgccgccagtaatcatggagtcgaacaaggttaaaataccggccccggcaacgttttgcaccgcgttcaggtcattggtcgcatgcgccatcaaatccccagtacggtgtttttgataaaacgtggcgtccattttcataaagtgccaaaatagccgcgtacgtaacgttcgttcaagcttcgcagcgccaccccagatcgcattacgccagccaaaccggaataaatactgggcaaccccggaaaacagcaataaccccagcatccacgccaagtgactgctggttaaccgagatttgctcatcgcatcaacgagatccccaataacttttggcggaatcaaattcaccaaggccacgagcagcaaaaaagtaacgccgagcaaataccggcgccattcttgtttaaaataccaacctaattttctaaagattcccacgacactgctccttaacccttttgctcatggtttccccatcagcatctcaaaataattaacgttctctcatcatagcacaaacgcactgggacacgaaagcgcgatgacaaagtgattcctgtcatcgcgctttcttagcaattacttagcgttacgttgggcttgtttcatttgcgccatcatctggttcagtttcttagcagatggtttttgacccatctgcatcatcatcgtgcgcagcatttcttcgttcacaggcggattatcctgaaaatacttcttcatgtaagcccgtgccccgaagaaaccgcctgccaagccgaccagtaaggcaatgatccccacaagtactgtgattaacaatgtgcggcctccttcaagtttcattcttcattgtactaaagcaggttgacgttgaaaagactaatcttttcgccaaccgtgttcacgttgaatcttttgaacttttttgctagtgagctccttgccttttttatcaaagacctgagtatgctcgatttgatctcgcaatccggcacgaaagtcctttaaataagcctcgcgcaattgttgacgctcgattttctcttcgggcgtcaaaccaacactgcgatcttttttagctaattcattgatacgatccagtcgttcttttggttgttctgccatcatgctacctcctacaatttcagtggcgtgcatcagttgagttgcactgcggcgtaacaataattcgccgcctcatgcttaggataaggcgcattctttaacatcgcaacatattctgcggctcgtcgttctgacgagaaggctttcaacaactcagtcggtgccgactgatccgcatagtagacgatgtagacaagctgatcatccatcagccttcacctcgagtctgtgggtgcttcttttttgcgtgtacgagttttccatcctactcatgcttcgctataacgcgcttgccagcccaaaaacctgcatgtaaggacatcagttgcagtgaccaaaagccggccatcacgaccgaggccacttacacactggtttctaagcgggctggctcacgctcaaaaaaaaagaccgtttgccggcctttttccagtattaacgacgcttttcgcggatacgagctgctttcccacgtaatgcgcgcaggtagtagagctttgcccgacgcacttggccgtgacgggtaacttcgatcttttcaacacgtggtgaatgtaacgggaatgtccgttccacaccaacgccatttgagatcttacgtactgtataagtagcggaaatgccaacgccgtgacgcttgataacaacgccttcgaagagctggatacgttcgcgttcgccttcaacgatcttggcatggacacggacgttatcaccaggacggaagtctggaatgtcatcgcgtaactgtttcttggtaatttcttgaatcaatgggttcatgggtatttctcctttgccgacattcataatcatcccgaccagcggaatgtcgttgatgtgtgacgtatcacagtcaataagtttaccatgactggttggacgtgtaaaggtgaaaatctttacggtatgctaacgttcaggattgattcttcaatcttgcttctgccgccttagtagcttcttctgttttaacttctcgcaagagtttttgagcagtttgatcgagcgtaatggttttcaagagatctggacggcgaagataggtgcggcgaaggctttccttttggcgccagcgagcgatgagttggtgattgccattttggaggacttcgggcactttcatcccccggtattctggaggccgggtgtattgcggatactcgaggagaccgttctcgaagctatcggtgtgggcactttcatcattgccgagaacgcctggcaggagacggacaatagcgtcaatcatgaccatagcagggagttcaccaccagtgagaacgtaatcgcctaatgaatattcatcggtgacaagcgtgcggatgcgttcatcgtagccttcgtagtggccacagatgaagacgagatgatcttcttgcgataacgctcgagcggcttgatggttgaacttcttaccagccgggtccattaaaatgactcgctttggaccggggtgacgctcgttgacaccatccatcgcctcaaatagcggttctggtttcagcaacatgcctgcaccgccaccatatggcgtgtcatcaacatgatgatgcttgtcatgactatagctgcgataatccaccacatcaaaattaagtagctcgcgttcaatcgccttgccgatcatgctttcgcgcaacggctcaaacatattcggaaaaagacttaaaacatcaatctgcatcgtcaatcaacccttccggcacgatcacatgcgccactttctgatctaagtcgatggactggacaacggattttaggaaaggcagtaaaatatcgcttttaccgctacgaggaataacccatacgtcattgggacccgggcttaagatttcattgactttgccgagcgtctgaccttgttcatcaataaccgttaagccgataatgtctttgtaatagtaacttccctcgtccagcggttgtaacgctgtctcggtaacttgcagtttcttgcctttaaatggcaggacttgattaatatcggtgtaatccttaaaggtcagcaaggtgagccccttgtgttctcgcacggattgaatcgtcaaggcagttttgggtgatgttgccacataaacagtgttaccaaccttaaaacgatcggccgggaaatctgtcgtgacaaggacgcgtacttcgccacgaataccgtgcgtgttcacaatggtgccgatgtcataataatctggcatgttcttcctcctctaaacgcgttcgctggcccagaaacctccacattaggaccttgaacctaaatggccacttatgctccggtttctaaccaggccagcgaacgctctttcaaaataaaaagaccgacgcggtatgcgtcagtctttttattctgcatgcgatgcacccaaaatattgagccgcacccgcttgttgtacgggcttttgacactatatacaatggttcggatcgcttgcgcaacccgaccttgtttgccgatgacgcggccgacatcttcaggtgccacagccaaatcaaaggccatgtaatcacctgtttcatgcgcagtcaccttgacggcttctggttgtgtaaccaacggggtgacgattgcttgaatcaagctgccgatatccaccattgataaccgcctttatttcttggcaaagcgcgcttcgtgatacttctgcatgatgcccttgctaccaagcaagttacgtacagtatctgaaggttgtgcgcctttttgaagccagttcaaaatatcttcttcatttaatttcaaatcgactggattagtcaacgggttgtaatagcccacggcttcgatgaaacgaccgtcacgcggggagcgtgagtctgctacaacgatccggtagaaaggcttacgctttgaacccatccgctttaaacgaattttaactgccactaagtccacctcctgctcatttatcaaccttgatagcatagcaaaaatattttaagctgtaaagccttttttctttacacaggtaaaatgtgtcgtttggcaacggtcttgttcctaattggttggtcaggaaaaaattaatttttaggaatggaaacgcttggcatttttcagccgacgtttcttgttcttcttttgtttgcggaccattgagttcatcgccattttgccaagtttgccagaaacgccgccgcccatgagaccgtcgaggcccttcatgttacctttgctcatctggttcatcatttgcttgctttgattaaactgcttaatcatccgattgacttcaaccactggccggccagaacctgcagccaaccgccgccgtcgacttggattgagaagatctggatcttcgcgttcttgcggtgtcatcgagtaaactatcgccttcatgtgggcaatgtctttcggatccattttgacattggccaaggctttgttgtttgccattcctgggatcattttcatgatatcttccagcggacccattttgctaatctgatccatttgatccagaaaatcattgaagtcaaaagaattctcgcgaattttttcagccatttccatggcttgtttttcgtcgtaattcttctgtgccttgtcaatcaaggtgagcatgtcgcccatgcccaaaattcggttggccatgcgatcaggatagaagacatccagcgcatccatcttttcaccttgaccaatgaacttgatcggcttgccagtgacggcacgaatggacagtgcggcaccgccacgagtatccccgtccagtttggtcaggacaacaccggtgatatctagctgctcattgaagcctttagcaacatcaaccgcggcttgcccagtcatggcatcaacgacaagcaaaatgtcgttaggatgggctagttccttgatgtttttcagctcgttcatgagcttttcgtcaatctgcagtcggccggcagtatcgatcagtacataatcattcttattttctttggcagtcgccaacccttggcgaacaatttcgaccggatcaacgtcggttcccatttcgaaaactggcacgttgagctgtttgccgatagtctgcaactgatcaatcgctgctggccggtaaacgtcagcagcgatcaataatggccgcgcactgtcattgtccatcagatacttggacaacttaccgacagttgtggtttttccggccccttgcaaaccagccatcatgatgacagtcggaatatgtggtgccttgttcagtggcactgccgcctcgcccatcgtcttgaccaactcgtcattgacgattttaatgatctgctgtgatggggttaaactttcaagcacttcagcgccaagcgccttggtgcggacgtttttaataaatgttttgacaacatcaaaattgacgtcggcttccaacaaagccaagcgaatttcgcgcattgcatcgcgaatatcactttcactgaccttacccttacgccgcagtccgctgaaagccttctgcagtcgttctgataatccttcaaatgccataatttccccctgctatttcgcggtttgatccgcgactcgttctaataaggtacttaatgccttgtcgtctggataatgtgtacgcgcataactcactaacgtatctacagcttcattttgcgcttgatagttggcgaaaagatgcaacttcttttcatattcttccaagctggcctcagtgcgtcgaatattgtcatacacggcctgacgcgagacattaaactcggttgcaatctcgccgagtgagtaatcatcaccgtaatataatgccagataggcgtgctgtttgtccgtcaataacggcccgtaaaactcaaacagcgagttcatgcgataatttttttcgatttccatcatgtcattcctttaatcccatgattgccggcaactcagtttccccggccgcttgaacatggtccttgtataaggataccggtatcgctgaaaatggtcaattacttaaaaaattaggttgatggccacggagctaaatgctagcgtagaaagccagcttcgactatcggtggataacagccaagaaatagggtcggagaaaagatcgctttcttgcaattgcttcaaaaacacatttgcatccgtagaaacctgcacataaggaccttgaacgaggttggcacatcgttttcagacaggaaaaggcttccataaaatattgtttgttttagtcttctcgtggagtatttactgcaatttttaaagactgtggtgccaaggcggagcaatcgtaggccagatggggcacagccgtgcaaacaacacagcgaccgggctttggagctgatgttattaggcgacttcgagaccgggctttgggctcgaagcgccgcctccgctctagcttcgcgtcgccaccccatctggccggagattgcggagtttggcacggcaagaaggttttagcctagcccttcctacgattgttcggaatttaatgactcacaagtcctacgaggaaaattatggttcatcctctcggaggttccgaaacgcgcgaacaggcgcagaaacctgcacataaggaccttgaagctaaatggccaaaacccagccatttagcttcaaggccacttatgctccggtttctaaccgcgcctgttcgcgctcttccagtttcccctagtttcgtggtacactgaacatgtgaaaaattggagggaagaatatggtctcaacctttatttactgggccgtgtttgccgctctcgctgcttggggactgtggagtttggtcttctcatgtgtttacctgagcaaccatgaaaacggcaatttgtggttctttgctatcattaatgcgattcttggccttctaggctggttattcgcttggatcatgagtaatacggcatggcaacaatactggtttgcaagtaaggtgcagccatctgcatggttcacctacctgctcatcggttaccttgtcttgattgtcctacaggtcatccttggccgggagaagaaagtgcaagcagcttaatgtcataaaaaaagcgtcgtactggtttttcgccagcacggcgctttttcgttattcttcattttaattaagcttcgacctgaatcaaacccttaaatagtccggccacaaatttggttggatcaaaagcttgtaagtcgtccatcttttcaccaaggccgacaagtttgaccggtacatgcagttcattgcggattgccaacacaattccgcctttccctgaaccgtcaagttttgtcaaaacaattccagtgattttagttgtttgattaaactccttagcctgattaagtgcattttgaccggttgtcgcatccagaaccagcaagacttcctggggtgcatccggcaattcgcggacaatgacccgcttgattttgttaagctcattcatcaagttgaccttattttgcaatcggccagctgtatcaacaagcacaacatcaaattgctcatccttggcgcgtttgacaccatcaaaaaccaccgcggccggatcgccgccttctttcgtggcaacgacaggtacatcaacccggcgaccccattcctgcaattgctggatggcgccagcacggaatgtatcggcagcaactagcagaacccgcttaccttcttcctttagctggtgggcaagcttgccgaccgttgttgtcttaccagcaccgttgacgccgacaaacaggaacacacttggccctgattcagcaaaatgtagggcattgtcttcatccttaccagcatcgccatacatatccaccagcttctccacaatcacacgggaaacggccttagggtctttggcatttttaagcttaacttcttcacgcaggtcgtcactaagcttaactgccgtttcaaagccgacatcagactcaatcagcatctcttcaagattgtcaaaaaagtcttcgtcgacactacgaaaattagcaaacagtgcattgagtttttcaccaaaactgctgcggcttttttctaggccctcatcatatttattttcttcaggcgtttccggttcatcaccggtaaacacctttttgatcgcatcaaaaagtcccattaattgatcgcttctttctgtgattgatccagactaacagccataattcggctaacacctgattcttgcatcgtgacaccatacaatacattcgccgcaaccatcgtgccatgccggtgagtgatgacaataaattgtgtggcgctagcataatgccgtaagaattcaccaaatcgattgacattaacatcatctaacgaagcttcaacttcatcgaggatggagaatggtaccggacgcacttttaaaattgcaaataacagaacaatcgccgttagcgcccgttcgccaccggatagaagggaaagccgagtcagttttttgccaggcggctgagcggaaatctcgatccctgttgcgagcaaatcatccggattcgtaaggctcaaatgtgcatgaccgccaccaaacatttgcgggaaaattgcttcaaaagcactattggtctgatcaaacatatccttaaatcttgttttgaccgtttcatccaattcgtgcatcgtttcttctaactgctgcttagcctctagaagatcatcttgctgcttggtgagaaattcgtagcgttcattgacttccttaaactgatcaattgcgttgaggttcaccggtcccaactcatcaatgccacgctttaaaagcttgagtttacttttcaattcaggaattggcgcgtgatcggctgtcactgcttccttagcggcctcgtaagtcaactgataatcctcggctaaagtattcaaccgagcatccaaacctagtttaactcgattcaaagcaaccgcttgctgctcggaagttgccatagcttggtgttgctgctcataagtggtcgtaatacgcgccgatatttgactcagcttaccacgattttccgccttttgttgtgttaatttggtttgatccgccttgagctgctttaattcagtttgcaaattcgcgatcgtagcggtacgactggccttttttgcagcagtttcttcggccgtcgcagtaatgtgctcaattcgttgttgcaaatcggtcgcttgggcttgcgcatcgcgtgcttgcgtctgccattgccgttgctggtcattcaaggtctgcaaatcattggttgtgactgctagcttggtcttcaacgcattaaccgttgctgcatgctgggtgctggatgccgttgccgccgcaacagccgccttagcattttcaatagttgcttgtgcttcagcaatatcttgaaccaattttttaccttggtgctgcaactcagttaatttggcactaagatctgcttgcgccgtatctgcttgttgcgccgctgccagctgacgttgcgcctgacgcaaggtttccgcttgggctgtgtgctgactcgtaattgttgtcaactttgcggttaatgcctgtgcctgttgggaagccgtttgccaagctgcctgggccacgttttcttttttcgtcaaagcagtcagatcagcttgctttgcctttaatgtttcaacaagcgtttgcagttggacctttaaatgccgggcctcttgactgcgagcaagcggcgatgcttggcgtccctgcttgacttggcccccagtcaacgaaccccccggatttaaaatgtcgccagctgttgtgacaattcgataacgatggtgggtggtattggcaatcgcgatggcatgtggcaaggtatccaccatcaaaacgctgccgagtaagttcgccatgacgtgtgccaaatctgcaggatattgggctaattgcaacccagtgcctaaaaagccttcagcaccttcaaccaactgtagaaccgcactgggcagctctcttggccgcataacggcagccggcaggaaagtcgccctacctgctcgttgttgcttgagcaggctaatggcgcgttgtgcagccgcttcgtcacgggtcacaatggcctgtaagttgctacccaaggctaagtcaaacgcctgttgataggcagttggaacctcaagtaattctgcgaccgcaccaatcactccgggaagttgatccttatgctttaaaaccacccgaaccccattgtaaaagccagcataatcatcattcaattcggataacgtttcatatcgcgcccgactgcgctgataggtggccagctcgtcttgataagcttgctgttgggccgcccgttgttgctgcaatagatcacgatcagttttggcctgctcaacggctgtttgctgttcatcaacctctgcttgcaactgttgctgctgcgtcaataatgcagtgaccttggcttcctgatcctgtgcatgtttactcagttcgtaaatccgacgatcatgcgcagcattttggctggcggctaactgttgatctttttgtaaagcagcctgagcatttttgttatcggcctgtgattttaacagatcaatataatgattctgggctacttccacttgttgattcagtttggctggatcctggtttgcctgtttctgctgagccaattcttgcttaattgcttgctctttttcggcggcagcagttgtttttgtcttaagttccttcaatcgctgatttgcttctgttaacgcttgttgagcacgcgccagtcgttcctttaaatcggccaacgtggtttcagcattagcagaacgttcactagataggttggcttctccgctaagattctcaagcttcatcgaccggctcaagacctggtcattcaactgattaagctggttctcaaactgtcgatctacggcacttaaccgctccgactgatcttccaaatctttaaccttcgccgtcaaagcggcgatggtttccttggtgaccttagcctcaccttgggttttctcctgttcagtcgctagttgttcgatctctaaggctaataaggtttgatgaatctgatgatactcgccggattgttgttgatagtccttagccaacgaagcctgctcacgtaatggttccacctgatgcttcaattccacgataatatcgttgatccgcgccagattatcatcgttattggcgagttctcgttctgccttggttttctgttgtttatatttataaacgccagcggcttcttcaataatgccccggcgttcttctggtttactattaaatatggcttcaacccgcccttgggaaatgaacgaaaagctttcacgccctaagccggaatccatgaacaaatccacgatatctttcagccgaacatcttgaccatttaataaaaattcagatgtcccatctcgataaagtcgccgagtgacagaaacttcatcaggttgatttttcagataaccatcatgattatcaaaagtcatcgtgacagatgcacgattaagcgctggtcgcgtatcagtgcctgcaaaaatcacatcgcccatccgttcgccgcgcaagcttttagcactttgttcgcctaaggcccagcggatggcctcagtgatattacttttgccactgccattaggtccgacaatcccagttaaacccgacacaaaatcaatctcagttttgtctgcaaatgatttgaagccattaatgattaaacgctttaattgcatgatgaccccaattctacttaccgcttcaagctggctaatgcagcttttgcagcagcttgctcagccgctttcttattcttgccaaaaccggtacccaaaacccggccatcgacttcgacatcaacgtggaactgccgctcatgggctggtccctgctcatctaataagtgataaacaatcgccacatcaccattttgctgcaaaacttcctgtaaagccgttttgtggtcttgatcggctgaaaactcacccgcgtcaattttcgggaaaataatctgctgagcaaaccgaatgttggcatcgcgtccttgatcaaggtataaggcgccattgaaggcctcaaataaatcttctagcaacgttaagcgtttccgcgccccagctttttcctcacctttgccaagtttaatataccggtcaaagtgcgcttcttttgaaaaagccgagaaggccgctgtctgaacagccgctgcccgaattcgggtgagatcgccttcgggtttgtcgggaaacttgcgatacaaataatctgaaactgtcaattccaagacagcatcgcctaaaaattccaatcgttcattgtcttttaaacctaattctttatgttcattcacatatgaggaatgcgtaaacgcctcatccaatagactgaggtcatgaaattcgatcccataacgttgacgcaattcactcacaaactctgaggcaaccattaaaaatcctcctcgaaaatgcacgcatgagctcgtgaacggcttgggtcataagtttagaagtacctatcagaggctggctatcacttctaagcagctgacacgccattgctaaaccggacgcattcacgcgctctttttttattaccttctaattatacaagagcgcacaaaaaaagacacctgcgattgcaggtgccctgtaagatctaacttttacttagaagcacggctgctgcttgtaacagtcatcttagcccaattcaagttagcggttgatgcatagtcaacactcgcgttcttgacgcgcttgttaaccggatagatttcttgacggtacagagtcgggatgacaaatgcttcgtcattcgcatacttctgccaatctttcaaagccttggcacgatagctagcacttaatgccttctggccatcaatgtcgttcaacaattcggtgttctttgcggaaacaaaccgactgtagttgaatggtgctttttgagagtacagatccattggtgaaggatccgaagaaagactccaagccgctgcgtaaacatcaacgtccttgtcatccttttgaactttgtcgtagaaagagttaaattcgatcggacgacctgttgtcaacttgacgcgcagaccaatcttcttccattgctggatgtagttttgtgccattggttgagcggttgagccaccagccatagttgcaaagttgattgtcaacttcttgccatcaggatcggttcgataaccatccttgcccttcttataacctgccttatcaagcaaactgttggccttcttgatattcaagttataaccatcaatatcggcatgaacatctttaccaaagactggcggaatcaaggttgttgcgcgagaacgcgtgccgttatagaacttagcagccacttgatcgttgttcattgcgtaacccattgcctgacgcaaactcttgttagccatcttagccttaggattatagatgttttcgctcttgctatggtcccatttacctaacttaaagccaatatagttataggccaagctctgtcgtccaagattgtcataaccgccgatactcttccaatcattgtagctatcagctggcatgttataaacaacatcgtacttatgattcttcaatgctgatgtaatagaggcagttgaaacattttcaaaagtgatcttgtccaatgttggcttgcctttccaatagtactggttaggcgtatattcaatactttgaccggcaacaatcttgctcatcttataaggaccaaagaagagcggctgtttacgaactttgtcgcttgactctagcttgtcaaaagcaacgtcatgtagatagtgatatggagccgcgttttcaaggaaatagccgttccctgaagtaccaaacgaaggcttcatctgcttgaagtgaatgaccattgtatcgccattatcacccttgggcatggtcaatccagaaattgaatcagctttaccatcatggtattcggtcaagccttcgatgttctgaagggattcagtataccgttggctcttagtagctttgttagccatgatttcatacgcataaaccaaatcacgggcaacgactggttgaccatcagaccatttaacatttggtttcacagtcacggtaatcgtcttggcactattgtcctgcttcaaggtcgcagctccggtgttgttgaacttaaatttgctgttgtaagcaaataaagactctgctgccgggctcatatattgattgtcataattgtcggtgtacagctcttcgttaaagacccccttaaatggtgaatcattaaccaccgccacattgacattaccgcctttgatcgcctttgcggagttgttgtaagaaaccgggaacttcacagctttattagctgtacttgagctggagttcgagctcttactgccacaggctaccaaggtgatcgataaagcggtagcgagcgtgatcattccgaacacagaacgcttcttcatactttttcccccttccgcgtcgtcatcgcaatatgtaaacgaagcaacgcttcatgtgagttaaatgatagcataattagaacagaaaaaccaacttttgggcacattttttactttttttcttcaaaaaaggagagacacttcgatttctctaagtgtctctccagtgattttcagaaaatgaaagtcaacctcatccgcgacgctggcgtgaatccgctgcacgacgcagtgcttgacccacaaagttgatcgacagggatagtgtcagcaagaccaacacggctgggaaccaaacccaccaacgatcaaagatcaggtcggggttggaggcatagccgatcagcgtccctaaactaggcgtctccattggcaacccaaagcctaagaatgacagagcggtttcaatcccaatggaactggcgatggttaaggtcaaatcagtgatgattaaggaactgatgttaggcaagacgccggtgaacatgatcttgaaattagaggttcccgacgttttcgacgccatgacatactcactgcgcgcttcagagagcaccagcgagcgcatcagtcgagtggtcgtcatccaatagaacgccgccataattaagataatggtgatgacgttgtactgcggaataatcgtgaccaagacaatgatcaccagcaatgatggaatgatcatccagaaatcgaccagtcgcatgatcacggcatcaatcaagccgccgaagtagcctgagattgtacccagtacgacacctacaaattcaatgatcaacgcaacggaaatcccaatggtaatcgaatttcgggctgcaaaaaacagatacttgaacatgtcacggccaccctcatctgtaccaaggatatagccgccggttccgggcgccatatagcgatccaaaatattaacttgcgtcgcaccgccgacattgaacatcagtgaaccgatgaacgcagcgaggataatgaacacagccaagaataaggacacaacagcaactttatctttgcgaaattcattcaaaatcaccttgaagttagaaggtgattgttcaactttggtggttgccgccacctcatttgcattattttgcataagttttccccaccttctactcgatccggatccgcggatccacgatactcatgatgatatctgacagcaaattccctaacaacgtcaagaaaccaaatagcaacaccagcgagatgacaactggatagtcacgactggtcatagaagaaacaaacagttggcccattccgggataactgaacactgtttccagaataaccgatccacccagtaacatggtaatttggttccccataaacgccgcaatcggcaataaggaattacgcaaaatatgtttgttgaagatgacgcgatccggcaccccttttgaacgggcagtccggacaaaatcttgtctcgtattatcaataacgccagttcgcaaatactgaatcgtgcttggtgtggtgataatcccagcaaccaaggctggcagaatcatgtgataaatacggtcccagacataccctaacgtgcccggattataagtggatgacacactaccaccggttgggaaccactgcagaaagaacccgaagaaaattaaacccaatagataaaagacgaatggcggtaccgccatcaaaatgaaagagccaacagagatagctgaatcccgcttggtgccttcgtaacggccggcaataacaccggctggaatagcgataacgtacagaataaccgttgacatcaaggccaaccagaaggtgttcacggcgcgttcgccaatcagaccggtaacagaacgtttataaacgaagctttgtcctaaatcaccgtggaacatattgccaacccatttgaagtactgaatataccaaggatcattcaaaccatattgctggcgtaatgctgccatctgcgcagcactttgaccttgcgagaaattaccagtcaatggatccccgggcatcatctttgatagcatgaaaaccaggacgcttaacaagatcaattgcgggatcatgattaagacccgtcgcagaattgttttccacattaatcatgcactcccttcatcgttgaatctggcagcgcaacaaaatgtgtgtcggaaatcttctggagatccaaaacgcggccttctttagaataatattttgattcttcttctttaaaaacacgttcgacttcacgacgatgctctttattcttcttccgatcatcagggttgatgtcaggaatcgcagaaagcagtcgttgcgtgtagatgtgctgtggatggttgtagatatcttcacgcgagccgatttcaacaaagcggccgcgatgcatgatcgccatgttcttacacatgtgcttcacaacacctaagtcatgggaaataaacagataagaaatattgtattcctcttgaatccgcttcatgaagttcagcacctgcgcctgaactgacaagtccaacgcagagaccggttcgtcagcgataatgagcttcgggttcgttgccatagcacgggcaaccccaattcgctgacgctggccgccggaaaactcatgcggatacttgtacaaagcatcgcttggcataccaacaatatcgagcaattcttggacgcgccgacgttcttcatccccagtaagattctgaaaattgcgaattggttcagcaataatatcctcaattcgctttcgtggattcaaactagataaagagtcctgaaaaatcatttgaacgtctttgttgtactgcatatgtttccgaacgctgcgtttggtaatatcctgcccttgatacataatcgagccggacgtgaccggttccaaacccacgattgctttgcctgcggtggattttcctgaaccggattcgccaattaacccatatgtttcgccttgttcaatatcaaagtcgatcccatcgactgccaaaacatgatccgtcacccgattaaaaaaccccgagcgaatcggataatgaatttttagatttctaacctcaatcattgccataatttactcacctttttcagctgcttgttcgtcatccgggaaatagaagtccttgtagcaggtacactgaacaaagtgatcagggccaacttcgtgcatgatcggatgctcttcatgggctgatgcaggaatccaaggaatccgagccgcaaaccgacaaccttctatctgcatattcttcaatgatggcacaacgccttgaatgacatgtaattcgtcgtcatctgaatctgtctgtggcatggagcgaagtaaactgcgcgtgtatgggtgcgttggatgcttgaaaacatccattaccgaaccactttcaacaatttggcccgcatacataactgccacacgatcggccgtttcagcaacaacaccaagatcatgcgtaattaaaataatgccagaatgcatttcccgttggatgtcttccaacagatccaggatttgggcctgaatcgtcacatccaaagcagttgttggttcgtcagcgatgataatcggtggtttgcaggcaatcgcaatggcaatcacaatccgctgccgcataccgcctgacaattcgtgcggatatgaacgtgccgttcgctcagggttgggaataccaacttggttcagtaattccaagacgcgactttcacgctcttctttgttcatcttagtgtgatagaccagtgtttcttcaatctgctcaccaatccgcatcaatgggttcaaagcagccaatggatcttgaaagatcatgccaatatctttgccacgaattcggtcaaaaagggcctcattcaagccaacaagattaagattgttgtacaaaatatcgccagtgaccttcgtattgcgcggatcatgaaggccgataatactggttgccaaagtacttttaccagaacccgattcgccaacaatagctaagatctcatcttttcgtaacgtgatgctgacatcatcgaccgcatcataatagtcgtctccgagtctgaatcccgtgtgcagatgttgcacatccagcagcaaatcttcaggtttatccaagcgaactcctcctttgcgtcctcgacgcaagattaaaacaagatgagatttttgaaataattgtctctaagtataaagaaattatagcggttatgcaagcgaaaaatgcgttctaaagctgttttgccatgtcaaaagcgaaaatttgatggcatcattttgggccctggtcgccgaaatttagcgaactgtgggcgctcaatgagttcgtagcagcgaatatttcgaaaagaataatcttttgatgtgtcgaacgttgcaacttcttatctgtggccaacatcttcggttcgctgaaagacaaacgccatccccaaggccttatccgtcagcgtctcagggacagtgcccaagtgcgctcatcacgctccagatcaaggtctattacacgatggtttctagccaagcaaactcttaaaaaaagccgtccatctctggtcggctttttgtcacttctgatgggcgttgatgtaatcaacggcatcttgaactgttttgatgttttcggcgtcgtcatcggggatttctgctccgaaggcatcttctaactctaaaacaaattcaacgatgtcaattgaatccgcatcaagatccttttgaaagttaagtgtcgggctgattttatcgggactcagttgaaaatggtcctgaattaggccggcaattttttgataaatttcgtcttcactcatgttgctcctccattcatctgccaatttagtgtacttgtttgccactggaatgtctacgctttctcagcggttttcgcttcggcaacttctggatgggcatcaaaataatcggcaactttcgtaacggtgccattttgaaccattttggcggtttgcagcaaagtataataaacggtctctgcatctgccgcaccatgagccttgattaaaggtgctttgagccccagcaagaccgcgccgccgtatgacgaaatatcaaaggttgaggccatcgacttgagattacccttcaggaacaaaccgcctaatttgccggaaaggcccccttcatagatggctcccttcagcatgtgcatgaccgtacgcacagtgccttcaattgccttgagcgttgcgttaccggtgaaaccgtccgtcaccacaacatcggctggaccgtttaggatatcactagactcaacgttaccaacaaaattaatccccggagccgcggctaataaatcatgagcctcttgatgcattttgtcgcctttgttggcttcagtgccattgttcagcaaaccaactcgtggattttcaacgttgcgaacatctttagcatagtaactgcccatgatggcatattgtaacagatgatacggacgattttcagcgttggcaccgacgtccagcatcacaaagcctttgccgtcaactgtcggcaaggttggtaacaaaccggggcgttcaatggcacgaatgcggccgataataaacaagcctgccgccaacaaagctccagttgagccgagtgaaaccatcgcgtctgcctcgccttgtttaacggcttgagcggctaagaccatggaagcctgttttttgcggcggatagcacgaacgggttcatcgtcgctgttaattttttccggagtatgaatgattgttaaccgttcatcatgatgaataagcggtttaatttttgcttcatccccgtacaaaagaaatgtcaattctttgttggcatctctagctttttcgaccccggcaatgacaacttctggggcgttgtcgccacccatggcatcaatcgcaattttcattcaattcgttcctttcaagttttaatccaaactaccgagcatctgccggctttccgccaagtaagcggcaagcggctgatggtcagactgcagcaaatgtggatcggttttaaaaatctgggccacaatcttttgcgcagcttctagggttggaaaatcgcccactggatcagcgactttgaactctggtaaaccagattgcttatctccaaaaatatcacctgaaccccgcatttccaaatctttttgggcaagtaagaacccgtcgttggtcttggtcataatttccatgcgggcaattccttgctcatttttgggatcagcgataagcagacactgtgctgccttttgcccacgtccgacacgcccgcgcaactgatgcaattgagaaagtccaaagcgatcagcatcaaaaattgccatgacagtggcattaggtatgtccactccaacttcaacgacggtggtcgaaaccagaaccgcgatcttcccatcgctaaaagcacgcataatctgatccttctcgtccggcttcatctgtccatgcaataacgcaacagggccaagattgccgaccgctttttgcatatcaacaaaaagctgctcggcattttgcaaatcaattttttcggattcggcaatcaaaggggtgatcgcaaacacctgactgcctgactgcacctgctcacgaatgattcgataaacttggtcaatctgatttttgcgcagccacatggtcgcgatcggcttgcggcccgcaggtaattcatcaatcgtggagacatccatttccccataggctgtaatggccagtgttcggggaataggcgtcgctgtcattgacaacaaatccggcttttgtcctttttcttgaaggatcttgcgctgattaaccccaaatcgatgctgttcatcaataacaaccagaccgagcgcatgaaagtcgacccctttttgaatcaacgcgtgcgtgccgatgatgagattcaggcggccatcacgcaactcacttaggagctcgcgacgctttttggttgacgtcgagccagtcaacaaccctaatttgactggaaaatctttgaataactttgtcaatttggcaaaatgttgctcagctaacacttcagtcggcaccattaaagccgcctgaaaaccagcggtcaccgccgcatacagaacaatggcggcaacaaccgttttaccgctcccaacatcgccttgtagcagtcgattcatatgatttggccgccgcatatcggcacaaatttcgtttaccacgcgtttttgagcattcgtgagcgcaaacggcaatgtcgctattagcgcgcgcaaggcctgattgtcataaggaatcgccaacccgttgctgctgttggcattcagttgttttaacgcctgaatttgcaattggaaaaggaaaaactcccggaaaaccccagtacggcgagccgcctttgcttctgctggcgtatcaggaaaatgcatgccatgaaccaactgagcatcactcattaagcgataatgctcgcgaatgctggcaggtaccaaatcgttgatattttgctgatcgcgttcccaggcagctttgatcaagtcgagtaatgtccccatgcggacatttttgttgacggtgtaaatcgccgccatcgacggttgatcctgcgactgtgtcgcgagaattttcatgccggtcagactacgacgcttggcatcccattttccaaagattgctgcttcatcacccatctgaaaacgatcttttaaccatggttgattaaaaaacgtcaccagaatcacgctacgttcaatttggagcttcacgttaacgcgactacgatgcggcccaaatcgactaataaccggatcggtcacaacgatccccttgaccgtcaatttttcctgatcggctgcctcggcaagatccttcactttcaaatcatcgtagcggtaaggaaaataaaataggagatctctaatggtgtgaataccaaggcttgccagcccagcttcacgtttcggaccaacaccaggtagaacagtaacgggatcagtcaaagccatcaaggcacctcctttttcaaaatatagcaaaccactaatgagtgtgttactgaccatctggcctaatgacgccaatcgcacgcttttatataaatttcgcaaaaaggtgccccgcatgcgggacacctgtacgcgatagctgtttaagcctactcaactgagacgaaataaggataaaccggttgatcaccttgatggatttcaaattccaaatccggatattgcttaccgacagcatcggcaatcgcctttgcttccgtttgattagcatccgcacccacgatgatggtcacaatttcactatcgtcattgatcattttatcaatcatcgcaatccctgctgcttcgcgatccttatcagtcactgtgatcgtaccgtcgataatccccatccagtcgtgatctctgatcgccaatccgttgatcgtcgtatcacggatggctcgggtgattgacccgctgatcacattcggtagttgggcagtcatttcactttgattagtggctagatctgcatcaggactgtaccctagcatcgcggtcattccttggttgatcgtcttacttttgaccactgcaacttcaacgtcagtcgccgcttttgccgctgcttccgcggccatgaagatattgccattgttaggcaagacgatcacgtgcttggcatgcgctgctttaaccgcatccaaaatatcgtttgtgcttggattcatggtctgaccgccattgagcacatgcgtcacgccaaggctcttgaagagttctccgagtccttgaccagccgcaatcgcaacgacacccatttcagctaacggcttttgggccacttgttgatccaatgcgccttcacgttcaataatgctctcctgttgcaagcgcatgttatcaactttgattttcatcaatgaaccaaattgctgaccataacggaaaacagtccccggatgctcagtatgaacgtgcaccttgaccacttcttcatcagaaataaccaaggtcgagtcaccgagtgtattcaaatagttacggaacggttcgtagtcaaaatgtttgaggttttggccatcaccaagttcgaccatcatttcggtacagtagccgtatacgatatcggctggatcaagctgtacttgcgcactttgatgatgcacagcattaatcatttcgttcatttcttcgtcagtgacgtcatgaacatctgaactaattttaccggacaagccttcttggaaaccctcgtaaataaaaacaagtccttgtccaccagaatcaaccacgccgacttctttcaagacggccaaaagatcaggcgttttggctaaggcacgtttagcacctttcacaactgcctgcataacaactaaagcatcatcagagccattagccgcttttaagccagctttagccgcttcacgggcgactgtcaggatcgtgccttcaaccggcttcatgacggctttataggccgtctcgacgccatgtgcaaacgcatcggctaggtcctgagccgtcagacttttcttatgcgccacgctttttgcaaagccacggaaaagttgcgagctaatgacgccagaattgcctcgcgcacccatcagcaaacctttgccaagatgcttggctaagtcaccaactgactcatcattagactccaacaccgcttttgcgccagtttgaaaagtcaggttcatattagtgccagtatcaccatccggaactggaaaaacgtttaatgaattcacaaaatcagcatttttattgatgcgatgtgcggctacccggatcatatcctggaatttagtcgcggtaatttcggttactgccacggaacatcctcctcgaagaacttcaatatgtcacaccgttaacaaccggtgcgtgtacgtcagtcgcctaataccttgacgccttggacgatgacggtcacttcatcagtcgtgacccccaacatcgtttcgaggttgtattttactttgtcttggacatttcggcaaacttctgaaattttagtgccataactgacgataatgttgacttcgattttcacgccattatctgtctgacgaacgacaacaccgcgcgaataattttcgcgtttcaaaatgtcattgagattatcgcgaatctgattacggctagccatgccgacgataccatagatggacgtcgccgcaccgccaaccaccgtcgcaatgacactgttggaaatgtcgatgattccgtatttggttttgattttgaccgccatgctgtttcctcctaagccattcgcgatgattttcacatcgcgtacaattctaccagctagtttagcatagctaagcgatgactgcgagcagagcgtgaatcagcccgattagaaaccgaagtgtaagcggccttggttgtgatggccggtttttggccattgcatccaaggtccttacacgtaggtttctgggcctgttcacgcgtttccgaacctccaagctcacaaatacctaaattttgatcacttaaacctgaggtgcctatgtgtcagtttctggtcttgtcgctacctttatgagacaatcgttaacagtaacatttttcaaagaatatcggactatttgtacttacccacccaattttcttagagtctgatcacgcgtttattttgacctgtcaagtaattttactttgcaaaaattcttgcattaaccgcgggcctatgataagttagttgagtgaaaaattcgagggtgaccttgaaaaaaaggaggtcatattgtggctaaagatattattactggtcgtcataccacgtttggcaacaagcgttctcacgctttgaattcaagccggcgccaatggaaagccaacctgcacaaggttcgtatccttgtcgatggtaaaccaaagcgggtatgggtttctgcacgtgcccttaaatcaggtaaactgacccgggtttgatcccataacatttaaaaaggtcctgacaatgaatgtgatgcatccttcattgtcaggacctttttttgttgagcgcgagcaggagcgattagaaaccggagcgtaagtggccttgggtgtggtgaccgacttttggccattacgcccaaggtccttacgagtaagtttctgcgactgcgagcgcgttatgacaaaacgcgagcaggagtgcctagaaaccggaacgtacgcggattttaagcggttggcctaatatccctcatacaatcggtgattcgttggacgccaactaatttgggaaaaccttgggctaaaatttccttgccatgccaaacgccgcaatctccggccagttgggactggtacgcactttttcaggatcttgatatgctgacttctcagatcggtagttcattaaagcaaatcaggaagaaaacaatgcctaattatccaatttttgcccgcgccgatcacgactataaataattgccacctgaccagtcgtccaactcacggtgaagggctgcttgccaagaaactcattggaagcccacacataaggatagcccgctcgccatggttttaatggatatttcgctccgacaatggtcaaatcggcaactggggtgagattgacaactgcaacgtaccgataacctggcagcggtttaatttcatgctcaccggggctgtaataatcaacccaattttgcacatcaaataaatgaaggcgttcaacatctgctaaaaagcgcggttgaagcggtaagaaaagattagacaaaaaatgatctagtcgtccaccagtcccgccaaccaaggtgacatcgccggatgaagatgcctgaagtgccgctttaacagccaactctgtatccgtgtcatctttttcagaaggcacctgttgtagcttctggacatgcccacgaactagccgcaattcttcaagcgttaaggaatcaaagtcgcccactgccagttcaggatgaatccctgcacgtacgagtcgcaatgtgccgcgatcaacgccgatccatacaccgggcaattgttcccaagcggctggcaagcatgcctgtggaccacctgccatgatgttgacgtgcgtcatttaacagcctcacacaagctattcatcgcgtcaccgacatttttggacccaaaaacatacgaacctgcaacaaaaatatctgtcccggcatcagctgccgccttcacggtttgattgttgataccgccatcgacttcaatgtcaaaatgcagtttccgagctttacgcagctgatataatcgatcaaccttgtccaccatcggcgtcaaaaatttttgaccaccaaaaccgggattaaccgtcataaccagcacttgatcaaccaacgggagaacttcttcaagactgctcaatggtgtgcccggattgatcacaaccccagcgcgaacgcctttctcgatcacatgctgcaaaacgccataaagatgatccgtggcttcttcgtgaaccaaaatcgtatccgccccagcttcagcaaaatctgccacccaagccgctgggtcactgaccatcaagtgaacctccaatggcagactggtaaccggacgtaatgcttggacgaccagcggaccgaaagtcagatttgatacaaaatgaccgtccataacatcaacatgcagtaaatcagcaccggctttttcaactttttcgacatcccgcgcaagatgagcaaaatcagcacttaaaatcgatggggcaattttcataacgatctcctccatatattgcgttcatccggccattaatcagcttgacgtccgcattttgtctaatctaagttacttcttcttgtaaactgggcgcttgccgcttaactcttcacgaaactgtaagtagttatcataacggctttgcatgatatcgccagccgccagtgccgccttaacggcacaatgtggctcgctaacgtgctgacagccgcggaatttgcaattgggtgctaacgccgcaaactcaggaaaacggtcacgcaaatcatctaaggtgacgtccagtaaaccaagcgatgaaaaaccaggtgtatcagcaactaagccaccgtgaatcggataaagatcagtggtgcgggtcgtgtgccggccacgatttaacgcatgactaatggccgctgttgccaagtccaatcctggcacaagatgattcaacaaagtagacttaccagcaccggtttgtccagtgaaaatggtcaatttatcggcaaagctcgcttgtacttgcgcgaggattgtcggatcaaagggcttgtcaggtgcaaaaaccggatagcctatttttgtatagccggctaaatcttgacgaatcttcgttaatcgctgaggctttgttaagtcggtcttggtcagataaatctccgcgtgaatatcgtggccctcaagataaaccagaaaacgatccaataggttcttagaaaagtccggctccacggcggaagtgatcaaaacggcttgatcaacgttggcaaccggtgggcgcaccaacgcattatgacgcggtaataccttcagcaaatagccttcatcatccccttctcccggttgaaaagcagcaatgtcgcccaccagcggcgtaattttgtcgttgcgcaaactgccgcgcccgcgagttcggtaagttgtcccattcacagcgatgtcgtaatacccgctgatctgtttaataattcttccagttaagtcttcactcattgagtaatgttatcctcctgcgcaatcacggtaccgtcccggacaatccgatagctgcctgggtatttcgtgctaacttgcaacgtgatggtgatttgatcatcagccgtgatgttaaaggaccgattaatggtactaatgttatgtgtcttatctgcgaagaagacctgaataccgttgggtgcgggcgcagcactactactgctactagtgctgccactgctattgctggcacttgcggtactcgaactggccggtgcttgatagggaattgaaattgttttcgaccaagttttggtctcttcaggatctgggccttgagagaccgaaacattgactgtgtcgcctggtttaacctgtgtcccagcagctggcgtttgactgattaccatgcctgtatcgacggtatcagagtgcgcttgagaaatcacaatcttaagtccgacttcattggcgtaatctcgcaaacttttttcggtataacccgtcaaatcacgaagcgcaaaagtatttggcttgattgcaacggaaacaccaaatgtgatcgtcgttttgtccgcaatgacctttttgcctgctttaatgctttgtgacacgatcttgcctgacggttcgtcattggcgctgacctgtttttctttgacggttacgccgcgtttttgcaagtctgacttcacgtctgtgtaatcttgcccaacataattctctagcgtaaattgcggctgaccgcggcttaaaatcagcttgaccgtcgagccttccttaacactcacctgccgttttggatctgaatcgatcaccaaatccttgctaactttcgtggaataagtgtacttgtatgacccaacttttaagcctgcgctggtcaaggcagtttttgcctgggttgtggtcatgccccgtagatcggggacgtccacatcccttttctgattggcaaaaactgcgccgataccaatcatcagcagcatggcgacaagtatcccgatgccaataatccaccaacggcgactttttttcttaggtcgtgctttcggacttggctgactcgctggactgtcagcatctcctccttcgtcatgcggcggtttgggaccgttggggatgactggcatgattcgtgtctcatccagatcatctttaggaaccacatactttgcttcatgtgctcgtgccggactcagcgctgtcttgaggtcgctagccatggcatccgcactggtatagcgattagccggatttttggctgtagccttaaaaacaacattctccagtgcctgcgggatatgcggatcaaacgcgcgcaccgacggaatttcttcttgaaaatgctttaacgcaatcgtaactgccgaatcaccttcgaatggtacagaaccagtcagcatttcaaaaagaataatgcctaacgcataaatatcactttgacgggttggcatactgccgcgcgcctgttccggtgatagatagtgcaccgaccccaataatgagttggtcatcgtcatcgaattctccgataacgcgactgcaatcccaaaatcggtgatcttagcattgccatccggatcaatcaaaatattctgcggtttcaaatcacggtgaatgatattgtgatcatgcgccgtctgaacggcagaaaggatctgttccatcatgtcgaccacgcgctgatatggaatggggaaatgctcgacaatgtagtgctttaaatcagagcctttgacatactccatgaccagaaattgctgaccttgactttcaccaacgtcataaatcgacacaatatttggatgaaccagctcactggtcgccatggcttctcgttgaaagcggcgaactgtatcggggtcattttgcaaatcaagccggagaaccttaaccgccacatcgcgatcaagaatcaggtcgcgtgccaaatagacgttggccataccgccttcgcctaatgttttgataagcttgtagcgctcatttaaaatcgtccccggctcaatcattgcggctccctccgatcctgatgaatgatcaaggcactgatgttgtcaggtccgccagcagcatttgctttgaggatcaattcttgagccttgctgccaatcggcatgtcctgacgcaacactgccgcgatatcttcattgtcaaccatgttggtgaggccatcagaacacaacaacaaatagtcgtcatattccatatcgtaaatcgtcacatcagcatcaacatcactgctgacaccaagcgagcgcgtgatcacgttacgctgcggaaagcgtttggcttcctcaggggttagttccccatgtttgaccaactcattgaccaaactatgatcctcagtaatttgaactaaatggccattgcgatagaggtagccacgtgaatcaccaatatttgccaccacgaatcgtgtaccgctgataatcacagccacaaccgttgtgcccatcccagaaagatctgtatattgtttcgctttttgcaaaatcacatcattttcctgctgcaactcaaaaatgagccaacggacgatggactcgatctcggcagtatctgttttctcaaaagcataacctaaatgcgatactgccatttcactagcaacatcaccaccacgatggccgcccatgccatccgccaccaaggccaacgtcgcttcggattgatttttaaaaataccgacatagtcttgattatttggtcgccgacgaccaatatcagtgcgataagcgaactccatacatacccctcatttgcgacgaatcaaactggcaatgaaaaatccgtctgtatcataatcatctggaaacagttgcagcgctggtgcgttatgcgccttgtgcaatggcttcaaggttggtactgaaacttgctcgaactcaggatgagccgccaaaaattgtgcaaccacatcttgattctcttctttcaccattgtacatgtactatacgtcaggcgaccaccgatttttaaggttggtgccacactatttaagattgctagctgaatttgttgtaaatgcgccggatcttcaggcgtttttgtgtacttgatttccggtttacgtcgaattaaacctaatccggaacaaggggcatccaccaaaattttgtcaaaagaattggcaggaaatgttgtcgcaaccttacgtgcatccagcacctgtgcatgaatgcggtccgtcaagcccaagcgtttagcgtttttattgatcaaacgcactttgttggcgtgcagatcaagcgccgtcacttgtccgccttgttttggatcaagatactgagcaatgtgggtggttttaccgccaggagcggcacaagcatccaaaacaacatccccaggctggatgtctagacttggggccaccagcatcgaactttcatcttgcatcgtatactcacctttgacaaatgcggatgtccctgctaagtggccactaggtgcaatgaggccaattggggtcaaaggactttccttcaaatcggggaattccggctttaaagaagcaagcaaggcagctggggtgattttcgtcgtgttgacgcgcagtgaagcatgcgctgggacattgatgacattcaaaatggcacgggttttcggttcacccagttgtgccgtcaatttttcaacaagccacaccggcgtactgctttcgattgacaatcgcttcacaggatcagcgattgcggctgggtcaggaaaaccagttcgctgagcatttcgcaaaaccccagtcacaaatttggcgattccttgatgtccaagtttcttggcaatttctgtactatcaaaaaaaaccgcgcgttctggtactttatcaagatactgcagttgataaacggctgtatcaagcaaacaccgaatccaattgtcgagtttccggcctttgatgaaaggtgccagataaaaatccaacgtcagctgatgctggatcacaccataaacgatgtttgtcagcaagccagcatcacgcggcgtcaacttgtgactattaatcacgtgatccaatgtcagatttgaatagccaccttgcccagtgactcgcgacagggtttcaacagctaataaacgcggattattcggggtcatcagtaatcacctgctgtcctgagaccaattgttggcccggtccattcaaaaagtcggcaattgattgtttagccttgccagccggttgtagttcatccacttggaaagtggtttgttggccggcaaccatcaccaaacgatgcttatcccgttcaacaatactgccagcaggaagcgttgatcctgctgatagcggcgtaatcgcccacaacttcgtccgttgaccatttaaataaacatacccgccgacatcgggacgcaacgcccgaatccattgatcaagggccttggctggcagatgaatattaagatgctcttgctctttggtaatagtcggcgaaaaggtcactttatctggatcttgaggggtccgggtagccgtgccagcaatgatcttcggcaacgtttctagtaacaaatcgcgaccgagcaatgacaatttggcaaaaacggttcccgtatcatcagcacgcgtcaatggcagttttgcctgcgcaaacatatcaccagcatccattttcttcaccatttcgataatcgtgacgccagtttctgaatcgccattcataatgctgtactgaatcggtgcgccaccgcgatattttggcaacagcgaaccgtgcacattcacagcgataattttggctgcttctaaaaattttgttggtaaaaattggccatatgccgccgtgacaatcaagtctggtgccatggcgatggcttgcgccagctctgggctgccactcaatttttccggttgcaaaaccgggatatcatgtttctgcgccgcctgtttaactgggctagccgccagccgctgcttgcggccaactttacgatcgggttgcgtcatcacggcaagaatgtcgtaatgctgggcaatcagtccttcaagaatcgggacagcaaattcgggtgtacctaaaaaaattactgaagtcattttttcctccaaacgatgagttgctggtaggttggtgcctattttgccatggaacaggttaagacgtttaaacaaatgccaacggttctggatcaatcgcgactaaaaagccgtgacgactgctttgctgggtctcttccaaaatatgctgcagggttgccgctaacgccggctcgtgtttatattttagaacgatttggtaaatatagcgatttttcaaacgagcaatcggtcctggtgtcgggccaagcatgatgacctgatcggatagatgctcacgtaattcttttgccaaagaaaagatagccttagccgcctgtgtttcatcaacatggctcacagcgattttcgttgaataaaaatatggtggataattgccgcgatgccgaatggccatctcttgccggaaaaagccttcgtagtcctgccgtttggcgtattgaatggcataatgatctggattgaaggtctgaacgaagacttcaccgggtttgtccgcccgaccagcccggccactcacctgtgtgagcaactgaaaggtcttctcactcgcccgaaaatccggcaggccgagcgctgtgtccgcattaatgacaccaactaaagtcacatcgggaaaatccagtccctttgcgatcatttgcgtacccagtaagatatcggcctgatggtcaccaaacgcatctaagatccgcgcatggccacctttgcgccgagtggtatcaacatccattcgcaagattcgggcatctggcagcaactgctgcaacttcgcctcgaccttttgggtgccagtaccgtaatagcgaattttatcagaaccgcagtttgggcaacgatgtggaatcggttcctcatggccgcaataatgacatttcaaggtgtgtgtgtccatgtgcagcgtcagactaatgtcacagttcggacattttgccacatagccgcaatcgcgacacatcacaaaacttgaataaccgcgccgattcaagagcaacacactttgttcctgtcgctgtagtcgaattctcaaggcgtcaagcagcgggcccgaaaagtcctcttgcgcgccgtgcgcaaaggcttcccgcatatcaacaatatgcactggcggtaatggttgatcgttaatccgatgcggcagccgcagcagtgtataaacgcccttttccgctcgagcgcgcgactccaatgaaggtgttgctgagcccaacacaaccggtgcatggtgaatctgtgcccgttttaacaaaacgtcacgggcgtgatagcgtggcgccgaatcttgtttgtagctggtctcgtgctcttcatccatgatgaaaacgccgatgttttttaacggcgcaaatgctgccgatcgtgcgccgacaacgacctgagcctcgccgcgcgcaattcggcgccattcatcatacttttcgccatcagacaagccagagtgcatcacggcaacatgcgtcccaaaacggccttttacgcgattgaccatttgcggcgtcaacgcaatttccggcacaagcatcaaagctgtctgtcccgcggctaaaactcgtgcaatcacctgcaaatagatttctgttttgccagagccggtgaccccttctaacaaaaatgttttaggatccctttcggcaacggcagcgttaatttgcgtcacaatcgtctgttgttctggcgtgagcggcaacggcttcgtcaacggttgatgctgcagttccggataaggatcgcggtaagtctcgtggccttcaagcttcagccagcctttttcgactgcctgattaatcaccggctttgtcaggccatattgatgttcaacggtcatcaaagcaggatgctgattgttagcagcccattcaccaattaaagttaacagtttaagttgcttggcggcgtttttacgcacgtgttcacgctcggcagccgcttgctccagtgataattgcgggatcaagtaaaagatttttttaacccgagcacgatccttttttaaatatgaaatagcaactttacctgcttgcgccaatttcatcactgcaacttgctgttcagcgttcaagctaccgatcgccagactgtcagccgttccaaaatatttttgttgttcatcagccgtcagcttaaccggttcagcaacttttaccgcatcgattttcaacatagttggcaacattgtctgcatgcacgcaatccaaaaagaatacgttgtttgcgccaaccacttcgatagctttaataattcgtgatccaaaaccggggccggatcaaggacatctaacaatggtttcaattgaccgtcatagtcgctttggtcggagactgacacgaccatgccgctcacttttcgcgcacctttgccaaactggacccagacccgcattcccgcctgcaaagcgtcttctaagcgcgcaggtacaagataatcaaacggtcgatctgtttgcatcgtgggcacatccacgatcaccttggcaacaattgccaagcgctcaccccttttgttttgctaacatcgttgcaagttgctcaatcaaagcagcagcgacttttggcttgggcatttccggcaaggtcactggtgcctgttctggccgcaataacgtcacagcattcgtatcagtgttgaatccgtgagtcgcatcaacgtgattggccacaatcatatcagcatttttcttagttaatttaagttgcgcatttttcaaaagatcattggtctcagccgcaaacccaatcaatatctgatgcgtttttttacggccaagtgatgccaaaatgtccggattctgaaccaaattcagcgtcagtccagaagtcgcatcagtcttctttaacttgtgatcactgacggttggcaaccgataatcagcaactgccgctgccatgataaccgcgtctgcttcggtaaattcggcatcaattgtgtctgccatggattgggcactttcgacttgtttgactgtcacaccgggaacaactggtaactgtcgcgttgtgaccagcgtcacttcggcaccagctccggccgcggcattggcaatcgccgtgcccatcttacctgaagagtcgtttgtaaggtagcggacaggatcaagtcgttctttggttccgccggcagaaacgatgatacggcgaccacgtaaccgcgggtcatctaaactttcgatgaataaggcaatccgttctggctcaggcattctcccgataccggcatagccttccgctaacaagccagtttcaggtggaagcacgagataattttgttcagtcatcaaactagcaatattcttttgcgtctgcggattttgccacatctggtcgttcatggccgggaccaacaactttggtgcctgcattgccagcagtgtcgtcgtcacaacattatcagcaaggccgttcgccagtttagccaacgtattggccgttgccggtaccacaacaccaagatccgcccaatgtgccaatgccacatgggcaacatgttcaggatgatcaaattcatgcccgtctgtcaatacagccgccttgctgacgatagccaacgtctccggcgtgacaaatcgttccgcacttttggtcatctcaacccgtacatcatggcctgctttgattaaggctcggaccagtaatggcactttataagcggcaatcccgccagtgacaaacaaggcaatatgttgcttcttcatgtcgactcctttcgcacttcaagctaggaccattataccaaacgcacactaaaaagaggcaggagcacttttaagcgccactgcctcctgtattgccagccgtctttaaacgccattgtcatcagacagccagaacgatcgatcgcttattcctgatccttgcgatccaatttttctgcatcacgctcaagcattttagacttaggatcaatgatgacatcgccagccgcaatttcttcaagcgctttgccaacacttttatcagacttataatctgacaacatcttcaaatcaccagattctaattcatgggcacgttttgccgccaatacggctagcgaataacgggacggcaccttttccaatagtttatcaatcgaaggataaataatcatgagatgaaactcctttttctaatagatgggcatgaaccccgcgctatgcgagccagccacagacaactatcttgccaaatctgcacttgctaacatgcccttgtaacgatcaatgacgcgtggcacccgcaagtgctcgctttcaataatacgttcgatgcgcttaactgctaaatcaactttatcattcaccacggcataatcataattttccatcatggtgatttccgaagctgctttgcgaatccgtttatcaatggtcacatcatcatccgtgccgcgtcctttcaaccggtggcgcaactcgctaagatctggtggtgtcaagaagatgaagacaccgtttggacattttttgcgaacctgcatggcaccgttaacctcgatctccagtagaacatcgcggccggcatccaaagtttcgttcacatattttaacggtgtgccgtagtaattctcaacatatttcgcatactccagcataccacctgtcgcaatttcgtgctcaaactgggctttcgtcctaaagtaataatcgacaccatcaacctcaccaggccgcatttgccgtgtcgtcattgaaattgaatattgaaaatctcgataattaccatccagcattgcttgccgaaccgttcccttaccgacaccactgggcccggacaaaacaattagcattccccgctcgtgcatgtgtgaacctctttcgttaagtattactgaacattttgcactttttcgaggctgatttcaactgcatcaccggtgaaatggtgaaaagtgcgcccgtttgagggcaatctgagcatcacggcgccccaaagcaatcatattagcgatggcttcaggccgaaaattaaacagtccaggcagccgctcactgggtttaagatagagatcgccatgatcagagccaatgcggccaattccttcgccgctaatcgcgatgacataatcagcaccaatttgccgcgcaatgtcaacaggcaagtcattaacaaccccgccatcaacataactcaccccggcccgctcaactggcgaaaaaacgcctggcatggcgcttgaagcaagcaaccactcccgcgcctcaggtgcagtcaacacatccagtcgggtcacatgtgcttgaaaatccgggacactggttgtcactgctaacaccgcccgcgaatcgagtttgggggcttgcagcattcgatctaatactggcacaaaatgacgccgcaaaaagatcggtccattcacttttgcttcggaaaaatgctgccaccattgtggtacttgctcgggcagcatacgggcggttccggcagcattgatggcgccaattgacgacccaatcacaaatgtcggacgtaatcgcggccccaatacggcccacacaccggcttggtatgcgccgtgggcagcaccgccgccaaaaacaactgctattgttgccatcgcttgttccccccaaacggcgtgatccactgatttaaaaaaactagttgcaactttgaacgcttgttcgtataatgaaattacaaacaaatgttcggaggcttgatcatggaaaacaaatcatctgcactgcaaaccgttacccgtcatctcgtcgcatcttatcgtgaattcttcgatttggcggcaccaaatgcaaaaatgccttcccatcagcttgatcttttccttgatcaggccatgcatcgccagtatcaagtggcgctgttctttgatcaagatcggccgccatttatcggtcgcattactcggccattgggtgagaaacggtatctggtcaaagcataccatagtaacgtctatcggatcatcaccgaagcggaggtatcctacattaaacgatttaaatgatcggtgttggccggttgcgcagtgtcgcgcgctaccatcatgccattcatcgcaggctgctgatcatcgaatccgaatttttgggcttgcatgaatggcatttaattcagatgggattcatcaccaccaactaaaacgacactagggtttctttctagctgctatataaagacgcctgattttcctaaatatggaaaatcaggcgtctttcgtttggcatagatcacttattggaaactaaaactgataccggcaaagcaaagaaatcattgaccagatgtactgtcgtagacaattcagtcacttaactcatgcgtccatgtttgaattcgtctgccattttcaacaattcttccgcatgttcaactgtcagcttagtgattttctccccagctagcattcgcgcaatctcatcaacgcgggcctgatcggttaatttcagaacttgcgtcgtagtgcggccattatgaaccgccttactgatgacatattcatgatcagccatcgccgccacctgaggcaaatgggtgatgcacaacacctgcgaagacttagcaatcaagctaatcttattggcaatcgcctgcgcaactcgaccggaaacgccggtatcgacctcatcaaaaatgatagccgtcacaccttctgttttcgcaaaaatcgtcttcatcgctaacatcaaccgcgacaattcaccgccagaggcaattttagctaacggtttagctgactcaccaggatttgtttgaatataaaattcaacctcatccagtccatcagcccgaaaatcctttgccttagcaaaatgcaccgaaaaaactgttttttccatatacaatgatgctaactgctcgtgaatcgctttcgtcaattgcttagcggcggcatggcggcgttttgacaaagccgttcccagcttctgcaactgattctgggatgccttcaatgtcgtatcaagatcttcaaccgaagtttctgcttgttccatttggttcaattcagtcgcggcccgcttgccataggcgatcacttcatcaagcgattccccatatttgcgctttaactgattaaatagatcaagccgcttttcgacttcatccagccgaccttcgtcaaattcctgatcatccaattccttcgacaagtcattttggacatcttgcaagctgtaataggcgctttgcaaattgtcagcaatggcagcaaaattcgtatcaagatcagcaatactttgcatactcgacatggcctgaccgatttgatcaagcgcattcacttcttcatcactcaataaagcatagctctcctgcaatgctgaattaatcttttgaaaattggcaagcctttcacgttctgcagtaagatccgtatcttcatgcggctgcagattggcactttgaatctcacccacctgaaatttcaacatatccaagcgttgtgcccattcttgctcatttgcctgtttttgcttcacggcacgcaaggtccgttgataatcgtgataaacatcagcgtattgttgccgcaatttcagcaagtcatcgccggcaaacgaatccaataaccctagatgcgtttctggatgcatgagctgttggtgttcattttgcccgtgaatatcaaccagcgtttcgccgatcgccttcaaggtcgttgtattgaccagatgcccgttcacacgacaaacattacggccagtgcgaaaaatctcgcgctgcaacagtacggtgtcattttgatctggatccatgaccccatatgcttgcagcttagcctctgttgccggattttcttgcgcatcaaagagaccttctaaactggccttagtggtgccggtacgaataaaatcgactgagccgcggccacctgccaacaagccaactgcatcgataatgatcgacttaccggcacctgtttcccctgtcaaagcggtcataccgggctgaaaactcagcgccagatgatcaatgatggcgaaatcatgaatcgctaactcttgtaacatcgcttcaccccaccattgcttcaagttcagccaacactgccgttgcatattttgcagaccggcagatgatcaaaatagacgcatccccgctgatggtcgcaaaaatacgctgatcatccagttgttcaattaaagtctcaactgctgccgctgtcccaggcaataaggccaaatgaataaaattatccatggcctcaccccacttcatcgcggtgatgagcgttcgccgcaatttatcagtggctggcaattgtttttctgccggcatactgtaacgataatggccttcaccagcaggcactttgatcaactgcatgtccttaatatcacgcgaaatggttgcttgcgtgaccggaatatgcagctcattcaatcgcgcaaccaagtcttcctgacgttcgattggttcatcttgaatcaatcgttgaatggttgcctgtcgttcgcgcttgcgcatgtgctcacctctgtcatagatggctttgttcgatcaaaactagtcaaacaaaagctttaccaatagcatagcgcacgaactagacagataccaagtttttgcataaatattcattatggccgatgtaaatcaccataagcggcagtcaaagtttcttcaatatcgacatcaggcgccatttttccaggcgtttgcgcactattttgcagatgaattaaaaattcaatattaccttcgccgcctttgatcggactgtaatccaatcccaagacatcgtatccagcctcaagtgcgaaatcaacgatcattttcagcacgtctcggtggacctgcggatcgcgaacaatcccgtgtttgccaacattagcaggccccgcctcaaattgcggcttaatgagggcaaccgcatgaccaccgggaatcagaattgcttttaacggcggcaaaataagctttaatgaaataaagctgacatccgtcatggcaaactcaactggaccatcagtgaagtcttccggcttactataccgaaagttaacccgctccattactttgacccgaggatcttcacgcagtttccacgccaattgattatagccaacgtctaatgcataactcatcttggcgccgttttgtaaggcaacgtctgtgaagccgccggtcgaggccccgatatccaaaacggttttgtccttcaagtcaatattgaagactttcaaggctttcgctaacttcaacccaccgcgactgacataaggcatttttttgcctttcacatgcaaaatagcatcgccagcaatttttacgcctggtttgtcgagtcgctgattgttctgatcatagacttcaccagccatcactgatcgctttgcttgctcacgagattcaaataaaccttgttcaactagcaaaacatcaacgcgttcttttttgatttttgtcatgctttcaacaccgccaaaatctcagccaatggcgccgcgtcaactgtcaattcgtttaacgccgtctctgcttttgcaatttctacctgcaaagcttgaatagcaccgtccaaccccaataactcgggaaaagtgttcttatgctcaatgacatctttgtcagccgtttttccgagttcagccgttgttttggtcacatcgttaatatcatctttaatttgaaatcctaagccaaaagcggccgaaaaatcagccagtgctgtttggtcagtctccggaatggtcacaaacagcccgcccatcgcgattgcggcttggatcaaggccccagtcttagcttcatgcatgcgtttcaaagtttcgagatggtactgctcgttttcaccgtccatatcgagcacttggccaccaaccataccgttgctgccagcggcttcggccagaatctgcacacatgcggcgcctttttcaggatactcgcggctcaagatggcaaacgcatcggtcaataaggcgtccccagccaaaatcgctaaggcttcgccaaactgcttatgattggtcggcttcccgcggcgcagatcatcgtcgtccattgccggcagatcatcgtgaatcaatgaataagtatgcacatattccaaagcagcagcagccggcaatgcatcagcaatcacaccgtcatacatcgccacgacactcaacaacaacaatggtcgcaggcgcttgccacctgcctccacggaataaaccattgccgctcgcaaatgcgggttagcaacagcagctaattgctcgtccaacgtctgttcaacggctgtgcgccatcctgctaacatagggctcattgctgatcatcctttggcgaaaatggttgcgtcgtcccatcgtcactgaccatttcggtaacggttttttctgcagtttttaatgttttctcaaggtcctgactcaatttaacaccggctttaaattgatctaatgccttttccagcggtacatcgccctgctcaagctgattcacgatgttttccaattgtgcaagtttctcttcaaaagtaggttcagccatgtgttttctcctttgtggtgacgtgtgcgccgacttgtccatcagccacgtgaatatgaatatcttgatctagctcgtagtcacttagacttttcagcatctgaccttgtttatcggtcacgtaagcaaatccgcggcccaagatttttaacggacttaggtgatcaaggccactcacggcactagcaaatgcctgacgcttagttttcaccaaaccgcgcatcgcttgatccaagcgatgacgatccccagtcacttgccgctgcaaattgaccaatcggataaacagttgccggccatccaattgggaagttgccattgccaaacgatgatcagcatcgcgcaggcgattatgcatactctgttgtagccgttgttgaaattgatcgactcgctgaacgtattgatcataaagtcgatccggttgcgtcaacacaacactttgtgcagaacgctgcactcgaatcgcggcatttttgagccgattatgcatggcattgaccagtcgcacccgatcttcagaaattcgattaagcgcatcaatcaatgtcacgggcgttacaatttccgccgcagcagttggcgttgccgcccgtcgatcggcaataaaatcggtaatggttgtatcggtttcatgccccactgagctgacaaccggcatcggcatgtcgaccaatgcgcgcgcaactttttcctcgttaaaaggccaaagatcttcaattgaaccaccaccgcggccaatgatcacagcatcgaatccacctattgttttaatctggtttaatcgtttcaccagtgaatcggcggcttgatcgccttggacaactgccgggaacagcgttaattgcaaaatcggatagcggcgtgcgaccgtcgtcatgatatcttgaatgacggcaccacttgggctggtcacaactgccacccgtttgggaaagagtggcagtggtcgttggttgcggtcaaatagcccttcagccgccaactttttcttcagttgctcaaaagcttgataaagcgcacccacaccatctggttcgagatgttcgacaattaaacgatattcgccgctgggttcatataaactgactcgcccaacaactaggactttcataccttcctcaaggtcaaattgaaccttgctgaaggcattacgaaacatcagcgcaccgattttagcgtgatcgtctttgagtgagaaatactgattacctacacgtttgcgataattggaaatttcacccgtcagatagactttggcaaggtaagggtccgcatcaaatttgcgtttgagatattgagtgagtgccgtgacgcttaaatattgactggcatcaaccatttgctcgcctcttagccaaggtcactgtctgggccatgagcgaagcaattgtcattggccccacaccacctggtactggcgtgatggcgctggcaatcggcgccaccgcggcttcgtcaacatccccaagtaccttaccgtcagctccacgcgaaataccaacgtcaatgaccactgcccctggtttcaccgcatcggcaccaataaaatgcggcaccccaacagcaaccaccaaaatatcagcttcttttgccagctgtttaagatcacgggttttactatgcgcaattgtgacggtggcatcgtgattgaccattaaaccagccagcggccgaccgacaatgtttgaacggccaatgatcacaacccgtttgcccgcaacatcaatatcataagcatccaacaacgccatgatgccataaggcgtggacgccacaacagttggttcattggcccataaccgccctacactaaccggactaaacccgtcaacatctttatcaggatcgatagcatcaatcaccgcctgttcatcaagtcctgctggtaacggcaactgaaccaaaatagcatcaatatccggatcatgattcaactcggcaaccttcgccagcaagtccgcctgcgttgtcgcttcaggcattcgaaacattaaagaacgcacgccaatatcttctgcacggcgctgtttattacgtacataaacctcactggccggatttgatcccaccaaaacaactgccaatgtcggcgtcacatcgtgttgtgccaattgagcaatggtttgcttaaggtctgccagtattttctttgaaactgctctgccatctagtcgggttgccaagagcttcactcctcattttatcggcgcttgttgcgcgcaatcgtcacttatcaatatgcgaacatagtacgaccaaagcaagataaatcaaaaccggtcaaagcaaatgcctttgaccggttgacttatgcttgcggcgttgcttggatgaagttcgccaaaatgccattcacaaacttggctgattgatcatcgctgtaacgctttgccaaattgatggcctcattaatcgccgcagcttccggcatcgcttcttcataacgaatttcgtatagacctaatcgcaggatgattaaatccggcttcgtcaagcgactgagggtccagcctttttttaattgcggcgtcaaggcagcatccaaatcagcctgtttactcaaaacaccctcaaccagcgtggttaaataagccggtacctcggtatcttgaggtaaaacttcggcatacaccgcatctttatcagcttccggattggttgccaaggcaaacagcgcctgaaaagcagcctcacggatcgcatgtcgtgattccatcttattcgtcatccttgccgctagcgctttctgcatcgtcagtgtcggtatcatcgtcgttgaacagattatcagggtcaactttttcagctttttctggaatgatgccaacaacgtggacattaacctcgctgagcgtcaaatctgtcatgaacaaaagctgttcccgtaaccgttcctgcatcgtcagtgccactttaggaaccgagacgccatagtctagatacacataaacgtcagcggcaatctgatcatccgtcaccgtcacactgacgcctttgccatgattagcccggccgaaccaggcgttaattgaagcacccagtgagccgcgcatttgatacacaccatctacttgactagccgcgatgcccaagatgacttccaaaacttcaggaacaatctcaatagtcccctgtgcatcggtgcgattcgctaatatgatatttgtttcttcagccatcgtgagaacctcctaagccctagttgttggcgcgtgaaatgtaggtgccatcatcagtattgatcgttaaaacatcgtcaacattgatgaaaaacggtacctgcacgaccaaccctgtttccatcgttgctggtttagaaccaccgctacttgtgttgccacgaatgccaggttctgtttctttaaccactaaatcaacagtctttggcaactcaattccaagcgtttcattaccatgcatgataattttgacattcatattttctttcaaataattcaattgatcgcggatctcgtcgccgggaagcgtcaattggtcataagtatcggtatccatgaagacataattgtccccatcggcatacaagtattgcatgttcttgctgtcaatttgcgccttttcaactttttcagttgagcggaacgttttttcttgaacagcacctgtacgcaggttcttaagggttgaacgcacgaaagctgaacccttacctggcttaacatgctgaaactcgacaattcgccaaaggtcaccgtcgacctcaatcgtcaaaccatttttaaaatcattaacagatatcatgaacttcctccatacattcagtcgtaaactaaacctattctagcaagcactgcgaatgcttgcaacagcagagcgtgagcaggcgcggttagaaaccggagcataagcggcctcaagcctaattggctgggctttggtcaattaggcttggggcccttatgtgcaggtttctgcacctgcgaacgcgttttagccaaaaatcaataagctaaccgatttgactcacaagtcagcttctggcacgtaacttacagcaccaacaactcactaggtgctggttgactcaagctttgactacccgcagcagtcactaataaatcgtcctcaatccgaacgccgccaagatccggtacataaataccaggctcatccgtgacaacattgcccttagcagccggcacgtctagatacggtccccaagcgccgggcccttcatgaattgataaaccgatgccatggcctgttccgtggccaaagtacttcccataaccagcatcattgattgtgttgtgagctaagtcattgatgactcggccaagaacacctggttttaaagctttttgcactttttgattcgtttgatagacaatttgataaatggtcttcagcctaggatctggttcgcccaccgcaaacgtgcgggttaaatcagacatgtatccgtggtagatacacccccagtcaagcgtgacaatatcgcctttttcaattttcttctctgttgccgcaccatggggcatcgctgagcgcgtcccggaagcgacaatcgtttcaaaagaaacattgctggcgccaagtccgcgcatgaagaaatctaagtcattggcgacatcaatttcacgcatgcctggtttgatcgtagcaatgacatgttgatagcccttttcggcaatagcgatagcttgtgtgattgacgccaattcattggcatccttgatctcgcgttgcgtttcgacaaagtcacgggttggtactaaagttccttgtgtgagcaaatcaaatgcttcataatcggcataatttaagtgaactgcttcaaaaccgattctagtcaattgtaagcgattggccagcttgccaacggccttaaacatgctgtcctgatgcaaaatcatttcagcattatgtacttgctgcttaaactgttcggtaaatcgcgaatcagtcacaaaataagccttttgcggggttacaagcaaggtgctttcttcacctgtaaagccggtcaaataagtcacgttcttcgtatcggtaacaaaaaagccatccagttttttatcctgaattcgcgcctgcaatgctgtcattcgatccatccaaatcgctcctttactgactcatgctttgttttctctgaaaaaaagacgccccgttaccgggacgtctagtctttattcagcagctgctgccggataaactgaaaccttcttcttgtcacggccgaagcgttcaaattttacaacgccgtcagcagtcgcgaacaaggtatcatcgccgccgcgaccaacgttttcgccagggtgaatcttggtaccgcgctgacgatacaagatattgcctgccttaacgaattggccatcggcacgcttgctgcccaaacgccggccagcagaattacgaccgttggatgttgagccgccacctttatggtgagagaagaattgcagattcatctttaacataacgtacacctccgaggattaattttgttcaagttgtttagtagtaatcgtcaaacgatcaggatattggtcttggatgctctgtaattcgagcaataaattttccaacagaatctgactgatgtgtagctgttcgccggtaatggcggttttaattgccatctggagatgcccaccatggacttcatccgcaatgacatcaggttcaaaccctgctaagccttcaatgccgttaacggcaccaatgctcaccgcagaaacagcggcacatacaatatccttaccggttttaccggcatcggcatgacccgtcaacgagaagctgacgatatcaccatgttcatctcgatgaaaaattgccttgatcataactatgctgacctcttaagcgttgatcgcgtcaataacgaccttcgtgtatggttgacggtgacccttcttttgatgagagtgcttcttaggcttgtacttgtaagtaacaacctttttctcgcgcccttgtttttcgaccttgccagttacggtcgcgcctttgacggttggtgtgccaatcttggcgtcaccttcgcctgcaaccatgatgacttcatcaaaagtaacttgtttgccttcgtcagcgtcgagtttttcgacatagatggcttcgccaacctctgccttgtattgcttgccgccggttttgataattgcgtacactgtgtgcacctcctgttttgcctttcggcttttcccctgaagactcgccaagttgggtgcttacgcttaaaaacccaacattgtgcggttgcataggaggggtgccaaatacaacggactaatattaccagagacgacgtcaagttgcaagacaaacaacaagcgcgtagattcgtgcgtttagaaaccggtatgtcacaaaccgtgctgctttttaaacatgccaccttcaagactctcatatgtgtgcttctgggctagcgaacgcgtttcaatcaaaagttgaaagccacggcaccgccttcagtaatcacgttttaatctagaaaccatcaactgtgcctttttcgaaaaagccagacaccagcaatgactgccagcatgtaaaggatgtatatcatcgtaaagatggtcatccaaccaccaagtgcggcattaattaacagtaaactaatgactagaatagcatccacaatccaattgaccggttgagccaattgtgtggtcacaacgatcagcaaagcaccggtcacgagaagaattaaaaggttaagtaatataatgataagctgtcacctccttgaagaattatatacgagccatcttctttcaacaagaaatcgtttaattgagcagaacggcaaaagaaaaaggctcagaaaagatctccgagcctgcccctgccaaggacctttaatataccatagatgcccgcaattattttactgaatttttgaattttggcggccgcattgtagccaacaaccccttacgctatcacttaaaacacgattgctgaaaagaaatggtttgttgtaggaaaagcttccaaatattttgactcgtaagcctttgaaacgacggcacaaaaaaaagccgctgattgttcagttcagcagcctttagttacttcttcaattgttgtaacgctttttcgatcgtgttgccttttccaatgtgtttagcattgcttgagtcaatagcgataaattcttgcgtcttcatgttgagttggattcgatatgacatcgtaatccctccattctttaaaaaatagtttgaatggtctcaggtagcgatgaaggctatactactcactttttgttagtatgtcaagcattaaaaaacacaacgattgctaactgacttgcttttgacgggataaatcaagatagcaacgctcaaaccggctttaactaatctgatttaaaagcaatttagccttggtcatggcctcgtcgtacgtgccatcggtcttggccggtaactttctgatttgatcaagcaattcgcggccttgaatgactaacgcttcaatatcagcatttgtatcactcaaaaaagaaacaattaagtagatgtttaagactttggtggcatcctgatcgcctgcgattacctctgcacctaactttttaatggccgttttcaaatttcggacttttctctgttcttttttacgcttgtgataataaggcaacacaaacggtaagaaattcagataaacccgcaccccactctgaaactggacccatttccatcaataaacaccttcattgtcgtgactcatgtcaacatttcgaactaacaactcgtagatacaaaaaaagcctgatgcattgtcctcctgcttagtcacggatagcccgtcgtcacagcaatgcttcatggcatttgtaagttttatgtaccagccgggattcgaacccgggacaaacggtttagaagaccgttgctctatccaactgagctactggtacaaatcgttattaagtatacgagaagcgcgacaggccgtcaacgggttctatgaggaagatcatccgatacgcaagttagacggatatagttgaaagcagtcaatgagaccgctacactgaatttatcacaattttctcataaaggaagacaatgctgatgaaattaaatcaatttgcccgtttgacacctgacttcaaggtgcaagtagcggagcttaagcagattggcctgcaagccgatcctgatgacgcttttagtcaaagtgcgaccgaccttttcaatgccttttttccagaggcttatactttagccgcaaaggaagataagctcgcccaagtagcagtcaacatggaccaaacactagcagcatggttggcgaaaaaaccatccaaaatgacgcgccgtgacttttataatgtggcgctacaactacttggcttcgaagctttcactgactttgacctgaatgatccctttaaaatgatgactgcaaccaagttaccaagcctcgatcacgatctaacgagcaccgctgatttgctcaaggctgtttatctattgttaaatacgcgaaccaagcatctggttagttatttggatgatctagctaatcgcggttttttaaaggacttccagaaaaaacagaaaaaaccgacccaccttctttttaacggcaaagtccaacaagtttttgatgcgcggcaggcggttcgtgaagttgtttggatcgaatcggatatggataccgatcacgatggccaacgcgacttgctcgaagcgactatttaccgcccgaaagccacagatcaagggcttaaagtgcccgtgttatttactgcaaatccgtattttcatggaaccaacgatgtgactgcagtgacgcacgtgccggaaacgaccttagctgttaaaacacacggagcctcgaaagctgaagttacggcaaatcctgaagagcctgccaacttgcctcatcatccagttaatggcgaggcgacacaggccgaagcttatgccgaagaaaacagtatgtatgcctttaacgattattttctcgcccgtggctttgctgtggtttattcggcaggtgttggcactcgctattccgacggcttccggacaaccggtggcccagaagaaaccgatggtgctgttgctgtcatcgagtggctgaccggtaaacgccgcgcttttacgaaccggacagatggtattaccatcaaagcttggtggtcaaccggtcttgtcgctatgaccggcaaatcctacctggctacattagccatggcggcggccaccactggggttgacggtctcaagacaattgtagccgacgctggcatttccagctggtatgactactaccgtgaaaatggtctcgtagtggcccctggtggtttccagggtgaagatgcggatgttctggctgtggataccttctcccggcaaaagtccggcggcgacctgatcaacatcaaacaagcttgggaaaagcatcttgctacgatcactcacgatcaggatcgaacaactggcgcttacaacacatggtgggatgcgcgcaactaccggaaaaacgctaacaaggtcaaggcagatgtggtgttgatccatggtcttaatgattggaacgtaaaacctacaaacgccatcaagttttgggaggccatcgcagacctgccaattcaaaagaaactggttttgcatcaaggccagcacgtttacgtccacaatgttcgctcattagattttctagatatgatgaatttgtggctcacacatgaattgcttggtgaggcgaatggcgccgaagatgtattaccaaatgttgttgtgcaagataatgttgctgttcagacttggtcggcctatcagaattttgccagcccagcagcagagcatgtgaccaacactcgcaatctaaaaacggatttcgaggcggccacggatcaatttaccgatcacgcaacagcaacttttaatgcccagcatgataccagtgccagtttcgagactgccatcatcacccctaacagtgcttatgccaatagccgcttgtggctcacgcagccgccacttgagcgcgaccaaacactggaaggcattccgcacttagagctgacgctggccattgatgccccaacaggtattctcagtgttcgcctcattgatttaggaatggccaagcgattcggtgaaaccgcggcaacgatggccttaaacggtcttcaacttggttttgattataaaacaacagacattctcgaattcaaaccaacggctaaaccgacaccaagcaagttgatctcgcttggccatatcaacctgcaaaatccaaaaaatgcttacgaagtgcaaaggattacgcccggccaaccgttccatatcagtttggatctccaacccacccactatcatctgccagctggtcgtcaactcgctttggtcattcatggggcagatatggcccaaaccattcgcccgatcaaaacaactcattatcaaattgatttggctaatagcagcatcacgctcccttaccgcatttaacttaataggatgctcaccagttttttcatgcatgatgcatcaaaaaaggagatatcaagcgccgagtcggcctgacatctccttttttcttacttaactgttcaatcaacttgcttcaacggtgacagcaacagcttttgggttgtctggtttagtaaagctccagatattgttgccgttcccattcagaaacctgctgacgataagcggaccattcgaggttctttgagtccatgaaactttgatacaaatgtttacccagggcagccttgaccacatcatcagccgctaatgccttcaaagcattgtgcaaagttgatgggaggtcttgaatatgatttgctttccgttcatcgtcttgcatccgataaatgttgcgatcaacggcttcttccggcttcaatttcttagtcacaccatctaaaccggcttggagaatcccggcgatggctaagtatggattagcggttggatcaactgaccgcagttccagtcgcgtggacaatccacgagattgtggcacacgaatcaacggtgaccggttcttgcctgaccaagcaacataaactggcgcttcaaaaccaggaaccaaacgcttgtaggagttcacagttgggttattaatagcggttaaagcataagcgtgacgcagaaccccggcgagaaaatgcatggcagtttcgctcaactggtcatccgtattggcatcgaagaaagcattgcccttgtcatggaaaagactcatgttgatatgcatcccactaccgttaataccgtggagtggttttggcatgaaggttgcataaagcccatgcttgcgggcaatcgttttaaccacaagtttaaaggtttgaatgttgtcagcagcttctaaggcatcagcatacttgaagtcaatttcatgctggcctggcgcaacttcatggtgagaagcttcgacttcaaagcccattttttcgagttcaaggacgatatcacgccgacagttttcgcctaaatctaatggtgcaaaatcaaagtaggagcccttgtcgttcaactgagtcgtcggattgccattttcatccatcttaaacaggaagaattctggttctggtccaatattaaatgaagtaaaaccagcctccttcatttcgttcacgacccgaatcaagttattccgtggatcaccagcaaaaggactgccatcaggacgatgaacggagcagatcaaacgcgcaatcttaccgtgatcgttttcccaagggaacaataaccatgtgtcgagatccggaaacagtagcatatcactttcttcgatccggacaaagccatcaatcgaggagccatcaaaggtgatcttgttattgaggaccttctccaattgagaaattgggacctcaacgttcttaacgattccgttaatgtcagtgaacatcaggcgcaggaacaaaacattttcatccttaacagtctgacgaatctcatcagcggtaattgtttttcttgccatatacgtgaactcctatctttagtgtgattggcggaaacctatggctggaccgggatcgggactctggttcagtcgactctggtttaacaactcgtctcgcagtacttgccgcacttcggcatcgctgtcttcatgatgtcggggatgcttgagtcgctttacgtcggcaagcgtgaaaccgtctgccatttgactgcgaatctcaagcaattcattaacattattcagcgagtatgtccgatgattaccagcgtttcgtgcaggttgaaccaacccttgcgcttcataataacgaatctggcgcgcggttaaatcagtcaataacatgactgtaccaatcggcagaaccgatcgcgttctcagatcagcgatctcagccataggcatcctcctttacaacaatgtcaggttatcaaaccatataaggcgtgtcaacggcagatgtaagcttttctgacattcaaataaaaagataccctttttttgttttcaaaatgaagatgccatagaccaataaataaaaagacggtcatcatctctggtaaagcgcaaccgtttccaaccgctatgtcgctatcatcccaccaccaatcacatcatcacactgccggctcagactgttggcacgaatagaaggcatcgaagacacagtctttgaagtcactctaaaaattttccgtttaacattatgttaaaatcaactgaatctattttgaaaggaactcgcaggcatgcacttatatatcggctactcagaaaaagtagcagcaaggatactgcccaccaattggcgttgtttaactgcggcaccgttagctgcctttggcgcagcaatcatcgatgcttctgacactgcaacgctcactcagcttgtggccagccaattacccttaccaacttttatcatcggccagataccaatcagtcacactggtcagctgacagtcaccaacatcgatacacttaataccgcaacaatggctcagattactgctgctgcacaagcttatgagcaaaccatggtaccagcattcattcgcgacttactggactatgcgaaggcggacccaaccagctttgcgactcctggccaccacagcggtcactacgacgacttagcaccagcaggttacttacttcatcaggcttacggcccaactttcttcgctagcgataccagcgatgtcgtcacttctttgggcgatatgttaacacatgggggcaccccgctagctgccgaagaagcgaccgcgcagttatatcatgccgatgaaacttattttgtgaccaacggcacgactggatcgaataacattgtggccagtgcattgctcacgccaggcgatttggttttattcgatcggaataaccacaaatctttttataacgcggcacttgtccaaaatgatgcccgcccggtttatttggatacacttcgaacgaaacgtgggttgattggtccgatcgatttacagaatctaacccatgaaagtttgcgacaaatggcggtagcggtggctcccgaaaaggcacatcaatcgcggccatttcgactgacaattcttgaactagaaacctttgatggcattgtgccaaatgtccgtcagttaatcgatctttttgggcctttaaccgactacattgctttcgatgctgcttggggtggttatgagccgtttattccagcaatgacgcccatggatcccctgcaggtaccgcttgcgccgactgaccctggtatcatcgtcacccaaagtgtccacaaacagcaatccgggtttggccaggcatcacagattcataaaaaagatgcccatattaagggacaagcgcgatatgtcggtcacgaacagttcaaccacgcgtacttaaaacatgttacgaccagctacaattatccgctttacgcgtcattagtcgccaacactgccattaatcaaggtgctcgcggacaaaaaatctggcaagatgccattcgagcagcactcggctttcgccgctcgctcaacgattcgcgactcttttctgcttacgaaccgcctgagttgacaactttgcctgctgatcaggccattcagactgctgaggcttggtccatgacgccacaagctgcatggcatcaactcgcaggccttcaacctgatcaagcatttcttgatccaggtaaagtgaccgtgctattacctgacacagccgcatttggcatcagcggttggttagtagatcgttatttacttgaccacggcattattccggaaaaagccgacctaaatagcctgctttttttagtgacgccgggaaccgctcgaacagactggcaacgattgcgccaagtgttagcccagtttgaaaccgattattttgtaaataaaaccgttgctgaaagtttgccaaaattagtcgctgaaactggcgaggcgtatgcacatcaaacattacgcgaactaagtcagaccatgtcggactttttccgagaagcgcacctaactgagcaacaacgtgacttgtttaccaacaccaacgccatccccactgccatgaccccgcaagccgccgatcgttattttgttcgcggtcaaattgacaccatccctctggagcaagccacgggccgtatcgcagtcgacggcgcgctgccctatccgcccggaatctttgtggttgtccctggcgaacgctggcgaccggaagcgatcagttactttcaaacactttttgaaggtatacggcacttccccggctttaccccagaaatccaaggcgttatcgctcgtgcaggtggtcagccatatgttcatgttgtgcatgaacaactttcatagccgtcaaaaaacgcgatcaattagcttgatcgcgtttttttgcttagcctattctagttatcaaagaaagtggactgcgcggctcccatggtcgccaatttaatatgcgcataggttagcccgccttgcaggtataacgtatatggcgggcgcaacgggccatcaccggaaaattcaatcgttgagccagcaacgaatgtgccgcctgccataatgacttgatcctcataaccggccattttttccggaatcggcgtcacaaagctgtcaactggcgagtttgcttgaacagccttagcaaatttcaccatgtcatcggcattgccgaagttgactgtttgaatcaaatcggttcgcggtgcatcccaagcaggtgagacgtccagccccagtttagcaaataaggctgcttcgaaaatggcgcctttaatggcattccctgtggtttgcggcgaaatgaagaagccttgatacatgtcagccaacgcaccgactgtggccccttcagccccgccaagacccggtaccgtgaaccgataactgatgcggtcaatcagatcctttttaccgacaatataaccgccagttttggccatgccaccgcctgcgtttttaaacaacgagccggccatgacatcagcaccgacttccaatggttccttggtttccgagaactcgccataggcattatcgacaaagatccagacattcggcaaaacactgcgaacaaccttgatcatcgcagcgatctgatcgacggtgaaagaatcgcgggttgcataaccgcgagatcgctgaatggcaaccactttggtcttatcgttcaaccgcgctttgacagcatcatcgtctaccgccccgtttggcagcaggtcaacataatcaacaccaatgccatattcttgcggcgcgccaatcccgttgccagctaagcctagtacttcctgcagggtatcgtacggcttaccggtgatgtacacaatatcgtcacctggccgaaccaagcctaataaggcaacgccaattgcatgcgtaccagaaacaaattgcggccgcaccagtgcatcttcgccgcccaaaacatcggcgtagatggcctccaagacatcgcggccttcatcattatgaccataaccggttgatccggttagataactttctgccacatgatggttttgaaaacttgttaaaaccttattctgattctccaagatgcgcgcatcaatttttgccagttgtggcgcgatctgtgcgtcaacttctttaaccattgtctgtaattttggatcaaacttatccatccaactcatgatacttttctcctttaagtgagcgcgaacaggcgcgtttagaaatcggcgcatagatgggcgtcaaccagatttgctcgaaactgaacctagccaatctggttgacggccttcatatccaaattgatacgactgtattcgcgttaacgttgtttaagccactgttgcaccaacgtaacaatggcatttttgtcttccggatgcgcgaccagatcaaaccaatgggtcggcatctgattgcgaaaataggtcagctgccgtttagcaaaatgccgggaatgttgcttaatcagtgcaacacaattcgccaattcagcctgaccgtgaagatatggcactagctctttgtagccgatagcctgcatggcctgtgcatctgctggcatggtttttaatagctgctcaacttcagcgagtaacccggcctgcatcatcgcatccacccgtgcattaattcgatcatacaaaacggttcggtccgtggttaagccaatgaccaaggtcgagaacaacggctctggttgtggctggtcagaaaagcgccgtccggttaattcaccgacttctaaggcacgaatcacccgccgcgtattggccggcgcaatttgttgcgcagcatctgggtcgcgctgtgccaattgctgccacaaccatgattgaccgtttgttgctagcgccacctgccagcgctgccgaatagctgtcggcggcgccttcccgcctaaaggcagatttaagcgcaaactattaagataaaaaccggtaccgcctaccagaatcggtaattgttgccgatcagccaacgtatcaatcatggccgtcgctgcctttttaaacttggcgaccgagtatgcgacggtagggtcagcgatatccaataaatggtgtggcaccccttgcatctcttttggcgtgattttcgccgttccaatgtccatgtggcgataaatctgataggcgtcgccgttaatcacttcaccgtgtagctgctgggctaaataaacgccgaggtcactttttccaacagctgtcggtccgacaatcatgacaatccgtttggctggtttatccatttcattaagctccgatagtatagtataataaaaacagtatcatagatcattaatcaggggggattttcatgaaacataaatttgctcgtggcttttttgttggcacgctaatgacccttggcgcaattgccggtagcgtttttgcctttaagaaaaactatatcgaacctgtggaaactaaggtcgatgaaattaacgataaccggcgtaaagctaaccgtaagcgtttctcagctcatcaaggttaagcaacaccagctgttaatagcggtatgttcataatgagcgccgctatcagcaaaaaagcaatcgacaagttcgattgcttttttcttgcgcttatgtagcggctaatagttagtcgggctcttttttgttttgcctgaccagttatcatagccgccttttagccaactgattttttcgaaaccattcttgcgtaaacgccgagcagcacgcaaggagagcacgccagttttgtcatagagataaaccggcagatcttgacgcatttcacccatccgttcacgcaactgcgtataaggaatatcgcgggcaccgagaatatggcccgctttgaattcgttacgctcgcgtaagtcaataatctgtgctttacgcatggtatgttcaaagtcatccggcgtgatctcgccgccgatagccttaaaccgtgatttttgatagtaactccacaaccagttgaaaccccaataaatcagaaacaatccaacaaaaattaacagataagttaacacgtgtatgactccttcttccgcttacttaagtgcaaggctggcagctccgataacgccagcagtgttacctagcgttgccagacgcagacttgttgtttcccgaacattcgggaacgtattttccttgaaatacttatcaactcgcttcagcaaaaagtcgcctgctgctgaaacgccgccaccaatgacgatgaatttcggattcagcagattgccgacatttgccaatgccaagccaagaaagtggctaacccggtcaacaatcatcaacgcaagtttgtcgccggttttggcaagatcaaaaacaattttgctagaaatctcatcgccatcatctaacgtctgcttcaatttggagtcgccagcgaattcttcagccatatcccgggccacccggacaacgccagtcgcactggctacagtttcgagacaaccgcgtttgccgcaagtacagagataaccattcaccggatcaacagtcacgtgtccgagttcgcctgctgagcctgcaacaccatgcaataagttaccatcggcaataatgccgccgccaacgcctgtgccaagcgttacgaaagttacattggcgtcattttcgccagcgcctttccaacgttcgcccaaggcagccacattggcgtcgttatcaatactaaagggaatcccagtaccagcctcaatatccttcttagcctgctgcaaggttttccaattcaagttgtaagcgccaattaccgtgcctgcttcaatatcaactgaaccaggtgagcccataccgataccgacaaaatcattcggtgtcatgttgtagagtttgagatgttcgttgatcgaatcaatgatatccggcaagatgtgactgccttcatccaaaatattagtatcgatactccagcgctgttgaatctcaccatcagtggttaagatcgcgaatttaaccgttgtgccgcccaaatcgacaccaattaattttttgtcattcatttttgtcattcctccgtttttcggcgggcagtggcagctcatgatttaaaggatgtgcctcttcttgcgcgtgtgcatgccgcagcacgacttttgcattcaggtaaaccttgtcatcaatgagctgcgctttgtgcagccgatctaattcaagtgcagccagttcgatatcccactcacgcttgccaacatgaatgaacgtaccaaacccctttaataattgcagaacatcatagtaagttttcatactagcctgcgttaaatcctaagaaaagcaacgcgcccagtccgaagagcaaggtgacagctgaagcaatccgccgcggtgtccccatgcgaccaagtgccggagcacccaacatgcctgctgcaagaaagccaccaagcaaaccgccaatgtgaccaaaaatatcaatgccgctggaaaacagattaaacagtaagttcaagccaaccaacagtaagaattggcgcgccaactgacgaatcactggattttctttgaagctgtcgccgagcatcaagcaagcaccgagcaaaccgaaaattgctgtgctggcacctgccgcaagtgtgttgggactaaaggcaaaactcgcgacattaccggcaaaacccgaaataaagtacaacagaaagaatcgccaatggccaaatagttgttccgtcatttgtcccaaataatacaatgagaaaccgttaaccagaatgtgcattaagccgatgtggacaaatactggtgtcatcaatcgccaccactgaccatacaaaatcaaaggattcagccgcgcgccgtagaaaaccaacacgctattattggtactgccaccagagaaagtctccaaaaggaagaccaaaatggtaaccgctaaaatagcattggtcacataagctgaattttgcagccgagagcgccagtttgaataattcatagtttcctttctaacccatctgccaagcagacaggaactgcttgccgtatgccgagcctgccgcaccaatccgctaaaaaaacaacaggtccgcctgttgtttttcgcaccgtcagaagcgttggccaaacacttggcggccatgttcttgtagtagtttagcattttttgcacacgctgccaacacgatcagccgttaactgtcttctgatgaatcgaataatccttatcttctttgatgttgttcatctgatagaagtcagtaaacatttctttggcaatctgcagttgataaggcgtggtggtttcagccttcagattcgggataatcactgcaatcgcaatctttggatccttcgctggtgcatacccaacgaaactttccgtgatggtttcagtgagcgctgaatctttggactcacgagcaaacccttgagcagtcccggttttcccggcaacgcccggattcaaggtattcagcgaagtcgctgtagtccaaccgtttgtgccatgcacaacctgccacattccttgcttaactaggttaatctgatcttgcgtattgtcgatttttgaagtaacggaaggctgagttgaggttaacaccggaccgctactgccatcgctcagtgtttggctaatactgttcactaagaatggtttcatccgataaccgttgttggcaatggcgctgatatactgcagcatctgaataagtgtgtagttatcatagttcccgtaagacaaatccaacgccgaaccgacaagcaaattgcctgatgaatcatgcgtattgccttctaaccctgcaatctcaccgggcaagtcaatcccggttttgagacctaatccgaattggttaaagtagccgcgcattttgctaaaaatatccgaattcaatttcagataattatttggcgagtatgcatagtggccttctttcatggccagccacatcatgtaaatgttactggaaacttccagcgcagaggctgcatccaatgaactgaaggtaccgaccgggtaaacagatttcttgactggtgtaccaggcaagtaaatcggtgtatcagcttgagtattagaattgacggtaatcacgccgtcttgcaaggcgcctagcaccgtggcacccttaaccgctgacccaacaacaaatgcgcggttgataacgccaagtgcatcatcttcaaccttatgtgtctgaacatcctgatgctgacccgccatggcgaggatacgacccgtatttggatccatcgcaaccgcgtaagcaccgtctgacaagctgcccgcaccagcagatcgaatcgaactgaaggtgtcactcaaagacttttcgactttcttctgataatccgaatcgatcgtcagattcaaattggcgccttgttgccccttgaacttggaaacagattgaataatctggttgttattcccgatttcaacctgcgtttgactcttggaacccttcagaacattttcatatgccttttcaaggtaactggtgccgacccggtcattccgagcatagccatttgccaaatatgcctgtagttggtcagctggcaaccctgacttttcgttggaaacttgtccaatgattgacgtcatagagtcaccgttcggataagatcgctcccagtcagtcccaaggttcaccccaggcatctgcgtcaagcgctcaccgacaaccgcgacttcatgtgccgtcacgtcctgattcttaaggtagacagtcgatagctgagtggcgccattcataattttgtaaaggccggctgcttctttttgagtcgccgtaaaggttggcatgtgttgacgcacgtaagcgacctcatacttgtacaattcgtcagctttgtctgtcggcagatcttgaattttctttggcagtttggaaacaatctgttttgaaactttcgttggtgccaaatagtagtcaatataatcgcgcttggtaagattgtcttcaggcttgtcaataagcttggcaagctgattagcaatgtcatacatctgctgcgatttagccccaacactcttagtgtaagtgatggcattattcgccttattcgtcactagagcacggcccttgctatcaaaaataagcccacgaggcacattgccggtgaccactgttttgttggtgcgatcgacttcagcagccaaccgcgggccatttaaaatctgcaaataagccagctgtgcaactaaggctgccagcaggagaaacgcaataaaaaataataaatttaagcgaaacggaatttgactcttgttccgtttgggttgcggtgtacgaatgtacttcacctaaaattgctccttcagaatttctatcttataaagtgtagcaaagaaccagtcaaaacgccatgacacgtgtcttatgatatgcttgagatacggaagacgacacctaaaatgccggaattaatcttattttagaagttggtggacacttgtgcgacaacgttggttgaaaaattatccgctgatcctcagttttcttttaccgggactgctcgtcggcctttattttgcaatccgtggcacctttccatttggatcaagcagtgtgttgacagtggatttgggacagcaatatatcgatttcttcgcttacttgcggcaaaccttgctcggccatcctggccaacttttttatgccttcaataaagcacttggcggtgacatgtacggggtctttgcctactatttgcttagcccattcaactggctagttgtgttgtttccagcagatatgctggatgtcgctgccttcttaatcacggtgttgaaaatcagcaccatcggcttcaccatgggttggtacgctaaacgtcacgccatccacggcatgatgattccggcgtttgggttagcctatgctttgagtggctggctgttggccaacagctttaatttgatgtggctggatgctgcaatgctactgccgctcattattgacagtgttgaaatactattcaaaggcggccgcgttatggcctatattggctggctcgccgcggctctcatcattaatttttataccggctatatgattgccttgtttttaatcctgtatgccatttactggctcattgcccatacctcaacatggcagcatttttggcgatctggactgcggtttatcggcgccagcgggttagctgggatgatcagtgcggttgtgctattgcccacctggtttcaactgtcccagtcaaaaggcacttacaccgtggcgacgatacgttggcgctttgaatatgcgccaacaaggtttttgagtaaaatgctgccaggcagttttaactttgaccaaatgccatccggttatcccaactattacattggtgctttaggatttgtactggttgtcctctttttcctatccaaaagtcatccttggcgccaaaaattggcagcggctggcgtgacaattgtgttaatcctatcgtgcatgctagaaccgcttgacttactgtggcacggctttcagtttccggtttggtatccataccggtttacatttgtattgtgcttctggtttttgattctgggtatcgctgtcctgccgcatttacaaattggcattcctttgcaatggttaggcgttctgctgcttgtgttcggcgctatttacattgatgtcgctgccaacctcaaacacttcagctttctgaccgtgggccacttgctttttggcgcaggctgtctgctgctgacttttgtctggtttagtttggacaatcgccggccagtctggttcggttttgcgatcgtgttaattgacttaagtggcagtttaatcctgacgcttaatcaactagcctatttgaatcacagtgattaccacgattataccgccgccttgattcgcgggacacagaccatccagcaacatgatcccggcttgtttcgagttggaaaaaccaccattcgtacccgtaatgaccccatgacggccaattatctcggcgcagaccaatttaactccatgttagagccggctgtccccaaattcttcggtcagttaggacaacctgaagacgatggttcggtggcctacacaaatggcactttaattacggacagtctactaggtatgaaatattatctgacgccaaccaaacgtgcggcaaaaaaactgccagatgccggtcaacgaccagatctaaagtggtatcggccaatcaaaacgacgcctacttggcaaatcctgcgatcaccttttgcccaaagtctgggctttgtagccgatactgatttgctcaaacaaccactctatagtgaaaccccgcttgccaatcagtccttaatcctgcaatcagccctcggcaagtcgggcaatccttattttacgccaacagcattagaggcaccgcaactcaccggtgtgcgccgagtctcaactggcagcgcacccacttatgctaaggttggtcacggtccccacgatgtcacttatcgatttaagccaataccaggtaaaatctatgtgttaaccctcggcagccagttcgctgaccatttagtgacactcaatcaaaatgggcaaactgtcaccttgccagatagttttaacgataccattacggtcaatgtcaccccccgtaatcctaaagctgaacaagttttgcggtttcgcctgaataaaaaagacgcctggtttgaaaattttgacttatatcaagctgacgccaagcaagttatccacgatcttaaaaaactgcaaacaggatcttggcatgtgatacaacacacggctaccaccgttgaagcgacgatcaacgttttgcacgaccaccaaatgctgcaaaccacgatcccgaccgcccctggttggcacgtgaaaattgacaatcgacctgtcaccgtcaaaaaaagtttaggcattttcatggccgtgccgctaaaacctgggcaacacatgattaccatgcgttacgtcccgccattattagggtggggtgctgtgataacggtgactggcctatgcttaacggcttgttggtatgtcgttgataagcggcgcttctcgcgacaccttgtttcgcgacggtgagatatccgaagttatttgaccgaccattgcaacccaaaagccagtatccgcacgtctttgatcgtagccaattgattggccgttacaatcaaaaacgcaggtatactggctttttaaatgcgctaattcatgcttgcctacaacactttctcagcatgcctaatgccactatagccgagccataaaagacgcgctgggcattaaagcttgccgaaagcacgcttattcttctttaaattcatacttcggctcatctaagtgcgcatcatagtcgactgtcatggcaagattttcaaagaaccatgcatcggttggatcaacaaaataagtgacgccgtctttttctactgccatgattggctggtcaggatgatcatcacgtgtcatgccaacactaaagccatcatgaacctgagtcttaccatatgccttcccaaaaaaacggataccagcacccttgtctggcaaacttaattcacggtgaaaccaacgacttgcttcatcagtgatcgcgagttgcaaccccatcatctccttgatcattttttacgagtccatgtttaagtgcataaatagctgcctgcgttcggtcctccacatccagtttcgccaaaatgttggacacatgcgtcttaacggtttttagcgtgataaaaagttctgtcgcaatttcttgattcgacttaccttgcgcgatcaattgcaatacctcacgttcacgattcgttaactcatcatactgtggttgcggatgattcatgcgattcatcattttagtcgtgacttgcggctccaaaactcgctcacctttagctgtttgccgaatcgccttggcaatttcctcggctgtggctgtcttgagaatgtaactggccgcccccgcctccatggctggatacaccttggcatcatcaataaaactcgtcaaaataataattcgtgcttgcggccatgccttcagaatctccttggttgccgtgatcccgtctttcaccggcatcacgagatccatcaaaataatatcaggccgatctttaagtgccatatcgacaccctcttgaccgttttcggcctgatcaaccacttccaaatcaggttggacccctatgtaagttgccaaccccaaccgaaccatttcgtgatcatcaacaatcaatactttaatcatgcgcaacatcctttgataatggcaccctgacttcaacactggttccctgtccgaccacgctcaccactttcgcagttccgcccatggccgcggcacgttccttgatatttgcaagcccataattaccattactgctggcttgtttcgcatcaaatccgacaccgtcatcgaccatccgcaacaccaccatatcctgcagctgtttcagataaacttcaaggctcgatgccttggcgtgtcgtaacgtgttacttaaaagttcttgaacaattctaaaaagattatcttcggccgctggattcaatttaatatcatccaactgccacgtgatctcgattgtaatcttggtttgcaattctttcaacaattgaataatcccttgtttcaaagatttgccttcaagattagtcggccgcaaatgcagcagcaatgcgcgcatttccgcctgtgcctcattgatcaccttttggatcgtatccagttgtttgctcagttcagcctgcgcagggtcacgatcagccacactacgcagtgcagataacatcatcatcgcagcaaacaactgttgtgagacagagtcgtgcagttcacgagcaagccgatgccgttcaccggttaaaatggcttcttttgtttcaccggaaaatcgaaccggcgtgttgctataccgttcaatctcacgttgtaagcgtatcattttttgccgcaactcttcaagcaaggctgccggttgcttacccaaagcgccgactgcctgctgcgagcgactaaaaataggtgcctgatattgtccagcatttaattgtgccaatcggctgtccaactgactgtgcatgactcgctgccgccacatgacaataaccgtcgcaccggtactgatcaacaaagcgccgattaccagataaaccaaaactggtgcggacaggacggtggtcaataacacctgcaaaaaatcatgttcggttactttagctagcatgaaaaccaaacaggcctcgaccaaaagcgcccagaccagtaatgccataaaaaagccaaccagcatccgtcttctcatacagccagcacctccaaatcgccgacacccacactcgtaatgatgtgaatgcggcgcggtgcatcatcatagtcctttgaatatgccgtgacactttggctatgcagcatcgaatctttattttcaaaatgcaaggtaccataaaaggcagcgtgttcaaccgcaacaccaacgccaatcggcaccagaattcgcgttttgccaaaacctttgcgaatcatgatcacactatcgcctttaggtagaaacgtatcccctaaatcaataatggtatcgccagctggcacaaccatattaatgtcatcccaatcataggttggcgaaatcgtatgccgatcagtccacgagttaatcgtgcgcttaccggctttttcactgggctcctgagtcactggcgctacatactgtttgcgatcccaagccgaaaaccccatacctggtttcgtaacgaccatgattatgaacacacccgcgatcattagaatgagccaaatggccggattgataaaaattcccaagactaacaaaatcccaccaaaagccacattgaacgagcgcaaccgatgccatcgcgcaccgaggaaaagaaaaaacacgcccactaggatcgttgtcagtgccataggattcgtgatgatctggaaaaacagccacagggttaaagctaactcgatgcctaaaaataattgccagcggcgcacgacgatccctccttgtctactttttagcgtatacattgactcgatgtcgattcatttcaattaattataacgaatttcgttgcctttgacttagggcgtaaggctgaatttgcaacccaagatgtggctcaatcgccttttcacttttttaaagccacaaaaaacgacaaacgtcttctccttgatgaccggaaaagacatttgccgttgattgcttttggcgcaagttgacaaagcgttatgtgctgatcagccttcaactttggtgatcttgatcttcatctcaccaccaggggtactgatcgtgaccttatcgcccactttacggccaatcagaccttgagcgatcgggctttcgttgctaattttaccgttgaaggcgtctgcctcagcagcgccgacgatttcatatgtttcttcatcaccgtcttcttcaaatgtgactttcttaccaagtgatacttcgttcttagcaaccgcttttgaatcaataatttcagcgtaacgaagcattgtttgaatggtcacgatccgattttccaaggtggattgttcatccttagctgcttcatattcagagttctctgaaagatcaccaaaaccgcgagcaaccttgatccggtcgataacttctggacgcttctttgtcttcagttcctccaactcgtcttcgagtttctttttgccttccgctgtcattggatagcttttgtctgccataaaattcttacctcacttcttattttccttagtcactgtattaagaccagccgcatttgtcaatgattactcttgcaaaccgcgttcggccagaatggctttgatcttagtaaccagtaaatcaatggcgacttgattttggccaccttcaggcacaatcaagtcagcgtaacgcttcgatggttcgacaaactgatgatacatcggttttaccgtttttaaatattgattaataatcgaatccagtgaacgcccacgcgataccatgtcccgcttgatgcggcggatgacccgaatatcatcatcagtatcgacaaacaccttaatatccatcatgtcgcgtaattctgcgtcatcaagaatcagaataccttcaagaataatcacatcttttggcgccagatgaacggttcggtcagagcgattatgaatcgtgtaatcatacaccggttgatcgacagcttgccgatggatcaaccgatttaagtgatcctttaacaatggtgtatcaaatgccagaggatggtcatagttaatcttttttcgttctgaaaacggcatgtcacttttcttgtaataagcatcttgcgctaataaaagcaatgagtgccccgaaaaatgatcaaaaatcgctcgactcacacttgtcttgccgctggcagaaccacctgtcacgccaatcacaatcggttttttctgctgcaccttgaaagccctcctcaaaactcatccttcagcccagaaacaaccgcataaggaccctggtcacaatgaccaaggtccttatgcggccaaagtccaattaggttacttatctgccgctgcattatcgctggcaaacttagccgtattggcatcatgttgttcccgtgttgtcgcgtaaagtacttcaccagttttaaggttagcaacaaagtacaagtagtccttgtcacgtgcatcagggctgagaaccgctgtgatactttgctcacttggcgagtcaaacggtcccggtccatagccggtgtggacgtataagttgtacggtgaatcaacgctagtatccttgttagtcagatgcgttttatgcgtgttcaatgcatacataacagagatatccgattgtagtggcatccccgcatcaattcggttcaagaagacgccagctattttgcgacgatcatcttgggtgaccccttcacgctcaactaacgatgcaagcgtcatgacttcttgaacggtgtattgctgcttcttaatgctcttgtagtaactctgcatcacactgtctgtcttggcaaccatcgcatccacaaggtccttgactgtttcaccagcgccaacgttataagtcgcagggaaaagatagccttccaatcgatagcgaactccttttgcattggccgctgaactcagcaattgcggatatttcttagccaattgattaaagaaggtttgatctttcatcaatgccagaaatttctttccggtcagatttttgttacttttcgttaacttatccatcgacgtcgcgatttgttcgatcgttgtgccttctttaactagcaattggcccgcagcagtggtggcactgccacccgcgcgcaaggcttgaatcaccgtgctcatattggcgcgttgtgtcaacttgtactggcccgcctgaaagtcggcgatattgtggaatttcacatagtaactaaaaacagtggcgctcttaatgacatgtttggcttccagctgcgcggcaatctgtttcgttgacgaacccgctggcaccgtcacactaatcgacgtcttgccatttggatcaaccggctcaagcgctgaacggacatagcggtagcccatcaaaccaacgatcactaggaccgccaatacaattccaataacccaagcaacgatcttgttggctgctttcttttcactagaacgctggcgccgcttgtcttgtcgatctgatgaccgtctatccaaaaatgttgcctcctctaaggttaacacggtcactggcacagaaatctgcacttaaggaccttgtccacaatggccaaagtaccggccatcgtgcccaaggctgcctatgtgacggtttctaaacgtgcctgtgcccgctctacttaactattctgaacaataaatctgaatcagcaaatattatacccaaccagcgacaaaaatgcgactgcatctagcgaatggcagccccgattcctgtctgtaacgccgccttcactttatcaaacgcctgcgtcacttcgtcttcagtcaacgtctgatcgtctcgacgataagttagcgtatacgccaaactcttctgacccgcggcaatgtgatcgcctgcataaacatcaaacaacgtcacatcctgcaagaaggcaccgccgtgttcatggaaaatagccatgacttgatcgttcgttacttgctcgtcaacttgcaaagcaatatcacgggttactgccgggaacttcggtgcgggttgcgcgattttttcctgtcgtggcgcggcaaatagcgcatccaaatctaattcaaaaacaaaggtggctggcaggtgctctgcatgttcaaaggcaggatgcaagcgccccaaaatgccaacaagttgatcgccgacaaaaatgtttgcggcctgaccaggatggagttcagcaacagcttgcgttgcttcaaagcgaatcggatcggccagcgaataatcacccagcaaatgtgtcacaatgcccttagcgtaaaagaaatcaacggctttcgcagattgatgccaatcttttgcgacaacattgccagtgatggcaccacccaaatattcaatttcggttggccgcacctgatcgcctgttttggtaaagatccgaccttgttcataaatcgcaacatcggtttccttccgcgcttgattatacttgatgacatttagcaaaccactaatcatgttcatccgcaaaacagcatgatcggtcgtcatcggtgaatcgactttggttgggagcccaggttgcagcttgaattgctcggcagcctcggcacttgtcaacgcataggtgatgacttgggtcagacccaatccttctaatagatgacgtgtacgtcggatccgtttttgttgcgaggtgtactcgccaatagtcatggttgtcgttggtaacgtacttggcaaattgtcaaacccatagattcgcgcaacttcttccaccaagtccgctttgatatgaatatcccaccggcgcggcggtacagcgacggcaaacaagccatcagattcggtcacatcaaaaccgagttgttcaaaaatctgcgtcacttgttgctgcgttaaatcggtacctaaaacatggttgatatgatcaagcgaaatatcgacgacaacatcttctgcagaaactgaagtcgggctaaccgttccctctgcaacctggccctcgcttaattcagccatccaagcaactgcagcatctaaagcacgattgatatcagccaagttcgtccctttttcaaatcgggaagaggcttcagaccgtaaattgtacttaagggctgttttacggacattgactggattaaaactagcagactcaatcacaacggtagtcgtttctggcgtaatttcagaattcaagccgcccatgacgccagccaaagcaactggtacctgcccattcgtaatcacaatatcttgatcatctaattcatgttcattgccatccagcgtggtcaaaggttcgccatttttagcgcgccgcaccacaatctgctggctgcctaacttggcatagtcaaaagcgtgcagcggttgcccataagccagcataataagattggtcacatcaacaatattattaattggacgaatacctgctaaccacaggcgtttttgcaaccacaaaggactttcttgaaccttcacatgatcaatgacacgcagttgataactcggagcgtctttggcatccttgacctcggcactcaaaaagtcgccgaccggacgatcaccttcagttaatggcttttcttcaaaatggggtttttctgcataagtagcgccaacttcccaggctacgccccgcatgccaagtgcatcagcgcgattaggcgtgatctcaaagtccaaaacggcgtcatgcatgcctaacgcagctaaggcatcactgccgggctctaatggctcgttaaagacatagataccattcaaatatggtttcggcacgacgttttcactaaaaccaatttcctgtaaggcacaaatcatgccaaggctttcttcaccgcgcattttgccttttttaatttttacgttatccgcaatgcgcgcacctggcagcgccacaatgacagtctgaccggcagcaacatttggcgcaccgcagacaatttggcgcggcgtttcttcaccgacatcaacttgacaaagatgtaaatgatcagagttcggatgtggcgtagcacttaccactttaccgacgacaatctttttcaagccggcgtctggatgcttcacgccatcaacttcaatccctgttcgtgacactttatcggccagttcttctggtgaaaccggcacgtcaactaattcttttaaccattcatatgagacgtccatcttaaccctcctggctgaattgcgttaagaagcgcaagtcgtctgtgtagaaactgcgaatgtcgtcaatcccgtatttcagcatcgcgaaccgatcaggaccaaggccaaaagcaaaaccgccgtaaacgtcagcatcaatgttcgctgcccgtaacacattgggatgcaccatgccggcacctaacacttcaatccaaccggtatatttgcaaaccgggcaacctttaccgccgcaacgaaaacaggaaacatcaacttcaacggatggctccgtaaatggaaaataacttggccgcaagcgaattgtccgatctttaccaaaaacgtgttggcacatggccaacaaggttccctttagatcagccatggttatatgcttgtcaatgacgagtccttccatctggtgaaactgatggctatgagtagcatcgtcgtcatcacgtcgataaaccaccccagggctaatcattttcagcggtcctttggtaaagtcgtgcttttccattgtccgcgcctgcattggacttgtctgcgagcgcatgagtaactcattggtaatgtaaaaagtctcttgcatatcacgagcaggatgatccttagggatgttcatcatctcaaagttatagtgatcttcttcaacttctggaccggtcaaaacttggtaacccatgcccataaaaaagccttcaagatcgtccataatttgcgtgataatatgtggtgtgccagcctcaaccggatcaccaggcaaggtcacatcaacggtctctgatgctaatttcgcattgatcaccgcctgttcgagctgggctttgcgggcttcgatcactgcactgagatcgtcgcgaattttgttggcgaacgcgccgacttttggccgttcttcagcggacaaatctttcatgccgcgcaaaacaccggtaatcgggcccttcttgcccaataattggacgcgaatctgatttaattcatctaacgacttaacctttttaatggtgtcgttgttttgttggaacaattgttcaagtttggtttgaagatccatgttcttcctccttggttgctgacgtgagggttgatacaactttctgatgcatttgaaggcataaaaaaagtccctctcgaaaaagggacgaagcatcgcggtaccacccttgttcatggtcacgaaataaccatgcactcaacaaggtaacggctaggccggagctttctaagtgttgccacttcaaaagtcaactcagaaagtgaagacaaacactttgacgatagacgtcttgcagtcgtatgaacgtcattccctatctcgtcagcctgtttgggctttcgtcatcgtttttacgtctttttagataaactaagcttagcaaattcagcgccaacgtcaagtggtgattcgcgctagttaataaaaaatgtggtgtcatcacgctccctatgacttgtcgtttgctagactccgagtaagctttgaaaggaactagacgatgcagtccctaacctcggccgtgccaaactccgcaatctccggccagacggggctggaacgctgtgacggcgcttcgagcccgcaaagcccgcggtctcgaagtcgcctaacaacatcagcgacaagaccggtcgctgtgttgtttgcacggctgagccccatctggcctacgattgctccgccttagcactgaaattttgaaatcctgtatcaaattgtctatgagaaacgaaagacgaataattttccgcatttggaaaaccattcgtctgcatttgatacttttggattatgctgaatccctacttctcgttagcgtggcattcagcatctgtgacccatgcatcgccccatgcgtgtgcagcggccataactgaattgaggccgcggcctttgtcagttaacgcgtattcaatcaaagctgagtctttgtgggtcaagcgatccacaaggccttcgccttcgagttcctttaagcgttcgaccaagacccgatcggaacaccgcgggattaattgcgcaatgtccttaaaacgggaattgccattgtttaataaaacttccaaaatcagtccgttccatttctttcctaagatctcaaacgtatgttgaaattttggacaaagagcgacctgctggctttgacaatcggctgtactggttactgttgcatccactctactcacctcataattcccattcacttacatttatatagtgctagaataccacaatgtgaaaatattacaagccagtcctcgagaaacgttgaaaaatatggcaaaactttccagaaaaagaaccacggcattcatccgtggttccaatcgtccttcacagccaaatagctgctaaaactttgcgatcctaatttaaagcctttaagtgagtgtggatcggatgccggagcttgtgcatccatggtacaacgacttcatccatggcggcataatcatcgacaagtgaaacaacgaaactttccttatactttggtaagccaaccgttgcgccccacatgtgtttgacgataatgtctttttccatcggtgacaattcagtcagcttttcagcattccgcaaagcaatccgtggatggatgaaggcatgagtccccaagtcaaacttggttttacgccaatcgtagtaaaacaggtcgtgcaacaagcctgcccgggcgatcgcacgaacattcaagtgcagccgtttcccaatcagataactctgataagaaacactgatcgagtgttccaatcggttagaataatgatgttgcgggtgttctgccagtcgctggacttcgggtttggctaaaagatccgccacatacccaacgtactcagcatccgattgccaatcgcgttttttgctcaagacatctgctccttttgtggtttgatgaacatacttatagtataacaggttctaaccagaaaggtcacgtttgtaagggattcttaatccccgactaaatgaaacatcatgactgctgcagcaaccgccacattcaatgattcagctttgccccggatcggaatgtaaaggttcgtatcggtattttgtaacaannnnnnnnnnnnnnnnnnngccattgccttcattgcccacaattaaggcaaatcgttcgctcggttgaatgctatgataacttttagctttttcatttaattctgagccataaactgggatgccgccacggtgtaaggctttgataattggcattaatttagcggagacaatgcgcacatggaattgactgccttgcatcgcacgtaatacttttggaccgaacgcatccgctgtcccattaccgaagaccaccgtttgaatcccagctgcatctgcagttcgcaccaaggtcccaacgttacccgggtcctgaatcgcatccaacaataagaactgaccactcaatggctctggcaattgttctgcgcggcgcggcatcacagcaaaaatgccttgcggggtctgagtgtcgcttaaatgctcagaaacggattcagaaatctgtgtgattttgtcataaaatggcttgagcgcacgatcttcaacatacttttcggtcgcataaatatcataaggggtctggccactggcaagtgcttcttggaccaagtgacggccttctaataagtagcggccagcatccttttgatgttttttaaccgtgagtttcttggctgttttgattctgtcattcttaggtgatgaaatatattccatgaagttctccttatttttaaatggtactttgtttgcttgatgccgtttggcgggttttcttcttgcaagacaaaatccaacttaagtctgttgtcgtttctactataagccttatgctacactagtatggactgtggagaaagctaagatgagcaaatgctgcttgacagcatctccaattaagaaaggaagtgtctttttggtcaaacttgctaaacaaatcgtcgtccgcggacgggtgcaaggcgtcggtttccgctgggccacgaagatgatcgccgacaatcttgatattagcggcacgattgagaatcggtctgatggctctgtctttattcaggctgcaggtgaaccgttaaaccttgccaaatttgtggcgaaggttaaggccggtccaaacccatatgcaaacgtgtcgacctacgaagaacagccgcttgaagacgtgccaaacttccgcggttttcaagttaccggttgaatccaaccagtccatacagtatagttaaacccgattacattttgaagggaaaacattcatgcacaagtcgaaaaaatttgtcacacttgggttggtgagcttgctgccgttgattttagcagcatgcgcgcaaaccactaaaaaaggcacaaccatgaagccgccgacggatccgttttttggcactttttataaagtgatcggactgccactgcaacatttgatggagtggatcgccagtctggttggcactgccagcagttatgggatcgccatcatcgtgatcaccctgctagttcgtctgattgtcctgccactgatgctgcggcaacaacgaacgatgacggcttatcaagagaagcagaagatcatccagccacaactaaagatcgttcaagaggctactaagcgcgccaagacacctgaacagcagatggcaatgaacggttacatgcggaaaatatactcagccaatggcacaagcatgattccttccatgggctgcctaccaatgctgattcaactgccaattttctctggtttgtatcaagccatcgcttactccccagaaatttctgaagccactttttttggcattcagttggggcattccaattttattgtcacgattttagcaactctgccatacattgtcgtcagcttgatcatgctgcaaggcgtaccgccagaacaacgtaaagccatgcagacaactgcctttctgaatccgatcatgacatttgtcttttgtatgatgtacaacgccggattaggcctctacttcggtgctggcgggatcattctgattattcaacaagcgatcgtaacctatgttgttacgccgaacatccggaagcgaatggatgctgaaatggaagaaaatccaccggttatcgttgttgacgaacatacttttgataactgggatacggcaactgctggtgccactggtgcagctggtacaacaggtagcagcaaacctgctgatccagacgccattgatcatggcaaattacgtcggcgtaacgccggtaagcaacaacgtccccggaaataatcatcaagtcatgaaatagccctgatcgcaaaattagcgatcagggctatttgtgtacgcgacaggatctgaagccaaaagtatttgatgtccccctgtttgttcgcctcatacagtgtgggttgcttgatgacacgctcatatgaactcaccctgcgcttgaaaacaaaaaacctcagacaaatagctcgtctgaggtataaaacgattaaagattactcttgatatgggtatcagttttgcctgcttctgcgcgcttagtggtttcctgtgcagccagtgcttgggctttagcttccgtgatggttggcaaatcaattcggaaaatggatccatgacctaaagcggagtcaacttcaatttgaccgtgataactctcaactaactgttgcgcgattgataaacctagtccgttgccgcctttttcacgactacgagccttatcaactcgataaaaacgattaaagacgcgtcgacgatccgcttcggcaataccttcaccaaagtcttgcaccgcaacggcgacaccggaaacgctgttttcagccattgatacgtgaatctccttgcgatcagtggaatacttgaccgcattgtccaataaaataatcatgacctgttccaaatgattgcgatacatacgcacaaacgttttctgttccaagtcgtcatctaatgtaaacgtgaattccggatgaatcatccgaaaatcaccaacgacttgttgcacagtctggtgcacatcaacaaccgcatttggaaattggatatccacttgatcagcgcgagtaagatctagcatttcttgaatcagactctttatgcgagtcacttcctgcaatgaggccgttaaagattccgccaaaacttccggatcatcttttccccagcgatttaaaagctgcaaatgcccttcgagaatcgccacaggggtgcgcaattcgtgggaaacatcctgaacaaactcaccttgctgatcaatgtagcgttgaatccgatccaacataccattaaattccagcactaaatcgccaagctcgtcgttgcgcttcaaggctggtattcgaaccgtactctgcggttcctcattgacaacatcaatagcattcgtaataagcttaatcggcttgagaaagcgcgtcgccaaagcatagccaatgagaatagaaataagaatagccgcaaatgacagtcccataatgagtaacgtaatctcatgcatggtcgcatgaaatgccgtcagtttatccgtaacctgcacatagccgatcaaatccgaactagttgcagaataaatcggtgccgtaccgaccaagccatgaaaatcatcaatattggcttcttgaacttccacgccatgaaccttgcctaatgtaatcggcgtatcgcgcgattgaaaaatatttgtccgatcaggtgaaaaaacagagacgctcacatccgcttgcgctagtttttgaatcacggaatcggagaaaatacgattttgcgattcacttggcactggaatagaggtttgtccactcggcattgcaccttccaatcgcggcacgacctgcgccatcgttaagtcaccactgactggggaaagtcgttggacgacggtgttaagggtgtccgtcacggttcggcgttcctgattcactaaaatctgccgcatcgcgccataaaggatcattgaaaaggtcacaaaggtcacaaaaatcccgacacctactgttaaggcccatttaacctttaacgagatgcggggactttttctagtttgctcaagcgtttgtttcttcggaatcattacgaacgcataacatagccggttccccgaaccgtttgaatataactcggttcacccggtcgatcgattttattacgaatataacggacatagacgtcaacaacattcgtttccacgtcagagttgtaaccccaaacctttgagagcaaaacgtcacgagccaaaacaacattgacattttccataagcgtcagcaataattcgtactcacgtttggttaattcaataatgtcgtcgccgcgccgaacaacgcgattttctttttcaatcactaaatcacgatatttgatggttgtctgcttagcggtgttgttttcgccttcaatactgattcggcgcaacaaagcacgcaagcgcgcgagtaattcttcaatggcaaatggcttcacaatgtagtcatcagcgccatgatccaagccactgacgcgatcaatgacagaatcccgcgcggtcatcataatgatcggtgtattcttcacctgacgaacgcgccggcaaacttcaaggccgtttaattctggcaacatcaagtcaagcaagatggcatcccagtcctctgccaaagccgcttccaacccggttcgaccgttaaaatgcacttcggtctcatagccctcgtgttttaattccagttcgacaaaccgcgctaaatttttttcatcttcaataattaatattttactcatcaatggtctccttatacttattcgtctctgacgcactcacagactgaatccatttgttttttctcataaaaacatatgctacgacagtttagcacagttttctcattttgactatcagccgcgcaacgatggggctcgacaaacacaagaaatctttgttcggagactttctcatttttcaaaactggtaaattctcataaaaagaccaatccttcaaacaataaatatgtttgtgagattggtcttcatttttataaatatgaagttattaagcttcggtataccatgaatagtggtagatgccgtcgcgatcggttcgttcgtaagtgtgcgcaccgaagtaatcacgttgtgcctgcgtgaggttagcaggcaagacggctgaacggtaggaatcgtaataactgatagcggctgagaagcctggaactggtacaccagccttgacagcaacaccaactaagtcgcggacactttcctgataattcttggcgatattcaagaagtagtcatccagcaataagttctgcaaatcgggcttcttattatacgcatcagtgatgttttgcaggaaacgagcgcggatgatgcagccagcgcgccagatcttggccaagtccccatattgcagcttccaatcgtacttctctgaagcaaagcgcaattgttcgaacccttgggcatacgacatgagcttactgaagtacagagccttgcgaatcatttcaatggcttcttttttgtcaacagaaacattggcaaccggcttcggcaataccttgctggcctcaacccgttcttgtttcatggcactgatataacgagcgtagactgattcagtaatgacactctgcggtacccctaattcaagtgctgactgggaggaccacttgcctgtgcctttattgccggcacgatcaaggatcatgtcaacaatcggtttgtcactgccgagatcatccttgcgagtcaaaatgtcagcagtgatgtcaatcaggtaagaatccagttcgcctttgttccattcactgaaaatatcagccatttctttgacatcaaggccaagaagattgcgcattaagttgtagctttcagcgatcagttccatatcgccgtattcaatgccattatgcaccatcttgacatagtggcctgctccgtttggtccgatatacgtgacacaaggtgcgccgtcttcagccttagcggagatggcttccagaattggtgcgaccaggtcataggcttctttttggccgcctggcatcaatgaagggccatgcaatgcgcctaactcgccaccggaaacacccatgccgataaagttaatgcctgacttgtcgagctcagcactgcgacgcatggtatcttcaaagaaagtattaccgccatcaatcagcacatcgcctttatctaataacgggagtagttccttaataacagcatctgtaccagcgccagccttaaccatcatgataattcggcgtggtttctcaagtgatgcgacaaaatcttcaattttgtaacttggtaccaactttttatccggatgctcttcaacaaccgcctttgttttgctgccagtgcgattgaagatagcaacggtattgccgcggctttcaatattcagggcaagattcttgcccataactgccatgccgacaacaccaatttgtggtttatccatgaacatggacctcctcattcatttcgtcatttactccttttatgttagcagaaacagcttgggtttaacagtcaacagctagtttagaagcggtcaatttttcttcgcttattttctttgaaaaagaagacgccgcctcaggcaaacagacagaatcagctttgtttcaactattttaaaatgctatccctctgtgtgagctgttatcacggtgaaactgttagcattaattgtcacgatgatgtgatcaatcttgacgtaccaatttttaccctttcgattcatgattgcttcaggattcagaattttctctttgcaaaatgcaatgacgtcccgattagtaagtgaaagattgtgttcaatccggatgcgccctagttttgtagtgtgcaatttgtctaagtttctcagtaactgattatcagaaatcatttttatattcaccgcagcgagctttattttttgagtccgctcccttatcaactgtttttgagtcatgaacccaacaagactttctcataaaaaccgttttcgctactacaaaagaaaatggcatcctcgcaatacaattacgaaggtgccatttgtcaatagatcaaatcgccttaccgtgagcctgaagaccttattgatcacgattgatcgtcatcagggaacattccctttaatttcgtaaagggattgtccgcctgtttttcttttttaacagctttatcaaaatcctcttcagctaaaacttcccagtcatcgcctgagggcatatcaccgcttgcgacttcttctggtgtcaggacctgcattggaatgctcaacaacagatggtcctcaattgctggcaacagatccagttcagcatcttcgagcggcataagaatttcgccgtcctcatattggtcagcatgaccagcgtccgttaaataaatttcgctgaacgtaaaatcttgcggcagtgtgaccggcgtcaaactgcgcgttgacggcacaaccaaattaccctttagattaacactgaccaaaaagtcaccacgatcatagacaatatcgccgcttacctgaatgggactcacgtcaagaacctcgggatcgcgatcctgtaaatccgttttaacatctaacgtggtgctaaaatgcaacggctcctgatcgtgttttattaactcctgaacggtccatttcaacatgtggtttacctcctttaaacgcgttcgtaggcgcagaaacctgcacataagagcctcaagcctcaatggccaaggaccagccattgaggcttgaggccacttatgttccggtttctaaacgcgcctactcacgctctgctcataaacgcgctcactggcgcagaaacctgcgtgtaaggacctcaggcgcaatgatccaagttcggtcatcacacgtgaggccgcttatgctccggttactaagcgcgccagttcgcgctcttcacatcagtggtcgtcggccatagttctgctcaacgccaccaatcgttgtgattaatcgatccgcgcgatgggtcatcgcgaggacgccatccggtgcaagcatatcagcactgacctttgtgagcaagggccagtcaagatcatgcttgacactattgagatactgccgcccagttggcgtgaaccctaaaacatgcaactgcgggtgttgccgtgcctgattaaccgccgtagccgtcatattcaaagtaatggccaacgctagccgtcgcaaccgcgcataggtatagcgtttcgattttacctgcttcaaaaaagcagtcatgtcttgcgcgtcatcaattttttgggtgaagcgatactctaacccttctgccatggttgcgaccagccgcagttcattgagctcggctgtttgcacgcgatatttcaaccacgggaaaaattgtgcccagctatactgttgttgcttagcataaaaatcgacaagctcagtaggcacgatggcttcaaccgattgatcagcacgtaaatactcacgcactgtcgaggcgctggcgatgttggcttgaatgcctacttcatcatgaccaatcccacgacgcgcaaatggtaacaatgtcatcggcctcttcaacgctaaattagccttggcataactcaagcccagcataaaattaggatcagtttgggtgatcccagccgcttttgcataaacagcgttgagttgcgtggcgtatgtctgcgtataatcgcgaaatccatcctcagttaacgctgctgtcgccagtttttcagctaaatccgcataagcaacttcaggatgctcagtaccaaaggctaaagtgttgacacccatggcggccaacgcggtcacaccggcttcagcaaactggtcagcggcctgaacggctccggtcaccggcaactcaacgacaatgtctgcaccatgctgcaaagccgcctgcgcccgaacccatttatcaaaaatagccggctccccgcgttgtacatagttaccagacatcacgacaacgacaacatctgcttgcgccagctttcgcgcttgtgccaaggcatatgcatgacccgtatgaaatggattaaattcagcaatcatcccaactgtctgcatggccgcctcctaaactgcaagatcatcatggtcattcattttttcttcgcatgaaaaaaccagcgtgtgctgtccgcctgaattggctgacggccaaaatcagctgtcacttcaattttttcaaacccacttgcggttaaggcatcgagatagtcgttaatcggataagttcgttctttatgggtttccgtaagcggtttataggcatccaggccttcatcataaagaaagaacgttaaatcatgctcaacactatgcggcacctcacctacgaaactgtgccataaaaaggcaaaatcatcggtctgataattgtacatataaccaggaaaaatctgatccatttgatatagcgagtgcgcatcgaaaagaaagtccccgcccggcggcaacaaagatgctacctgagtgaagacttgctgaacttcttcaagattcgccatataacaaatggaatcgtcaaaacatgtcacgaccggaaacggtggtaaatcactcaaatcacgcatgtcgccttgaataagagccagttgggcatcggcttcctcagccttttctgccgccagcgacaacatttcgtccgataaatcaaagtcggtcacctgatagccggcttgcgccaacaacacagccaagaaacccgaaccgcctgccaactccaagataggctgaccagctggtgcaacccgcttcgtgacataatcccgccactgcgaatagagtgattgatccatcagtttgtcgtaaacttcggcaaacgtttgataaatcatgcttcaacccactgatctacttcaaccagcggtgcttcctgccataacttttcaaggttgtagaattggcgttcttctggcatgaagacgtgcacgacaacatcgttcatgtcaatcagcatccatttcgatcctttttggccttcaatacgacgaatcgtaacgccggcttcttcttctttatcctcaatttcatcgacaatcgcttgcacttgtcgatctgaagtaccgctcataatgacaaagtagtcagctaataaactgacaccgcgcatatctagcgccacaatgtcttcagcacgcttagaatcacctgctttgacagcaacttccaacatcgtttttgaatcaatcataaattactcctttgttaagaatgcgttataagttaatagtgtctttggaaaaacgagtttgcgcgcaccaatgagataagtcaaggtattctccaattcaattcgactagcttcttccaagttcgtttccgctgccttacgcgcctttgcttcaaccggcaaagatcgcgccggttcgataaaatcaccaacaaaaatgatttcatcaagcttggtcatttccggatcacctgtcgtgtgccgcgcaatggcagtcaatacttgcttatcagtaatgccgacctctgtttgaatgaaatgaacgccgacaacaccatgccaaacgccgcggccatattgcaacaaatccggatcgaaaccatcttcaataatcacgcgtttataggtctcaactggaatctctttaccataatcgtgcagtaaacctgctaagcctgcgcgatcaacgtcttgatcaaaacgcttggccaattcaatggcagtcgcttcgacccgcaaacaatgctcataacgcggttcatcgagccgattgtgcagccgatttaaaatttcctcacgacttaagccatgtgtcagacttgccggatattgatgttcactcacgatataatccctctttttgaatataatcaattactgaatcaggtaccagatacttcaaacttcggccattttcgacccgatcacgcacatcagttgagctgatatcaatcaaaggcgcatccacccacagaattggataacgactagctggcgtatacccacgccgtttaacaccgacaaatgtcaccaatttgacaagttcgtcaatgtgcgaccactttggcagataatccaccatatcggctccaataatgaaataataatcggtgtctggatgtaaccggtgcagctccaacatcgtctcataagtgtagctgacaccgcctcgtcggatttcaatcccttccaatccaaaaagcggattgtccgcgatagctagttgcaccatattcacacgatgccgcgctgaaatggcagttttagtgtcgacatgcggtggttgattatcgggcataaaataaactttttctaatcccaactccgtgccagctgcttcggccatgattaaatgaccgttgtgaatcggattaaaagtcccaccaaataggccaatctgttttcgccgatgctggccaagaatctgctcgcgcatttcaacggagatcacgggctgggtcaatgtgacactctgcgtcttctccatagtgatcctcttagcgtgcgttaacttccaggctaatttttcgatgatctttcttctcagcctgcttatagacaacaaccgtgtgaccaatgatttgggcgatctccacaccttgaatggccgcctgtaaggtatcggctacctcttgcggtgtatcatcggcagccggcagtaaactgattttaactagttcccgcgcttcgagggcatctttcaccccagccacaaacgtgtcacctaaaccgttcttaccaacattgattaacggcttcgtggtcatcgccaaactgcgtaaatatcgtttctgtttccctgttaacatcaataacgctcctctaaccgtgtcggcaggcatagctctttaaacacaactggctgagtgcctcgttgtggtcatggatacttaccgccgtacacgttttacttcgacatgattaattatgatacgaaagatagtttttctaaatgaacgcacgccgtaacaaaacatccacaccttttggcgcatagccggcaaccgtaacaccagcaggcacagtgatccagcctaacccggcgaaaactaagtcggctttttcctttggggtgaattcaaaccgaaccaatggcggaaagtctggcacttcatccgcctgtggtggtgacagtaaaccgcccacatgcttctgatagaaatcatccgcattttctaacttggtgcgatgcagtgtcaactgattatcagtgtaaataacgaaactgttgcgacctccgcgaaggtaatcaaatcgcgctaaaccgccaagaaaaatagtttggccttcattcaattgataggttgctggcttgatgacggaagtcggtgagactaattttaagtctttagggccgacaaagtgtgccatctgatgccgatgaatgatccctggtgtatcaatcaatgattggccatcatccagcgggatcataatgcgatccaacgtcgttcccggaaaacgcgacgtggtaatcaaatcctcaacgccagtcaattcttttataattcgattgatcaaagtagatttaccagtattcgtcacgcctaccacataaacgtctcgatgatcacgatatttttcaatggcatccaacagctcatcaacgccaaaaccttttttagcgctggccagcatcgtgactaccggacgcaacccttgtgcctttgcctgctgctgtaaccaattcttcaatcgattcgggttaagcgacttcggcaacacatcggctttgttcccgacaagaatgactgggttgtcacccacaaaacgatgcagtccagggatgacactgccattgaaatcaaaaatatcgatgacgttgacaatcaacgcattactttcaccgatggcattcaacaagcgtaaaaaatcatcgtccgtcaacgtcaccggcgcaatttcgttgtagtgccgcaaccgaaaacagcgctggcaataaatctcgtcatcaggatcggccttgcttaaagtggcttttggcaagtatcccggctttttgggatcagttgtctgcaaaatagcgccgcagcctatgcaacggcgctctgtttcagtgttcgtggtatccatgaatatcctcctgataatccaaatgccgtttcttagcgagtgctttaaaaacgtaaccttcaaagtaacgattaattctggtgttccacgcatcactttgaacaagtggctgggttaaaacggttcgcacaccagcaagattgcctgcccaaatatcggtcagcaattggtcgccaaccatcaccacttcagatcgcttaagccctaattgtttgcgcgctttcgtgatacccacaggaagcggcttcaaagcacgagcaacatatgccacacccagcttggccattgccttgtggattcgatttgcattgttattcgagacgaccaccactttaatcccgctattgcgcaagtccgtcagccagcgagtcagtgtttcagtgccttcgggatgatcccacgccatcaacgtattatctagatccgtcaagaccgccttaatcccttgttgtttcaagctggcaggtgtcaaactgaaaatattcgttaccagccaagtcggctcaaaaactgccacaaatcttgtcccctctccggttttcatatccttatattatagccgaaaagcgtgccgagcgcgagtcagcttcattgacaggcgtggcgagctccaatcctattgatccaaaggtgtacgcctttgtccgggatggttccgcgagctctctgcttgccattaaaattaaagaagctagttaagctactctgttttcttccaacagcaaaatccttcagcaattataaaaattgctatttttccaaacaagcgtcaagcttgaatgaaaccgttatctttttaaagacgaaatcatcgccttatatgtcaaaacaaggtacgattaggttgatagcagcgactcgcattcagcgaataagactgttatacttatttttagtaagtgtatcaaggaggaggcaatgtcatgacccgtttgcatcatgtgtcgctgttgaccggtgatgcaccagcgacaattcagttttatacaaaggttttaggtttacgtctggtcaaaaataccgtcaatcaggagaacgttcatgttcgacatctgtttttcggtgattaccaaggaactcctggcagtgtggttaccttttttgcgattgatcgattggggcatcgctacgatgggcaaaatcaattgggtgggattgatcttgccattccaactgggtcattggcattttggaaacagcgtctgcggatggcaggttgtgtggtgacagccacgctgaccagtttaactttggttgatccggctgatacgccggtcagactgttggtgaccgatcaaacgttaccaacgcaacttgtcgtgccaaacgatgttccgggcgaaaaccagattaccggattaattaatgtcgatctcccagtggccgatcatgaagctgaaaagaccttctttcaaaccatgctgggtgtgacccccgaaaataatcaattcaagcttgaggccggtaacaccttgacccttaagcctagcctcactgatagcatcaaacgatttggccgcggaagcatggatcattttgcgttaaccgttgaccatgaagaagcactgccgcgactggggacaattgccgcacaacatggctatgaagttgaggagtttgctgatcgcggctggtttaagagcctatatgttcgcgatcctgccgataatcggattgaatttgccactaaggaacccggctttgcgttagatgagccgcttgcccacctcggcgaaggtctcggactgccgccgaagttcgaggcacaacgtcaagccattgaaacgtattttaaaaccaaaggagtggatttccatgattgaacacacattattaggtatgaaccacgtcacagccatggccagcgatcctcaagcgatttttgacttcatgagcaaaacgctgggattgcatcttattaagaagacagttaaccaagatgcgttggatacgtaccatttttatttcactgatgatcaaggtactgccggaactgacatgacattcttcaccttccctaaccagcctaaaggtaaaaaaggcacgaacatgatctcccgcgcaagttttcgtgtgcctagtgatgcagcgttagattattggctcaagcgatttgctgaaaaaggggttgctaatgaaggtattagcaatcaattcggtaccaagattattaacttccatgatcaagatgatcaacagtatcagcttgtatccgatgaaaacgatcatggggttgccggtgggacgccatggaaacacaatgacgtacctgaggaattcgcgattactggccttggaccagtgaccgttaccattttcaacttaggtcatatgcaatatgtactgaccgagattatgggttataagcaaattgctgaagatggcaactggtcactttacgaggttggcgaaggcggtcatggcgcccaagtgattcttgagcatcgagaagatctgccgattgccgaggagggctttggcaacattcaccacgcggctttctcgactgagaatcgagaaaccttaggtacgtggattgatcgcatcaagcagtatcgtttgccgcaatcaggttacgttgaccgcttctacttcaaatccgagtatttccgcgcggcaccgcaaattttgtttgaacttgcaaccaccggcccaggcttcttacaggatgaaacttatgatgaagccggcattcacttagagttgccaccattcttggaaagcaaacgcgaagaaattgaaaagcaattaaccccagtcaaaaccgactggcgcggacgttaatgattggaggttgcgatggcagaagataaagtaaactacgcatttgttaaaggtgatccaactgtctcaccattactattactgcatggccaaggcggcgatgaaaatgacttactgccaattggcaagtacctctcgccaaatagtcccatgttgtcgattcgcggtcgcgtgtaagaacaaggcatgaaccgctacttcaagcacacggaaaatggcggctttgatttaaacgatcttgaacaggagaccacttggctattttcagtgttaaatgacctttgccggaaatttgacatcgactatgagcgatttatcgtgatcggctattctaacggcgctaacgttgctgcacgggcgctattgacgcgaagtgatacattccacacaggcattttctttcacccgatggcactttcgacagtcgattcaaaacaagatcttagcgatgtcaaagtctggatgtcacatggcgatcaagatccgattgtgccagcacaaaacttcaaagtgctcgatacgtaccttgaagagcaaggtgccgatgtcacgattttccgtcatgggcaaagtcacaatttgaatgaagaagaattgacaaacgccaaaagctggctggcaaagagtggtcggttagctgattggcgacggaggtgaaagactatgcaacgttttggttttgaacagtatggtgatccgagcgtttttgaaaccattgaggcgccgattcccgaaccaaaaactggtcaagtacaattgcaggttcttggctttggcttgaatccctacgatgcttcactgcgtcgtggtgaacaagcggcttttcgaaaagttaagttcccagttgtccccggcacagatgttcttgggcgaattaccaaactcggcgaaggggtgactgactttgctattggtgatcttgtcttgaattatcgaccaattggcggttacagcgagtatgtcaccgcctcaacttcaaaaatttacaaaaaaccgactgccttaagctttttggacgctgctgcactaccgcaagttggcttagctgcttttaacattttgcactatatgctgtcacttaagcctggccaaactttggcagtcattggcgcaagcggcggtgttggtgctatcttggtgcagctcgccaagtttgaaaaattaaatgtcattgccgttgcaggtgcccaacaccacgactatttgcaacaactcggggccgatcagatttacagctatacagatgatttacctgacagccgtgctgatgctgtggtcaacgccgtttttggcgctgcagaccacggtgcctcgctaaagcttgtcaaagctggcggtcaatatgtgacgaccgcttatgctgacgttgatgttagcagcaagcccggcacaacccacctgcaattgaacccatcgaaggactattctgttcatgatggctttgcctatttagttgatgtcgcccaaaaatggggtctgcaagttcgtgtagcgcaatcatttgcttttaccgtggatggcgtcattgctgcgcatgaaatgttggaaacacaccacgccccgggcaagttgattgtgatgcaagatcgtcatgtcacccatccggttcgtaaagacatcaatcaactttaaacaaaaattgggttaacgccttgtcccgcttgttttcacgccgtatgataaacgggtgaacgaaaggcgggacaacatgaaaattgcagtttattgtggcgccaatagtggcgcggatccagcatttctacaggcagcaagcaaagttggcgcatggattgcggcacgtggcgatacgctgatttatggcggcggtaaactcggactaatgggcgcagttgcgcaaagtgcccttgaccatggcggtgacgtcatcggcatcatgccgcaagtgctcgctgatcgcggcttagccatgccagccttgacgcatttagaagtcgttgctgacatgggaacgcgaaaagccaaaatgatcgagatggcagatgccgaccttgcccttcccggcggtcctggcactttggaagaaatcaccgaagcaatttccttctcccgaattggccttaacgcaagcccaacgatcctgtttgatcaaaatgggtattaccaacctttgaaacagatgtatcaaaccgcagttgaccaaggtttctttgatcaggatgcgttcgataacgtgttattctcggatgatctaaccgccatcagtacgttcattgccaactatcagcccttgggggttgttcggcaatatcattaaaaaaccagctcacgtgagctggttttcttaatgtgaacccatgtttttcacttatatacgcaaaaagagcatgtccgctcgccaaagcgagttgtgacatgctcttttaaattggcattaagccaaagcttttttagctgtatcagccacagctttgaagccatctggatcgctaacagcaaggtcagcgagcattttacggttcatgtcgacatttgcaaccttcaagccatgcattagcttgctgtaggaaatatcgttcatgcgtgccgcggcgttgatccgtgcaatccaaagacgacggaaatcacgcttcttagcgcgacgatcgcggaaagcataacggtatgacaccatgacttgggcattagctgccttaaacagcaaatgcttggcaccacgatagcccttagcgagcttcagtaccttcttacgacgcttacgagtaactgttccacctttaacatgtggcattagaattcctcctcaaatcaaatccgatagattattatttcatctggctgagcatctggcggatccgcttcatatctgagtgggataccaatgctgacttacgcaattgacggcgttgtttcttggtcttgccgtggaaacggtgagacgtataagcatgaccgcgcttcagtgcacctgatgcggttttcttaaaacgctttgcggaagcacggtgggtcttgaattttggcatgactttttcctcctgtaaacatcagcgtgttgctggtgaagttcaccagtttgcgctttttatacgatcttgccgaaaactacttctcggcacgcggtgcaagcatcaagaacatgctgcggccgtccatcttaggatgcgtttcaacagcagcaatttccttaacggcatccgccatctgctcaaggactttgcgaccaaggtccttatgcgtgattgcccgaccacggaaccgaacgctgactttaaccttgtcacctttttcaaggaacttggtggcgttcttgagtcgagtattgaaatctgcttcaccgatggttgggcttaggcggatctccttgatggtgacagtcttttgtttcttccgagcatcgcgctctttcttttgaagctcaaaccggaatttcccgtaatccataatacgggcaaccggtggcttggcattaggcgatactaggacaacatctaaatttgcatcctcggcaatggccaaggcgtcacgcgtactcttaacgccgagctgttcaccggtctgggagatcaatcgaacttcacgtgcgcgaatactgtcattgactatcagatctcttgctatggttgttcacctccgtgtgaatttcagagaaaaaacaaaaacagcgtggccagaaagaccccgctgttcattaaataccgaactaatgagcctagcggtccaaagacttaggcgagaagcgggaacttctgctttttctcaacggatataactatacaggaacattcaggcgacgtcaagtttcagcttttagcgattttatcgctgataaaatggcgcaaactcaccgctcacatagcgtcctaattcattgtcgttaggactcacgtggaattgggtcgtttctggtaaataagcttctgcaaaggcaacaatggcgtgtaggtctgttcccttatctgcatctacgaccagcaacaggctttgggtatcatcagcgcggatcatggtggtcaaataggctgcatgaacagttctcagcttcgccaagtagtcgcgcaagtgcttaactaatgtggcggtttcacgcggcggttcaccgatccgcacagcctcaccatttttagcactatcaggtttagccacgtaaaacaagttggcgcgtgatagcagcatattttcgccgtatggattgatggcgacaccttgtatatcgtgatcttcgtataaaaagttggcacagtcattgatggtggcaacagcgtattgatcatgatctgggcttttaccgaaattagcctggtcggtaaaaattggtaagaagtcctgtccttgatcatccgtaatcatgacgattgtcggatcaccatctctcgttgccccaacaggcaacatgaatttagcagtctttaaagcagcgtaaaaagcggcttgggtctcatcattctgatcagcccgtaataactgaatcaaatgaataagttgtggattttgaacaattggctcatcagtcatcatcgttttcccctttatctcgtttctgatcggcactcactttgccacgaaacctgcgtaatttttttggtaggccaaccagccatgagagtaacacaatgccaacactgccgaaaacagccacaccttgaggttgaaattcaattttagcaaaccaccaagttgcgatgccataagcaccaacaacagttagcaacatcacaatgcccatgatcactaacaggccacggccgcgatgggcaattaaccagtaaccgcgctgattcggggtccgccatggcagcttcatgtaagcgaacaaaaccaccaaatacaaaacggcagcgaggatctttgtgaccacgaataagacgagccatgaagcccataatgcgataaacaccgagtcaccctttcttttgatgtgtgtcgtaaatgtgtccagtttatcatacatgctgaaaacaaatggcggatgtgctaaatttggcgagaacaaacctgttcctaaagatactaacaacaaaattatgaatgaatggagaaatcaccatggcaacaattgacttagtgaggcatgctgaaccagacatcacgattcatgatgattttttgcggccactgaccagcgctggtcagcggcaaactcagcagttggttgacagtttgcatcaatatccgtacacggcctttttttcaagcccactcaaacgtgctgttgatacgatcacaccgattgcagatgatcacggcttacccgttcaaaaaaacgaactattggtggcgcgaaaaatgcctgcatggctgccaaatttttctgaatatgttaatcagcagtggcaagatttaacattctttgaaaaacctggtgaatctattcatcaagttcaagaacgttacctttcatttttatatggactgccaagttcggcattcgtcgctgtcggtagtcatggcacggcgataagcagtcttgtcgaagcggccatccccggtatcggctatcattttttctcgaaacttggttacgccgctgtcacccgtatcgaaatgcatgcaggcaatgtggttcacctagctgtctgggaaccaaaatcaaagacgtttaaagttctaaaatagtgtttccaaacctcaaaataatccaaaactgatggcgcgtttcgggattttgatcaaaagaaaaaggagctttgagaacaatgtctcaaaagttccttccccatttgattgaaaatgacactaatcacctaaaaccttggtcgcttcgcctggcttggttttgccgtcacggctgtaattcttcacttcagcaactaaagcatcgatgaacatgttgcctgcttcttcttcggtgtgttcatccccatagcggcgaactgaaaccgcagcatcattcaattccttatcgccgacaacaacggtgtatggaatcttcttggtttgcgcttcacgaatcttgtagcccatcttttcgttccggtcgtcaactttaacgcggagaccggcggctaacatttgtttcttaatgcgattgacgtaatccagatgcagatcattgttgactggaatcaaaacagcttgtgtcggtgctagccaagttgggaaggcacccttgtagatttcggtcagataggcaatgaaccgttccatcgtgccgacaatcccgcggtgaatcatgactggccgatgctcttcaccgtctttaccgacgtaggttagattaaaccgttccggaagcataaagtccagttgaatggttgacatggtttcgtcattgccaagtgcggtcttcgtttggatatccaactttggaccatagaaggcagcttcaccttcggcttcgtaataatccagtttcaagtcgtccatggcaccttttaacatgctttggctacgtgtccacatttcgtcatcatcgaagtatttttcggtgttcttagggtcacgatatgaaagccggaaactgtaatcggtgatattgaagtcttcgtaaacatccatgatcaagcgcagaatctttttgaattcttcttgaacttggtctaaagcaacaaaagtatgaccatcgttcagcgtcatttcacggacacgttgcaggccggacagggcacctgacttttcataacggtgcatcatgccgagttctgcgatccgcaacggtaattcacgataagagcgaatgtgatggttataaatctgaatatggcttgggcagttcattggccgcaattccaacatttcgccgtcacccatgtccattggcggaaacatgtcttcgcgatagtgatcccaatgaccagatgtcttatagagatccaagttagctaaaacaggtgtgtagacgtgttcatacccatcggcaatttccttgtcaatgatatagcgttcgataacacgacgaatcgtggcaccatttggcatccagtacggcaagcctgcaccaaccttaggatcaacgaagaatagatccaaatcacggccgatcacccgatggtcatgttcagcagcttcttggcgtcgtttggcatcatcttccagacccttttcgctccaatatgccgtgccgtagatccgttgcagcatcgggttgctgctcttgccttgccagtatgcaccagccactgacagcagcttcagatgcttcaagtccttgagacttggtagcaacactttttcatcaaaatcaacgaagtcgcctaacttatagcctttgatcggatcgccagcagcttcaaccaactgcttcttgaatggatcatttttgaaggcttggaaagcttcggcgcgactcaacacaactggttcaagtgccgcgttttccttgataatcgcttccattttcttttgaacggttggcaaatcatcaacactcacctgaccgtcagcacgatcggtatcgtagtaaaaaccgtcttccgttgcttgaccctgaccaaaatgaatatccgggtataagtctttcaaagcagcggccagtacgaacgctgctgtctgccgcaaaacggtcaaaccttctgcatcatccttggtcataatttgcaattgaccagaatgcgcaatcggttcgtcataagcgatcaaatcgccatctaacttgccggcgacagccttctttgccaagctattactaataccctcggtgattgccttaactgtggtgccatcaggaaactgtttgacgttaccatcaggaaatgtaatatctaatgccatgagtaagactcctttattgttttttcgaagaaaccaaaaaatccctgacatctcttaagagacatcagggacgatcagtgatcgcggttccacccagtttgccaacagcaccggctgttggccacttaattgacgcgtaacctgcgtaacagggccttgcggcaatctcgagaagtggttcggatcagatcttgcaagactttcagccatggtcttgctctctattggatgatcctttgttgcttccgtcttcgatagcttcattgaaacacattgcgcagtcaggtgcaagaggttttctgaaaaagagcgctctctggcgcgtttagaaaccggaacagaagtggcctcaagcctaaatggctgggctttggtcattttaggcttgaggtccttatgtgcaggtttttgcgccagagagcgcgtttcagccacagtgtgaactagctccgtccgcaaggctacaagtaattctggaaataacatcatccgccaacggtttacaactgaatagcgctactttgagcgtcaatctgccaatggattgcgccgattttcaccgccgacctgcacttctttagctaaaaaatgaatccgttccatgatgcgcttggctttgagcatctctgaatttccgcgatctgtgccggcaagtgaggcagttaaatcttccatgcttttattcgagctaaacaaggtcggcattttttcctgcatgcgatactgcaaaatgatgccaagaacatcgtcgcgaacccatgggctaatgctttcagcaccgatatcatcaagaatcagaacttgcgcgcgtttgatgcgatcaatctttggcaagacggtgttgttcccgatggcatttttcatttcaaccacaaatgttgggacatgaatcaaggtactggcaatcccgcctttttcggcaagatcattggcgatcgcgccaagcaaatatgttttgccgactccaaatggaccactcaaatatagtccttgatgaaaagccttaggatcggcaacaacggcgagaacgaattgattagccgccaacaaagcatccatccgctcatcagtcggatcgtaattggttaagcttgccccacgaatgtccttaggcatgttaaccgatgtgactaaggaagcctgtttagcctcctcatcggccgcaattttggcatctgttggttcataagcgacgtcaatcaaaccgttagctgccactagggtcggcttataacccggtgccaatggtaattcgccacgagcaattttgtttcgttcgctgacaaattcgtagatcttcgcggttccgcgatcaatcgcatcatcggcgagttcgccggtatgttgttttagaaaagcctgaacttcagggtcctgcaaggcttctttgaccatcttgaaataacgatcccgccactgtcgagaatccatcaacatggcaattcgtttccgcatatcttccatcagttcgcgcctcctttatcaccgagttcacgcagtttcgccaattgggctgctagtttctcgcggtcagcatcgctcacctttttcttttcaggctggtaaccttcttgtgcccaatctggcaacttctcctgccgcggacctttggcgctaccttgacgccgtttttggccactggccttctgtttttcaaagtcacttatctgtttcaaagcagcctcgggactgttcacattagctttcagccaactgttagcaattgcatcaagcaatgcctgattaatactgtcattggttcgtaaaatataatcaatcaaaatattgatcgtcggcgcatcgaacacattccgctcactcagctgctgaacggcacgtaactcgttgttagccgggtacattcggacattttttgcctgcttggcggcggttaagaattggcgcggtggcatacttttggctttttgcaacaaagcttcgtcagctgatgccacttttggcggcgccgtcgtggtcgtcggctgcgcatgtggttgtgctcgggtgtagccttgttcagctaagcgccgcaattgactcaaattaatcttgccggtcatgacatctgtggcgcgactaatcaagcgagcaaaatccggcggttgaatcccgtaaaaaccggcgatttgatacaacgcttcctgatgcgtggcgagttgccccgcttgaatattactattcgccagcatcgctttgactaatgcccaatcatagccgccgcctgtgccaagccgtggccgcgtggcttctttttgcgtcatatctgatttagctgccaccactgctggtggttccttgctcaaatcatgatcaaaccgaaacacatcgagaaaactggctgtaatctcctgccattcaggtctgcggactggtttgaggctaaattggccaaccagctcatcgtatcttttttccccgactttgtcgtataggagcaacccgagaagatcgtccttgaaaaaggcatcaggtgccaccggtgcatacaactcataagcgtagtaacgccctaatgagtcgacttgcgtataagtgcgcaataacccgaccgcctccagtttgacacgcgcattgaataattgatcaatatcaatatctaacaaatccagcagccataattgcagacgtcgatcagtcactagtgcgcgatctttaacttcctgccacaggctcagatacaatgccatcgcaatcggcccgatgagcggctgatagagtgaaattgccactttttcgtcaaaatcactcaaatgaccggcttttgttaacacaaaccctgcctgtggactaaatgtatcaggacgttgcatgcactttcacctcttttcagacaacggacctgagacatttgcctcaggtccggtttaccattttcagctgcgatgatctttacttcttggtcttttctttcttcatcatgtcctgcaattcctgcatgaagacggacatatctttaaactgtcgataaacgctggcaaaacggatataggcaacatcatcgacatcggctagtttagacatgacaaactcaccgatcgcctgactggagacttcgttttcaccaatcgcacgcaactgattttcgaccgaatcgacaatactttgcatttgttccatggtaaccggccgtttttcagcggcccgaataagtccttttaggatcttctcacgattaaattcttcacgtgtaccattctttttgatcactaacagcggggtttgttcaacccgttcaaaggttgtaaaccgaaacccgcaattttcgcattcgcgacggcggcgaatcgcacggccaccgtctgttggtcgggaatcgacaactcgcgaactattatgatggcaatggggacattgcacgactccaccctcttaatcaaagtttgatagcttattatagcacgcgtaagccgcttatgatagccgttgcagccgctggatcaaggcattggcttgggcaatagttgcctcttgagtcccattattatcaatcacaaaatctgccaatgctgccttttgcgctaacggcatttgcgattgaattcgggcctccgcgtcagcctgtgagagcccgtctcgtgccattaaacgcgatagttggatattgggatcaacgctcacaaccgcaacaccgtcaaagtcatcggcataatcggcctcatacaacaaaggaatgtcgccgacaacgatggcggccccaccggcttttgcctgtgcaactgcctgactgatggcctcgcgcaaataaggccgattgatctgattcaaggctgccattctgcctggctgggaaaaaacaatctcggccagcttggcgcgatctaggctgccatccgcgcgcagcacttcaggaccgaaagcttgagcaatacgtgcaagaacaggctgcccaggctcgacgatctggcgggcaatgacatcagcatccaccaccggaaacccagcggctttgaaagtgcggctcaccgtcgatttccccgatgcaatgccaccggttaaccccaagagataagtcacgctggccgcctcctttgatgtaatggctgacagtgtgggcagtaatgggttccgcgctgaccaaccttaattttgacaatcgtcgtgccgcagcgatcgcacggggtaccttcccgatcatagacgtgcaaggcattttgaaaagaaccgcgattgccttctgcatcaacatacgtatgcgcgctggtgccgcctgccgcaattgcagcatttaattcttggataatcgcgtcatgcagtgttttgatttctttagatttcaaggtgtcagctggctgcagcggattgagccgacttaaccaaagtacctcatcagcgtaaatattgcccacaccagcgaccacggtttgatcgagtaaaaccgacttaattggtttatgatggcgtttcaggcgccgggcaaactcagtctcgtcaaacgtgcgtggcgttggttccggtccgagcttagcaagggctggcacctgatcttcctgaccagttttaatcaatcgcatccgaccgaactttcgcagatcccgataccgcaactgactaccatcctgaaatgtgaacgtgacgtgatcatgcttatcaaaaggtgtgtttgcatctttgacaacatagtaacgcccttccatacgcagatggctgatgatcgtttcaccattgctgaggcgcatcaaaagatacttgccgcgccgatcaatggtcgtgatctcactgccgacaatttccttttgaaaagtcgccaacccattgatcaggattttctcccagttagtgttgatggcggtaatgactttatttttgactaacggcagaagcgagcggcgaactgtttccacttcaggtaattcaggcattgaaatctccttatttagcgtcgaaccaagttggtccataatgactttcaacctttaatggcacatcaaggtgaactgctgagtccatgactttgggcacgagctcgctaagctggacaatttcttcttcaggtgcctcgaagatgagttcatcgtgaacctgtagaagcattttagcttgcaaaccggcctcatccaaggccttttgcatgcgaatcatggctaccttgataatatccgcagcgctaccctgaatcggcgtattcatagcggtccgctcggcaaacttacgcagattgaagttgcgtgagtgaatttgtggcagatagcgccgccgatggaacagggtttcgacatagccgtcttcacgcgccttcttgaccatcgcatccatataatcatgaaccttaggatattgatcaaaataaccatcaatgaacgcttttgcctgtttacgggaaatgccaatgttttgggatagaccatagtcactaatgccatacacaatgccgaagttagttgccttggcttgccgccgcatatcaggtgtgacttgatctggcgaactcaggccaaaaatcttcatcgcagtgttggcgtgaatgtcgacgccatgtttaaacgcctcctgcatattctcatccccggaaatatgcgacaacacccgcaactcaatttgggaatagtcagaactaaaaatttgccaaccttcatgtgacggtacaaaggccttgcggataatcttaccttcatcacgagcaggaatattctgcatgttaggatcaactgagctcaatcggccagtttgcgtcaaagtctgcaaatagcgggtatgaatcttatgatcaggcaattgcgccttcaacaagccgacaacataagtcgaattcaatttagcccagccgcgataatccaaaatgtcctgcacaatcggacttgccgatttcaattcgttcaacacgtcaacgcttgtcgagtaaccggtcttcgttttcttgatcacaggcagattcaatttttcaaaaagaatttcgccgagctgctttggtgagttcaaattgaacttcacgccagcttctgcatagattttctcttccaaaatcttgatgctttgtgagaattcagtgcccatagccttcagtgttttagcatttagggtaatcccttgaatttccatttctgccaaaacccgagaaagcggcatttccatatctgtgaataagtccgtttgttcctgtttttccaaatcaccagtcaaatcaggccgcaatgcgaacaaagcatcagacttgcgagcaaactggccaaacagcttatcgtcttctggcacttgccgtttggcgcctttgccataaatatcctcatcacgcggcaagtcatgataatcgtgatcttcagcgattttacccaaatcattgctgttttcgtcaggattaatcaaataggacgccaataacacgtcaaaagcgatatccggtaatttcacgccgagtcgattagcggcgacgatgtttcgtttgccatcaaaaactgtcagatctcgtttggcatcttccagccaccgtttaaccgctggcagcgtcagcaaggtgacatcggtactcacataagtttcttccttagtgccaataaagaaaccgatttgttcggccacatgataattatcctcgagcatttcaatctcaaaagtcagaggttcggtcagtttggtgagtgcaagaatcgattgctcatccagcacggaaaaatgaaccgcctgaacaggtttagcgacactaccaccaatttttttgagcaacgaattcatattcatttttgtatagaagtcccggagtttgtctaaatccggtccagcgtatgtcacatccgctaagtccacggtaagcggtgcatcgcgatcgatcgttgccaactgtttgcttaagaaagcgttatctttatcgttgatcaaattctctttaagcttgctctttttcatgtcatccacattagcatagaggttttccatgcttccgtattgattgagcaatttcagagctgttttttcaccgaccttggtcaccccaggatagttgtccgaggtatcacccatcaaacctttgagatcaataatttgagccggtgtgatgccaagcttttctttgacatgtgctggggtgtaggcttcaagctcattgacacccttcactgtcaattgaactgtggtccgatcggtcgtcagctgcgtcaaatcgcgatcacccgtgacaatcgtcgtttcccagccggcctcatccgcacgcttagccattgtgccgataatgtcatcggcttcgtaatcctttaattcataatgcgcgatgcccatgtcatccaataattccttgatataaggcaattgttccagcaattcgctcggtgtcttggcgcgaccacttttgtaatcagcatatttggctgtgcgaaaagtcgtcttgcctgcatcaaatgctactaaagcggcatctggttggactgcctttaaaacaatctcgagcatgttgttaaacgcataaatggcgttggtgtgcaagccatcttggttcgtaaaacggtctaattgattatataaagcaaaaaatgcacgaaatgcgactgagttaccatcgactaataataattttgttttgctcgccataagtgggcttccttttctacggccgctgctgtcaccgcgacctgagttagttgtcatagtcattgtaccaaattctgctaaccggtgacttgctggtcaggggaaaactggcagaaaacaaaaagagaactggcaaataccagttctcttgaacatttttagttaattattgttattcccaacaccgagaatctgtaggattgcggtgaacaggttcaagaagtcgagatagagcattaacgcaccgagaaccgctagcgagccttccgaaacggcagcttgtccatcattgccagtggtgagatacaggttcttcagccgctgcgtatcccacgccgttaatacaatgaagataatcaggacaccgtatgaaatcagcagttgcatcccatttgagccaaggaacatattcacaaatgacatgatgatgatcccaaacaaggcaaccatcgcgatactgccggctttgctcaagtcacgcttgccaaaatggccaaccatcgacatgaccagaaagacaaccgctgtcgtagctaaagcaacggcaaggttagtaccgtccgcaaccatggcaactgaagcgaacgtgaagccaaaactagcggacatgaggtaaaacatcactgttgcataccccggacttgcctgtgcgcgacgccctgtcacaaaaaatgacaaaatgatcggcataaaagccatgatccaaaaaacaatcggatgcccactcacaaaactggtgtactcagctctgaatggaaatcctaacaaataactgacgagcgccgtcacgaccagcccgctccccatcaaggtatagatgcgggagaagaactgtgtcaagccggcctcgtttacaacacggcgttcttgcatagcgttcattcctttcaagtaactctttcgagtatctgaagaccattataaccggaatgatgatatttgtcagtcaggcgaaagaccgatctttattatgagcagttttcgatcattttagacacagttttcgatgtccaacaaatcatgatcacacggtctattcttcagccaatatggtttcgtaagctttttcatacttttgaatatcaccggcccccataaagacaaccactgcattatgatattgcagcaaaggcttcatgtcttcctgatgaatcactgcagcgcctttgatctgcgcggtgatatcttcggatcggattttaccagttttctcacgagcagaactgaaaatcggggttaagaatgtttgatcagcttggcttaggacctgaacatattgtggctcgtaggcctgcgtgcggctgaaggtgtgcggctgaaagacagcaataatcgccttgtcaggatacttttgacgagcagcatctaaggttgctttgatttcattcggatgatgagcatagtcgtcgacgatgatcatgtccttgagatccttttcggcaaaccgacgcttaacgccactgaagttgccgagctcgcgggcaatcaactttgcatccagcttttccatgtgagcgaccgcgaccacagccagtgcatttaggacgctgtgttcaccaaacagcggcacaaagaaatgaccgatcagttgatcgtggaagtaagcatcaaagctgctgcctttcgtatcgcgatcaacgttgcgagcctgaaaatcatcacggtcactaatcccataataataaaccggcacctttgcctttagcttccgcagccaaggatcatccccccaagctacaattgcttttttaacttgattggcctcagtttcgaaagcatcgtatacatcttcaaaaccagtgtagtaatcagggtgatcaaaatcgatattggtcataatcatgtagtcaggatgataggccagaaaatgccggcgatattcatcagcttcaaatacaaagaatttggagtcgggaatgcccttgcctgtgccatcaccgatcaaatagctggttttagcaacgccgcttaaggtatgggccagcaaaccggttgtactggtctttccgtgcgcaccagcaaccccaatactggtataaccttcaatcagcttgcccaagaattcgtgataacgataaatcgtgagtcccaattccttggcccgtttgatttcaggatgatcgtccgtaaaactattgccagcaatgacagtgtaacccggtttcaggttagccggatcaaacggcagcatcttaatgccggcagcggcaagtcctttttgggtaaacgtatattgagtaatatcactgcccaaaacctgatgccctaaatcatggagcaccaatgccaatgcgctcatacctgatcccttgataccaataaaataataggttgcctctgtcatgacgtttgttcctctttctttgcttgactgtaataaacttcccgcggctttgcgcctttagctggcgaaacgagatgcttcgcttcaagcgcatcaatcaaattagccgcgcggttgtaaccgatagaaaaaacccgttgaagctttgaagtcgagatatgccgttcaccagatagatagtctagaacttcaggcatcaactcgtcttcatgtgacacgctggcttcagccgatttgaccaagccagccggatcaaaaagataacgtggtccgcgccgagctttgacataatcaacaatcgcatcaatttcgcgatccacgaaggttccttgcaggcggatcggctgactagcgccattgcccagatacagcatatcaccacgaccaagcagccgttctgcgcctgccgtgtcaataatcgttcgtgaatcaatttggctggcggtcatgaaggcgatgcgcgtcggaatattattcttgatggtaccagtaatcacatccacacttggccgttgagtggcgaccaacaaatgaatcccagccgcccgggccttcgccgtgattcgcgcaatgtcatcttgaatctcactgcccgcagctagcatcagatcggccaactcgtcaatgataatcactaagtatggcaggacttgtgcgtattcgtgaaaacgctcggcctttgcattgaactgttccaaattacggacaccagccgccgccaacttcttatagcgatcattcattgttgacacgacccacttcaaagcggcactggcagctttgggatcggaaataactggcgataccagatgtggcaagccattataaccggcaagctccactgcttttggatcaatcagtaataaccgcacttgttccggtgtagccttatagagcaaggatactaacagactgttgatgaagacagactttcccgaaccagttgctccggcgatcaagccatgtggcatcctagccaagttggtgaccacaggctggccaaaaagatccacacctaaagcaatcgtcagtggcgattttgcctgctgaaaagccggggtatctaggacttcgcgtagcatcactggtcgcggtttcagatttggtatttcaatgccaaccgtatttttgccaggaatcggtgcttcaatccgaatgtctttggctgctaaggccaatttcaagtcatcattgaggttcgtgattttattgactttaacaccactggccaggcggacttgaaattgggtgacagtcgggccaacagtgtgagcgaccacgtgtgcatccacgttaaaggcttgcaacgttttatccaaccgatcgctttgtgccacaacccaatcttcttgggcagcctgatcaactttgaccggcgaagcaagtagcttgagcggtggcagtgtgctaacccccggtattggccctgtaggtgcggaacctgtgtcctcagccgcagccattgatgaaggtaaaataccagttgacggtgattgcgttagtgctgacgttgaatagtcggcatcattggctgatggtgtttcagccgtcgttgaaggtggccctgatggttttggtgatgtttgcatctctgcctgagcttgctttgcctttgccttctgggcagctaattcacgccgtagctttttggccgcatgtttgcgccgcaacgcctcaattctcgctgccttgcgactgttaggcgcatgtggcttattgatgacagactgtgaggacgaatcaacaaacggcttgttaaccgatgctggagcctcctctgcctcatcagcggtcacagcggtcagtaatgtctttttttcggtctccgctgacttagcctgtggttcaacagcagatgttgccggtgtcgaagacgataattggtgcgtgtcggttggtgttaccggtttggcggcaactgacggtgcggttgcttctggcaaagtctcatcaagcggcttttggttctgcgtcccggcttcatccgatttttctgctaataaggtatcttcctgcggtgctttagaagcgttcgctcgtctgtcagcctcattttcatcttgtttttctataaatgacgtcgtcgatttggctgtattcgtatcagacggtgtcagcgaaatatcatgattgacggccatcttattttcgatgccatggcccgcaaaaagataaaccgtttgcgaatctggtcgcaaaatctcagcaatttgtgcgtaatcggtacgatcaacgggacgccgatgagctgtgctgtttggtgtcgataggcgcgacaactcatcgcggccccgcggtcgttgcggataatcaaaggcacgcaaatcggcctgagcctccgcgaccttgcgcggatccacatcaggctttggttcgtgcgccaattgcggtggcaactgatattgttcctcgtgttgcgcctgtgtccagtccgaagtattcaactcagattggggttccggcactttattttgatgtagaaatgccgggccatcataatgcgccatgattgaatccccttctattcatgtttctagcagtgcctctattttagcataagcaccgcaaccaataatccttgatccctaaaaatatcaccagcaattggaaaaagattcatgttaagaccagtgattttgcaattggagacaaaagaaaagacgtaagcacgaggcttacgtcaaattttttcgttattcgcgatcaaaacaattacaaccggctgttcagatgggcacaaattatgatgcttgaacagcaacaacggcctcggcttttttagcatcaaatggtgtgcctgcaggtaaactatcaggcatcaccaagataccgcgacgttgtggcgcgccaggaatgcctaactcacgagcactgctgatcatgccgtaagagtcaacaccacgcaacgagcccggccagataattttgccatctggcatcatggcacctggcaaagcaacaacaaccgtttggccgagtgctgcatttggtgcaccgcaaacgatttgaacctgttcattaccaatatcaacttgcgtcacatgaagatgatcagcatcaggatgatccttaaaatcaacaattttgccaatcacaaacttaggggtttcatcgaccgctagtttacccggcagccctgccgtctgaatagcctgattaagctcggcaatttgtgttgcggtcaacacaaggcgaccttggccagttaactgacccagccactgtgtcacgttgaaaaagttgtagccaatcacgttgcctttatcattgagaatcgcaacaatgtcaccacgtcgctgaattgtttgtgttgccgtatcctgacctgtgatggcaagcaaggtgtcgccaaacgctggttgattataactggtaatgagcatataaacctccaaaaattaatgcaagccgttaatgaaatcttcgacttgttgtttcgtcttacgatctttattcacaaaacgaccggtttccttgccatcgttaaaggcaataaagctcggaatgccaaacacacccatatcttgagcaacttctaaattcttatcgcgatcaaccgcgatgaattcataatctgaaaagtccttctcaatttcaggcatagctggtttgataaaacggcaatccgagcaccaatctgcagaaaagaacaacatttttttacctggttgcttgacctcatttaaaattgctgcattagagcctaattctttcatagccaacatcctttcgcttactatttataagtaactataacaggaaatcgtcttaagatcaatgatgctcgtgctgtgttacattatactcaaggtgataaagcttgaacaggtcaacaaaagccaagtcacacatcgtcagatcagttagagattagcagaagacgtcagcaatgtctcgcctttatatcagttttaaaagaacgtccggaataggttggacaggttcgtcttcatcactaaagggggtcacaaatttggcaattttcaaaaagaagtcgaattggcgtgtctggatagccgctgctgcggtgacggccggcatggcttcgattgtttatcggcgcctgtattatcgaaccattcctaatcgcattttgtccatcgtcaagaccaactttacaaatcgcggcaccatcgaaaatagctggatcaacatgcagccaaccgaacgcgggactggccgtgatcgctatcgcgtgtatactggcgggttgaccgtgcgtgaaggcgaccgcctcaatcagtttgcctttgctgttgagcccgatggtaccttaagacaattaaaacaacttcacgaaccgattaatgcttaaaatgcgcgacaagttcgtagattcgaccgccatcagcgctgaacttctcttcgtattcagtgggcacgttatccgtgacgcgtttgtcgtgatgtaggttcaaggaaaccaaatcgaacgtcatcccaaaatgattcatgctgaccaaggaatattcaaacaacccttgattatccgttttaaactgcagcaaagcatctggcttcataatggcttgatactgtcgcaaaaagtcacgataagtgagccgccttttttcgtgacgggtttttggccacggatcggaaaagtttaaaaacaagccatcaatctcaccttcactaaaataatcggttaagtccgcaccatcgcccagcacaagctgcaagtttggcaattttaaggcaacctgttttttcagaatcatcgctacagcggcttcctgtaactctaaagcaataaagtttcgatctggatgggtcttggccatttcgacaataaattggccctttccagagccaacctcaagatacaatggccgtgcttggtcaaatcgcgattgccagtgaccttgcatcttttctgggcgaaccaaaatcatctcaggatgagccaagattagcggtttcgcccactgtttgttacgtaatcgcataaaatttctccttaacttgaacattggctaggtcaaagtacaccgtgaccgctcaaaaggcctgggacaaaatcactttttgcctcaggccttttttgatgaatgaccttgcttgtttgcagcacagcttaccgactcgcttgtaaacattcgaattgatgcaaaacttgcgcaacttcttcgaatcgttgatgcgtggctgctaccttaatatcatgaagcaaatgcagatcaccgtaccagtacagtcggcgtttcaaatcctcatcaagtcgtgcgccataagcatccaaaaactggtgacttgtggctggactgccatagtgggcaagtacatccgcaagatcataagccggatcgcccagcgccacctgctcccagtctactaaatacaaccgaccgcctgcctgtaaccaattcttgtggttcaaatcgccatgacaaaccgtttgcacatccgtgtgcggtaaccactgctttaaatcgtgcagagccgttttgatcttaggctgcgcagccacatcgactgggaaatcctgaagtagtgcgattcgtaattgctcaggatcaaggacttgaccgcctacttgacgtaataaccgttttaacagacttgagtggtgcacctgtgccaacattttggccacgactggcaacatcatttgttgccgcgttaacgtttcaccgtccagccactcttgagcggttagcacgtctcccgtactcacccgccgcgtccacaacagccgcggggtaatgtgttcaactgatagtgccgcaagaaacggcgaggcattgcgcttaaggaaatatttttgattggcataaaccccaagaaacgcacttccggtggatccacctgcaggctgcagggaccacccggaatctaattcaaactccataggcactactccttacttctggccgcaggaatgattcacaacatcaaaaagacactcccaggcgctcgtgcgtccacgctcaatattactaacttgcgaaattcacgtcaagagcagagcgcaaactggcccgcttagaaaccggaacataagcggccttaagcctaaacggccggtctttggccatttaggcttaaggtccttatgtgtaggtttctgggccagtttgcgcgtttaggcagagtgtgaactggcgcggttagaaaccggagcataagctgccacaagtgcgatggctgtactttgaccattgtgcttgtggtccttatgtgaaggtttctgcgcctgtgagcgcgtttaggcagagtgcgaactggcgcatctgtcattcaacgcatcgcatcatgtaccctcaaccgaacacgtgcataccatcgcgtgaagccccagacaaatgcagtcccgccaacaaatattgtcaacgcggcgagccactgcagtcggatcaacgcaaccagtgtgaaaacaaccacttcaagcagcaacaacgtcatcaaaagccgttcaaaggccgccagtttttgatttggtgctactggatacaagtgcgtgaagacaatttcatcatattggaagaagaatggcaacagctgaaagccaaccatatacaagaatagaatcgtaaagccaagcaacagccaccactgagacaaaaccgccacgataatcgcgccgatcaccagtagccgcaagtacaacccaagatactcaccgccacgcaaaaagccgcgcagatacaagtatgcccacgtctctgtcttgcttggcttaaccaacttcaaaagtggatcgaggtaccggcgacgatggacgctattggccaaacctggcacatccgtgaatagattataaaatcgatacagtcgacccatgcgatctgcttcgaggtcaattaaagcttcaaaattcaataacccatctgccaacaaggaacttcgcagccatctgaagaccaaattcagagtcagcgccactaacaaggccacagccggatgcaagtaaaaacctagaaaaagagctgcgaatgtgatgacaagcagtacaagtcgtggatgtcgccaattgatcggcagatgatagcgctgaagcaattgcagccacaagtcgagatctttgaataaccacacagctagtagcagcgtcaccgtcgcactgattggatcttgacccaattgtgcaaataatggccacatcgccaaagccgcaaaacccaataaagttgccggtaacatcatgctgtatcgccgtgccttcaacaaatagtcactgaaggcctctgcttttggcagtaagaagacttgatcgggcgcctgcgccaacgtggctaactggccaagcgcgattaaagccgtaaaaatgacagccagacacaaagctaaccaccaagatggttgcaatgttttcactagcagactgtaggcatataaggcaccaccaaaaagtattagcaagaccagtacaaaatggtcattgaacaccaatcgcaaatatttttgctgttcttggacatgttgtcgaagtcgagttcgccataacgcgaccattactgttcctccgtcattttcatatagatgtcatccaagctgccatcctgaagatcaaattgctgcttcaaagaaggtaaatcaccagttgctctgactttacctgctttgatcaaaacgaattcgtcagcatattgttgagcggttgccaaaatatgggttgacatcaaaatagacgctccttgctccttttttgctgtcaccaagtccaacagatcatggacggccagtggatcaagtccagaaaaaggttcgtcgatgataaaaagctgtgcatgcgtcataaacgccgccacaatcatgaccttttgctgcatcccttttgagaattttgctggaaaccagtccaacttattgtcgagtcggaacattttcagcatattatcggcatcttgccatgcaaccgtcgcatcaagatcgtaagccatgatggtcatttcaagatgttcccgcaacgtcaattccggataaagcaccggtgtctcaggcacatacgcgaggtcagctcgaaaaccagtgggatcatcgtgtaatgttttgccatcaagtgaaatcgtcccgctttgtggggtcaacaatcctataatatgtttgatggtcgttgacttgcccgcaccattcaaaccaattaacccgacaattttgcctgccggtacggtaaagttgatatctttcaagaccgttaaattgccgtaaccaccggtcaatccttcaattgttaaagtcatcttaccagtcccaatctgtataatttcagttagtgatatgatagcatgaaatcaaggtttctatttaaaaagcgcaagcagaaatgaggcagcaacatgaatgattgcattttttgcaaaattgtccgtaacgaaatccccaatgttaccgtatatgaagatgacgttgtcaaagcctttctggatatcacgcaggttacaccgggacatactttattagtccccaaagttcacattccagatattttcgcttatgacactgaacttgccgcagcggtttttgaacgtctgccaaaaattgcccgcgccatcaaggccagtgacccggcaattaaaggtatgaatattttgaataacaacggcaaggtcgcctatcaaagcgtttttcactcacatatccatttgattcctcgctatagcgatcaagatgattttggcatgcactttggcgatcacagtgcacagtatgacacagagaaacttgaagcggtcgctgacaaaattcgtacccagctggaggcctaagcatgaaatttaaacacggctttttactcggagcactgaccggaacagtttatgcgctgttgactgcaaaaaaaaccggtccacaacttcaacaagagatcgcggcctactttgaaggcttatcagacggagttggtcaggtgcgtgagagtgttgctcagttcagtcaatccctcacccatttatctgacgaactcaacaatactttgaaacctgccatgaaagatatcacagatcgggtcgagacttttgaatttgaaacggccccgcgcgttgatgcgatccaaaagcatgttgaaaatatcaatgatgctgtcagcaatcttgatgctatgccgactgccgatcagcgtgaacctttaccaaaacattgaaaattgccggcgatgtccatcaattaagtcgtgacggtttcgtgaaacttatgtgaagatccgcgtgcggcagtaagttatggtatagtagacggcagtgttaaccgaaacttttaagattaggatgtgtgattgcatgaaaaaatggattctcggcgttgttggtttgtttgtagcagtgacgttagctggttgttcaagcagcacggttgcaaacatgaaaggtgccaaggtcaccaaagacgagtactatgacgccatgaagaagaccaccactggccaagcaacattgcgtaacatgattgttttgaaggcattggaacaacaatacccgaataaggtgtctgataagaaggtcaacagtcagttcagtacactgaagaaacaatatggttcttcattcgatacaacccttgaacaaaatgggtataccgaatcaagttttaaggatcaaattcggacaaccttgtactcagaagttgccttgaaggccctcaaaaagccaacagaaaaacaaattgctgctcagtggaagaagtatcaaccgaagatcaccgtgcaacatatcttggtcaagaccgaagatgaagctaaacaaatcatttccgactaccaaaaagacccaaccgaaaagaactttgaggcccttgccaagaagaactcaatcgatactggaacaaaagataagggcggtaagttgacggcgtttgacaacaccgatactagcttggattcaaccttcaagaaagcagcctttaagttaaccaaggccggcgatatcaccacaacaccggttaagacgcagtatggctatcatgttatccgcgttatctccgttggtaaaaaaggcacgatgaaggaacacaagaaagatttggaaaaccagctctatacaacatggcagagcgaccaaaccgtgatgaacggtatcatcaccaaagtgcttaagaaggaaaatgtttccattaaggataacgacttgaaggatgttctttcaagctatctgagcaccagctcaagtaccagtacttcaaactaaaaattaaatcagtgttagcacttgaaagcctcgcaattaattttgcgaggcttttatttgtgttgcaaacatgacgcaatgaatggcaagtgattgtttgtaggactcaaaaaaggctgataaagataggcgctatcccatctttatcagccttttgacaaccacatgactacaactaaactgactgaattcgcctagtgcggatccggaaaagtttgaccatttttaggtcgatagaagcgacgattgtccataccgaaaagtcgttctgtgaaggtaccaggatcaacatgttggtaggcggttgtcatcatattgattgatgcgtccaattcgtctaaatcatgcaacacttgcgcttcaagcagctctggccgcaccggcgagccgtattcaagcaatccgtgatgtgcaagcacgacatgacgtagtaagagcatatcttcagcgttgatatcaattttaagttgctgtgctgctaagacaatctgttcgtcaatgagaacgatgtgaccaatcaagttgccttcaaccgtgtaatcagttgagattggcccgcttaactcaatggtcttaccgagatcatgtaaaattgcgcctgcatatagcaaacttttgttcaagctcgaatactgttgaacgacacttttagcaagtcgcaagatgcttagcgtatgaaaagcgagaccaccagcaaaagcatggtgatttgacttggcggccggataactgaaaaatgccttcttgtgatcattgatcagtttacggacaattcgattccagttagcattggtgatttcgaagatgtaactgttcagttcctcttccatatcactgggtgcttctggcgcccgctcaacaaaggctttaggatcattgccttcctcttgggttgccaaccgcaatgaaaaaatcttaatttgcggattgccttgatataattcacgcttacccgacaattggacgacttcgccagccttaaactgagcaatgtcattgtcgctagcatcccagaacttacctgaaatatgtcctgaattgtcttgaaaaatcatcgcaataaattttttgccattctttgcgacacgcacttcagctgatttaatcagcacaggaagccgaacatcttcttcattatgataatcgaaaagccgttttaccaaggtcgtcaccttttccttgaattttcacactacttaaatcatacagatatcaatgataaagtacaaggaaggttggtgcttgagtgaatgagaaaccatgcttcattgtcatacaaatgttaggcacatccaaggacgagtcagcgctcgggtaagagctggcacctaaccctttttaaaaataatggttggatactgcaaaagaaaatgcaccacctatgaattgccttttgccagcaagtttagttcaaacattgtcgcgacacgctcagccttctctatgcgcatgaatttccaaagaaaaaggatctccgcaatcaacggaaatccttcaatcaccagtcattacttgccttgatagacatcaataattggttgggaaataattttgttcaattcgtccatcatctgagataggccttgttcttttgccatcaaattttggatcggctggatgtcgcgcatcttgtcgccaagttcttgcaatgacttaacttcatcatccgtgaaatcttgtccctgcattgacttttgctgcatctcatattgcttttgttggaattgttggaacaaaccgtaagcaacggcgtccagcttcaagagatcaaacgccttcttgagatcctgaaattcctgtgttgtcttgatatctgccgccatctgattagcggtgtcgtaaacatttgccatactttacctcactttttgagcctatttaaaccagcccttgatattatcataccattgtcccacagtttgcttggcactgtctatgcctttctcgatactatcctgaattccttgccatgttttgtcgccactggatggtgtttggatgctagccatttgtgcggcatctttcgtgtcaaacgcggtttgtggcgtattcggcattaggttcgtcatttcgagtttaaataacggtgccaccccagacgtgctggtgccttgaaggaaatgctgactgtcagttgtcgggtagccaatccaggtcgcatttacaatatctggcgtatagccaatgacccactgatccttagtgccatagccccaactacttgggacctcagtactgccagttttcccggcgattgtgtagccagctggtttagcagtttgaccggtcccttcgttaaacgttccgatcatcatgctcgtcatttcctgagccactttttttgatatgatttgacgcatcgttggatgtgagttgtcgaccaccgtttgacctgacgcatcaacaattttgcgaatgaagtgagtcgttggcaatttaccgccattcgcaaacaccgcataggcccgtgccatcatcagcggtgaaaccccatttttaaggccaccaagtgcagcagcaagattctgatcgctttcttttagttggatgccaaaccgatctaagctagtgacccctttttgtacaccaatcttattaagcagccaaacagccggcgcgttgatcgaatcggctaacgctttatacatcgggacagtacctaaataggtgccggttgcattggtcggcgtataattatttttaccgtaactaagtttctcgtccttcaagacagaatcataatgataaccattttcaagtgctggtgtataaaccatcaacggcttgatcgtggaacccggcgaattgcgaagttgtgttgcgtagttaaaccctaagaaggtatgctcaccgcgattaccaacgaccgccctgacaccgcctgttttcggatcaagcacgatggaagccccttgaacctgcttaccatctgcggcatttgccggaaacgcccagtcttgagcaaagctgttttgaaggttgcgttgataagtttgatccaaattggtataaattttataacctttgttcaaaatatcatcgacactaataccttcactgcgcgcctcttcaatgacggagtcaaaataagacggatatttttgactgttggccgttgaaaaagtatcgacaacctgcactgactgcgcttttgccgcattggcctgcgcctgcgtgagcttcttattgtccaccatcaattgcaaaacgacattgcggcgcgacaaagcattgtccatgtgatcagcggggttatagtagctaggattccgtaacatccccgccagaattgccccttcactcgcatcaagctggctggcatctttgccaaaataccgcttagcagcatcttgaaccccccagaccccattgccaaaataagcattattgaggtacatcgcaagaatgtcttgtttggagtaaactttattcaactggatggccataaatagttcttgggccttgcgcatcaccgtctgcttttgcgtcagcaaggtattcttcgccaattgttgggtaatcgtactaccaccacccatgatttggccatggtggatgacataattcaaagcagagcgaagaatccctttgattgaaaaaccgccattggtataaaacgtacggtcttccgtcgagataacggcattttgtacttgcggactaatcgcctttaactcgacgtaggtccctttttggccgtacagtgtgccggcttcttcgttgttagcgtcataaatgacggtttttgtttgtaaggtactcttgatgttttcaacatcggcggttttggctttataagtaaaccaagcagagaacccgagcatgactgtcagaccaattaaaatcagccaacgaatcacctgaaaccggcggaaaaaccaccgtgttccctgccaaattcgtgataagaactgcatttccgtcctcctaatgtgaatcttgtttattgtagcataggcgacaaccgccaaaatttcatcgacatctttttaagcaaactttatggtcaaatgaattgaggaaatcacttgttgtttcaaacttctgcacgcgccacgctgcccaccagccttcgtgatcaacttcaagcatggttgataccacgtaaacggcaacaccaattgcgcgttgccaaaacaattttagttaatggtcattatcgtaattttaatgaaaaagtacagcctagtgatgttatcacgatgacttatgatgaacccacgccacttgcctacgttccggaaacgccggccctcacaattcattatgaagatgatgatctactcattgtcgataagccggctggtatgaaaactcacccaaacttaccaggcgaaaccggtaccttaatgaaccaggcagccgcttatctggccccttttccggcgttaattacccatcggctagatatggcgaccagtggtttattggtcatcgcgaagaaccctttaacgcaagccatcattaaccgacagttggctcttaaaaccatgcatcgggattatatagcgttagtaccgcagggaattgcggccagtggcaccataacggctccgattgggcatgatcctgatgatcagcgtaaacgcatgattagaccggacggggcatcggccattactcattttcgccggatcgcagaaacgtcaacaactgcgacggttgcgctcagactcgaaaccggccgcacccatcaaattcgggtacatttagctagcattggctatccaatcctaggtgatccgctttatgcccctgatcagacaacctatcagcgcatgtatctgcacgcctttcaggttcgcttcacaaagccgctatcagacacaacgttgacggtgaccagtcccctgcctttttgaacaattttgagccaaagtaatggcacataccatggcaagcagcgggccactaattgtgtgacaacgaaaagagctgggtttgacaaggttgaccttgttgcccagctcttttgcttgtgatgttgccagatggttacgaattgaaggcttgccgataagccgcttcaaaccattttgcctgcttctcatccgggctaatcacgacaatcgtgtcatgaccagcgatggtgccgacaacttgctcaaaaccgatgtcatcaataatcgctgccaataaattgccgttgctcggtaacgttttgatcacgttcatgaaatgcacccgagtaattgacagcccgacttcgcgaattgagcgacctaaccgttctaactgggactctgaagagccgcgaaaaatggtataacgtaacgtcccggttgcgtcctgcgatttgacgatcttcatctcgcgaatgtcgcgcgaaatcgtggcttgcgtcgcatcaataccagccgcttttaatgctgccaataactcttcctgcgtggcgattggcttttgattaatgattcgtgttaaggccgcttggcgttcacttttattcatcacatggcctccaccattattgttgcgcgggagtcagtccaagagacatcggcgtgtaagcggccttagatgtgatggccgtactttgaccattgtgaccaaagtccttatgcgtaggtgtctggactgacgagcgcgttatcgtcactgccggttgctgacgcgcaaggttacatttcttctggcgcaccgacacccaacagttgcagcgcatttgttagcacttgtgtcgtcgccttaaccatcgccaatcgagctggcagctcactgtcctcaaccagcactttgacattggcataatacttattgaaagcttttgccaagcgtagtgcatacttagcaatcacagaaggttcatattccttggctgcacgcaagaccatgcttgggtaatcgccaagggcgcgcaaaacgtcccaagccgctggatcacttaaagccacttcaggcgccgggtcaatcgcagccttccgcaaaatgctattagcccgcgcgttcgtgtactgtacatatggaccagtttcaccttcaaaacgcacgacttcttctaagttgaagtcgaagttgtctaagcgttcgttcttcaagtcatggaaaatgacggcgccgacaccgacttcatgcgcaactttatccgcatttggtaaatcgggatgcttttcagcaatttgttgtttcgccagaccgacagcatcgcgcaaaacattttccagtaagataatgttgcctttacgcgttgacaacttcttgccattcgccgtaatcagcccaaatggaatgtggtgaatatcattcgcccagtcgtaacccatttctaacaagacggcttttaactgctggaagtgttcgcgttgttcattaccaacaacgtacaggctttgaacaaaatgataatgttctttccggaaaatcgcagcagcgagatcacgcgtcatatacagcgttgcgccatctgacttcttgatcagcgctggattcaagttatacgcactcaaatccacaatttcggcaccttgactagttttcagcaaatgcttgtcttcaagccgcttcaccacatcagccattttgtcattataaaaggcttcgccattgtaagaatcaaaatcaacaccgagaattttgtaaattcgattgaactcagccagtgaaactgtgcggaaccagcgccaaagcgcaatggcttcttcatcgccatcttccagccgcttaaaccaagcacgggcctcatcgtccaactcgggatttgcctcggccttctcatgaaattccacatagtaatgcaatagatttttgatcggatcggctttgacagcgtcctcggatccccacttcttgtacgccacaatcagtttaccaaattgtgtgccccagtcgccaaggtgattaattttaatcggtgtatacccgattttgctgagaatgttggctaaggcattgccaatcacggttgagcgtaagtgccccatggacattggtttagcaatgttcgggctgctcatgtcgatcggtacattcccgctgccgatattagcatcaccataatgctcgccagcttgcgcgatcactttcaacacatcgtgggcaaaactgattttatccagataaaagttaacatagccaccaacagccttcactttttcaaacggggtcacatcaatttgaccgaccaaatcgctcgcaatcatctttggtgcgcgatgcatgatcttcgccaaggaaaaggttggaaaagcataatctcctaagtctgatgatttgggtgtttcaatcaaggacttgatcgcagccgcgtctaattgaccggcaagtgctggttcaagtgccttaacaacaagttctttaaaatccataacttcctcctaaaatgatgatgccacgaaaaaaggacccatctctcctgttcgaagagacgagccctagcccgcggtaccactctgcttgacaatatgtccactcaaagcactgattctcaaaagcgcgccatcaggtccgacgtgatcgtttgcactatccgatctcactaagaaccgccaactgaccttatttcctctttctcacagaaccttatacagcggtcgacgagaatcgaactcgcgacaccagcttgggaagctggagttttaccactaaactacgaccgcaaatcaacggatataagtatatcacgagggctacattttgcaaaggtcatcaaaggtgactttttctatgaatttgatgagaaaaaatcttaaaaatgagtaccggcaattttcttgttaatgtttctcaccgtgctataatattagtaaagaaggagtggtcgagatggcaaaaacgggacgtcactattatttcgtggcgcgcaacgagaaaaccaaaacaggttatcacattagttttccaaatattcctaacgctgaggcagtcgggacaacatacgaagagaccgtttattattcatatcgggtcttggctgacttcctgagccatctgccaaaacaagaagcggaaattcgtgcctacacgctttccgatattccggatacggtttccagcaatgttttctattcattggtgagcgtcacgcctgactttgatccgcacaaaatggaaacacattttaccttgccacaaacaccgcctgccgatattcgacaaaaagcagctaaactggctggattagtgacgccaaatgataacttggctttgtaactaggtattcaacatgcaaacttttcgaatgttgttgttagttatttttcttgttggcgttgggttagctttgatcggcctagtaagttggttgattgccctattgcgacaccgcgaaacaaaaccgatgcggcgactgacttggctgagcggcggagtggcgcttgcggcgctgattgtcaacgcgtttacgtaaacaactttgatttaagcgataattcttaagtcatcatttcaagaagagcactgccagtgatgggagtgttttttgtttgggattgcacggaatggtcgtgcaatcaaatcgagaatgaaaattgaacgttgttgcttcaaaaacgcgttcgctgccgcagaaactggtgtgtaaggaccttggaagcaatgaccaaagcccggtcatcacgtccaaggccgcttacacgccggtttctaaacgcctcagctcacgctctgaggcgttgactggtttctattgtatttctatgcttaaataggaacagcaaataatgaaggagtgggcttatgactgacctgcaaacaagtattggcgactttcaatttgataatgtgttcatgaacgcaagcggtgtacgctgctacaccgaggaagacttagatgcgttggcacaaagtgatgctgggacctttgtcactaaaagtgctacccaagcaaaacgcctcggcaatcccagcccgcgctatgctcgactagaactcggctctatcaattcgatgggcttacctaatgagggcctcgattactatctcaactacgccttgaagtttcaggaaaagcatccaggtcaatggatttttctgtcagttgccggcttgacaatggaagaaaatctcgccatggcacacactatcgaagactccgattttaatggcttggtcgagtttaacctgagctgcccaaatgttccgggtaaaccccaaaccggttacgattttgaccgaaccaaggaagtgcttaccaacctcttcacgttctttaccaaaccagcaggcgttaaattgccaccttattttgacctcgcgcaattcgaccaaatggctgccatcttaaatcagttcccgttgcaatttgtgaattctattaacagtctcggcaacggcctcatgatcgatcccgaaactgacacagcgttaattaagccaaaaggcggctttggcggtattggcggcgcctatgcgaaaccaatcgcactagccaatgtccgtgccttttcacagcggctggacccgaagattcagcttatcggcactggtggtgtgaccaatggccgtgatgcctatgatctcatcctcgccggtgcgagtttggttcaagttggcaccttgcttcaagaagaaggaccggccgtattcacccgcctgagccgtgaacttcaggctgtcatgcagaccaagggatataccaaccttagcgactttaaaggacaattgaaaacccaatgacgaacgaaaaaatgaaggtttgggcatactttaaacacaacgctggcgactttagccggcattggggcgcgtatatcatgctcatcagcgtcactaatctatttattgggttagctgtgatcccgttttttaattttgctgctcagcaaacgttgcgaattggtcacgtgccttacattaccttgacgaacctcggacaaattctgactcatgatcccggagttgctgcagttctcaccttgttggggctgctactactgttattcgtttactggcagttcaccttcttgattctaggtattcaaaacattcatcggcaaactcgcttaagcttctttcaattagcaatcgcgactttgaaaaaaacccaccgcctaacaccgacaaccatcgctgtcttaatcgcttactttgttttaatctttccattttcaagcgttgttttcaaaacaagcttgctggccaaattaaccattcccgatttcatcgtcgattttatttttgcccgatggtatctcggcctactggtcatagcgctttacatgatgggtacctggctcgccgttcgcttgttgccgttattacctgctttaattttgagcgaaacccctcctcgaaaagcggttgccaaaacttggcggatgacgcgcggccaaacttggcgcacattgttagcagtcttgttaatcttcataccggtagctgttctgaccactttgctgaccattggcctatatttacttcagtcatacttggacagtcactgggaacattgggccttacttggagcaaccatcaaccttggtgtgttgcaagtggttatgctgctattaacagtgttctttaccgttatgctttatcaattgggaacctcgcaggcagagacatttcaactcattcccaaccaagacttgattgcccgagtcccaaaacgtcggcgcaatcttcttttccgaattggcgccgttggcttaattgcgttagtcatcggtggcagcagtcttttctactacgcttatctgactggtgcactggcaagtcagccgttaactatctcacaccgcggggttgatgatggtaacggagtccaaaatacaatcccagcgttacaagccaccgctaaagaaaaaccggattatgttgagatggatttgcacgaaaccaaagaccatcaatttgtcgtcatgcatgacgagaacctgaaagatctaaccggtgtcgatgccaaaccacatcagctgactttatcagagatgaccaaactgacagctcgcgagaatgggcacaccaccaaagtcgctagttttgaccagtatttggcggctgcggaacgactgcatcaaaagttattgatcgaaattaagaccacacctgaagacagcccacaaatgatgaatcattttattcaactatacgggcaacgacttctagccgatcatgatcagttgcattcgctcgattatcaagttgtcacaaccatgcgcaaacaagtgccaaagttgaaaacttttttcattttgccgtatacgctcgtctttcctgaaacaccagctagtggttacacacttgaaacaaccacgttagccatgcgggtgattgacgaagcgcataatcgtgatcaaaaagtctatgcttggactgtcaatgacagcgatgatatggaaaaagtagctttcatggatgcggatgggattatcacagatcaattgggtgaattaaaaacaacactatatcaaatgaaccaccatccaagttatgctgatcagattttgcaatatctgacgagcttttctgatgatgctgaaaactagctatctacaaataaaggcaccaaaaaaggccatcaacttttattcgttgatggtctttttagtcatttacttgaagtaatacctagctgtttctaatgcgctggtttccatcaagcgtttgccatactcagacagcaccgctgatgacaacggtgaccgatcgccaaattccatcgcgacggccatttgatcgtgcgcctcgtcagacgaaatctcatttggataaaaggtcagtaccagataataagcgttcttataacgataaagatcgctctttccgccttcgagccgcaatgtatctgctaaactaataaaatcttcaaagtcctttaatttcaaaacaagctcagtctgtggtgctttgtcggcatcaatatagccgccttcatcaactgcctgatgatcttgttgatcactggcatcaagtccttgcagttgctgacgaatataatcaggcacctgggtatccgtaccttcgtcatcagtctgatcggctgcgctatcatcgtttttttgaccacttttactgatcagcaattcgagtccggactgactcggcatgacctgaaacgtcacggcctcatttgtagcaaacgtatgatctttatcgacctcatcgaggatactatagaagaagctctcaatctgtttatgattgcctaacagatccaaaaccgtgatcccacgctgcgctagatcatcgttgcctaacatgacccggatcgtatttgcgttaatccgttccatttccatgattgctgcacctcactttagtcacggaaccctggcttctgtgaatatcacattaccacttactacattatagcagatttcgtacgtcaaggcattctaccgcaggttagcgtgagtatcaagtaaagcgcgcggtcttcaaacttggttcaaccttcactctagtaacacttgttttatcaacctgcagtaacatcgcgtttgcgcctttcatacgcaaaaaccgcaccaaattaggtacggtttttgcaaatgattggctcatttataattagttttttaaaaacctgcaagtagttgtgcttgttgcagctccattgttcggacagaacgcggcaagaaacgccgaatttcatcctcgttataaccaacctgcagacgtttatcgtccatcataatcgggcgacgtagcaagccaggatacttggcaaccagcttaattaacgtaccagttgacaagtcatcaatattaatacccagctcctggaagattttcgaacgtgttgaaataatttcttcagtgccatcttcggtcattctcagtaaccgtttgatttcatctacgttcaatggatcagaaaaaatattacgttcctcgaatggaattttattttccttcaaccaggcgcgcgccttccgacaagatgtgcaacttggggatgtatataaaataaccattagcgctcgctcctttttcgtgacgaggtacttttcatctctacaggtatagtataagagattggaccggcgctaagcaatcacatttagaaaaataattttttaaaagctgaaattccatattaacgaatattgactattgtccattttatcaacaattatgcttattcatttgcaataaataatacacgttataataacc

SEQ ID NO: 43 - DNA, 9500 bp, Lactobacillus paracasei
agctaaacgcaacgagttgcatatgttcacggtgttaccgcaacgatggatcgttgaacgttcatggagttggctagacaaatgtcggcgactttggaaaaactgtgaacgtgcccttaacagcagtcttcaaatggttgtattggccttcctgaagatagttcttaaaagatactagacaggttctaagtctcccgtttggacaacgcaagaccggtatctatatatcaagacctttagtgaaacttatggaaatcaatcagcagacttttggaatactcgagaagtgcaccatattcggccaaaaatttatggtggtagcaatgaatttaacaatttgatgccgatattagcaccaaatcataggctaattacgtcatggtttaataatggattgaagtcaatatttgagacagattttaagagacattcagaaccgcgtttaccttccacagctcaaataaatcattaatcgcgattaataacttatttgaactctggaaagcattaaatcaggcggccatttggctcgtaagtgttgcaatttcaacttgtaagggggtctggtagcccagtgaactatgaattctccctcaattttcaagtcaagtgcaactatgataacgaattcttgatagtggtcgataaggccaatcacaagcgccagttaattgcgattcaactaacatctcgcggtcaaaagtcacgcgcaaccatccaagccacggccaataaacttgccaaagccaacgatgtggatgctgtgattcaatttgtccaatcctgaaaaacgatagccggccttcatcatttaaaatggccgatccttagccgaaatgtcccgttccaagccgtttgccttgcgatcacggtcatcgtacagataccacagggcactcaccaggaaaatccccagccctgtcaaaaccaaggtgaccgaaaaactgagtgtcaaatacatggttaccaacagtgccagaactggaattgtgagtccgccgggaagtttgaaccccaccggcaatttactatgatgccgtaatttgatcgccgcgaaaattgtcggcacgtactgcacaaatgatgtgaagacaatgcaggaagccagaaataagtagttgccggacaacaagaataacgcgcagatcacaactgataggatcagtgactgcagcgggaccccgcgtttattctgcctgcccagcgttcgcggcaacagttgatgttcggaggccagtgaactggcgatcagcggagttgaaaacgaaaccgacaaagcaacgccgagaatcgaaatcagcatccccatcaatgccagatcataacccaccgtgccggcaaagtgactgaaagccacggcaatcggcacgtttgcggcggccagaccactaccggccacgccaattgccgtcagctgaaccactaagtagagcccggcagccgttaatagcacgctgatcagtgcccggggcagcattttttcgggatttttcatcttggacgcggcaattggtaagaacgaaaaaccagtgaacatgtagaataccatgccaaatccctggttaaagcggctgaaaagtggcgtcgctgctggatttcccgttaaatttccaaggttcgccggatgaataaagaacaggccaatcacgacaaaggccaccagaacccccactttagcgatcgtcgaaacgttgtcaacccagtccatgaatccggatcccatgaggttcagacccgttaatgcggctaaaatgccaagggcggtaatcagatacggcccgtgctggttaagcaccggaaaaaggctccgtaagctggtcacaaaggccgatatttccgttgccatcgtaataatccctagtaaccaggtaaagataccgatctcaaagccggcaaaccgcccgaatgccgtgtaggtgtataaccaggcgccaccatccccggggattttgctggcgaggtttgcaaagcacagggcgatcgataaaattgcaatcccagcaagcggcatgacaaccatgctcaaatcaccgagctttgcgtaaacccggctgggcattagaaaaataccagatccaatgatgccgtcaattcccagtaaaaagatgctgagggcgttaagttgtttgtgagttgaacgggccatggtgaggacttcctttaatgaagcatttcgccaaatgtaatcgctttactagttactgttagcttaccattttatcgtttgggtggcggtaattatcgctttacccaccatcaagacccttccagatgctgagttatcttaaatcatgaatacataaatacgcaatcaaggccgaaacaccagttaaaacgcttgtgcttcggcctctttaattgactgttaattagtctaagaagctgtccaagatctaattcagtgaccaggacaatatcaccctcacgaatataggccagcattttttgcagttctggccgattagtgttagccccacttaatttatccgtaaataatttatcaacgtcttttaaagccgctaactgccgatctaaatgttgctccttggaactcacgcgcgcataaccaattttagccattttcagacctccttttggacagttctaataaacatttgtaattcctagtatagcacagaaacaagaatggccaataggatataccctaatggctagattggtttagtcaaacaaaaatcttaattggttccttataagagcatataattccatcatcactacctgttgtgctataactatggtaaaggtggtgatgatatgcgatttatatttaaggcattaatagtagttgttattatccttgcatttcctttatccatagttcttgtctttaaaaattggtcaacggccattggtactagtacacccatgtcattaaagcttggttggttggagcagtacgaaccgatatacctcttttggagtggagtaattctggcggtactgttaattatttttttgcttatcacacttttttggccacggtcacaatcattatatcttcatcaaaagtctgatggtcaagtgaccatcagtaagagagctattgaacattttgcgctttcagcacttcaacatgaaccctttattggcaaccccaaggtatcagctaagttatcacgaaaggggatcacacttaaaatatggggtgatctactaaattcagtcaatgccaagaaacagactgcaaattttcttaatcaattaaaaaaagatttgcgtatttgtcttggaatttctgaacagaaaaaaattaaaatcagactcgttgattttaatgagttggacgctaatgtgcataaatctcgagttgtctaggaggtgatatcgtgaccgaactcattaaagcctatttttggccactaattggtggaattatgggattgctcttagcggtccttatcatcacttttggatttttcaagacgctttttgttttgatttttatggcaatcgggattaccgcgggttattatattcaaaaaactggtatcttaacaaatgtttttaaataactgtttgaattataaggaggaaaaattatgcagaatggaacgccaagtgagaaaacaacaactaacgaaaagtctggtgttaaaggcaatttaacatttgatgataaggttattcaaaagatcattggtatcgcactttctgaagtagatggcttattaaccgtagatggcggctttttctcaaatgttgctggaaaactagttaatacttcagatgtcacatcaggaattgatgtagaggttggaaaaaagcaggttgcagtggatctcgacattgttgctgaatacggtattgatatttctaaactgtatgacaagatcaaaaatgttatcgttcgggaagtaaagaatatgaccgaattagaagtaattgaggtaaatgtgaatgttgttgatatcaagacaaaggagcaatatgaaaaagattcgacttctctgcaagatcgcgtgagcgatgccacagacaaaacgaaggaagccgtcattaagggcgcaaagaaatcgaaggaaacattaggtgacagcgttgataaagtaacgtctgacaatcaatctagtcgtgttaactaagggagtgagtaaatatgggacttatttggtcattaatcgtcggggcaatcattggtgccattgctggcgcaatcactaaccgtggtgctgctatgggctggattgcaaacatcgtagctggtttaatcggtgcgtggattggccaagggctccttggcacttggggcccttcgttagctggtatggccattattccgtcaattataggcgcaatagttgttgtagcagtagtttctttctttttaagtcgtagcacaagataaattttttacctatatgttaaactttttaacaatcttttaaatgaatccatggttgttattggctggtcagttacttcagttactgtagtaattggctttttttataaatgttttactttaatttcatgtaaagccactctaattattaacaagctgaaagaagtggacgaattggctatgcaaaatagaagtggcagaaaatatggattattaaattacagtgtttacgtcatatctttgggaggattcctatttgggtatgatactggtgttatcaatggagctttggcttttatgagcaagactagccaattaaatctaactccttcccgtcagggaatcgtgtcaagctctttagtcttaggggcttgccttggtgcattcctatgtggaaaatatgctgataaatatggcagaaaggttacacttcgttgggttgcagttatctcctagattgcaataataaagttaccacctagaaagaggcttgatcactgcttgaactggggtttgccaacggagacattttctgggtttgttattgataagcgctgtggctcgttgaatattggcctctgaaacctgatcaaactgtgttcccttcgggaaatagtagcgaagttctcgattgaaccgttcatttgtgccccgtgggcacaccaattagtgcgaaccgggaaacatataagcacattcgtaagttaccgatggtgtacggacaggcattaacaatttgcgcatttgcggaatatttgaatttcagtcactcggaaaaacacgtttagaggagagaaacacaatgaagaaaatcgtaaaatttgctttgccgatggtattacttgccctcacactaggtgcttgtggctcgggtagttcttccggcagttcggccaagaaggatgtcactttctacttgtccggtgatacgagtgaaggcggcgcgtatacaaagatggccaagaagtatgagaaggaaacaggtacacgcgtccgaatcacggatgtgccctacgatgacttgaaaacaaagattgacaaatccgttcaggctaaggatgaaccagacgtggcgcgggtggctggtgttagtagtacctggaccaaggatttgcaaaatttggggagcattgcaaaaagcgccaaaacaattaattctatgaccattacagattcaaagactaagcaagtggtggccattccttcagatctaacaaccaatggcttgtttatcaacaaaacattatttgataaagcgggtgtcaaataccccgcgagtgacaaggatatctggacttgggacgattttcttgcggctgtcaaaaaggttcaggccagcacaggtgctaaatatggtctagtggttgatccctccgatcagcgtttacggacaatcacttatcagtatggcgggaaagacttccggctcaataaagcaggaactagttatgtgacggatgccaacacgaagaacgctctgaaaaagtttatctcctggaacgacaataaattgatgcctaagactgtttggacatcgggagaagatccatcttcgatgttcaagagcggacaagttgctgcgtatctctctggtagttggcaaattacggacttctcgaagaacatcaaggattttaagtgggcagccacatacatgccttacgtcaaaactcgagccacgaatttaggcggtaattttgtaatctcgttcaaaaatggtaaaaatccgagtggtggaatgaaattcttgaaatggctatataaaccggcaaattacaagcaactgtgcgaatacgcaggttacattccggccgtcgaagacttagatattgattatggatccaaccaaaaagcttatgacattatgctgaatgaaattgctaattcgtctagtatcgccggttatcaagagacgaagggtgttgaggcagtaatgaaaggatataagggacttagcggttcatacaaagatgaaattgcaaacgttatcagcgggcaagagagcttcaatgccgccctcaagaaaattgaacaggactataatgacggtttcttgaaccaaaagtaaacgagcacagaatattgatgtgacagagacgagacacggattgaatgaatcctgtgtgtgaaacgtaaagcaatcaaatagcaagggtgattaacggtgacgctgaaacagaagtttagaagaaacaaatggcccttaatattcgtgggcgtgaacgtggttctatttatcgtttggttcgtaattccggctattttaggactgtactattcattcacaaactctgatggtaatcctggtgaacgatttattgggttggctaattatcagaaactatttgtcgatccatccttttacaaggcgcttttccgaacgtttacttacgtcatctgtgaagtgcccctgctctacatcgtttcattactagtcgctgtcttgctttccagtgacaaggtaaaaggtaagattgttggtaaaattgtggttttccttccttggtgcgtatctggaattgtcactggggtcatgtggaaatggcttttcggtcaagactttggattcatcaactatgtattgcagaaaatgggccagaagccgattccatggttttccaacggcaatactgcattcatggtcattgtaattgccggtgtttgggcagctacggcattcaacgtgttattgtttatgaacgcgattaagaatgtgccaacatcattatacgaagcggcagcacttgacggtgccagcagttttgacaagttttggcacatcacagtcccagcgattcgaccgacttctttcatggttattctgttggccacaattggcgcaatgaaagaattcgtcatggtgcaagcgctgacagacggcggaccggggacggacaacatgtttattgtccagtacatctatacgactgggtttgataagtcaaatgtggggtacgccagtgccgtatccatggtactattcgtaatcttgcttatcctggcgttaattcaaatgaaagttggtggcggaaccaatgagtaaactatacgatcgcacaaccaaaacgcttttgactttggcactggccattgtgtgtgtcctctatctttttccaattctttggttcttgctgagttcgctcaaaccaggaaatgaattgttttcatacccgttaacaatattcccgaagcatgcgacatttgaaaacttcagtaacgcatggaatactctcgacttcttcaagtatttcaagaacaccttcatttcggccacaattaccacggttctgacggtcttggccagtgccacttgtggttacgccttagccaagtatgatcgtaaatggcttaagattttcttcgtctgcattatcgcaacgacgatgctgccgacagaagtcctcatgaatccaactttctccgtaatcaaagccacgggattgtataacagattggctggtatcatcattccttcaatcaatacggccacaggaatattcatgttccgttcgttttttgtcaccgtgccggactcgcttattgaatcagcaagaattgacggtgcctcagatggccgtatttttgccagtatcatgtttccaattgccagaccgatcgtgatgacactgagtatcttctccttccaatggcggtggaatgattatatttggccattaatcgtactgaatgaccccgacaagtacacattgcaagtagcgctgcggtccatcatcggggcccaaaatgtcaattggtcattattattggcgtcgtcggtaatctcaattctaccgttggtactggttttcgttgtattccagcggtacatcatgaattctggctcaacaagtggaatgaaagactaatggaggtcaatatggatcgcagttggatgtcaaatccgcaattggcaggagtgaacaagctgcccggacgcagctcataccgagcggagaacaaaaacgggtctagaatttttggtgttggaaagtatttccattccaaaagtactaggccctttttgataacaaaaaaaggcatctaagcctccctagtgctatgctttaagagcctgtttagtgtcttttgagcatgaagcgaagaaaggctaacgttatcatcattgtactagtgtgaagcttgcgttcgcagtttttccagaggcgacggcatttttctagccagccaaagcttcgctccatcacccaacgttgtggggttacatggccatgctttaaatcactttgcttggcaatgatgacatctgcaccgatgctattgccaactaagctggcaaacttatctcccgtatagccgccgtcaaccatgattcgctggacaaggtcaaattgatctgcatgtaacatcaatagcgaactagcagcgtcacgatcagatacgtcaccagtggtgacgtgaattccttggggcaatccttgattatcaacagctaatgtccgtttgatacctttaatctttttgccgccatcataacctgaattctctgctgtgtccgtgtttttaacactttgagcatccagtatcaggaacgaagttctagttgaccggccttggctaaatcgtaggaaagcgacagtttttttaaaaccctggttaatagggccatctcgattgggttctcttgttttgtccaaagcacccagtaataataaacagtttgccactttggaaaatcactcgggagatcacgccaagtacacccatttttcatggtatacagcattgcacaaaagacatcgtacaaatcaatttgtcttggtgcagtatgtttccgtgcatcttcaagatcagctcgaatgaggttaaattggtcacgcgtaatatcgctaccatatcgatgggtaaaagttcgcatagttagctccagtttttgtgcaaagcatacctgaaatttagctattccgtaaagacactaaacaggctctaagaacccgtctagtatcttttaagaactatcttcaggaaggccaatacaaccatttgaagactgctgttaagggcacgttcacagtttttccaaagtcgccgacatttgtctagccaactccatgaacgttcaacgatccatcgttgcggtaacaccgtgaacatatgcaactcgttgcgtttagct

SEQ ID NO: 44 - DNA, 54015 bp, Lactobacillus paracasei
cataaaagtaaataaaattcagaaaagtttcttaagactggtcctgagaaactaatataatagttaaataataggcgttattgaatctgacttggcaaatttagacgtcaatttttcgtaaatgattttatataaaaagacattatgttatttatgtactttaaagcgttcgtgtttaattctataaaacctttaaaaagggcgttttgaatgcgataccattttttataaaaaatgtttctgaaaatagaatgttgttatattaatcgttctgttatatatttagcactaatctaatgttaggttcgcgaccaaacaagaacaagaatctaaagttgggtttaatacgttttatgatagggggcgaagaaataaataacgatctcgcactaaccgtcaaaatacctgcagaagtgtcgtcgggaacgcgtcatgatttaaacattcatcttcttccaaatgaccgattaaccgttcgtcacaatctggcgggaatgaatcaaaagatgtatcaagggttagcagctattgattcacgcgattcttctgcgagtaacacacaacgtatgatgagtttatttttcactagaatggggtgagcacatgggaaagtttagtaaggaaaaaccgtcagcaaagacaacgaatttcaagatgtacaaagcgggcaaacgctggatttttgcgtttagcacgcttactttgcttgctggtggtgctggccttttatcctccgaaggccagtcagttcacgctgattcaaaagatgatcagcaaattattaacgcggctacggcagcgtcaattcatactgcgccggcagtacctagcacagctgcctctgcagcgaccattgcagcaccaaccgctgcgacaaccgcagcaccggccacggttgcagcacaaccaaaagcagataaccatgagcaaacacaaccggcgtctgcctctgcagcaacaccgtcagccacacctgaggctgcaagttcagtaacagcctcagttgctcccgcaacatcatcaagtgcgacgccaattgttaaacaagcggcgcaatcaagtgcgcccgaagtgacaacgcagactgcgtccaaaacaactgagagtgctgccagccctatcagtgcagcaccaagcgcggcagcctccagcgtgacgcctgcttctgctgccgttaatgacgttggaaaagcaattgtgtctaaaacgcttgcggcaatgccggttgttgatgatgctggtacaccaagtacaattgtgtatacgcaatcgaatagccgcggttcagctactgtgactgcaccaaatgtttcaatttttgcgggagatacttcaattgatcaagtagtccaatcgaattttacagctttcggtaatggaagtttggcaacctttacactcacttctggtttaacgatagttgccagtaccgcagtgaacaacattgattacacgcatgacttaacaccttttggttctagctcgatcaaaggtccatttttgacattccaaggaacgggcaccgtaggaagtattctggctaatcaagttggtcggcctaatgatgctaatattccaatttggattccctcagtttcatacaaaacaccaggagtttatgcggttcaattcaatatcgatacgaaccagtcaaaaccattaataggtccgtttaatggcgttatcatgtcttatttcttagtgacggtcaaatcggcactcaatcctgatactgattcatcaactgccgcaagcgccgctagcgttgcaagtgctgcttcgacaaaggctaattcagcaagttccatcgcaagtagtgcaagcagcgcagctaattcggctaacacacaaacagcaagtattgcatcggctaatcccgagaatgattcacttgccagtcttgctaaagtagcttctagtgcgactgcggtagcttcgagctatgcaaccgatgcgagttcagatgctgctgcggctaaaagtatcgcggcggtcgttggaaccgcgaataatgtcgctgcttctgctgctacagcggctaacgcagcaagtgctgcagggaaaattgatgatgctacatcttttgcaacgattgcttcgagtgcagcctccgtggcgagtcaacaggccccaattgcaaatgcggccgctgacaaagccttaagtaaagcttatgcagcctcttcagctgctgacaacgctctgaatgctggcagatctgcagcagcaatcactggatctgcaagcagtactgcatcagcaggaagtattgcttcttcagcgggcaatactggcagtattgcgctagataaggccacaatagcctcaacgattgccaatagcgcaagtgcgattgcaagcaccgcaaacagcacagccgcttcggctaaggcgattgttgataacgctgccagtgcgtttccaactaatgattcacttgcaaagctttcagcaactgcctcaagcgccactgccgcaacttcaagttatgcagcttcagcttttgcaagcaattcccaagcaagcgatcttgctgctaaagtaaaagctgcaaatgatgctgttatctcggcggttgcgcaaacaacagctgcattggcttcgaagaatttacctgatgcaagttcttatgctgcaattgcagcaagtgccgcaggtcttgcaagtcagttagctgatcaaacaagtactgctgcatcggcggctttgagttcagcacttgcagctagtgatgccgctaagatcgttgtttcggcagctagtgatgccagcaagattgctggaagtttaggtacgacaactgggagtgcaacagctgacggtagtaatgctagcctagcaaacggtgtagcattatcagcctctgcggaggccaataatgctagcgcaattgctaaggcagctagcacgactgcaagttcagctaattctacggcgtccggtcttgcttccgcttttccagacaatgcgtctattggtagtttggccgctaaggctgctggtgcaaacagtttgacttcaagttatgcgacagccgcaagtgcctttgctagccaagcgagtgatttagcaacgcaagtgagcgttgcaaactcacaggcgcaagctgctgttggtcaagttaccagcgcagctaacaaaggcgattctgccgcggttgctttgtactcagcccaagcatctactgctgcatctactgcggcggctttagctaatcaaacgaagtcagctgcaagttcggcgatgagcaacgcgcttaaggctaaagaacaagctggcatcgcagcagatgctgcttctgctgctggcaacatcgccgcagggttgacaactggtgctggggatggtgcgggatctggcagcaatgttgctcagtctgcgtctgttgttgccagcaccgcatctgttgtagcaaattctgctagcgctatcgctagtaccgccagcagcgtagccctgtctgctaagaatgtgactgcgagtgcagcaagtagttttccaaaagatgattcattggctgctctgtcgacaaccgcctcaagcgccaatgatgttgcctctgactttgcgactaaagccagttcagatgcttcagtagcaagcagttacgctggtcaaacaagctcagctaatgatgttgctaagactgctgcttctcaggcaaatagtgccattgctgcaggccaaagcgcagctgcagttacttttgccagccaggcggttgctgctggtaaacttgcaagttcattagcggataagacaagcacggcggcgagttttgcacaaagtgaagcacttaaagccagttctgcagcagatatagctgctaacgctgcaaattctgcaacgggtagattgtccagtttgacggctgatacaagaaaagataccagtgctgctagtgataaagctagcgccgctgctgtcgctgcaaaatctgcttcaacagtagctaacaacgctagcatcattgcaagcaccgctagcagtgttgctagttccgccaatgatgtgaccacatcactgatcagcagctatccgacaaattcatcgctaacgagtttgtcaaatgttgcttcgagtgcaaatattgcaacgagtggttacgcaaagagcgcctcttctgatgctgcaacagctagcagtttagctgcgaaggtaactgccgccaataaagctgcaagtctcgcagcttcacaagcaaacagcgctatcgcagtgggtgacttgccaaacgcatctgcctttaaagctcaagcatcagctgttgcttcaactgctgcagatctcgcaagtcaagccaatgacgctgctaatcaagcgtcaatagaagctgatcaggcgaactcgacggcggcaatcggttcaagtgctgctgcggcagcaatcgacgtcgcagcaaatcttgctaaaacaacttctgatactgctgatcacgcttcttcggttgctagctccgcgtccgttgttgcaaattctgcttcggttgttgccaactcagcaagttcaatcgccagcgctgcttcaagtactgctaagtcagcaaacgatattgcttccagtattgcaagcagatttccgaaggatcagtctattggatctctttcggcagcagcttccagtgcagcaagcctaacttctagttatgctgctggagcctctagtgacgcttcactggcaagtagttacgcagcaacggtatcgtcagctaatgatgctgctagcgctgctgcctctgctgctaatagtgcttatacaactggcagcatcgctgttgcatcgtcttttgcagcagatgcttccagtgcagcctcaactgccgcctcggctgctgataaaggcaagtctgctgctaccaaagcattgagcgaagcttatcaggcaagctcagctgcgaaagatgcgtcaagtattgcggcagttgccagcacagcggcttctagtctggccgcttcgattactagtggcaacacttctgccagtgataaggctagttcggcaagtgatcaggctcgctcggcctcagtgactgcaagtactgcctcagtgactgctaacaatgcaagtgccattgcaagcacagcaagcagtgttgccgattcggcttatcaggatgcttcaagtgctgccagccgttatccggataacggttcactgacaagtctttcagctgttgcatcaagtgcaaacactcaaactgccagtcttgctacattagcaagttccgacgccgatgcggcaagcagttttgcaacagttgttagttccgcaaatgctaaggcaacctctgctgcagctaaggctaatagcgctattgacgcaggggatctaacggcagcttcttcttttgctgatcaagcagctattgcaggttcaatcgcttcatctatcgcggataaagtgagttcggctgctggccaagcattaagtgaagcaagagcagcaagcagtgctgcaaaaattgctgtgtctgccggctcaaatgcgcgtgatattgctggtaaagttgcttcaagcacgacatcatatactgctgattcagctagtgctgttgctaacaatgcaagcgatattgcaagcacagcaagtagtgttgcaagctctgcttatcagaatgcttctagcactgccaacaattatccagataacttatcactagctagtcttgttaaaactgcctcaagtgcgaacacagttgcgacaagttttgctactgatgctagttcagacgcttctgcagcaaacagttttgccgaccaagttaagtcagcaaatgctgctgctataacggctgcttcacaggcaaccgctgcaagtagcagaggggataacggtacggcgcaaagctacggtaataaggccgcttccgccgctgctgctgcctctgactatgcagacaagactagttctgctgccgcaaaagcgttgagtgaggcgtataaggctagttccgccgcaaaagttgctgttgacgcaaacgatcatgccaaggcagttgcagccgtcgcctcaagtgctggcgatcaggcttcagtaaaagcgagtcaagcaagcgatagtgcccaagctgctgccgttattgcacgttcagcttcaactactgctaacaatgcaagtgccattgcgagtgccgcttcaagcacagctaagtctgcaaatgctattgcatcgagtgctgctagccgattccctaacaacgactcattaacgagtctcgcgcaggtagctgcagatgcaaccgcacagacttcaagttatgcggcacaagccttgtcagatgtttcctctgccactagtttggcaactgttacaagcagtgcaaacacagccgcaagtcgagctgcgtcgcaggcgaatagtgccatcgctgctggcaacatttcacaggcatcttcccttgccgaccaagcatctagttttgctaagacagctagttctgccgccgatgctgcaagtagttttgctgatactgccttaagcgaagcagttcaggccaaagcacaagctgcgattgtatcaagtgctgctgccgatgcaaaccgaattgcaactgctgttgctagccaaggcgataaatacattggtgatgcgattaaggctgctagccaagcaggttcgagtgcagatattgcacactcagcttcaagtaagtatccgaccgatgcatctattacaagtgcgacaagtgttgccaaaaaggcagctgacgatgcttcaagtgcagccgatactgccaaacaagcagcacaagggggcgacattccaactgcatcaagtgcggctgctgtggccaagagtgccgctgatcgcgccagcgttgcagcagatttggcttccagtttagctattggtcatgacggggatgccaagagctatgcaaacgatgccgccaagtcagctagtcaagcaagttctagtgctgacattgccggatctgcagcaacaaagtaccctgatgatccaactatttctcgagtaaccgatattgctaagaaagctgctagcgatgcatcaagcgccgcaagtattgctaaagatgctgctaagcttggtgatgatacaacggcatccagtgcagccgcagacgctaagtctgccgcagatttagcagattcagctgctagaattgcaagcagtactgcggatagtatcactgctgctaaaaaagcagctgccactagctacgcgagtgatgctaccaaagctgctagctcggcaagttcgagtgctgatgttgccggatctgctgcaacgaagtacccgaatgatccgacaatctctagtgcaactgatgcagcgaagtcagccgcaagtatcgcatccagtgctgcaatagatgctaagagcgcagcccaagcgggcgatgactcaacggcatccagtgccgcctcagttgcgaagagtgcttctactgttgcaagttctgctgcttccaaagcatctgatgctgcaaaggcaaagagcacggctgccactagctacgcgagtgatgctactaaagctgctagctcggcaagttcgagtgctgatgttgctgactctgctgcaacgaagtacccgaatgatccgacaatctctagtgcaactgatgcagcgaagtcagccgcaagtatcgcgtccagtgctgcaatagatgctaagagcgcagcccaagcgggcgatgactcaacggcatccagtgccgcctcagttgcgaagagtgcttctactgttgcaagctccgctgcttccaaagcatctgatgctgcaaaggcaaagagcacggctgccactagcttcgcgagtgatgctactaaagctgctagctcggcaagttcgagtgctgatgttgctgactctgctgcaacgaagtacccgaatgatccgacaatctctagtgcaactgatgcagcgaagtcagccgcaagtatcgcatccagtgctgcaacagatgctaagagcgcagcccaagcgggcgatgactcaacggcatccagtgccgcctcagttgcgaagagtgcttctactgttgcaagttctgctgcttccaaagcatctgatgctgcaaaggcaaagagcacggctgccactagctacgcgagtgatgctactaaagctgctagctcggcaagttcgagtgctgatgttgctgactctgctgcaacgaagtacccgaatgatccgacaatctctagtgcaactgatgcagcgaagtcagccgcaagtatcgcatccagtgctgcaacagatgctaagagcgcagcccaagcgggcgatgactcaacggcatccagtgccgcctcagttgcaaagagtgtttctgctgttgcaagctccgctgcttccaaggcatctgatgctgcgaaagcaaaggatgaggctaagtctaagagtgatgctgcatctagttatgccgatgccgcaggcaagtctgcaagtcaggcaagttctagtgctgacgttgctggttctgctgggaagaagtatccagacgatccagcaatcaagagttcagctgatctagcgaagtcagctgctgacgatgctgcgaagtcggccgctgttgctaaggaagccgctaagtctggtgatgattctaaggcctccagtgctgctgcaggtgctaagagttcagctgatctagcaagctccgctgctgatactgctaagagtcttgcatcctcacacgcggctggttctgaaactgttaaccatccggctcagagtgattatacaagtgcagcaaatagtgctgttaccgccgccaatttggctgcttccatcgcagccaaagctgctagcgaaacagctaacattgcacaagcaaatccaaacaacacctcacttgcttatctgaagtcagatgctgccagtgcagcacttgttgcagctaatgctgctaaagacgctgcttcatacgcggcctatgcaaaagccgcacaagaattggcccacgattatgtggatccaaataaggcggcacaagcattatcatttgctgctcagtatgtagcctctgcaacagctgcagctgatacagcaaaaagcgcagcaacccgtgcacaagctgatcgtgatcttgccgcacagattaccagtggtaagtcgaacccaacgggagaccatggaacgactgatcatggcaatcaaggcactggtcaaggtggacagcagggcacaggcggtaaaggaaccacagataacaatggttcacaaaccggtaacaacacgggcaacaataaccagaatggcgacaatgcaggcacagttcacaccgttgcaaatgaaactggtgccggtgccaagacaaatacagccgacatcacgggttcgggcacagcaaacggcaacgatcacacgttaccgcaaactggtgaaaccgatgcggctggtgctctagcactagccggtgttgcattgatgggtgctttggcactaatgggtgcaaaacggcgccatgaaaactaaattgtaacaatattgaaagtgagggtgatccatatggtagggaaacaaaacttaccccgtgcggcaccttagggtgttgccagtcattatttcttcgccaatcaccgttaataaaccatggaatttcgaaccaaaaagtaattttaaaaagaactcagtagaatgccacaacactcaaaaacaatgacttgtttaaagcaagcaatgtttttaacggtgttacaacgaatgattaagttgtgataaaggaaaaaggggtggattaatttgaaaaaaagccaaaacatcgcgtttgctgatactgaaaaaattaaggttaagcgcgctaactttcgatcctggaaaaaggggaaaaaatggctctttgcctcatcactgattgtgacagtgattggtgcgggagcgctggattctggtaaaacagttaaagctgacgaggtgacaccggaaactattaagattgctgcgtccattgatcaagcgccgactaataaggaatcggccgaagcacaacaggcaaaggattctcagtcgagccagtcggcagtcaatactcagcccagtactcgaccagcttctcaagctttgattgcaccacaaatctcagctgtagctgctcaacaatttgtagcacccaatgccatcgctcagtcaacggctgcgttaacgcagacaaattcagctcagtcatccgaagcttcttcagttgtaacagcaagtgttgcccctgcagccagtcttgtagcaccttctgtcaatgcaatccaagcgactgtaacgaaggacaagcaaactttagagacgcgcgacgtgcaagtccaaacaaaaagcagttttgacccaagcattgctcttattggtggcacagacagtaaaggtaatccattgaatcctgaagacataagtttgacgggaactgttaccactgcttacgctggctcatacttccttcgatacgagtacattgacccttatacgaaggaaaaaataggaaaaacagttagagttaatgttagcgatagagaagttcaaccccctgtggtatcttctgcgggacaagcatctacatctagtcttgctactttaaagaacaactcaagtgcaactgaagtagtaacaaaaccggttgctttagattcactgaatttgacaagcgtttctgcttcacttgcctcttttgccaaaacagatcaaggtcgaattactttgagtgaagctgcagataaaatcaattctggcgttaacttctttagtgctgctgtttcacttagcaacgatccaaaggtacttgccttccagacacaactatctgctgcaactgctgcttctgacgtggcacttcaaaagtcgttagtggcttcattcaatgcgacagcggaaggccaagcaatgaactctttagcagcaattcaatcatcaactgccaatgatccagcctttcaatcaatgcttgggtcgttatcatcaagtacagcagctgcttctgtcgctgatgctagtgcgacatcttcgttcatggctacagctgctggaaaagcatttatgacgcaagcatcattggtagctgataaaggatctctggccagtgctgcagcagtttctgcatttgcaaaaactgctgacggtcaacaaatgattgctgccatctcgtcatatgctgctattcctgaatttgctgcctacaacaaggcaatgtcttcggcagtcgcttcctcaaatgaaagtctagctcagtctttgacagcttcattctttgctacttcattgggctcagcgtttattcaagacatgcaaaagtatgagtctaccaattcttacaaggcgatgcagaccgcaattactgaagcgcaagatagtgttgctaaacagttgcaatcaactattagcgttactgcacaatcgcttgttaaagccgattcaggatttagcataacagggattcttagcagtattaccagttttgcgtggaacgcaattagttggttggcttctaatatcaacccggttaagttggtaccgaatttgactggacttggccaggttggggaactgattgaatctgtcattggtggcacgcttggcagtgcattctacggcacaattacaaccgcaattggcgggttcgcaacatggatagttgctggtgttccagcaactgtcctgaactcgattgtcggtatcattcctattgtcggttggattaccaatggtggtaacttggctgaacttggttggacgggcggtattgttggttggttaagcggtcttgtgggttcctcaattggagcatactacggcgctactatggcggctggcctgtccaaagatggtaaggttgataatgttgtcagtggtgtggcattaggcgcaacaattggcggtttggttggccacacgattgctaactgggcgatttcttataccttagggatgatcgttgaagggattgccgttgtcattgctgttgcggctggtttcattggtcttggtcctattgttaaccctctggaattcttcctactcggctggttcacacctcttacagacacgattgctagtttaattggttcgccaataggggctgcgatcggcggtgttattggtggtgtcgctggctggttgttacaactggttggtattcaagtcaacttacctgatgctggcggcgttctgaagggaatctctcaattgccgggtatttcagatttgattggcacaatttcacagatttcttcaaaagcaggtaagctagttacgaaaaacgttgtcatccaagcaaaatcccattttgatccagccgacgcctttgttagcgcaactgatggtgatggaaatgcagtagcccttgaccaaatgtcagttgatggcgctgttacagtttctattccgggcacctacattctgaggtattacttcaccaatgcagctaataaaaacgagattgttacgaatgacgtttatgttaccgttacgaggtagacaaccatgaaggcaaaaattgaattaaggccattagtgttgaaaaataaagaaagttttcaacctgaaaagttgcttgttaatgcaaacgattctttgggcaatccagtgccattagagctttttggattgtctggtgaagttaatctcacgcgcccgggtgtttatcagatcacaattgattttactgatcctgtttctaatcaacatattgaagaaaaaacatctgtcacggttctttcgtaatcgttggtttttcaggaattaaagaagtcaattcatcaattgaattgacttcttttctacataacggagtcaaattagttgttgattcgttatggtaactattttaagggctcttgactggatggagggatgtaaatggggaaaaggcagcgtcaaaataaaacaaagttgaagggaaatcttccaattgttgaattaactaaagttcaaagaaggtgtttagatacatcgggacttatcttagtgttcgctagcttgatagccctcaatattggacattctgtaaatgcatcttcaaatggcgatggggtgattgccggtgatgcaaccactaatcaatcttcagcgaatcagatgtatccgagtggtccctcctccatcaacacaacgaactctactgcatcggcaattagctctgccccagctaggcgtgtttccgaagaagggaaaatagcgctagagaagcagcaatcatcagaggtcagtcagacagatgtgacggacaaagcaaaaaaagaattgaacgactctggagaaagcgaccagaaaaaagagaatattgtatctgtttctgaaacgaatcaggtacagacacctaagattcagacagccggggtcacaataagccgaaactcgtcatggtccccagcagagaatctaataagcgccagaaatacgctgggacaagaggttggtttagatgatattcaaactgttggcactgtcaattcggcagtagttggaacatattttattcagtatgggttcaaagatgtttcaggcggaaaagatgttacccaattctcctcaattacggtcacagacaataatgatccagttcattataaacaagccggagaaaatattttacccagtgtcccagtgggtgctttagcatcaattaaggcaaaagatacttttttactcacaaagtcttcttggatgccaaataataactttattagtgcgactaatagcgatggggaatcagttaaccctgataagatttcaatagacggaacggtcaatccaacagttgtaggtaattattttatccgttttagttttactgatacaaagttaaaaacactcgttgcgaatatggccaaagtgacagttgttaatacacttccactggagagtggcgatctaagtcaaggtggatacaaagaaagtcatctagcttccttttttccctccaccaccaactaccccagcaccaaaacggtttacttgccagatgatccgaattttaaacctgatgaaaatgaaatttcgaaatattttcttcaatatgtcaatgaacttcggacgttaaatggccaaacaaccttgacgatttcagccagcgatacggcgcgggcacagcagcgggcgcgggcgattgttgatagtttcaatcatgagactgtcagcagtgccaccgagaatatcggaactaatgccggtatcaccgaccaaatgcactctaaccaagaaattgcttattacatggtgatggcttggtacgatgagactgacaatccggaaccattaggagatggccattatgggcatcgcgccaatttgctttatggcgggccaacaatgggattgagtttctatcgaccgtcagctgggacggctgagtttacagattattatgcctttgaagcaccgatttatacggacttcttgctttatttgaaagcgaagtcgatggctaatgcgatgacgaatccggtgagcgtgccgcttccgaatatcacgtttgtatacgttaatgcggcaacacttgcaaccttgcgatcgtatttaaattggtcacaggtgggacatgcggatccaaaagtagaaaataacgcaaaacccagcttatcattagcgtaatcaccccacattcatgtaagattatgttatggcataatcaagctttttatgggggattatacaataatatcaataaattgtatttttatgtcgataaattgcacagagctttattaatcgcctggtggccgttaaaaaacgtccatgtcgattgatgaacttaccaaggaggcaagcatgggattttttagtaagaagtcacgttcggagacggctaatctgctcgattcgctagccaagcagtctagttcaagtgagcagcggcaaaaattgggtggtggcaagcaagcttttagcccggcagatggtgttgatcagttggcaaaggcacttgcacctggtagtgccgcgtcaacgcaacaacttgatcagttgagtagtgttgcctcgcttgctaatgaaattttaaaaccaactgaaagtaaaagtgatacttggtcaatgaatattacgggaggcacagagttaagcttcgcagatgatcaattgacggtttatgtgcaaaatgaatcagaagcagcggcgccgaacgatcaggcagttccttcaaaagcgactgtcagtcaaccgcaagatgctgctgcccccatccaacctgatcaggctgaacaccatgcagatgacgcgggaaaacaagtgcctgatccgattgtaaagagtgtggataatacggatgctgctaccgccagtcaggcagaggtcgttactcaccatcaagtaaaggcggctggggccagcgccacgcagcaacaatctgaggcccccgcggttgttttacaagaagccgcaccgcagttggataaccaatcgacgatcaaatcaactggtgatcaatatcatgaagcgttgaaacaaaatagcattctcattacgcaaattgcagttttacagaagataaacgaacagctgaccacgcaaatagagcagtggcacacttatcgttcgaagacgaccgtttacatcaaagatttgatggctaagcatcaagcaacacttgctgactttgaaagcaatcggcaagccgctgaagaggccaaaacgcttcgttcacaaaatgaggctttgctggaaaaggagcagacactgcaggatcaagttgccaatttgacacaacaactaacaactacaaaagctgatctgacaaagcaattggaagcggccaagactgatttagcaaaccagttagaaacagcccagtctgatcgagacaaggcgcttaatgccaagtctgatctccaaaacgagttgagtaagcaaattgtggcagaacagattgccgaaaccgatcttaagcacgcccaggaagatttggcggcagcgaagcaggcgcagcagcagttagaagctgaattaaccaagctacgtgctgaacgcgccaatcgggcggccacctcggtcagttcccaaccagctgtagctgtcccaactgccaaggcgttggcagacagtggcgttgccttaaataggctggacgtgttgccatcgagtgatgtgcctgtttttgaaagcgattttccagaagcataaacaattgacggtttgaggtaaacgcaatgagaaatgggggattttaattgaactattttgtaaatgaaaacattttttcaatgaactcaggaactgagttttctgctgctaagcgattgacgttgttcaagcgtaacggtgtgccggcaaaagttttgactcggaattataatccattattgattgacgacttgaaacgggttggcttggaacaggctgatgtcttgaatatgtacaattattttcaagaggctgtggcggtggtgccgcaagacatcgatattcgctatacggaagtcattgataaattcgattaccatattgtgggtattgacgcgaatgaatcgcaaatccttcatcatgggaaggttgttggaaaagccttagttgcaccagctactgtcggtttggttggctcgctggagtattacaatgacatgaatgctacggtcgctaaggatgtctgggatcggcgcggttttaagtcgtcaacgcaatattttcatcctgatggccagatcggaccgcaagttttttataaccctgcaggcgaaccgaagctcgaaattgtcagaatgaatgtcaatgggacattgatgaataccatgtatcaactgttaaattacaaaggccgtgcttggcggtttaactcagaaagtgaattgttcattttcttcatgaatgaaatcgcagcagccgaaccaagtgtcttgattaacgatcggccttcgcttatcaatgaagtggccgctgtcactgaggcaaccgccaaatggcaatatctgcatagtgttcacacgcacaacccagaacgagttggcgggtccaagcattatgttgactacctgaagccgctgtttgccacacacatcaatgactttgacggcgtgatggtagcgactgaagaacaaaaggccgaaatagacaagttcttccactttaaggaagtcgtcgttgtacctgacacttttgccgatgcacacgatttagtgccgatcaaaaaacgggatcgcaacaaaattgtttatcttggtcgcatttcaccagaaaaagaaccgcaagaggctatcaaaatttttgccaaagcaaagaagcagttgccagatttgcatcttgatttttatgggtatgtctcagatcaggacgtcgagaatggcatgattgcgtatagcaaggaactgggtgttgatacagctatccagtatcacggttatcagacggacgaggaattggccaaagaacttggcacggcagcggcgttactcagcgtttcgtcttcagaagcttttgggatgaatattttgcaggccatgagctacggcgtcccagtgattgcctacaatgtcaaatatggcttgaatctgttggttgaaaaggatgtcagtggctacttggcacctttgggcgaaagcaaagcagccgctgatcatcttgtaaggctgctgacagatgcaacaccaaatgcaaagtgggcggatatggttaacacaacttatcaaaagtcacagacatttgatgctaaagcagcttggcagcagtggcaagatcaactggcaaccgtcccgaatctttttcttagataggagtcctgaccaatgatattctttattaattcgagttttaaccaaagcaattcagggattgaacatgcccagttaaaacgggctggactgttcagggaccatggcgaaccgttcaaaatgattttccgtgaatggaatccgcgcttgcatgaatacctgaatcataatgacgttgccgacagcgaaattctcggtatgtttgattatttccaagacgcagaagatgtgccaacgaaaatcttgcacgctgaggacattgacttcggtttagataatctgagctaccaaaaagagccgaatcagttccggtatttggtgcttcgtgggaaccaatttgtcgcgcgggtgaactattttagcgatgatccaactgagcgtgtcagctccattgaacagtttgacgcgttcggaaatcttttccgggttgatttctacgattttcgcggtttcatgtctttgtcccagtggtatacgccagacaacaaaattgggactgaagtgtggcataaggtggatggtcggccagtccttgaaacctttaacaaatacgatgctaatcatgttttcacaaaaacgggctggcggctgacggaagataatggtgctgtttacgttttttctgatattgacgaactgaccttgcatttttataaccggttgaatgaacaatattgggatgacaagcggccaaacattttcatcatcgatcgatcgcatctcggcgattggcaactggttaaccttgtgcgcccagcctataccgttatgcatctgcataattctcatgctggggatgcgcaagacccaatgcattcggttatgaataacttctatgagtacagtttgatccatgcaaatgattatgatgcggtggtttcagctaccgaaaaacagactcacgatgtccgcgaacgcttccatccagaaagtaagttattcacgatccccgttggcgttattcctgatgaacaatttgcccgaccgcgcgttgcaatggcagatcgtcagccagccaaggtgttggtcacagcacgtgttgcgccggaaaaacgaattgatcatatcattgaagcgattgggattgctaaaaaagatgtccctaacatttcacttgatgtctatggttacgttgaccatcgtgacaatgatgaagcaatgacgaaaatcaatgcagcgatcaagaagtatcatctggaagacgacgttaagctacacgattatgtgaaagatgttggtgccgttcagcgtgaagcacaagtctatgcgttggcatcggtcatggaaggctttaatttgtcattgatggaagcgatcagtaatggcatggttggcgttacctacgatgttaattatgggccaaatgaactgatcgttgacggcgaaaatggtttcgttgtgccattcgaaggtatcaaagccatggcagcaaaattcgttgagttatttacccatcccgatgaattacagcaaatgtcaacacgttcgtatgaattgtcagatcgttattcagaagaaaatgtttggcaggcatggcaagcacttttggatgatgcgaagaagaaaaagttgccccacattgatgagattactgaggggattggcgatcagcgggtgaaaacgaaggggtaattcgttttttgcgcaagttggtttcaatcaccgtcaaatgaagatggtggtgagttgtttttcgtcgcaaaaatggcttctacaggcagtttgcctctagaagccatttttgatgatgatcgcgatcatgagtgggtaatcttcggcagtttaacgatcagttggaaacttaatcccgaccattgaccgtaagtggaacagtgtcgtgtgcacgtctcgcgcaagttgcaaccaactggcatattgtttttgttgttcaggatcgttgagattttcgaggacattaccgattgccagtgcttccccagttaggcgattggcgtaagtgatggtattgaggagattattttgcttgtcgacatcgtaatgattgatgagttttaattcagtgatgttgtcgatcacgattttttcatgaaggccgtaaatttctgacggcatgaatgaatcggtggtgatgccgatgtggagggtaacatcaaacttgggatattccagaaaaatggcgcctaaaccatcaaccccagtctgaattgcggtggcaaaataactccctttctttggtcggccaaatagtcgcaaggcggcatataacgggtaaaggccaacaatttgcagcgcgcccccagctgatgcaagcgtgaagccatccggttgttgaccggcaaggacttgatcataaccgggaagatcacgcatggcaacgaaggtagcaccttgaatggctggcatggtcgccagtgtggccgcaacattttcaaaattcggcatatgcagcggatagactgcttcaaagaaccgaacgtcagggtgatcggcaagtagctgttcaatagccgcaaactcagtaggattcgtgacggcaggcggctgcacaatcacatgtttatctgcctgaatggctcgcttaatttgctcaaaatgcctgattggcgacgaggcgatgaaaactgcctcaagaccgtcgctttgcaaaaaagtattcaggtcagaaaaagcggtggaagcggactgctggtccgcaaatgcttgtgcgtccttggcatcgtcagcataaaccgctgtgagttcccactttcgggaaatggtggctgcttcgatgaattcgtttgtgattttattggttccaattgtcccatatcgtatcacttaaattccctccaaagaattaatatttgtaggctaattataacgtgatggttggcaatgaaaaagaaatcagtatcgaaacgacctagctttttggtaggatttcgttggcaaaaagatttagctgataccgttacaagtagctttatatgatctgaagacattagaagtttccgacatcatcaatgatgattaatggcatgaaattaagaaggacataccgttaaaacattttcacagcgaaatttaaatgagtgtcatattcttttgattatttttatataaaatgagttatttaacggcaaaatatattgtcgagccaagatactcgcatcatggccgccattctgttatttttaaattattaatgaacagcattttcgatgaccggtttcaatcgatcatgaactcgcttagcgtgcgattagtgctgaaagtaaaatgtttgccgggcgagaacgtggccttttaaaatatccaaaattgaatctaaacaggcgccttgttggtcagagtttgccatttggtgctaatcataacactggcggagatggcgaccttttcagcggaatcatcatcttggcttgtgcgatgaaggaggaatctgccttgttttattttgtaacgaatcaatttgacgtgaatgatcctgttggggttgaacaattaaagcgcctcacgctgtttagcgataatcaacaggatgcaaaaattttggtgttagacgatcagcctgacttgtctcagcaaaaagacttggcgcaagtggctgcgaatcagattcagtccgttttcacagctatcgtgccacataccaatgcgacggttcgggtgccttatacaacaggtgatattcaaacttttacgcagtatcaggcgcgaccaaatggggaagagactgctttttttgacggtgagcagttggtcatgaaaattaggtatttcacggcaaccactggtgggcaggccgtgttgcatcaaattcggacgatctcatatttcagtgagcacggcgatcggttacgtactgaggaatacgacctcactggcaacaaaatcagtacacattattttcgcgctgatggtaacttacggttaaccgtctattttcaaattgatggatcgtctttgttgacgattgattatgaccagcaaggcacaattcataagatttcttacttagatcgcgctggtcagaccgcggaattcgctaactggatggcgtttgcaacatttgcgctaggccggaccgtgcaaaatacgccaggtgaggtcattgtcgatcatcctgcaacgagcctcgatgaactggtgaagcttactgccatcacccgtttaacgcctgttgtgcgcaatgagcatgatgcgcaggcggttaagcaggtgcttgaacagcccgatttacgctcaaaaattgtccaaattgtgattgatccaaaagccgattacgcgacactcttggctgatgtcggcattcaactcttgccaattgcagcaggggatgattcggtcgatcaaccggcaaccgcacctgaatgggatgaccgccaagcggagcagttggcattgatcattgacgatcaacatgctccgaattttgaacagcttattggcgcgctgtctttagtccgggtcaaagccgagcaagtgaaactcacttttttcttccagcgcccagattcaccgcttaaacagcagcttcagcaacaggtgaatcagttaggactgaatcagctcattcgcattcaagacgaagtaatccaagaaacctcggcacttgagcagtcagcagccttcatcgtgccagacatcgccaatctgaaggatgataacgtactaacggccttggcacacggcacaccgattatcaccttcacaggcgatccgcttggcggtgctgacaaaggcgaactgggtatcttaaaagccaatcaggacacattcgaactcgctggcctcattcaacgtttgatcacggacaaagattggtggacgcaaattagtcagaacgcacaaaaaaccgccaaacccctgcgccgtttaacggtttgggagttgtggcggatgaaattggtgacggcgggttagtgaaaagaagtgtgctcgttgagatttgttgctcaaaagacatagacatgaaggaagccataagttacatctttaagatgcaatttgtggcttctttagatggcagcacgttgactgtgacgaaacattcatatttcagacggagtgcttcccaaagatgatctattttgttatactagttcttgtgttttggagagttggcagagtggtaatgcaacggactcgaaatccgtcgaaccggctaataccggcgcgcaggttcaaatcctgtactctccttcataaacgttgatttgacagcgttctgcaacctttctgggttgcggtttttttgttaccttcaaacagttgtttgggtcgaaatcgtccttccagtaccagtacagtaccagctcgaaaaatcaggccgccgtttttggcggtaaacgtgtccgaaatttcatgtgatcagacctttcttttagaagaatttgtcgagggcataggcggtttcgcgttgcttatttgggaaaagatgcccgtaagtgtcaattgttgtcacgatgctggcatgtctcagtcgttccttgataatcgtatactccgtttctcggtcgatcagcagggcgacatgtgaatgccggaagtcgtgaatgcgaatctgcttcatcgtgggatcacgcttaccgatgcgtttgtagcgcatgcggatcgtatgcttattgcgtcgtatcagcgtcgcttggaacatcggcgcttctccgctccagtcgagggcaaagccgtgcttaaagagtttctgttgctgttcacgcgattgacgtattgctcgaacaattcgtcgaaggtgacagtttcttgattgaacagccggttgacgctagtgcgcatctccttttcaacttcgcgggcagttgccattgaatgaatgcctagtttcgtctttcggcggcgcttgccggtgacgggatcagtgccgaagaagacacatgacaacatgtgccgtttgatgcttgggtaatacacatctaataccccccaaatccttggacacatatttgttttttggttctatatatgctagaattcgattatggaaaagccaaaattcagaccttacaagcggccaaatggcaacatcgaattcttcgaatttcttgattcattgccttttaaagagcgcgcaaagttgcaactggcaattcaaatgactcaagacttaggcttacaagaagccgcacaacggctattggttaagaagcttgcgactaacttatacgagctgcgttcccggcaaggcaagacctatcagcgtggcttatattttcatgtgtcagggaacgattatgtgatcacgcatggcttttcaaagaagaccaacaagacgcctcagcgagagattgatcatgccattgaccttcgagccgaattctatcaaaactacaaggaggaagacgaccatgagtaaagatctgcacgaattcactgtggaacacactggtgatctcgacgcttattttgcggaaatgatgaaagattcctcgtaccgtgaagtctacaatgaagaaaagaacaaaatggcaagtgcaatggcgctacttgaggcacgcgaagaagctggcttatctcagcagaagttggctgacaagtccggcgttcccaagactacaatcgtgcgtatcgaaaatggaaataacacttccattgatactctcaccaaacttgccaatgcattgggtcgtccactcaacttgacgattggaccagcaagcatggcatagagccgagcctaattcgattacggaacaaccacaaatccagtattgtaaacttacaattgcggcgtccctttttgaaggacgcttaaggccggagattaggagaggtggtaaaaccatcttgagcactcgctggcttttttgttcaatcgaaaatgcatatggtctggatgcagactgttgacggaagactcaaagataattttcgatattcaaatatattggtctacaatacggtccctatttcaaaattgtcgagtgagcagagcaaatatttgtccggatgctgaacgcatcttgtttgctagagaagcaaatagcaaccaatcattacattagctgatttgcatgcccctctgcttattccacctaatctgagaaaagcccattttcgcaacgaacaatttgtggattctctaaacgggtcgtcctctccgaatggtgagcagagaatctttacacttgtaaagttatacaggaccttgtccacgtattaatcaagatataatactcgggggaactaaattgaaaattgaattgttgggccaagtttctgattctatcatacacatcattagtcgaaaaatcggaacggatgatttcaggtcatttatgatgaatcatagtctgccatactctggatcaaacgtcagtaggttttatcagttcttcaataaaacagctaatcgaagtacggatgaacgagctcagttacaggaagaactagaggagtttgttgcccattcattacaattcggacaaacgcgaattattgatgaggcaacgttcgacctaaaacctactccggactcaatcgaagaaataccagcttacagaagtaccaagaataagagtgaattctccttctcaaagctcttaaacttttcagttggtaaatactttagcctaatctatcgagttgtcgatgtagacaacgtcgagaaactttcaaaaataaccatgtgctttgcacgaaagtttactccgattgatactaatgacaaagcggagctcgtttggattatcattgatttcaaaaatagaacatggcagatgagacgtgacgcaagaactggtaatcgaatagacgataaattggcaagtacgtcgccacaactgtttaaatacttcagaaaaatacttgcaggtgactatgctatatctacagaagaatcctctgatcaacaaacactgtttaagatgtttgagcatttcacgagaatgaatgaggaagagttttctgatgtcatcaccaaatatgacaaacaaattcaatctctttgtcagggattccttaaagaacaatcgattgacccacatgtcaccacattaaaattagactcacgggtgcgaaatctgcttctgcgaatgttgataagctctaaatttgagcggtacgaagaaactcagcataacatggaagcctcggttcgttcatttgggttcaacgcatccgaagatacatctcttagtgctaaaagcggccctgtacgtggatatcgaagtgttgaacaaatttctgaatttagtattgaacatacagcggcgtacttcgataatagagaaacaatagaacagtcccagagattgttcttaataagtcttctttggatgaaaaatagtacgggattagacaacgatgtacttgtcaaatatatcgcatactcaggattcacagagacacatttccaattgtatgcgttaaaggaggaggaatataacgttgtatttccaaaacttgaagattatcgaatctgaaatcaaagagaacccaaccgactattctgcgtcttattttattgcactttgcaaactagaccaatggcttgtatacctgaatagacgtgagcgtctactcgttcgcccacttaccttttgcagcgaaaatagcgtaaattttaatgttgcaattaaactgttttgtctcgcgtccgggcaagggactttcaaaccggtattttatacgattggtgattttggagagattaggttgcttgctgacacgaagaagacccttatcaagcttattcaggatcctgttgataatgatctgtacggtgctgcaaaggaagatgatatttttttggggtaccagctcattgaaaccccaacggaggtacctaaggattttactgagcgcatcgaaagtgaggcgattactgtcgatctacagataaatggtgataccccccaaagccgacaagctcgtcatgcaatactgtgcgcctttatggagtcctaagagatatgcaaaagcgaattaataaagacagggtctttcagctactgaagacgtatactccaatcgttctcaccggtttatttcttttaggccaatatttgctggtcggcactttcttatggagggaatatctgcttaaattaaagtttgataatttgacaccaaaagttcaagtatcttttttttcctctatatcaccctatattggcccttcgatcacagtacttaccgcattgacaacaatttacattcagcaaattattatcaagcataaagatcgttctgagcgaacaagaatcaatcgattgattaaaattgaattcgccgaaaaccagaatcggttaagaacgttaaatcaagttaagagtatttctcccactgatcgtttcaagggcgcgcttagttgcataaacacacgggactggaacaatttacgctcgaaacttactcccaaggatttgttggctctcaatgaaattcgaatagcatactgttcgtttgacgatgcaaaaagttttagcgatgccatcgagggcgaagatgaagataataggattctctgggacaaacttaaacagaaatttggattgtgaaataattcgctattattaatagcgagtcaccaattatattcgcgtgccaattcagtaccacttcatccaaattcagccgatttcaaccgcaccaagaatgccattaaatcaccgatccgacgtcattcaaaccgtcagattacaactcgaaatccttcgaaccggataatactggcgcgcaggttcaaatcccgtactctccttccttaattgcaatgaagtaagcctggaacataattctcagccagacaaaagaaatgatttttcgattatgtgcggaaaagttgttccattttggtttctcgtggcatatttattgtaattttaaagaccatagtgccaaggcggagcaatcgtaggccagctggggctcagccgtcacagcggttcagccccagcggaccggagattgcggagtttggcacggcaagaaagttttagtctaacatcttcctgtgactattcggaatttaatgaatcacaagcccaactgtcaagggccctcgatcgcgttaattgatctcagttggtagggctattcttatatcttcaaaactgctttccgttgagtgtgcattcggactcgaaaccacagaacaaagatttttcaagcaaaaccaaaagcaatatttttaatagccaaccgttcccgaaacactattattttaattaagtcgttttcatcttccgtgcattgccacgtttaaccttgtataatacgattatcgctaaacaagggaaggtcgacacttgaaaatttccattaagaaagtaccggcactgtatgacctcttatatggtgcctttgccttggtaatgctagttgctgccatcatggcgacattgccaaacggcttctcattgacgggtgttggatcaacactgatgcagtgggccaatcatttgtggtggctgacgttgcctgggatcgtcttacatttgctgtcgtattttgcgagtcagaatcaacggctgcttttaataggcaatctggtaggcttgtgtgcatttattgccttcattctgattccgaactacagtgtctttgcagtcattggtttggctgttgccatgttcttaattttgtcaggcgccaaacgatctcgtcgtgtccataataattcggaggtgtcgtgatggcctggttaaagcataaaaaagaagaaccgcctgagattggcatcggcgatcatgattttagtcaattcgtgcaggatgctcgccgtgatccgcaacggtttaaggccgtacagtcagttttcagccgcctgaagcgcaagccgcgaaaagatgattcgcggcgacctaagcgacattaaatctggtttggggtggtaatacctattacaaaagtgttggttcagccttgatttgttaaagactgccaacactttttttggtcaataagccgtcaagggattcgatgagatgatatagaaattgtatttaagcaaccatcacattttcgcaaggtatcaataagagaagtgaacgatgtccctcgtggataagttgtccttcttacataccagtgacatacgcattaaataatattagtaataaaaataattattcagttagttcctttttgtttttaaaaatgtcatgatatgcaatgctgatggataaagcattagcattgcagaatggctttaacccgcatcaagcttacatttcttacacttttgtcacgcgttaagaaagccgtaaaagccgttgaaagtgttgaatctaggtcacgattttggcatactatttttatcgagaaggagtgaaacaaatatgaaaaaagcattcggcgttgtgttcttattggtcgtcattgtcttgggctttttcggctatcagtattggaacagcacctataatggcgttgaatcctatgcaaaggtgacacaaggaaccaagcatgcgtccaaaaataatgatggctccccttataaagttaatggtaaacagtattactattatgattatgagttcacttgggtgacaaaggatggtcaaaaacgcgaagttggatatgagtctggcgaatctgcaaatccaactgaactacagcctggctcttatgtgaaagcaactgtttccgagaaacgggttatcaaaggcccagaagtcgtgaataaaaatgcgatccctgcctcagtgctttctaagcttgagtaaacgggaactggcaaaaaagaacgaagcaggctcattatgagctgactgcttcgttctttttattttttactaagcttgctccttgagtttgagcgaaccatcctcgacaagctttgtcagaatgcgatagagaagttcctcagagaaatcgcgagattccgacagtaggtaactgtaggtatcggctacaccaggatcaggtacttttgctaaccacgtctgcagtcgtgcattgaccttgtcgtcggtatagagttcagagacgagtgcatctgtctgttggctgattaatgcgcgcaatgccaagttttctgccatgttcagcttcctttctaacttgataccattatacccggcaaagatttttaggcaaagctgtgctgcctctttgatttcgcgcgcagctaggctaagatgttaagcatgatgataccatggttagtaacccagccaacaattcaatctgcgcagcaattgctaggtatgcaactgagtctggctggctgcagtggtttgattgttgagactgaggcgtatttaggtgtagaggataaagccgcgcatgcgtttggcggtcgaaaaacaccgcgtaatcacagtctgtatttaccggcgggcaacgtttatgtttatcaaatgcgccagtactgcttattgaatattgtgacgcgaactgcggaggtgccggagtgtatcttgattcgggcgctggagccgcaagctggtatggcgaaaatgcagcaacgtcggcaccaagaaggcgttgggttgaccaatggcccgggcaagctttgtcaggcattggcaattgaccgtgcgcttgacggcagtcgattaaacgctggcggcttgcagctgacggcgacaacatttcagccgcgtcacatcacgataggaccgcgcattggcattccaaacaaagaaccttggacaagcgcgcccttgcgtttttccgtgcaggggaatccgtttgtatcaggcacagctcggcgagaccaggatttaaaaacgagaggatggcaatcatgagccaaatcaatatgttagatgcaattggtgacaaaatggatgcgctggatttcgatggtgatttaagtctaaactgggataaagatgcccatgtgattgaacttgaaatcacgatgacagtacaaagcgagtctggtatcgaggttgaagatcaatctggtgagaccgttgacaatgggccagttgaatatcaagatgccattttattttatgatgaaacccggctgcacggtgaagactatgcagatgattatttagctgttttcgggtttaatggtaagaagggcattgataaagccacagtggatgccttgtttatctatttgcaggatttcttagacgatagcgaaagtgacctcatggattttgtcgatggcacgtctgacgatgatactttcgtcttgaattttgacgatgcggcatttgaacggattctggcggaacagccggaggaggataaccgcgtctttttaccctatcccaagtactagtcagcctgccaatgaagaaagaatattggctgcaaggaccggtcggctgacttttcaagccggtatctggacagtagcagtttttgcatcaaagaacacgtttaaaggaggcaaccatgaatgattggacagcgttaacggtcacaaccaccactgaagccattgaggcggtcagcaatattttaatggaggcaggggcggttgggattcaaatcaaagacgccgctgatttcaaaaaagaaaccgttgatgctcacggtgcctggtttgacccgaaaacggtgccgcatttggcctccggagcacaagtgattgggtattttgatccagcaacatcacttgttgaacaacgcgatcatattgcaacgcgggtccgcgggcttgctcaattcggcctggatcccggtgctgcaaccgtcaccttggcagatgtcaggcaggcggattgggcaaatgtctggaaacagtattaccatcccttacgcgtttcgcgatttttgaccatcgtacccaagtgggagcattatacgccgcaacaagcaggcgaattgcagttgacacttgatcccggtatggcctttggcaccggcacacacccgacgacccagctgatgctttcgttattggagtctgtgatccgcggtggtgaaaccatgattgatgtcggcactggctcaggtattttagcgattgcggctgaacggcttggtgtcggtgacattttggcgaccgatgtggacgaaattgccgttagaaatgctgaggctaatatcaagctaaatccggttagccacattactgtcaccgcgaatgacttgttgaagggcattaccttgtcagccgatttgattgttgccaacattttggccgaagtgctggtgccgctgattccgcaagtgcgaccacgattaaaagctcatgggcacttcttgcttgctggcattattgccgacaaggcgacgttaattattcggactttagaagataatggcttttcaattgctcagcggcgcgaagccggtggttgggtcgcattagacgcagtgattaaagaaacagcgtgaggtggcacggttagcaatcaaagcaatgagcgttcttggccggaatggccgtgctttgacgattctgatcaaggttctaatgtgcagctttttgcgctagtgcttgcgattcgtttatgaggaggacatcagatgcagcggtattttaccgatcaaaaacttaaaaccggtgacgttgttcagttagatgcgaccattgccaaacatgcgatcaaagtgctgcgtcaggatattggtgatcggttcgaactcgttgaccccatgcaccacgcatatttggcaatcattcagcagtcgtcgccgctacaggtcgcgattgatgaagacataactaaaaaagttgaactgccactggctgtggaagttgtctgtggtgtcagcaaaggggacaaatcagaatggatcgttcaaaaagctactgagctgggtgccgacaaaatcggttttttcaatgcccagtggggaacggcgcggtggccggcggaacgggttgttaaaaaaattgcccgtttacaggaaattgctaaaaatgctgccgaacaaagtcatcgaaaccaggttccagatgtgacgatgtatgctaagctaaatcaggtagggcagactgccgaggcgaaattggtcgcttatgaggaaagtgccaaacaaggtgagcatggtgccttaatctcggcgctatcgcctcggcctgcttcgttgtgtgtggtttttggtccagaaggcggccttgcaccagaagaattatcagttttaacggggcagggatttattgctgcaggattagggccacgcattttacgtgcagaaactgcaccgctttacttgcttagtgccgtgtcggttttaacagaattacaagcaacatctatataagtgtcattaaaggagaacattttcatatgagtcgtattctcaattgggtcaaagtgccccgcaacagtgttattagttggagcattctgatcaccttgattttaccgtggctatttccgttatttcatatcagcacagcgattcgtgtcggtgttttgtttattctcatcgatatgttcagtgcttggtggattggtaagatgattcatcggcatcatttggcttggtggtggttattcgttctgccagttttatttgccgccatggtttttttgcgttatcaatggtatggctatttctttgtgccggtctatattttgctcagtctgctcgcaatggcaaaggactagcatttttacatagaatcgttataatttaagggtaatctaagaaaagtgaaccgtcacgcacactgctttttgaaaacggtgtgttgagataaaagcgcgcactgacgcgaaacagcaagcgtagcgaagcggcgataagcgtgttgcctaagattcttttggcaggtgcttatcgcccttctcataatatcagcgtgcgcgtgcctgtgaaggcgtggaattcaggagggaatagaatggccgaagaagttgaactcacccaaccggatgtcatgaagttgtgtaaagcttacatgaaccctgaacacttggcattcgtcgaaaaggcctacaagtttgccgcatatgttcataaggatcaggttcgcaaatctggcgagccgtacattatccatcccattcaggtggcagggattctcgctgaattaaaaatggatccagcaacagtcgcatctggctatttgcatgatgtcgtcgaagataccaatattactttgggcgatattgaagaagtgtttggtcatgatgttgccgtcattgtggatggcgtcaccaagttaagcaaagtgacctatgttgcccataaagatgagctggcagaaaaccatcgaaaaatgttgctggcaatggccaaggatctacgggtcattatggtgaagctggctgatcggctgcacaatatgcggacgctgcaacatttgcggcctgataagcaacgacgaattgccaacgaaacattggagatttacgcacccttggctgatcgtttagggatcagtaccatcaaatgggaactcgaagatctatcgttgcgatatctcaatccgcaacagtactatcgcattgcccacttgatgaatagtaagcggactgaacgtgaagcttatattcaggaagccatcgatgaaatcgaaaaggccttggctgatttacacatcaaatatgagatttacggtcggccaaagcacatctattcaatttacaaaaaaatgcgcgacaagcataagcagttcgatgaactctatgatttgttggccattcgggtgattaccgagacgatcaaagactgttatgcggttcttggcgccattcatactaagtggaagccgatgcctgggcgattcaaggattatattgcgatgcccaaggcaaacttgtatcaaagtattcataccacggtgattggaccgatgggtaagccgcttgaagttcagattcgcaccgaagaaatgcaccatgtggctgaatatggtgttgcggcacattgggcttataaagaaggccagaccagcaaggttgagtacgataagaccggtaagaaactcgacattttccgtgaaattctggagcttcaagatgaaaccagcgatgctgccgattttatggaaagtgtcaaaggcgatatcttcacggatcgggtttacgttttcacgcctaaaggtgacgtctatgagctgcctaaggggagtaatccgttagattttggctaccttgtgcacaccgaggttggtaatcacacggtcggtgctaaggtcaatggcaaaatcgtaccgctgaattatgttttgaaaaacggcgacattgtcgagatgttgacggctagtggcagtgcgccaagccgcgactggatcaagctggtcttcacttcacgggctcgcaataaaatcaagcgctattttaaacaggctgataaaagcgagaatgctgaaaaaggccgtgatatgctggaacgtgaacttttggacgaaggttacgtgccaaaagatttcttgaccaaggaaaatatgacaggcttgatgcagcgcctcaattttcaaacaattgacgaattgatgagttcaattggttacggcgaatataccccgaaagtcatcgccaatcgtttgacggagaaattccggcatgacaaggctgaaaaagaccggaaggctaaagaagccgaaatcctgtccaaaaatcaaaaggttacgacggtttcaagtgacaaacatcagcagccacaaacccattctgaagatggcgttgtcatcgaaggcgtggataacctgttggtgcatcttgcgaagtgttgcatgcctgtccctggtgacgcgatcgttggctatgtcacaaagggtcgcggggtcaccgtgcatcgcgccgattgcccgaatgtgcaaagttccggtgaaatggccggccggttgattgatgtccgctgggagaatgaagaagcccaaaagcagctttttgatactgacttggaaatctacggttataatcgcagcggtttactgagtgatgtgttgcaggttctaaatgcccagaccaaggcgttaaacaacattaacggccgggttgaccatgacaaaatggctgacattcacgtgacagtgggggtacgcaatcttgctcatttggataaattgatggatgcagtcaaaaatgtgccggatatttatgaagtaaagcgggccaatggctgattttagggctggttgacgataaaaatgctgtttgctcaagacaggtggtcagaaatctgctaccgtattgagtaagcagctttttttgatcatgctaagcaaataaaggggattgagttcatgcgcgcagtggtacaacgaagtcttgaagcaaaagtgacaattgaaggcaatacagtcggtacaattgaccacgggtttgtggttttactcggtgtcggaccaactgatacgcaagccgacagtgattatttggcggaaaaaattagcaagctacgggtgttcagtgatccagtcggcaaaatgaacttggctttagctgatgtaggtggccaagtgctatcgatttcgcagttcacgttgtatgctgacactcaccgcggcaatcggccgagtttcactggggctgctgatccggcattaggtgatcgtctgtatcaggccttcaatgccaaactcaaggctttaggtgtgcctgttgcaactggtgagttcggtggcgatatgcaggtgagcctgacaaatgacgggccagttacgattttatttgatacggaggcgaaatgatgctagtcaatgccatctgggattttgacgggaccttgtatgattcctacccggggatgatgaaagcgttaggtgctttggtgacagacaacggtggtcactttgatttagccgctttgtatcgaacaaccaaagagacttcaatcaaacaatttttgacgacatttggggcacagatcggccgcagtgtgaccgatttggaggctgattaccaccatcgggctgcggcttatttgcaggatatcaaaccttacccgactgccttagctgttttgcgagcgatcaagtcgcaaggcgggaataatcttttgttgacgcaccgcgaccacagtgcttggaaaatattggccaaggatcatgctgctgatttgtttttgggtggcgtggatgccgatttagatttgccacgcaagccggcaccagattcaattcagtatctgctcaaacgatttcagctaaatccggctgtcacagcgatgattggtgatcgctcattggatgttgacgctggcattaacgctggcgtcaaaacgatctactttaacgttgacggcttgaacgccgcaccgcaagctgattttcaggtggatcatctggaagagatcccgccattattccgcgtttaaaagttattattgactctaaaaaaggtcctgcattgaagttgtaaactcaatgtcaggacctttttttagttcatcactgatgattgcctgccttaaagtaggcgtttaggccatttacaatatcggtagcaatcttggactgatagctcggatctttgatttgacggaaatctttatcgttgttgatgtaacccatctcgttcagaatagcaggttgtttattatcacgcaggacttcgaaattaccaaaggcgacaccgcggttttccagcggaaggccgctgaaagcactgttgacggacttggccaaggcaaggtcttttttgctgtcgtagtaataggtggtgatcccagatgctgaattcttggatggactggagtcaaaatggaaagagatgaaagcatccgcgtgagcattgttggcagtatttggtcgaggtgctaaatcaacgaaagtatccgttgtacgggtcataatgacattggcaccagccgcgcgtaaagcgttagcaactaaattggccgtcttaagcgtgtatgttttttcatagtcggtgccatcattggcaatcgcaccagtgtcggagccgccgtgacctgggtcaaggacaatcgtagcctctgacaattttgtagcggctttttgcgtttgcccgtcatttggtgcgctgacggtccagctcgcaacgtagccagttttgccatctggtgccgtgaccgcataccaatcatcttgttgcttagagaccgtcagttcggtgcctttgtctagcttttcaaccgaaggcgcattgataccggcagcattgcgaaggttggtcatcgtattggttgttaccttcagcgccggcgcacttttctcggttgccaacgccgtttgcgcaggctgggctaaattggtggtttggccggttaactgaacgctgctgctggtgatccatgcagccgtcgtgttgtacgcaatctgagtccaagcgccttcttgatagacgaccttgacgctgtcgccggcatttagcgaacctagttgttttgcattttgactggcatattcacggacgttaaccggttgattaaccgttgccactttggcctgtgaagttgctgcttcactttgatccaccaaccaagaggcaacccagccgattttattaccagctagtcggacttgataccaggagtttttcgcaccgataatcgacagttcattaccggatttcacttgtcccataattgaatatgccaaaccaggacctaaccgcacgttgacggtatctgccttgacagtcatgtattgtgtgttggccattacactggttgtggcaacaccaacgccgaaaagtagcgccaccagaacgaccagcggccatttttttaattgtccaattttcttcatgagcccaccattttctgaagatagttaatcctattatagcaaatcgcattagaaaaagtggcgtaatcacgtttaagttgcgttaaggactagacaacaagacaattcggaataacccttaccagtcggatcgggcgcttatggcaaaagaaactgagtgattttttgccgaatcgcatcatgcttggccgggttgtattgatattgtggatcgtgccaatgatccggggtgtataaccaaacaggtttagcaagtcgctccgcggattccgttttgtatcgtggaaacacatgggcatgtaaaaaattatctgtattacctaaaatatcatagttcactcggaccgggtgacaagcggccaaaaccgcatcgcctaactgagccatgctttgtaagaataaagttcttgctggctcttcgagatgattgagatcggtaatattctgttttggaaggagcacacagtaaccgggtaaaaattgaacatcaccaaataccgcaaatccgccgggtagctcagccatgaccattggattggtaccgtcaatggctgcttggatacgattatcttgccacataaagacacttccttgttttagtagagtgggcgcgaaattagtaatagcgtactgctgcggagtcgaactggcaaagaattctaatctatacgtttcccagattattcagaatctaatgaatcacaagtccaataaggaattatgtctcattctttttcggtctaaagactgacgccaagtgcaacttatgattgatgttgccataagttattaattttaaacttgtttcaggaggtgcatgtctcatgtcattatttttgaaaaacgttggtcaacgctttggggataaacaagcgttgactgggataaccgcgacacttgaagccaatggggtcagtggtttgattggaccaaatggtgctggcaagtcgactttactgaaactcttagcaaccttggcaaaaccatccagtggcacgattttattggatgatgttgacattgtcaggcaaccgcaaaaaatgcgtcaagttttaggctatctgccacagcaggtgccttatgatgcacatgtgaccgcattggcctatttacgctatattgcggcgcttaagggcattgctcctcgcgaggcggaccggcaaattgtccaaacgttaggactgctgcatttgaatcccagcaattcaaccttgctcggtgattactcaggtgggatgcgtcagcgtgttgggctgactgctagtcttttaggtgatccgcaagtggtgattgttgatgaacccactgttggcctagacccagttgaacgaattgctgtccgcaatttattgagcagtctcgcgcaaacccgaattgtcatcatttcgacccatattattgaagatgttgaggccattgccagtcagttattattgcttaccgatggacaattgcattttcaaggcacaccagcacaatttctcgacaaagcttcggggcacgtttgggaatacacactgccgcgcaatgcgtccttgccgacaagtgagcgaattagtggtatgcaagaaagaagcgatggtattcatattcgcatgattgcagacgaggcgccggtggcgaatgcggtcatggtagcgcctaacttagaagatgcgactctcgatttctttgaaagtcaggcggtgaggaaaggatgatgcgactcattgcggttgattatcgggaacgcacccaacaattctcatttcgtattttggcggtgatagcactttttgctgctgtcattcttgcaccgcggccaaagggcaattttcgggtattagtattggatccacagtattttgcgcaagccaataatcccacttggttaccaatcggtgttgcttgcgtgttgtcattgttctttccacttgtgagccttgtgatcgcgcgccaaggtattcatgctgatcgggaaaatggtgtccttacatatttgttgacgacaaaattacgacggttccgttatttggcgagtcaatttctggttagctgctgcctattgttcaccattttagtcttggtgatgcttggcagcgggctaatgctgttgatccaatatcctggtcaagggttgagcttgagtcaatttttgtcacctttttttagtctggtgcctgggatcttcttgattagcggcttaggggttttgagtgagacatttccgggactgcgaggacaactcggtaccaccgtgttagtgatagcacttctgacgttatatgccatgatgactaccatgacttggtacagccaactttttaacttttcgggtattacgttcttgatggccatgatccgccagtccgccatttctgccggacatccgcttaacacggtgctgatgctgggcggcaatgatcatttgagtcggacgggcacacatcagctaatttttcagccgctggcgttaacacaaacagaatggttggcaatcggcgggacggtgttgatgagcatcgtgttggtgttactggctgccttttgtctggagcatcggccactacaccaaaaaacgaactcaggcaaatcaaaattaacggttgatttgccaaggccaaaagatgatcggtttcattcggcaaggacggccaattttcgctggcaacaattgcttggccaacaggcacatcgacttttccattctcagaacaagtggtggtggctagtggcgatcggtttatggcttcttgcttgggttgtgccagttggcagcttgcgcgggatgattttgccgattcagtatttgtgggccatgagtttcttcagtcaaattggttggcctgatgatttgaatggtttatcggcatgggaaggtaccgtgaaccatgcgactcgccgcgccatcaacagcactttatggttaagtgttaccttttcgttactacttttgctgccaaccttgctgcggcagggaatcgttgcgtggccgttacttggctgggccatcatgttaccggtggtgagtctcatgttgggtcagttgaccaaatccggccagtggagccaactgctggggactgtcattttgttcctagtcgtttgcggcctgactggaccactgccgctagcgacgagcctagttggtatggtgacaggtgccgtttatagtttgattgctgtgggctgctggattgtgatagaagtacgcgcaaggtaacggcagcaacattgcagaaaggctacagagaaaatttgatccttaattcgtatattgaacaatgaaacggaggggtttctcacacgaacagcgtttactttattgaaaattcaaaaaatattgtcaagttaaactaacgccaccgtcgagtcaaaatattgctccataaaatgaatgcgcgcggcaatttcagctgccgagaaagtttcgttttcagtggtggcgacccacttttcttcgttatcatccgctcggtgaacaacagcaatcaacttgccttcaaacgattgcaagggttcattaatcaggtcggagacaatgtagacatcttgcttttcgccgtcgccaccggtaaccgtaggcacatagccgtaattaatcggataaggcgcatgcgacttgtctgaaaaaccgatggggcgatcaactttaacaaaaactgatttacttgccattgatataacgctccttgcctatgcttgaacatgactaacatcttttttcctcagtattatacaatatccacaagcaacagatttgttgaaaatgaaccgtgaaaatcttgccaaacgcgttgacaaaactttcagcaaaccgtatgctttaagcaataactaagacctgtgacgaagtaggatagatcactttaagcgacccggagatggtgaaagccgggaacgatcgaaaagacacttctgaggtgaacaagttccggaacgccaccgttatggcaaagaaaaaaacaaggtggtaccgtgtccgcacccttcgagcaatcgaggggtgtatttttttagagcgcaaaaggacgcgcttagaaaccggagtgtaagtggccttgagcagtagtgacaaaagtgcaggtcactactgctcaaggtccttacacgcaggtttctgcgtccttttgcgcgtttcggaaccagcacacttccccaactaaatcacagtgcttaaaccacaggaggcaatccatgaattatcaacgcccaaaaggcacagccgacatattaccaggccaaagcgaacgctggcagcaagttgaagccgtagctcgcaaaatttttgcacaataccagtatcatgaaatccgcacacccatttttgaaaatgtggatgtattctcgcgtagcgcgggggacactagtgatattgttactaaggaaatgtatacctttaaagacaaaggtgaccggatgatggctttacgccctgaagggactgctggcgtcgttcgtgcctatgtagaaaacaaactgtatggtcctgaacatgctaagccttataaggtttactatttgggtccgatgtttcgatatgaacggcctcagagtggtcggcaacgccaatttcatcaaatcggggttgaggcatttggcagtgattcaccggtgttggatgccgagacgttggctttggcaaaacagttgctggaggccttaggcgccaagcatcttaaatttgtgatcaattcgttgggagatccagcaacccgcaaagccttccacgcagcgctggttgactatttaacacctttcaaagatcagctttctgaagactccaaggttcgtttggttaaaaacccgttgcggatccttgatagcaaagacaagcatgatcaggaaattgtggccaatgccccatctattttggattatttgacaccggaggcacagcaacattttgatcgggtgaaaaccttattgcagggattggggattccgtttgaagtggatgccacgatggtgcgcggcttggactattataatcacaccatttttgaagtcatgtccgatgataaggtgtttggtggcggctatacaacgattttagctggtggtcgatacaatggcttagtcgaagaactgggcggtccggagacacctgggatcggatttgccatgggtgttgagcgcctgatgttgctaatgcaaggcgaattgccaacggcgcagccagatgcgtacattgtgaccattgaccaaggtgccgatcaagaggccctgcaaatgctgaccgccattcgtcaacaaggcttcaccggcgagatggattatatgggacgcaaacctaaaggacagtttaaggctgccaacaaagcaaatgccaagcttgttttgacgattggtgaaagcgaacgcgctgcaggcactgttcaaatcaaaaatatggccacaggcgatcagcaagcattcccccaagctgatgtgctggccgactttggcaaaatctatacgcaagtaatggaggcaaaataaaatgagtaaacgaacctgttatgccggtgatgtgaccgccgagtatgttgatcaagaagtgacactaaaaggctgggtacaaaaacgtcgcagtctgggtagtttgattttcattgacttgcgtgaccgtgaaggcattgtgcaattagtcttctctgaagaatttgacaaggatgctttagctgtggcgaattcggtacgctctgagtacgtcatcgaagtgcaaggtgtggtaaaaaagcgtaagccgcaagctgtcaataaagatatgaaaaccggggacgtggaagttgaagttcataccatcacaattttgaacaaagctaaaacgccaccattttatattgaggacggggtggccgtcactgaggaaaccaagttaaaataccgataccttgatttacgccggccggaaatgcagaagaatatttttacgcgcgcacatatcatgcgcagcgtgcatcattttttggacgacaacgggttcattgacgttgaaacaccgacattgaccgccagcacgccagaaggtgcccgggactatttggtgccgtcacgtgtttatcctggcagcttctacgcactaccccagtcaccgcaattgttcaaacagctgctgatgggtgctgggttcgatcggtattatcaaattgcgcgttgcttccgtgatgaagacttgcgtggtgatcgtcaaccagaatttacccagattgaccttgaaaccagttttctaactgctgaagagattcaggacatcacagaaggcttgattgccaaagtgatgcatgatgtgaaaggcattgatgtcaagttgccatttgaccgaattacttggcaagatgcgatggataaatacggttctgataagccggatctgcgctttgacatgcagattcaggatgtgtctgaactcgtcaaagattctgatttcaaagtctttgccggcgctgttcaaaatggcggccaagtgcgggctattgttttaccaggcggcgctgacaagtattctcggaaaatgattgatgcccagcaagactacatcaagcgttttggtgccaaaggtttggcttggctcaaagtcacgtcagacagtatcagcggtccgattgccaaattctttggcgatggtgctgacctcgtgaaagctgttggcgctaacgccggtgatctggtgttgtttgttgctgacaaggccaaggtggtcgcagatgcattaggctatttacggacccattttggccacgatctcggtttgattgacgaacaagcatttcgcttttgctgggtcgttgactggccgctgtttgaatatgatgaaggcatccagcgttgggtaccagcgcaccatccgttcacaatgccaaatgaagaagacgttcatttgcttgacactgatccgcatgccgcacatgctcaaagttacgacatcgtgctcaacggttacgaattaggtggcggttccattcgtattcataaccgcgagattcaggaaaaaatgctcaaggcgctcgggttcaccccagaacgagcccaaaagagttttggcttcttgctaaatgccttagactacgggttcccgccgcatggtggtctagctattggactcgatcggtttgtcatgctgctaacaggccgcgataacattcgcgatgtgattgctttcccgaagaacagcaaggctagtgaaccgatgaccagtgcgccatatcccgttgctgatgcacaattaaaagatctcggtatcgaagttcgggccgatgttgatcctgaaaaggaacatgaaggcgacgaaaacctcactgagtaaacgttaatttaaaaaatgccagccacaattaagttgctgacaattaaaacacctcccgctataatgaagacagcgggaggtgttttaattgtcagatcagtttgaaaaggaaagcaaaaaggacttgaaaaagcgcttgtcaccagaggcttatgcggtgacacaggaagcagcgacagagcggccgtttactggcgagtacgacgacttttatcaagatggcatctatgtcgacattgttagtggtgaaccgttattctcatcgcaggacaagtacgatgccggctgcggctggccgtcattcaccaagccaatcagcaaactggctgagcaccgcgaccaaagttttggcatggaacgtgttgaagtgcgcagcccatctgccgagtcgcatttaggccacgtcttcacagacggtccagctgcaaaaggcgggttgcgctattgcatcaactcagctgcgttgcggtttattccagtggccgacttagaaaaagaaggttacggggattatcggcaactctttaagtctgttcattaaaatgttttaaaaagaccatggtagcaatacaggaccgcccttgttatacttgatgcgcgacttattacgggtgacagggagcggtttttgtatggaagagattgataagctgattagacgacaccaaaattggtcacggctatcagcggcttttttctatagtatttgtgtggcagtggcgctgaatatgttctgggaaccaggtggggtttttgccagcggggtcactggactagcgcagttattggcaacaatcgtgcgaaagtggtttaatttttcgattgcattgcctttcgtatcgttatcaacaacagatcttttttcaaccgggacgctgcttttcttcctgaacgtaccgttgtttgtgttagcatggaaagccattggccatcggttcacttttttcacgttcttggcggtcattttttcgaccattatgattcgggtgctcggtgtgctgacaccgcttactaaagacccgattgtctgcgggatcttcggagcggtcgttaacggtctcggaacggggttcgccttgcggaataatatttcaaccggtgggattgatatcctcggcattgttttgcgaaaacgcacaggccgaacggttgggacaatcaatattatgttcaatattttgattatcttcttcgccggatttgtcaatgactggccgcatgcgctgtattctgctttggcgatctttatcaatggccgggtcatggattcgctttatacgcggcagcaacgacttcaagttatgattgtcacggcccggccgcgacaggtcgtgaatgagattcagaattcaatgcggcgtggcatcacaattgttcacgatgcagaaggtgcctttcatcacgaggaaaagacgattctgttcaccatcatttcgcgggcagaaatgtatgatttagaacaagccatgcgccacagtgatccttatgcattcgtctcgatcacggattcggtcaagattctgggtcatttttatgagccgaaaacggattaagaccatcagatttagcccggagcgattccgggctttttcattggcaagccgtgcctgtcggaatcgttcaacgtatccgacatcggcaggtcaccttgtcaaaatcaaaaacgatcaattaattaggagggaaacatgttaataggagctaacgtcagtatgaaagggtcagaaatgttgcttggtgccgttgaagaagccgccagttatacggctaacacgcttcaattctatacgggggcaccgcaaaacacgcggcgtaaaccaactagcgaaatgatgattcctgaagggctagcagcgatgacgaaagacggcattagtcataccgtgattcatgccccgtatatcgtcaatctcggcaataccaagaaaccggaaaactttacatttgcggtgcagttcatgcgagaagaagtcgctcgagcagatgctcttcatgcctataccatgccttttcatcccggtgcgcatgtcggtgctggtccggaagcagcgattaaacaaattattaaaggactcaatgagatcattgatcctaatcaaaaagtgaccattgctttggaaacaatggctggcaaaggcacggagatcgggcgctcttttgatgaattagctgccattattgatggtgtgacacataacgaaaagcttcgggtaacctttgatacctgtcataccaatgatgctggctatgatatcaaaaacgactttgacggtgttctcaacgagtttgatcacatcattggccttgatcgactcagtgtgattcatgtgaatgactcgaaaaatccccaaggcagtcataaagatcggcatgccaacattggctttggcacgatcgggtttgacgccttaaacaagatcgctcatcaccctgccttggccgaattacccaagatactcgaaaccccgtatgttggtcctgacaaaaaacatcaggtaccgccatacggggcagagatcaaatggctaaaaacaggggactttcagcccgatgagttacgccacttgatggtttaatgggtttcagtattatcaaattcatcaagacccatgtgttccaaaataagcgttgctgtttcttcaatcgatcggtgggcggtgttgatcaccatgcagccgatttttttgtacagatcttccgcaaacttgagttcttgattgacttgatcgcgtgctgaataagcggtgtcgggattcaagccataggcaatcattcgctggcgccggaattccatcaaaacagaggcgtctgtggttaaaccaacaatcttcttcgggtcaactgaccagatctcttcaggaatatgggcgttaggtaccagcggcaagttggccactttaaggttgcgattagcgagaaacaacgacaatggtgttttactcgttcgcgaaacgccaagcaaaacgatatctgcctcgagaaagcctttcgggtctttgccgtcatcatacagcaccgcgaattccatagctgagatgcggtcaaaatagcgttcattaagatcatgaacagcgccgggaacgtgatttggttcctcatgcgtaattgacttaatcccgcttaaaattggcgacatcacatcaatggcaatcacgccttgatctttggcataatgcgttgcaagttgagcaaagcctgatgtcacgaaggtcatgattgccaaggcattttccttcttggcctcatcaagcgcgctgtaaatcttttcttccgtatgaataaatgggaaccgcacataatgtgcctcaaagttgggaaactgtgccgcgacagcttgcgccaaccgcaagccagtttcgccaaccgagtccgacataatatataaatttaattcttgcgtcatactgccacctcattacttagataacgctatcatagcatatttaccaactaaacaggagcggttagccgacgaccaatggtgacaagcgtgtctagaccagtcagctatttaaggtcgaccatttgctgatgttagggattttacgccaaaaacaactaaaaagcttaacagaacagggcaagtttattcaaaaatgtgaaatcgcttattgacgcgtggttgctagttttgtatactaataaacgaactattggctatgatatccgtcagtggttacacaagtgtcggagggagggatatcacatggctaagacagttgttaagaaaaacgaatctctcgatgacgctcttcggcgcttcaagcgtactgtatccaagtcgggtacactcgctgaataccgcaagcgtgagttctacgagaagcctagcgtacgccgcaagctgaagtcagaagctgcacgtaagcgtaagaagttttaattaaaggacttggtgaatagtggctttaatggatgagcttaacgctcagatgaaacaaagcatgttagccaaggacaaagtgacgttgagcgtcgtccggatgttgaagacggctttggtcaatgagaagattaaactcggccacgacctttctgaagaggaagaaaagagcgttcttgcgactgaacttaaacagcgcaaggaaagcgtttctgaatttacaaaaggcggtcgtgatgatctcgttcaacaaaccgaagctgaaatcaaggtcgtcgaacgttttttaccagcccagttaaacaaagcccaagtcggtgacatcgttgatgcaactatcaaggaagttggcgccaagggtaagcaagacttcggcaaggtgatgaaaacgttgatgccaaaagtcaaaggccaagcagatggcagtcttgtcagcagcgtggtcaaagaaaaacttagttaacgacaaagccggtgcaatagccggcttttttatatgggttttgtgggtgaatggcgtgcgtggtgatcagataagggtgctgattttgctgacgaatgggtttgcgctgaatatcgtctaagtttggtcaggcgattgcttcacgctttgcttggaaacgcgcgagcaggcgcagaaacctgcacataaggaccttgagactaaatgaccaaagaccggtcatttagtctcaagcccacttatgctccggtttctaaccgcgcctgctcgcgctcttaaaatatgctaaactgagagcatcattgcttaataaatttgttagggggccaatatttggcacaagaaacctcggagaaaattttccgtcttagtaatcctgacatggcgattaaccttgtcgggatcaatgacgctaatttgacattgattgaagaaggattgaatgtgcagatctcgccttttggggatgagttgcggattcatggtgatactgaagcggtcagcttgacattacagttacttgaggcggctagtaagttattagctcaaggcattaaattgtcgccgcaggacatcgctagcgccgttgcgatggccaagcgtgggacgcttgagtattttgctgatatgtacagtgaaaccttgttgcgcgatgccaaaggtcagccaattcgggtcaaaaactttgggcagcgccagtacgttgatgccattaagcataacgatatcacgtttggcattgggccagcaggcactgggaagacattcttggccgttgtcatggctgtcgccgcgatgaaggcaggccaagttgagcggatcattttgactagaccggcagttgaagccggtgagagtctgggtttcttgccaggcgacctcaaggaaaaagttgatccctatttgcgtccggtatatgacgccctttacgctgttttggggaaagaacacacggatcggctgatggatcgcggtgtgattgaaatcgccccgttagcttatatgcgtgggcgaacgttggataatgcgtttgccatccttgatgaggcacaaaataccacccaagcacaaatgaaaatgttcctgacccgcttagggtttggctcaaagatgatcgtcaatggggacatcactcaaattgatttgccgaacaacgccaaaagcggactgcttcaggccgagcaattactcaaaggtattagtcacattgcctttacccaattttcggcacaggacgttgtgcggcatccggttgttgcaaagattattgaggcttatggtcgacacgacctgcagttgcagaagaagacgaaggagtaagggatggacttagaattattcgatgacgatcaactgctggatgacaagcaccatgatctcatcaaaaaactagtcgctttttgcggcaaacagcttaagttgcctgaaaacacagaaatgtcgatcaccttggttggggatgatgagattgagcgcatcaatcgcgagtatcgtgaaaccgaccgggtcacggatgttatcagttttgcgattgaagagggcgaagacgatttgccgctgctacctggcatggcaaagaacatcggtgatcttttcattgatccactgaccgttcgccgccatgccgaggaatatgggcacagctttgagcgcgagctgggttacaccgtcgtccatggcttcttgcatcttaatggctacgaccacattaagccagaagatgaagctgtcatgatcccgcttcaaaagaaaatcctcgcagcttatggccttaccagataagcaagttggcaagaataaacatttcatccaaagtgcccgtcacgcgctcgatgggctgaaggtgttttttgtcgacgaaaataattttaagcgcgaatttctgagtgcaactctggtcattgttgccggcgttgtcttacaagtttccgctttttcatggttcgtgttagttctggcgatcttgttggtatttcttggcgagttgttgaacacgatcgttgaaaatgttgttgattttattgttggcgatcaatatgacgcgcgcgcgaagaagattaaggacatgagtgccggcgcggtgctcatcgtgtcgctgattgccgtcgtcgccggtatttatgtctttgggccgccacttttggccctttttaggagttggtaagttgtcagttttgcgtacagctgctttagcggctcgagaaaatgcctatgttccgtattctcattttgctgtcggcgcggccgtccgtgtcggtgatcgcattttttcaggggcaaatgtcgaaaatgctagttacggtcttagtaactgtgctgaacgcagtgctatttttgcggcagtcagcgcgggctattcgaagctggatgaattgctggtgattgcagataccaagggaccagtggctccttgtggcgcttgccgccaagtcattagcgaattctttggccctaatgctgtcatcacgcttgccaacgttgccggacagtcagttcaaacgacgccacaggctttactgccaggtgcgttttcgaaaggagatcttaacgcttgagtgaacatcattctggttttgttgcgattatcggtcggcccaatgtcggcaagtcaacgtttatgaaccgtattttaggtgaaaaaatcgccattatgtcgccaaaggctcagacgacccgtaacaaaattaacggtatctacacgactccggacgcgcagatcgtatttgtcgacacaccaggtattcataagccgaaaaatgagctggatacctatatggataaagcggcattgtcaactttgaatcaagttgatgccatcttgttcatggtcgaagcggacgaggaaaaaggccctggtgatggctatatcatgcgccaactggcggaagtgaaaaagccggtttatttgatcattaataaaattgatctagtaaaacctgacgatttgttgccgttgattgaaagctaccagcatgactatgcgtttgcccaagtttttccgattagtgcaacgatgggaaacaatgtcgacgagctattgacggcattgaccgatgcattgccagtcggtccgcaatactaccccgaagatcagctcaccgatcatcctgagtattttgttgtcggcgaacttatccgcgaaaaaattctcgaattaactcgcgatgaagtgccgcacgctgttgccgttcaagttgagcgcatgaaagatcgggaaggcggtaaattgcagatcgaggcgtatattatcgttgaacgcgatagtcaaaaaggcatcattattggccgcggtgggcagatgcttaagcagatcggcattcgcgcccgacgtgacatcgaaaacctgttgggcgacaaggtgaacctgaagttatgggttcgcgtccagaaaaattggcgtgataataatgcttatctgaagtcgttagggtacaacacgaaggatcttcgataatggttaggcagactgaaacatttgagggactggttatgtcccgccagaactatcgcgaatctgatatgcttgtcaaaattttgaccgatcgattcggcaaaaaaatgtttcttttgaaccgggcccgtaagcccggttttactttaggtgctggtattttgccgttcactcacgctgattatattggtgaagttcgtgaatccggtctatcttatttgtctgccatcaaaaatgcgactcaatatcggcaaatttctgatgacatcaccttgaatgcttatgcagcctatatttttggattaatcgatcttgcttttccagatgggcggccagtcggattctggtttaaccaaatcaaacaagccttgtatctcattgattctggcctcgatccacagattatcgccaacgtgattgaagtccagatgcttaaagaatatggcgttgagcctaactggcgcggttgtgtgattgacggtcgcgccgatttgccgcttgatttttccgaaagttatggcggtttgctgtgccaaaatcactgggataaagatccgcatcgacttcatgctagtccgcgggcgattttttacctgcgacgttttagcacgcttgatctcaacaaagtggagcgcatcaacgtcaaacttgataccaaagcagaattacgacgaattttggatgttatctatactgatatggtcggtgtgaccccgaaagccaaacgttttttggatcagatgcatcaatggcaggatcgcctgcctgatgactcggaatgatggttgatatcagtggcataattatttact

SEQ ID NO: 45 - DNA, 7615 bp, Lactobacillus paracasei
cattgaatacgtcataaagatcataacgacgcggtcttgtatgcttgcggaagttttctaaatcaggttgtattaacgcaaattgcgctcgagaaatattgcttggataatctggcatgacaaactcctcagtcggttttccacaattctaccagattcagcagatactagacaggttctaagcaaatgtcgttctatgggtttaaaacccacatgctagtaaccactgatggctacattctgaattatgtggtgactgccgcttcggtccatgatacaaaagttgccgttagcttgattgatgattgtccttgtccaattgttttggccgatgtcggttatgtaggcaagcgacttggcgctgaatttaagcaattaggctacacgttatggacaccataccgttcgaatatgaagggggccaaggaatataataagcgcgcgctcaaggcgttacgtcgcacaattgaatcgcgtttttctaccttagttagtgattttggaattgaaactaacttaacgcggagtgcctttggctttcaactaaaaattgaactggcaattttagtctataatttaggattttttaattttgtgacgaactagcaccacgcgtaccctctatcttattatttactggaaaattcatttccgtttggtcggaataaaattacgaataaactgaaatcgtttatgttcatgatcgatatataaatagccaaaaatactgaaaaataacgcaccaataaaattaacgaatagatctttcatagtatcgatcacgccaacatcgagatagccgttatggatcacagtagtcacttttttgccatcagcggtttcactttcaatcgtcgttcgttgaatatctttcagctggaccactttattgttatgttggcctagatccacgctattgatttggcgcacaatgcgatccttttgcatatccatattcaaccaacgatccgctgaaaattcgacaaattcccaagcaaccccgaccgtcattgaaaaacaaaacgtggtcaccgcaataaatagcggtgttaatttcagaatcgttatattttcattcaacaaataaatcagcgaaaaaccgactccagcagccaaaaacccatttagtgcgtgtaacgctgtgtcccagactggaatatgaccataaaagtcatttagttcacctaacactgttgagctaaaaataaaactgattacgatcaattctagcaaactaggtatattaatatgcagataagtttcaattaaatatggtagcataaacaaatttaatgtcagcactaataaagcgacgtgtgaccattcttgcatataaatgctattgcctaacataaaaatgacaattaaccgataaaatatataaatcagcgtcacgattttacttgcggtagtggtgtgtgccgtaaagaatttcataaaacgcccccaatcatcgttgaatccgtataatttcctaatttaagcttatgatattggtgatgctagttcaagtcgggtgcaaaataaaaaaatcacaccaatttaaatagtgtgcccagaaaatctttttctatgaaataacttagtctgaatcgtcgtcactacgacgtaatcataattcgaccgagctaccttttcactgacaagcttatcaaactacacttttgactgagccattggaattcaacaattagggcagcaacaattcggtgccctaaatatagttttctgaatgttttaaccatcaaaactcatgtaggcattattatcacacctgataatccgcatctaggttgcgtacttttaatggcaaatatagcacccattgaacacatatgtgtacatttatctttacattttgattacaagtgcatgtccccatcttcatgccggtttcgagtttgatgttgccgctgctttttcgtcattgcccactcggtctcttttaagccacgtagttgctgctttcttagatagtccgtgttcttcgcatataaaatggttattaaggcttcgtccaaaatattagtcaggtagtttttcgggctagttgggtaataattaatggcctgatagtccttaatttggtcttgcttatattgatcaaaccgtgttgtctgttgtttcaaacgggcttgcaccatttcaatttgtttgtgatccaacttaggatcttggccacattcgccgataaacagctgccgggtgccatcatgttttaagacccgttgcagtcgatgatgctgaatatcttttaattccattttacctaacaggtaatttaaaccggcttggtgttgctgactagtaaaaactaccggtggctgctgttgtaattgactaagatcatcggcgcttaatggctttaattctgggtcatagtaaaccacagcggtatagatttgctccttgtcaatcgtctctagcttatcgaggtcactgtccggaaaagcagtcgttagaatgctgtcgtattgggtttgcaccacggctttaacttcccgcatgacccgtaaatctttgaccgctttagaaatgaattcgagttcgttaggttcataaacggctagcatgccccgatcagtatgcttcaaatcgtctaactggtgaccatgtttggctagcaccgtggttaattgcttctcaattgtttgggcttgctgattagctaactgccaactggtatatggccgcttggtaaacgtcaataattgctgggttaataagtcgtttcgaatatccgctaaccgttctgccaattcgctacctttgaaaatcgtttgttcactattagtttctttaatcagttcccggcgttcagccgcggttgtctgttcaaaatcaagttccggataaagctttttcgttgctcgttccaccactttatttaacaactgattagcttgtgctagtgatgtcgtttgctggtcaatggtcagcagttgtttggttacatcttcaccaaccgcgtgtttaattaataagctgtttttccaattaaacagcatgcgctgtttatcatctaaatgctctaaatcgacataggttttcagttgctgacttagatgactaattgtgtgtttttcagaaaatgatagctcgtcagttaacgcgtcaaagtgttcatgatttctaatcttttcgtcaagattatgatatttagcttgagcgtttctttgcgctctaacttgttgattaaatgcttttcgattttttctttggctgttaatgccttcgtgttgggtaggtgtctcttgaatccattgatcgacaaacgatttttcactaatccgatccggaatatttttttgtgctaagaactgattaacactcaacgcccaattttttcgccactcattaattttttcctttttatcccaatcaaccaaccaaatttttctttgttttggaaacccgcttttggttaaaagttgcttgccattttcatctttaatgtactgcgtctttgcttttaatccccaactaccatcggggttaaatgggcgattggttaacatcacatgtgcatgcggattgtctgggtgatcgcgatgaattgctacgtcagctaccataccttgatcgacaaaattttcttgcacatattttgtcagtaattctttctgttaggattcacttaattctaccggtaaagccacgttaaattcttttgcataccgcgagtttgatttacgatctttcttttcaacttcattccataactactcccgatcactcgcccattttggtgcattttttggtgttaaaataaagctttctggcataaccgaacgcgcataaaaatagcttcgtccttctttttgatcgaataacttttcaccacttcgataagcagatgggaagtcaacactttttcggacagtttgctaagcgactttttgtgaagcttggtcatacaaggaaagccatgctactggtgcaagatagtctaagcgtgcttgtacccttacgcggttgtaaaaggtctcgatgtaagcgaagacttgcgctctcagatcattgatatctttaaattgtatctgataaatgagctctttcttcatgatggcaaagaagctttcgctccaagcgttatcacccggttttcccaatgctgagaagctacgttgccaatgatattggttgaccaactttgtcactgctttggccgtgtattggctaccacggtcactatgaaaaatacacgtttctggcaaagcccacctttggtgggcttgtttaagtgtcgctaagactaaatccatgtccatatgattggatatttgatgagctaacactaggttgctggtcaaatcccttatttggcaaatgtaagcttttccttctgatgttgtcgtctgtgtaatgtcacttgataaggcttcaaacggcttaaaagattggtgtttcactagattgggataatcaccttgacgagcaaggcggctatcggtcaaactcttcggatgacgacaacgtagcgttgaatacagaccggcatcagccatcagacgggcaactcggtgataggaagctttattaccatttttacgcaataaaccgcagatgcgtttgggcccgtaagtgccctgtccttgatcaaaaaagtgtttgattcgttgacgatattgcctttctttggcgtttcgctttggcaaagctctccgccaagcataataaccactcgttgatacgtctaacaaacgcgcccaccttaccacagaaacagaggtttccctcaacataaaagcatacttatcgctgggggttacttctggagactggcaaagtaggcggcggctttttttaacatatcacgctccaatgctaattcggcattttcacgttttaaggcacggttctcagcttctaaagaagcaaacggcgtttgctttccatcttcggtatatagcttccgccaacgatacagggcactttcaggaacaccaagttcggaggcaatgattttaactggtttggaagagttaaaactcaaacgtaccgcatttttcttaaaatcttggtcgtagcgattgcgtgaataggtcattttgaggactcctttcggataaatcaattctcttatgtttctgtccgaaattctagtacagacccgatccagcaatggcactacgtcctttaccagcactaatattttgaaaactcatgtgaaaaattgccatgttagtcaccgtcttcctttgattctatgagtttgactttgttgtcgacaacggcgacttctaatacaggttttaatggggttaacacaacatagaatttattctatgtgtaagtgcgcatcgacctcgtttcactcggtcttctgattctattaactttaacttagtctatgccttccgcttcgctatttcaaattttatactttgacttaacgtttcttatatgatacagtttcggtgattatttctaatatgattggagggatcgttatgtctcaaagtaacttagaaaaacaagaagctaaattaaaatcccttaatcaaaaaattaaggacgaaaaaaataagattgaacaacggctaggtaaacaaatcatcagtcaagccaatttagattatgctaatttgtctaacgatcagattaagcttttagccaagcaattttctgaatttttaaaggtaaagtccgtagatcattagccctacgagatggggaaattccatgtctaatcaatatgaaaaactaatcgagcagcaagcgcgtttaaaacaaaaaattgagcgggaagattttaaattacggcaatctaaatactatgaaaatcggcaagcccgcaaagcccgttctcgccgattaattcaaaaaggggctttattagaaaagtactttcaagctaataacctctcggtcgaacaaaccgaagaacttttaaaaacatttgctgactatgttaacgcccataaaccggatagattaaaaaacgatcaacctaataactaggccgatcgtttttattttcaggattgttttttggcttaatttctggattgtgtttagcaaagtcttttaactgtttttgaattctttttgtaagctctgctttactttctttgtgcttccttttacttgatcgctgttgaattatcttttgacccttacctcttctttttgattttaggtcaagcgtaaaatctgaaattttattttgatctagcttacttaaatgaccgatttctttaaagtttaaaccggctttgggaaagcgataaatattaccaagatcgacccaggaaggtttcttcaacccagcggattgccaatcttgaatcggataatattgttgcttgatataagtcgacttcttttcatactgactagtaattttaaaagcctcgaccgtctgttctgatacccgacgaattaaaactggccgagacttgccaccgttagtttctacaaaactaacgtataggctgactaagtcattagtcctcatctggatcgttgagccaatcagcgacctctttagcgtctttgaactcggtgactggtgtcccttcggtcgcctttaaaaagcgtaaattagctctttcttcttcgcttaaagacgcattaaaaggtaaagcaccattagcaacaatccgcttgtaaaacatgttaatggccgtggttggatttaagcccaattcgcttaaaacagcttcggtatcatcggccaaatctttatcaatcttgacttggacccgtttcttttccttaactgccatgattgtctcatctcctttcttttgttactaccattatactaccttttgagtaccttatcaatagataaagccttggcctcaaatcacttgagcttggcgttgatctaaaggctgaacttttgagctagttagcctggttagctctggcactcatttaaaagcccctattcttctgtttaagccatttaaatctaacttaagtaaaataggttagtaagtcttaaaaccgcttagaaaggattttgtagccttttaggactagcagtacaacccactgttatcgttgtcggccgacttttcttcttcagggtgtttagccgcatattctctagccgcttgtttattccaccaaatcccaaataggttttgcatggtgccgtataagaacctgtctagtatcttttaagaactatcttcaggaaggccaatacaaccatttgaagactgctgttaaggacacgttcacagtttttccaaagtcgccgaaatttgtctagccaactccatgaacgttcaacgatccatcgttgcggtaacaccgtgaacatatgcaactcgttgcgtttagctaccgtcgtcttagtattcaaaatgagcttcacctgatccgcaaagtcattgccagtgtagccaccatcaaccatgacatgctgaaccagctctaaattttggctagccaaactaagcatagccaatgcacctgaacgatctgatacattagctcgtgtcacgagaatggcttgtggtaaaccgttaatatcaaccgccatatgacgcttaatccctgaaatctttttgccgccatcgtagccactatttttcgttaaatcagtggttttaacactttgagcatcaacaatcacaaacgacgttcgggccgatcg

SEQ ID NO: 46 - DNA, 16670 bp, Lactobacillus paracasei
tgctaagaacgcacagggaaaaataaagaatctcaagttaaaaacagatgagcacgatataggcccgtttaaatcagggcaaatcattaaaattactgttaataaaacatatggaatcgttgattaccaaagagtgactaaaaaagagacaccactaagagcacaatagggtgtaccctattgtaactaaagtgagaagggagtattattagttacatataagtgacccggaggcgacctggaattggctaaaatcggttatgcgcgtgttagtacgcgtgatcaaaatcttgcacgtcaaattgaacagctacatgatgccggtgttaataaaatctttcaagagaagctttcaggtaaaaatgccgatcgtcctcaactaaaagcaatgttagactatattcgtgatgatgatgaagtagtggtattgagccttgatcgacttggtcgcaattctcatgatttgactgacatcatcgaaaccattcggcatcgtggagctcaattgaatgttctaaacctgcctagctttgcaagtattgaagatcctaaccttcgtaacttgattacgacaattattgtcgaactatataagtatattgctcaagaagagcgcgaaactattaagatacggcaacaacaaggcatagaaattgccaaacgccagggcaaatataaaggcaaaattcgcgaatatggtcctcattcacctaatcgtcaaaaacgctatatttataaagaagcctgtcgccttttaaataggaagaaagacggagatgaaactctgaccaagcgacaaatcgcccgcatgttaggtattgcaccagtaaccttatatcgcatcgaaaagtatcaggcagaagatctagcaaatgttccccctagtgagaggtaaacatcatgatagatttaaggggcaaacgaattctctttacaggccgtttgcgatcttttcgtcgtttccaggcacaacagttagcaactattctaggagcaaaacctgtcaaccggattgacaaaaatgtcgatatccttgtggttggtattattagcaaaccctatgatcaactacttaccactcaaaagttaacgtatgctagaacctatggcattccaaagattgacgaattagcctttatttcatggtgccaatggcgattagatcaattgaaagcaactctttaagtaccttcttatcaaacggggggattagtatgcaaaagcgtatcgatttggccaatcaaacgtttggacgactcacagtcattagtttttttggaagcagttctaatggaaacgcgctttggctctgtcaatgtcaatgtggaaataaatgtattgttgacagtcaacgacttcaaaaaggattcactcgcagttgtgggtgtttgcgatcagaaataagcagatcaaacataaaagctaataaccagactaaaaaattcatgggcaatcccaagaattttcaactaatcaatcgaacaaatttagttgcttctacacttaaacggtccaataataaatctggtgttatcggagttagttgggataaaactgctcaaaagtgggtcgcaaggctgtactttcaaggccatcttgtcctaaatcgtgtatatgttcatatggaggatgccatcgctgctcgcaaggcagcagagaaaaggtatattgtacctttgcagaagaaatataatcaaacacaccaaaaaaatcaattaaattgattagacaatctaatctggagcaaatgccatcacctgcactttctatagacttatagaaaagccgattcattataaaatggttcaattccgtaatcatgcaactgccctaaatactaagatcagtttgcaagaaaagaagccgtagcgtgtatttgtggcatcaagacttaattcgacaaactcccaagacaacaattattgggacagcgtcgtgaaatggaaaaacgaggttatcatccagatcagaaacagtgtgatcctcggtatcaaggccaacattgcctagcatacaagcaactaagaacgtgttttaaatcttgaccataaaagtgcccatattcgtgatcagcgtgtcgagtcttcgctcaattcgcgtgagtaaaatcacggcaatgataacgccgactgcctgatccaaaacatacgttaataattctttatccatttaaaaatccctccaattcgagttgccgatacttcacctgtattcgtttgcgtacttttaaaaaccgctgccgactaatctgtaactgtctcgctatgccagtatcagctaaaccagctaatcgcagttgcaaaaccctccgttctactggcgtcaaaatggcttctagttgccgcaactgcagcttcacctccactgactgctccaagctggtaggtgctgtcgccacggtggtcgtctgcaacactgccgcattggccggtgcttcttccagcgcccgccgatggcggactttttgcatccgttgcatcaacgtgaggaaaacgaaccgccacgccaacttgttaaacttggtaatcgcggccgcatccgttaacggatcgcgataccggtcaaagtagttgagatacaccaaaatcccctcgtcccgccaatcctgaaaataactatgatgcggacgaatactcaacttcgctaataccccgtaaaccacggcttggtgctcaagaaacaacaaaaatcctttctgtgctactgccatccttatccaatccggctcctcatgtctttcgatatcgaaaggcgtagtgtaacgaacggcgtgagggcttgtctgatcgcaatgaagtggcttaaaagctgatttaacaaaggttggcgttgctggttggggattgttacttgaaaaagagtattgtgccagcgtcttggcaggacttattgcgcagaaattttttgttcaattatttgtggcaacagtcgtgctcgaatttcagacaagaaaaagcgcgtccaggaagtttccccagacacgcctgttctcgtaacatttgcagccagctcggcttattttgacattgttgcatgattctctaatctgcaaaaattcggtgactgcacacccatctgttttaagatcgttctatgacaccaacgccagcgtcaggccgattgcagccttaatcaacacgatgcttaacgtagaagatcagtgaactaatgaacacaacaatgccaatgacgccagtaccgagcgcaatctcctcaccagttttcggtaatgactttttcttcttctgatcggttgagctagcttctgttgattgactcgcctgtgatgggtgtgactcatctgaggactgagtgctttccgattcattttggctgcttgatgatttactttcacttgattgactcgcctgtgatgggtgtgactcatctgaggactgactgctttccgattcattctggctgcttgatgatttactttcacttgattggctaccatcaccagaatcagtcgcatcgccattctcggttttcgtcagaacccaatcatccgtacttccccatgacttggcattacttttgatattgagccccaatttaacctgcgtctccttcgccaatttaaaggttaacttaggctcaacccacttcttccatcctgtcaacgctgggaccttgctcgattggttttggccgtcaatatcggcatagatttccaaatcgcttgtactgtctgtgtcaccgccctgaatgcttggactgaattcgtaagttcctgcctccagtatgattgtctggctgacgcttgctgaaaagttatcatcgctgtaaaagttcaaggcgtttttccctgtcttaggggtgtcttgtgttaacttgatcggtccactcagctgataagcacttaaatccgtatcctcgaagctgggatttttaagaagactctcgaccgctggctcatcgctaggcagcattggatccgggagttgttcgttagcacccgtgtaaaccgccttaaaagtatgcaacgattgtaacgcccgacctttggcatcaaacaacgcttggttatcccactgtgagccgccataggtcgttgccgagaccgttggatcatacccaataacggccgatgatgcccaacccgaaccatatttttcccagataggtaagttggctgtccgattggcactgccaaccgttgtccaagccggttcccaataaaagacgcctaaagctttaggaccaacattggcaacggcattaatgacatcacgcaaagcatgtgcctggccttgtggtgtggcagggtaccctgctggcttgatatcgtctgttgtcttaatgacattcgtctcaccatcagtatcatctaaggtataagggtaggatgtttctgccaccataacctttttatcataggtgttagcaattgtttttagtacgtaggttaagttgtccagtgatccatgccaatatgggtaatagctggtcgcaaaaacgtcataatctattttattgtcagccattcctttggcataccaaagcattgtgtcagttttgtcgggattggtaaagtgcaacgcaatcagaatgttcttatcaaagtcgcgcactgcctgagtgcctttggcaaacagcttatactcatcttgtccggtgacaccgcaaatgcccgaagctgtcgtttcgttcccaacttgtaccataccgacatcaacgccagcatcgcgcagtttctttaaactactgctggtaaagtcgtagattgcctgggctttttgatccacactatatccctgccaagacttaggtggtatctgccgacctggatcagcccaaaagtcggaataatgaaaatcgatcaaaaccttcatgccaagcttcgttgcgcgttgaccgatcttgatggcattattgagatcggcgttacctgcaccataaccttgacctttagcattgtaagggtcattccaaactcgtacgcgaacataattaaccccattgttgtttaaaattgtaagaaggtctttttgctggccatcaaaatccgaatatttaacaccgctattttcttcactaatcaatgtggaagtgtctgcccccataatgaaattcggtgacagattattgaccttatcaattcgaatagttggtttttccgagtctgttgcagcttccaccgattgctggccgccaaatcctgctaaacaagccagcacggctatgcctaacgttgtaacgactattttctttaacacatgtttcatctgctgattcctccgttaatgtgagcgctatcaacattatgtaaataaaatacggtgtcgccaccgtattttatttaaacgtttccccgtctggaacttcggctacgatttactcggcagttcgactaaagtcaatcaccaccgagcgtcaccatcattaccttcgctttgattccaatgccttcaaacgtttaaaaacgttaacaaagtacttggtttcgtcaatgagtaacatcgttgtcatcagcgtgtcctggccgtgaaccatgataaaggtaacgtccatgtcagcaccgccagcttcttcggccagaatctttgtttgtgaattgtgggcgtcgtcaatggacttttgcgcgtccttaagttgcttatcggcctcttcgaagtcaccttcttgcgctgctgtcaatgccttcatgacagctgtttttgcatcaccggcataagccacaatttcaaaaccagacatcgaaatttcttcttttgttgccatcactatctccttcttgtcaatgtgaggttatgcgatcgaccgcatcggtactgggaatttcatgattcttcgtcaattgttcaaaccaataggcgctcttcttgggataacgttcctgtgtcttaaagtcgacaaagaataaaccataacgcttactatagccattcgtccaggaaaacatatcctgtaaagaccacaagaagtaaccacatacgttggcaccgtccgccatcgcttcttggattgctttcagatgcaaagcaacataatcaattcgttgctgatcatcaataacgctgccatcagcaggcaatgtttctttcaagccaacgccgttttccgtaatgtacatctttggcactaacggatagttattcttgatgcgcattagctgatcatagatgcccttaggatagatcggccaatcccaatcggttgtcggaattcctggtcgaacctgttcctcgccgataccacgtaaccgcgtaatagatgagcccttcttacctgtaccattatgcaccgtttcagaaggtccgtcatacgctttaacgaacttgctaaagtaatagttaacgccaacaaaatctaactgttttgctgcttgcgccaacgtttcttcatcctgatcggtgattgtgatgtgttcctgctggtttgcgtccaaaatctcattcattagcgacaaaacttcatctgagtaatgtccagctaatgtgccatccaagaacaggtagttgtccaatgtatcttgctttttggctgcatgaatatcagcggcgttgccttcttcaaagggatacaccgtttgtagtgcatgaataatgccaatctcgccgggcaagttcattgctttataagcattgactgctcgtgcatgggcaagattctcattatgctcagattggaacgttttatggaagttatacttttcaccgggtggaaacgtgcctgtggtccattgctgaacggccatagaggttggctcattaatggtgatccaatagtgaatttcaggaaattcctgaaaacagaatttcgcgtaatcaacgaacttatcgatgttatcagggttcagccagtcacctgattcattaattgataatggtgaatcaaagtggtgcagggtgacaaacggttcaatcccgtccttcttacactctgcaaataatcgatgatagaacgcaacaccgcgtggctctgttttccctgaaccggttgggaaaattcgcgaccaggcaattgatacccgaatagcgtttaaaccaaattgcttcgaaagttgtagatctttcggatattcatggtaaaaatcacaagccggatccgggctgaatgttccttttttttctagaaatggatcccaaagaatcgggccgcggccatcttcatgggttgccccttcagcctgataggctgcagtggcgccaccgaagtaaaagttttctggaaatttcacgtaatttatctcctctttttctgaatgtgatggttattttgcgtgttcttcaacaaatttgagtgccttatcgccgtcttgagtgagttgaatgtactcgcgcccggtcgttgttaccatggttacgccatacttatcggtaatctttttcaaattgcctttttgactgtccatctgtggtgccaagatgacgagatccatatcttcgatgagatccatgtcttgtccatatgcgcgtgctgttgcttgaagtggtagtttacgttcctttgccaatttattgagtgcattggcaagaatgccgctagtaccgccaccggcacatagtacaagaacattcgtcggcttatttaaatgttctgtctttggttcttcaaccgcgacttccggatcgccagcctttgcagcggctgctccggcaactgcaacacctggttctacagttggtgcaatagcagcaggctgagcatccgaggcagctgcggcagattcctcttcaacaagttgactgtcgtaaaccttcaagaacggcagatacatggcaatatcaacaatcaacattaagccaaccagcacaaacgatagaggtgcaaaccctgtcgccacaggaatcccgattggtccaggaagtgtccaaggcatcgtgtacatgattgaattcatgcctagcgctgtaacaaagaacttgtacatccagatgttgaaaatcggggtcaaaataaatggaatgaagaatatcggattcatgataatcggtgtaccgaatagcacaggttcgttaacagaaaatgttccagggatgaatgccgctttcccggttgcttttaattgttttgaccgagcaaagatcagcatcagatacgctaaaacaaaagttgatccagtaccaccaaagttcataacaaaatccattgtgttataagccagaacatggctagcgtgttcgcctgcttgatagagttgcaagttggccgccgtgttggcaatcatgatcggggtaacagctggtgaaacaatggatggtccctgtacaccgcaaaaccagaagaatgccatcgcgcccgcaatcaaagcgagtccaagatacgaatcactggctttaaacagtggcgacaaaacctgaataatgaacttaggtaaattagtgccggtgaatgtcttaaaggcaatggttactgcccagaaaaccgtaactgaagctgccattggaataacatctttgaatgtctgtgaaatattgccaggaacttgtggtggcaacttgattgtgatgttgttcttgatgcacacatagtagatattaggaataatcagaccaaccagatacgcagcaatcagtccttgggtacccatgtaagtcatgtcagatccgatttttagcggtaatgcagcaagaatgaagaaagaaatcattgacgccatgattaccgaaatcggattaatttggttggtcttcggaagcttgatattttttgtatcagtcaagttcttagctgttgttccagcaacaaacagagcgagaagccccattgagtagttgtatgccaacatcaaattattctcgacacctttaggccaaacgaagccccatgcattagggacatacgcaatcatgagaaagacactggaaaacaaaatgattggcattgcggcgatgaaaccgtcacggatcgccgaaacgtaagcgtttgcagcaattttctcaaaaacaggccgcaacttttcgatgcgttttgtgaagctatccatcacaataaacccctcgatccttcttagtttttatatcttgtaatgagcgcgctttcattaactggtatcatcatagcctgtgaatctgtctgtgtcaacaaaaaatttactaaacattttttataatgcttatatggattagtgtaaaggattttgtttatattaataaagtaaaggattaagcgtttaccaaataaattaaattattagaagccctctgcattttaacgagatgtctacacgtgtctcgtccggtgttcaaggaaaattgacttcactttgacttagaaccttgttttattcgggtaatcaccagacaacggatttattaatggcgactgaggaatacaagcgcaaaaaaagccgttgaaagatcttccccttcacggcattactggtgatgcattcttagttcgaactaattactactttcgcgataagcaaccgatgttcctaccgttaaacaaacggcgggaacagtctcgtttgtcactaacatgcgcttcaacatattgatcccctgctgtgtcatcaaatcgctgtaaactcgaatcgaacttaacgacggcacggtagccgcagctgtgactgaatcattaaagctaacgattgatacacgatcaggaacttggatatgatgttcatgaagatagcgcaatacgccaaccgctaatgtatcgctagcgatgaatagcgctgaaggaaattcgtcctgaagcttatcgaagcccttcgtcgccatctggtaccccttctccggcgttattctaccttgaaaaacattttggggccgatacaactgcttcgactttaaaaaccgccgaaaagcgcctaaacgtgggtcataaatcttttcctgatcatcattggttcgtccattcccaatcataatgccaatattggtatgtccatgggcaataaagttcgctaaaacactttcaattgagaattcgttatctgttacgaccgaagaaatcccatctctcaacgtattttccccaataatgacaagcttagggttaagttctttcaaaacagcccgctgtttgtgactaaaatggccaatagcgataacaccagcacacgtttcaagttctgtccaagactgcccataatacaatgtcactttgttgaaattctctgcctctagtgcgtcctccaccatcactcgcaaagaaagataatacgcatttttgacttcctgagcttgggtataccaagtaacaacgccaatcttgcccttaggctccttgcgagtttttttctgataatgaacatcttctgcagctcggaaaatgcggcgccttgtctcttctgtaacagctaaagtatcgtcataattcagtacccgtgaaaccgttgacaccgacacttttgctcgtttggcaatttcttttaaactggccattggtaccctcctcagtcgtattaatgcattttatattaaagctatcgctgtgaataagcaactttgaccggatttctgaaggcacatgtagctttggtttaattaaaaactgagcttccatttttgagctagaaaaaggttgcccgggagttgcaccaaacagatagcactccaattgtctgcttccgacaacgcatgctataatatacatagcaaaagagcgttgcatctatcgacaccacgctccctgcaagccgcttcaaaggcggtggcgtttacaacatcaacttgattaagccgacctgtaaccgaccaaagttacacagggcggccttttttgttacttctttttgtcgttgagaatggttgcgactaataagccgaacgcaatcatcagcgacagtgcctgaaagacactcataggctgtgaaccctttctgaagattcttccatgttcccatagacgtcacctcatcgggaaaagacagccaccgcccttaaaacttcctgcttaaacaacataccatagcttacttatcatcactggtattttgcacggtatctttctgactcaatctaagaatttctggtaatagaacagtctctagctcaatataaagttgattggctaccataccttcgaacacatcaggaacaacatctatctcagtttctaattgtttgcttaggtgtcgtgcaatgcttggtgattggttatcgatggcggtcttaatttgttgctgtaaatcattcaatatcatcaaagtacgctcctttcattgaacacgtgactatagtcatttttaaacttatctaaggcaacgaggctggttgatttttttagttgaacacacgaagcgttgattgcatcgctgctacctttttaacaagatcagcttgtacaataaaacgcttgggcgtatcaggtgttgctgaatcacaggtaactaaggttaacaacttcttacctggaacatcatcaatcacggaaacttgatgctcatcaattgtctgtttgtttgtgacctggtacgtataaacttgctgattatcagtcaaataaacataggaagctgtctgaattcgtttaagcggtgaaaataagttgcctgcatcggtcatataatggcctgctaaagcataattaccctttcccaggacttgatttggtttcatcgtgccagctcctcgagccaaattattgttatcaagaccgtaaaaaacgggtaaacgcatactaacagaagggattgctaaccgagcaatggcgttagaatcattagtcatagccttagcgaccgtagtaacatccaatgatttaactttcttaaaatcaaaattccccgtactttttgggggatcttttaacgaagcatgataagcgctgttgctaatgtgttgaacagtcagatttttaagttgttcattgaaaatcatcgccaaactcacgattaacaacataatcaacaacgtccatcgcagccaacggtatttgtttttccgattttgcataatagatatcccttctaagttttagttcataaaattggttcaatagacagattttattagcctaggcattctactgctatgacgcttctgataatcgctgaatcaacatgggttcatctatatctaaataagtttttcgacttgtgtgtaaggtgtcaccagtgcgtacctgtgtattgatccagcgagtacagtccgcgtgatgttcaccacgaaagtagactttaccagaagtaaagccaataaccgcgaattttggttgtacgcaagcagcagacaatttttttagggcagaattcgaaatacgttcctcagagtttagcaaacgtcgcacagtacgatcatttattttagcttgtctggcaaattctgggttgctcagattattcttattgatgtagttctgaaccattttacgaacagaatcacgatccattaaatcagactccttctattgtaataaaccattgttccagttaattgtaaccccgtacttgcgtattgatggatgatgcatgagacatatatgccaaaaagactgtagagcttagtcccatcaagataatcaaagacaaaacccagcgtgttcttaattttatatggaagtcctttctaatacatagtggtggccttgctgagcaaataacgctcagtaaggcttaatttgcgtaggggcggcgggccctaggccgacccgcacgccccggcaacgtcttgtcgtttcaggataggtaactggcaagttcagtctgtacctaaaccccattggttgccggttgccagctatcgtgcagatcatgcatgacttgtgcataaagcttgtggcgtaccgccacgcgggcaagcccgcaggtgccttttctacgccctgtcaagtttaaatcccgctatgtcaatgaatttgattttgaatatcgaaacttcttagccacaggatgctgaatccaatcttaaattctgatctaaaatatccttaaatcatatagtctgacaccccaaataaacctgcatgctttccaaaatttgtgcagatatgtacagtaagtgtatcgagtcagtttatcttgaacaagcgagttcgtatgagtataactgattcgtgtttacaaggtagtgaatcgtttttagtaggcgatccatgcaggcgacaagcagcggcttcctccgggaagctgttgcttgtcgttttgcataaaagtcacggatatgacttggctgtgctcctgagccaatcatatttataactgtccaatacagtagctttctagtgtgagcattgccatgcttggtgatcttcctttgtgccgtatagttccctgattgtatctcttgcaaatcaagaccaataaagctattgagtttcgctctggttttaaaccgccgaatatcccccagctctgcaaccaaacgtacagcggtgttttccgcgatgtttggaatgctcaggaggataacgtactccggtgttctttctgccaagctgaccatggcttgtacggtttcttcacgttcgctaagcaactttaacgccttttgagtctcatgctttacagcttggacaacgaacgagttgccgctaacagctggatatgacctggctcgagatctccatagtgcacgtgctaaattgctggatctgaccgctcccaccccctttaagtgcatatccagaatctgcgtctttatattctcaaaacttaatccagtcagttctgccgggtgagaaaaaagagttagcgtgtgtaaggctgatggctttctcaaatcaagttcttcctcaatccctggaaatgagagctgtatgagtcgatgtatccgattcttggtccgttttaagtcctccgtttgctgatcgtagtatcgactaatatccatcaattcgcgatatacagggtcatagaagcttggtttgaacggcttggggtgtttggcaaactcagttattgctagcccgcgggcatcacgtacatcgttcttccttgttcttgagccatcgtctaaccttttcttagcgacgagtggattaagaatatgatacgtaatgctttcatccagtaggtatcgctctaatcgacgtgagtacaccccagtcgcctcgaacaccacttccgcaccgccatatgagtcaatgatagccttaagactcgtgaatccaatcatatctagcgtgatatccccctcgtaaacagttttagcatcaatggctactgacagtttagccgttgattttgagacatctataccgataatttttcgcattgttacactacctttctgaagcaccatcactaaaaatcttagtaatcaagttttcaaaacgcggtctctcggaccaatctactttgagcgaatttgctaagacaaatgaagtagccactttctactacggcttcaaagagccaaaaggcaacccgcggcttctgcttcaataccactataaagtaatagaggcgtacatggaccccgtcgggtatcatgtacgcctttaagcttagtggatttctactgccggtttttgccttgctttgattccgcattcaaccagcaacaaagctgctaaggaacaagttcctaagcagctctagcagaaaaaacaaggaccgggcaaaattttgttccgcaaagaacactccacaaatttttgccactttcgctacgctcacccttgcgttttctgccgtagctggtgtgcctgttacatcaaaggcggcttcaaaaaccgccggtagaaagggtgacaaccatgccagagttaccattttacctgccaatgattgaagacgatgaggagagtgtttttgacagttggccaaatggacaaagaacacacgataaattgagtgaggggttacgtccttacattcaagaaattgctgttaaaagtcaaacgaccagtcaaattgagagagaccgttacggcaaccaacgcctagccttttatgccaacgggtgcgatacaccttattacgttaccgaagacttcctacttacgcctaatcaaactcacgatgaaaagaagctgttagtgacagcactgatgctaggcgatagcaagctgacggcggttgtatctgaccagttactagctcaactttcaccgaagacccgcgtatttgcaaaatatcagctcatcaacctaccagcacaacagtttatggacgaacacatcagcattcaggttatcaaataggaggctaccatgattgatattagaaatacctacaaacctaatgttctggaagcttggataaaggaaacgagagaagccggcaactacgtgagtgctgaacttgtccagttgcacgacgacccacaactaggtaatgctcttgtgctaggctttcgctttgctaaaacaccacgagcacttgctgatgaagacatagcgtttagcttcagtcacgaaacaaccggcccagtcttctggcggttggtcggtgtggcggaagcgtacgctaatgattttaatgaagaactagcttttgcataaaggagcgtaagcaatgaaaaaaggaaaactgtatcaggtcagcattgacgaaatcgaatatcaaccgcactttattatggtttacgccagtgaagacgctaaggacaaagacctacagcggctcgcaacaaactttattttgagtcaaaatccagaattgccagaaagtgcattagtcgatagcgtcattgttgaaccacgtgacccgaacgagaaaccagacgttgtggccgagggactgcatgtcccaacgcctgcgtggggtgtcaaaatgggcttactgtacgcgcaagctgttcaccatgctacctacgatgacgatgagtttgatggggtggcttacgttcggggcgaaacaaaggcgaaacgatttgaaaccgaggccgccgcaaaagcgtttgctcaatggctcaacccgaattgtgaagttgttccactggaagaaggtgacgaccatgattgaccaacaacaagcacaagtcgcatggagtgaagtcattgaggaactggacagcgacacctttaaccgcctgcgtcacgcgttagaactcgttgatgcctatattcggcaaggaacagaaatcgaaagaggtctttaaccgtgaaaactgcctacgacgaagttgtgaaacagccatgtgacaaactcggccagaccatgcaggacatgacttattgttacaacgagactgtggtacctaagaaacaatacaagaaacttctgacgaagcaacttgaagaggtcgtggctgacagcgtggctgtgaatatggtcaatgcctactacaaaacacttgctgaattcaacaaaggtaatcgagagggttcgtacttgctatgttgtgcattgaattaggagttaagcctgacaaagccagtgcgcaggaattaagcgccctgcagatgattgctagcaacattactggtaaccaagcatcgctactcaatccagacatcaagaatgcctttgaaggtgctataaaggcttaaaaagtgcaagcacaatctagtcagattgtgctttttctgttataatgagaatacaaacagggagcacccccacaagagtgctcccctagcagagccgtttaagacggcgacaactattggattaaataaccgtcaacctgccaaagttgagacggttatttttctaccattagtcaagtaaaacgttgattgcataggatttcatatacaggctaagcttgtatatgaggtcttttttcagttgatttgtggaaagcaatgctttgaaggtaaactaaataaacctcttgaaacgttaattttccaagatgctatactgtcttcataggctgtatgag

SEQ ID NO: 47 - DNA, 30300 bp, Lactobacillus paracasei
gcgttatgctttaacattagatgaaacgccgggctatcaaaagattttataatattatttaataatctaaagatggcctattctcacagaacataaccgcactgatcccccacatcaactcaccaattcttgctctataactattgtaaacgctcgcaatgaggaactgccaaaaatcagcttaattaattaaaaaatacacaataaaaaaacaatgccaatttattcagcattgttatttactttccgcggttgctggcacaaaggcccataagctgccacgtgtgaactgttcgccatccgaggtatccaattcactgatactattattcggcggaatgcgcatcgcatcacgcgcagaatcgagatcggcaccgaggtatgtgcttaataacagcatgccgattaaaccgtgcgccacaacgagcactttgccgtctggatgggcatcataaatccgattgattgcccgccgtccacgttttaacgcatgggcaaatgattctgcaccgatacgctggttatcaaacgccgtcaagttatgataataatgattgatctcaggatcatcttgcactgaggcgagcggctgaccatcccatttgcctaaatctacctcgcgcaaatcacgatccgtcacaatcggcggttgaacgactcggctttgggccacaattaattcagccgttgtttgcgcccgcggcatcggactggcatagatgcccgcaaaaccagtcgtcgccaaaaagcgtccaactgcgatcgcaccatcgcggccactcgctgtcaacggcgtatcggttcgtccaccgttaaatcgccgcgccaaattcgtttccgtctgtccatgccgcacaaagtaaaacttggtcatctcctgcacgctccttataaacacgttcatcaggccagcaaccggtctgacgaacgttctgtctttgaccatagtgtagcagaagcgcaccaaattagcggcaataatcagaaaagttcagcccgacttaaccaaaactgtaacgattatgcctattacgtcagcattttgacgacatcaacgacaagaatgtgcttactcgtctagaaatgtgtgggtaagacatttgtacgcaaaaagccgaacatgcaagtttcacatgttcggcattcttacgcgatcattgaagcacagcgctcagtaggcgtttactgggcagctttaaccccttgatgatccgcttcggcttcagctttataagccgcaacttcgtcatcagcggcaaaaatgtaatgttcaggataaacttcaaccattttacgtttcttgttgtcgccttcgaccttgctggcgtcatacggcagcggcacacgtctacgctcaacatctggatcaggtaccggaatcgctgagagtaaactcttggtgtaagggtgcaacggatgactataaacttcatccgccgttgccaattcaaccaaccgtccataatgcataacagcgatacggtctgagatatacttgaccatcgataaatcatgcgcaatgaacaggtacgtcaacccttggcgatcctgaatgtccttcagcaggttgacgacctgcgcctgaatggaaacgtccagcgcgctgatcggttcatcggcgataatgaacttaggctgtacggccaatgcacgggcaatcccgatccgctggcgctgaccaccggagaactcatggggatagcgagttgcgtgatcggcgtttaaaccgacttcttccaacaactgctcaacttgatgatcgcgatcagcgttgtttttggccaaatgatgaatatcaatgccttccgcgatgatgtctttgactttcatccgcggatttaaggacgcataaggatcctgaaaaatcatctgcgtggcccggcggaaagccagcatctgtttggagccatttttcagtttggcaatgtccttgccattgtacaaaatctcgccgctggttgggtcgtacaagcgaatgatcgcccgaccagtagtggttttaccagaaccagattcaccaaccaagcccaatgtttcgccctcataaatatcaaacgagatatcctgaatggctttcacttggtcttttttcccggcattgaaggtttgaaccaagtgcttgacggacacaagaacctttttgtcttttttgtcgaccacgttagttcaccaccttttcatcttgatgtttacttgcccataaggcatgtcgccgcgcaatttctggcggtaattccactttcggtgcgcctggtgctaatagccacgttgccgccgaatgggtcggtgagatcttgaagaatggcggttcctgctcgaggtcaatcgccatcgcgtatggattccgcggtgcgaaggcgtcaccttttggcggatcaagcaagtccggtggtgtcccaggaatggcgtacagtcgatcactcttggtttcaagtgtcggcatggcttcaagcaacccccacgtatacggatgctgggcattgtaaaagatttcatcaaccgtaccatactcaacaatcttgccagcatacataaccgcaacacgatcggcaatcccagcaactacgccaaggtcatgggtgatgaaaatgattgaggtgtcgatcttcgactgaatctctttcaacagatgaataatttgtgcctgaatcgtcacgtccaaagcagttgttggttcatcagccagcagaatctgcgggtgattgatgattgcaatggcaatgacaatccgctgacgctgcccaccagagaactgatgtggatagtcctttaagcgaccgccagcatccttgatgccaaccaaatccaacacgcgttccgcttccttgagcgcatctgctttactgattttactatgcaacagtaacggctctgccacttgtttcccaatggtcatagttggatccagtgaggtcatcgggtcttggaaaatcatggcgacatcattgccacgcattgcattgagctgtttctcggactttttgagaatgtcctcgccgttaaacagcacttcgccatgcgtaattttcgcatttggggctaacaaacccatcaccgttcgcacggtaacggatttaccagaaccagactcaccaacaatggccagtgtctcacctttgttaaggtcaaaattgacattgcggatggcgtggacagggccggcataggtggcaaagtcaatctgtaaatcttttacttctagaattttactcattttgccacctcctaatgttcactgcgcggatcaaaggcatcgcgcaaaccatcagccagcaagttgaaggccagcatcagaatgacaatcacgatcgccggatataacagctgatacggcagcacttgcagattcttttgaccatctgacagcaaggtcccaagactagcagtcggtgctggcagcccgatcccgatataactcaggaaagcttcaaagaagatcgctgtcggaatggtgaacatcgtttgaatgataatcgttgaactcagattagggatcaaatgtttaaaggcaattttgatgctcgactcgcctaacgttctagcagctaagacgaattcctgatcttttaactgcaacgtctgggcacgaatgagtcgagccatggtcacccacccagtgaaagcaatcgccaagataatggaggtcaagccaggacggaagaccagcagcatcagaatgacaacaaccaagttaggaatactggagatgatttcaataacacgttgcatcaacgtatcggtcatgcccccgcgccagccggagatgatgccgtagaaaaccccgatggtcaaatcgaagaaggttgcgacaatcccgatgaacagtgaaactcgggtgccgaccatgattcgagacaacaggtcacggccaaggtaatcggtacccagcaagaagtaaacatttttacccatgccagcgtatttgttttgaccgttcatgtagccgttcaaacctggcaaatcgatacctggccatttgggcggcaggttcgcatagttcaggctttgtttgtttggattagaaggtgataaccagatagaaatgatagaaatgaacgcgatgaaaacgagcacccacagggaaatcactgcggccttgtttttcttcaatcgccgaatcgcatcttgcgtgaacgtcagcgcaggcgtggcaatacgttcctgttcagccgcatccactttaacatgcttgaatgcatctggacttaatttacttgttgccattagtttgcctccccgctcaatcggattcgtggatcaatgaagccgtaaagaatatcgacgacaaggatcacaaccgtcagcatggcactgtagagaatggtcagtcccatgataactgggtaatcgttggtcgtaattgacttaacgaattgttccccaatcccagggatcgcaaagatgttctcgacaaccagtgagccgaccattaagtcaacagccattggtccgatgatggtcacaatcggaatcattgagttacgcagcgcatgcttggcaacaacttgccagcgtgattcacctttggaacgtgccagttcgatgtaatcagaactaagcacatcgaccatttcagttcgcatgaatcgggccgtttgggcaagcggtgcgatcgccaaggcaactgtcggcaaaatgctatatgagaagccgccccaaagtgctactgggaaggcgccagttttgaaagcaaaaagctgcagcagtgcggcgaacacgaagttaggaattgagcgaccgagaatcgcaaaaatggtagcagtcgcgtcaacccatgtgttcttgcggatcgcggcaatggcaccaagcaagatcccggcaagtgtgccgacgaccatcgcctgtgcgccaatttgtagagatggtccaatccgagaagcgattaagtttgacacggtttggccaggaaattgataggacattccaaaatcgccatgtgagattccgacaatatacgttaggtattgcatccaaaccggcttatccaatccatactgtttcttcaaaatcagcagttgatctgctggaattttggggttgttaaacggcgtccccggcaacaacttcatcaggaagaaggtagcgctggcaacaataaacagtgtcaggagcaggaagccgatccgttttaaaatatatttgaccatgattcactcctgtttatgggcacacgccctgataagcaaacagcgttgtccgccgcagaacacgagacaacgccgtttgtgagaactacttatttgaaactagcaggcagttattcgtaactgctcacgttttggtttaaaaacgcggttgttagaccataatccgactaagttctacttaactttcgcattcacaaagttgtaggaattggttgggttgtaattcaaaccggtaatggtcttacgctgcaaggttgtttgtacccgttgatacagcggtacaacgccttgttccttcgtcaacagttcttgggccttgagtaaggtgttccaacgagcgattgcgttggttgcatcggtcgtcttggactgcttgatcaaagcatcgtattcagcatttgaccacttgccatcgttgtaactgttatcggaggtgaacagatccaagaaggaaatagcatctgggaaatcagcactccaagcggagataaccatatcgaactgaccattttgggaacgagatagacgcgtcttgaatggtactgtagcgatggtaactttcagacctggcaggttctgttgcaaggtgctctggaagtattcggcagaacgcttagcattggtcgtatcgtctgtcagcagttccaaagttggtgcggactgaccgacttctttcaaaccttctgtccacaactctttagccttggctggatcgtacttaacagcggaggattcggctttagatgccgtcttggagaagtcttgaccgttcttttcgaacaatccttcaggggtcacattgttggccgcgatggaagcatcattcagaaccttcttaatgtatgcctcgcgatcaatagacatggaaattgcctgacgaatcttggtgttcttaaagattggatccttcttctcgttcaattcaagatagaaggtcgcactttgcttgaggcctttgaaatcagacatggattttgcttgagccgcttgttcaccttgcaaagctgcgatatcaagtttcttcgactgatacaggttcatcgcggtttgcgaatccttaacaacttgaccattaagggtatcgatgtgaacgttcttagcattccagtaagtagtgttcttagtttctttccaagtgttaccagtgccgttccagttcttcaactggtaagggccattggacaagatgtacttggaggtagtcccgaatttcttaccagatttttcaacgaatttctcattttgtgggaagaatgctgggttaaccaacatggtcttgaaataaggaatcgcgtggtccaaggtgactttcaaagtcgtcttgttgacggcggtaacccccagcgtgctggccgcttttttaccggctgtgatgtcatcagcgtttttaacgcctgaatataggtaggcgtattgcgacttggtcttcggttcaaccgtccgccgccaagcaaacacaaaatcttgggctgtgactggatcaccgttactccatttagcattacgtaacttgaaggtataggtcttcccgccatcagtaacagttggttgactcttggccatggcattttccaatttgctgccattgtaccgatacaagccatccatggtatcaatcaatgcctgcccagaaatagcatcggtggtcgttgacggatccatcgtggagatcacatcactctccatccgtgtaatcgaagtacctttactgctgctagaagaattagaaccacaggctgctaacacccctgcaagcgcgagcgcagagcccgcaaccattgtctttctaaatttcatcctgttccctcctaaaatgattgaacttaccttacattagaaatccattaatgtaaataagcgaatcctcaatttcgcctaaaaaaactaattctttgatcttacttttgtcacatttatgctaccgatctcaaattaaaaattgtatatcccgtaaatattctctagatggattccttatttataggcagtaagaagcccacctaacctaataatcgacacgcgtttttgttttcattttgagtgatgatgctaagaatagcttatattaaataacattggtaagaatcggaaaatcgtcaaatagtggactaatattcggcttttgctcatagaattttcgcttttgtcagacaagctgccatcttatacaaataaagctgagcaaatgctcagttttatttaaccgctttcatatgtttcacttggatttattgaactgaagccttcgttcgccgactgcgaattgttcgaaaaatgacaattattaatccaaccacggaaacaatggttgctaaccagaaaacaaaggccaatgcatgcaggaatggtgcccccgactgcggcgaaattcgcgtgacgcctggcagctgggcaaaaagtaacgtagcaccaaagctgatgccgatggtcattccgatggttcgcgccaacgagttcagcgatccggccacaccagagacgctagcatcaaccgctcccatcgttaaggcattgtttggcgaaaggaacaacgccatgcccgctccattgagcacaatcggccagatgatgggtgccatcgacaattttgctggataaaaggcgtagccgacttgtgacacaatcaggactaacaagcccagaatcgtgagatagtaacgattccaatgatcggcaagccagccggcaaacggtgtaatcatcaacatgacaacactttgcagcatcatcaacaggccgctttcaaaggcagaaatgccgccgtaactttgcaaatagaatggcaacaaaatgttggaaacggagttaaccaacatgacgatcagcagcacgctgacggatattaaataatcgggattatgcatcaatgctggcgcaatccacggtgacttggcacgttgatcttggatgaaagccaacaacgtcaaaatcgccccaccagcaaggatgagaaatcccaacagatgctgcgtcggctgctgaagccaatagccactggcaaaggtcaagatcatcccgccagtaaacagattttgccctgtccaattggcgttaccccagacttgcttaatctccccagttgctggccggcgcagtggcaaaagtcgcatccccgcaaacacgatcagcagaccaactgggacattgaaaaggtaaatccatcgccagcttgcccaagtaatcaaaatgccaccaaatgccgggccggaaatcgacccgacggaaacaaacattgagatcaccgctaacgcctctgcccgattagcatcaggaaagtattggctaacgatgcccgtcgaattcgccatgatcatcgccgacccaacggcttgaatgacgcgaccggcaaggatggttagataagtcggcgcgatcccagttaacaatgaaccaacaatgaataccatttcgccgatcaaaaagacgagattttttgagaccaaatcaccgatatggccaaacatgaccagtaaaacagaggtcgtaatgaggccgatggacacaatccaagtcgcggcactgctggaaatcatgagatccgccgaaattttcggcatggccaagttcgtactcgacccagacagagccgttaataacgacatcatccccaaaacaattaaaattttaattcgttgcgcgcgtggcatggtcatcaccatcacaccctttcggactgtattttaggctaattggtcaggagtcacaattattctaccttggtgtgacggggtttgcttgagctgatcaaccaactggctgtctgctggcacgcgttgattcaatgaaccggcaagcgatcgcgcaaccggctgcggcaaaatgacacgtttttggataacaaaaaaccacacagattattcactgtgtggtcagcttgctttggaaattatttttgcgcgcggcctttgtaagttcctgtgtcggtcgtgacgataatagtttcgccatctttgacgaaatcaggcacggtaacaactaagccagtttccaatgttgctggcttgccgccgcccgccacagtgccgcctttgacagctggctgagtttcggtgactttaagttcaacgctgcctggcagttccaagccgatgacttcatcgccgtagaattcaatttcaaccggaacgttgggcagcatgaacttcaattcatgctcaatgcttgaagttggcaattcatattgctcgtagctgtcgctgtccatgaagtaggcagtgtcgtcttgcgtatagagataagtcgcctttttacgatccataatcgcaatttcgactttttcgcttggccgcatggtggtggtaacgttagcgccggaacgaatgtcgtagaacttcatctgcatgacggtgttgcccttgccaggcttgtggtggttggactccagtaccttgataagcttgccatccttaacaaagaccatcccagatttcaaatcaattgcttcagtcatattttgtgttctccttcattcgcattacgccgcaacggcgcgtttcgtgtttagtataccatagtgaacgatagcgctatctttttaatcaaagacaaaagcacaagctgagccataatttcatctagaccttgtgatctgtcaaatatcgaataaattggaaaaacaatctggactaaaaaggggcttgccgtgccaaactccgcaatctccggccagctggggctgatgtttttttgcacggctgagccccatctggcctacgattgctccgccttagcactagggtcttcaaatatcagaagggggtgtatcacaaaacgcttgtttggtagacataatgccaaattaaaaagcccgtttcttctccatcgagtcaccacaacagaatagagaaaaacggacttccgaaacactcgacatgatattgacaactcaccaagaacaactgctcactaataagctagagctgagaaacttcggcaatcacttgtcagagtcagatcacagatttctgaaacatctcattttgtcatcacattgacagaagatgtacctatcttggctccaatcctacgacagaatgcagagagctggctacgcggggatggggctcagccgtgaaattggtcttggtgacgtggttttctccgcctagaccaaggcggatcttcaagaccgcggttttggccggcttgaagtcgtgcccacagctctagcttcgcggtcgccatcccccatccccgcgtagccagctcggaccatcaattaaagcttagcccagaatagaactgaagaactaaggaactaaaaatctcaaactacatatcctccacaaccaagtaagtcatgtccaacgggccgtggaccccgacaacgagggtcatttcgatgtcgccagagttggatggaccggtgatgaagttgatgttgctggtttggagcttgccggctttaatgtcagcatcatagtgatccatggcttggcgagaacgtggcagaatgttgctctttttgataatagccaagtaatgggttggcaggaagtggaagccacggccttggccaggggtggtggcaacggtaatcgtgcctgattcagccagcaaataatccgcaaagccgatggcgacgtccgcggccgccgcttgcttcaaattgaagtcgcggcctttgcctggcgtccagtacatcggcttaggactgacggtgttggtccattcggtcaagccaaaatccgcgtacttgtcagtggttggcaaaatcattgttttaggcgcatcttgctcaatgtaagcattcaaggcagacgccaaatcagctttggtggtggttttaaacgtgacatgcaccccttcgctatttttcttagcgatggtttctagctcatcttgagagtggccagacaaggttgtttctggcagatcattgagcggctcaaatggatgatctttgagctggtgccgcggtcggccggctttttcagcgatggcgttcaaaaaatcttcccgattcgtgtgatcactcatgtttttgcgcctccaatgctgccttgtgctccttgaaccagtgacggaagttctcgttcttcttcggtggccgtggcaggtcacgcacatcggtccagccgcgtgcgagtttcggcagcatcttagtttgtttgatgcgaccactgttgtactcattttccacgctgccttgatccttcgtagccaaaacgcccatcatggcatgatccatatcaagcgccatgttgaataaaaccggagcgctagtgccaacgccaaccattttcatgatcttgtcgttgaagctgtgatccatcttgagcttatccatcatgacttcacgatgcttgatcaacaattcgtgaagcggaatgcgaacgggacaggtttcggtacatgcagcgcaaagacttgaagcaaatggcaaatcaccgaacttttcataaccatctaaaactggtgaaagcaccgcgccgattggtcctgggtagattgaaccgtaaccatgaccaccgatatgccgataaaccgggcagacattgagacacgcgccacagcgaatgcattgcaagactggctcgaatggcgtgccaagggcgttactgcggccattatcgacaatgaccacatgaaaatcttctggtccgtctgcttcgccgtcaacttgcttgccagagaaagaacaatagctggtcagtttctgtcccacagctgaccgagacaacatgttatccagtgtttctgcttccttcaaacttgggacaatccgttccatccccatcacgaccacctgtgtcttaggaatcgccatggtcagatcggcattgccttcattggtgaccaaattgatcaacccggagtcggcgatcgcaaaattgcaccccgtaataccgaaatcagcttgtaagaaatagcgccgcaagtattcacgcgcgaacctggctaaatgttctggatcgttgtcacctttgtaacccagtttatcgaaaatggttttgacctgatcacggtttttcgccaatgccgggaaaacgatgtgggttggctctgcccaatcgtcttcttgcaaaataaactcagccaaatcagtttccatcagctgggtgccaggaatcttcaacaaatccttatccaaattgatttcggtggtgaccatcgacttggacttcacaatcttcttggcctgcttcttcttggcaaggttcgtgatgtaagccgcggcttctttgtccgttttggcaaagtaaacgtgcccgccgcgtttttcaacgttatcgctaaattcttctaaataatccggtaagtatttgatcacatgctggcggatctgttcgccaagatcgcgccattgcggccagttgccaagttcgtgacgtgacgcctcgcgtttatcccactgggcgtcttgtgctttggcaacacttgcctgcatgaacttgtcctgttcggattctttcacccgctccaagaatggtttatcactggtaacgatactcataggcgcacctcctgttctaccggcagtggatcatggaacttgatccgtttcgggtcaacattgtggttgagcacttcagcaatgtgcatgatcttaattttttcctgacgacgagagaagcgaccggaaatattcatcaagcaggctggatcagccgaaatcaggactttggccccagtactcagcacatcgtcgactttttcatccaccatctgcttggaaatctccggctctttcgcggaaaacatgccgccgaagccgcagcagttttcgatatgtgggagtggttccatttgcagatccttcacatgatcaagcaaaacgaacggtgctgtccgctcacccaacaaccgggtcatgtggcaagagcgatgataggtagctttggcatcgagttcagcgcctgcatcaatcacattcaaaacccgatacagaaactgggagaattcaaatgttttgtcggcgacttccttcgccttttcagcatattccggatcatctttaagtaaaacgcggtattcgcgcagcatatttacgcaagaaccagctggcccgacgatgtaatcggcgtcaactgacagcaacgcatcgatctcattacgaaagaccttctgcgtagctttcacgtaacctgaattatatgtcggctggccgcaacaaatctgcttaaccggcatgaaggtttcacagccaaagcgttccaatacttcgaccattgctgccccgacgttcgggaagaaaagatctacgatacaggtggagaaaatgacaactttcatggcgcacctcctatattaaaacgattccaatttaaatatacacctccaaacatgattacggtactgaaagcgtttataaaaaaataatttacttctttttgaaatcgttatactaactagcagcgaccagccaatgagttcactttgaaaaagcactgtttatgctagcttttgatactagtgttaagcatattgtttcgtaagcgcgatgctgcccgcctgaatcacgctgacaacttggcataactgccactagcatccacaattaggccgtcaccaaaaccaacgacatcttgtggctcttttgctgctttattaactaaaaaaatcaactttttaaaacggtctataccccctctctcccttgacttaacgctgtttcgcacagtttcacagccttgatttttaggctaaaaagactatggtaaaggtggagttaggaaaccctaaataataatggaggcgtgtttatgcgtaagcgatatagggcaacgttacaggcgcttaatgatgattgtatcggtcggaaagcacacgggtttgcgaatcttgaagtcacggatgatgatgccctgcaaattcgcatcgagatgtttaatacgccagcagatatgacgcatatggccgttttggaaggttccgttacgaaagcgccagtcgcggttgcgacagccgcgcaagacgtgaatcatgatggtgtcgttgacgaggaagaagcagagaaggtttccggtaaagtgtttgtgccactcgataatgctcctgaaaagctgaatctcatcggtggtaaatatccagaagccgacgacaatggcttttacatttaccagcagcgagttgtcatgtcagacttgcgggaacagttgctcaaacgttatggcacggatgtcttcaatcttgataatgcggtcatgtatgttgacggcgtccaaagcgatgtcctgttgccgaaaacagtgatgagcgatttggacaaagagaaaccttatctcaccttgccgattgccgttggtaagttgcgtaaggtgatgggttgatcattgtcccccaatatgggattcgtgaaaagattgggctaaacaattctctgtcgtgccaagctctgtagttgtagactttgatctttcaagcctaaaaggcactgtgacgtgggcaaaaattctttgtttcggtaattgcaaattttgtcctgacctgttcactgtttcttgttagctttacaccattcaaaaaagccgatcatcatctgaccggcttttcgtttgtcattttttgtgttgcgcccatgattaaacagttggcgcggttgtcatttctgccatccgctgataaacagcgacaacttcaccggccaaatcgcggaaagtgatggcattcatgagatgatcctgcgcgtggaccatcagcagtgacacctcggcatgatcgccgctcgcttcggcagtcagcagctctgtttgcgcattatgcgctgacactaatgcatcatcagcttcttttaattgcacagttgcttcaggaaagtcaccggctttggcggcttgaatcgcggtgaaggccgcacttttggcattgccgcctgctataatcaagcccatgatcgtctgttcattcacttgcgtcatcgcgttttctcctttgtcatgatcagtgtttgttaactcatcggcggtttgtggctctaacttttaacatgctttaacatgaacgtccgccatggtttcagcaacggcaacaagtcgagatctgagtcggttaattgaccaattttattgcgtcggccatcatttgccagttcacgcaggacaatctgcagttctccggcatagcgggcatacgtctcattcaccacgacaacatcgccacggtgtaacgtgccagttgcatcatgcgctggaatcgcctatcctgcatagcgaatgcgtggctgggtgtcgcgaaccagatagtctgaggcgtcaccacgatataaatgcgcctcactgaatgcaatcttggtttccaattcagaaatggccgccgttggatgcacgcgcaatgccggatacggacagaagaaggccagtgccgcggcgtgcaaatcagcctcgctcgccatcgcattgccgattaacacatcgtcaatcacttcggtcagtcgcaaatggtgcacctgactggcaatggcccgatcgcgatcactttccagtgttggcaagccttcgctgatcggccacggcccatgatcagcacttggcgcagtcacaaatgccgcggtgcgaatgccataatgtcgaaacttctgcgagtaggccacaaaccgctcatcacccaaaccagtatattgctgcgggtaaaaattatggcaacctaacaagttatctagacgtggtccaaacggcatgatggcatcaacataattcgtgccagcactcatattgatctcaattttcaagccatactggttatgcgtcatcaacgcctcttcttgtccagtaaatccctcgtcaagccgcaagccccagacgcccagttcgtgaaagaaactcagatcatgataatcaatttctaactcggaaaataacggtggtgcaatatcgacaatcgttttaaatccaagttgagttgctttggcgacaacagccttaaaaatggccaactgatcgcggcctttttcgccagacaactgcaatagcgatgtaaacagccgccgatacccaagctgatgagccatttctagataagcagtcgccttcgctaccgtggtttgttctgggtagagactgatcccaatctgtcccattttttcgcctccttctgtcgagtcattgttttttgtttcactgtcttgtattgcttgcttcgtgctccgtgccgatacacatggtgtgtcacctctaaaggcaacttttttaagattgacacatcttcaaggccattttcttgaatcggcgtttccgaaaccagcccatcagtaggccgctcacccgattgttggccgtgccgcgcgccgtttttgcgactaaggactcttcatattccaaccgacttttttccgatgcaagtggcactaggcgatagctaacgcgaaagtcgtcttgcggcgttgccaatgtataagcatagactttgttcggctccatgtcggtaatctgcagccgcgcctgccgaccattcggccattttttagcatagctaaacccgcgcaaacttcccggtaaaggttcccggccggtatgcgtgcgaatgtctgccaatgccgagagctgtaactgtttgaaaaagaccgccggctcaaccggcagattcatggtgatcttcatcgcgcccctcctgcttttgtgccttgatcaactgaacatagcgacggacgaacacaatcgttaaaccaatgccgatgccgcagccaacgatctgccatggtgctggcaataatggactgaacatcacgatggccatactgagattgagcaagatcaagtttgctgtcacatttttcaaacagcatcaccttccagcttgcctgtctccttcaggcgtttttcttttttcatcaccggttcgtcaacggtcaactcagggtccagtttgttggctgctttgacgaatggcacatagatcaagaacccgatgaccatattgactgcctgtagaatcggtgcacgccagtccatggttgcaatcagcgagttgacaaacggtggcattgaccagacgatttgattcttaactggcgatacccagccgaggatgtgggcgccataagcgattgagaccatgaccactggcgccagaatgaatgggatgaagtaaatcggatccagcacgatcggcaacccgaacatcacaggttcattcacattgaagcagcctggggcaattgataattttgccacggtacgttgatcgtctcgttttgaaaacaggaggatggcaatcagcagcagcaaggtactgccggcgccgccaatccatgcatacagatcaaaggcgtttcgggtccaaacaaacggtaacgcttcacctttcatgaacgcattcatattagcaatttgcgcggtcaaccaaatggaatccaacaccggtccgagcacattggtcccgtgcagaccgaagaaccagaagatttgcaccaacagtgtcatcagtaagactgcccagaaaccttgcgacatattcagcaatggctcctgaattaaggtagcaataaattcgatcaccgttgttttgtttaagctaatcagatagttgatcacaccggctaaatacaacgcagccgttgctgggatgatcccggtaaacgccttcgcaatagcaggcggcaccgcctctggcatcttaatcgtgacattctttttcatgagccagatgtataaggtcatggcgatgccgcccatgatcatgacggtgaagaagccataggaaccaaagaacttgccaaagttgaagtagccccacatgctgatgttcttgccatcaacgaccccaccagcatcggtaatcaactttgtagcgcctttaccaagtgcactgcttaaagcgactgtgaaattctgcggtaaactcatgatgaatgcgcctagtaccacaatccccccagtcaccggctcaacttggtactggactgctaattgatagccgaacgtgaaggcaaacagcaagcctagaatcgccagtgtgccggtccaaaccatcgcattaatgccgatcagccattgcattgaatcaacaatgcccatccacttgaactgggtcggaatatcgcgaattaaaacgttcaagactgtcgaaactgcgccggccatcatcgctggcatgatcgcaataaacgcgtcacgcaaagcaactaaccaccgaattgatccaatcttagccgcgatcggcaccacatgccgattcagccatccaataaatgcattcataaagatgcactcccctcgaatattttttgataatgtcgcagtcattctttattacaattaaaattttacgggagtgctggttcgcgggtcaaagataatagtagttattatttataatttttataagcaaaatagttgcggcggcctgttcttgtgttggcttgttgaacacccttagtacgagctggctacgcggcgcttgggctggaacgtggtgggcacgacttcaagcccgcaaagcccgcggtcttgaagctcggccttggtctaagcggagaaaaccactccgccaagaccaacgtcaccactgagcccatcgccgctccgccagctctctgctttctatcccataacttgaacccgattgctcataattttccaggtacaagaactactttttccacatcgaaagtcgaattcaagagcggcttcttattaatatatggacacgaaaaaaatacttcctacagcagaaagaaagagctggcggagcggtggcgggctcagccttgaaattgttgttggcggtttaccgcctacaacaaggccagactttgaaatcgcgtgggttttgcgggagttcaaagctgtgcccacggctccagcttcgcggtcgccagcccccgccgcggagctagctcgttctgtcggtgttcaaacagcccccgtaagaaaggaagccctcccccgatatcacaagcagttcgacggccattcgcttataatagattgaaaccagtcaccataacgcgctcgcagtcgcagaaacctgctcgcgctttccatcatgggggtaaactttatggcaaatattgaatatgatccggaacgtcaattgtttcatttgcacaacaacacctttagctatgtcattcaggttattcgcggttatcttgttaaacgttactgcggaccggcgctggatcatttttctggtaccgccaaacttgaagacttcagtcatgcttttaacattcaaaatgatgccgcaccttactcactgacgaccttgccgctggaatatagcacattgatgggcggcgattaccgtacgccagcttacgccgtgcgtaacggtcacggtcagctgattggtaatctcaagtttgaccactatcaaatccttgctggcaatgaaagctttaacggtaccttgccgacagcgcgaacaccgcacgggcaaacgctgatcataacaatgcacgatgaaacccagacgcttgctgtccggctcaaatacacgattgtcggcgatttgcctgtcttgctcaaacaagttgagtatcgtaatctgacagacacgacactgacgattactcatgctgccagccttcaactagattttgacgaccacgcttatgacctcattacgctgaccggcgctcatctcaatgaggccaaagtgacccgccagccgctgacccccggcaaaaagtcaatcggcagtaattatggcgccagtgggccgcaaggtgtcccggcgacgattcttgcagcgccagcgaccaatgaatttgctggggaagctttaggcgtcacgcttttgtggagcggcaattttaactatacggcgcaagtcgatcagttcgacaacagccggctcgtgatgggactgaatccggagctctttgcttggcaactcaagcccggcaagccatttgtcacgccggaagcagccgtcgcttacaccaacgatggcctaaatgatctcagccggatcttccaccgcttttttgccgatcatgtcatgccattgccgcgcaaaaacctaattgaatacaacacgtgggaaaccacttattttgacgttagcgaagccaaaattcttgccgagattcccaaagcggaagagttgggagttgagttactggtcattgatgatggctggtttaaaaatcggcctaacgatgctggccaacttggcgactgggtacctgatcccgttaaatttccacatggcctgcgcccggtggctgacgcaattcacgctcgcggccttgcttttggactttgggtcgaacccgaaatgatcagcgaaaatagtgagctctatgccacccatcctgactgggccatgcagtatgtcggccaaaaacctctgcgttctcgcaatcagcttattctcgatctcagtcagcggattgtgcaggatcacttgatcacagttctaactaacctcgtgcgcgataatcatattgattacctcaagtgggactataaccgccacttcagtcaacctggcagtccggtactgccacctgatcaacaaggtgaagtcggctatcgctatacccgcggcttatatcgggttttgaaaacgttacgcgacacttttccaaagctactcatcgaaaattgttcgtccggcggtggccgtttagatggcgggatgatcgcctacaccgaccaaacatggaccagcgattttactgacccggtttaccgcatgaaaattatgaacggcttctcgctgtttttcccgctcaaaatttttgtctcgcatttcaccgcctccccgaatctacaagatgcacggttaacgcccttgcatacccgcgcactgttaagtctggttggcatcactggcatcgaatgcccgccgagtcagctcagtcccgctgaagccgcggcggtcaaggccagttttgccttttacaaagcgaatcgcaaagaattgcagaatggtttgctttttcggttacgacctagccatgttaatcaagacgaggtttgttggctgatcaccaacgctgccaaaaccaaggcactggtcttgacttcagttggtgtcacttcgccgattccccattatcaacatgtactgctgcattacttggacccaagattgtcttatcaaatcgacaacaccaaaaatgccaccgggttagaactgaaccacgccggtgttaccttgccacttgcccatggtgatttttcggcaacgctcatggagctgacggcagtaaccaaccttccgcaacccaccgcagcaccgacgcttgatcaaatagccacgcaaagttagaccatcttgttgttcaagcatgaccgtttaatctcagtcgctagaaagtgagtttcgctcgcatgaaatttatcatcgctcccgcaaagaaaatgatccgcgctcaagacgatttctcggtccaaagccagcccaaataccgtgcccaagctggcgagctgttgctgctgatgcaacaattgaccttttctgaagcgcaggcgctgtggcataccagtgacaaactcacgcaaaccgcctacaaccaactgcagcaatgtgacctgactcgccgacagtcgccggccatcttcagctattctggcattcaataccaatacatggccccggacttgctagacgacgccggactggtgtatatccagcaacatcttcgaattctgtcaggactgtatggcattttgcgcccattcgatggcgttgtgccttatcgcttagaaatgcaaaatcacttacctctgcctcatcatcgcaatctatatgacttttggggcaaccgcctttatcaggccttagccagaatgcccggccccatcatcaacctcgcctctgacgaatatgccaaagccattcgcccctacttgcaagcaaaagatcaattcatagatgtccgtttcgcccatcgcgttaacggccaactaaaaacccgtgccacttatgccaaaatggcccgtggtgaaatgattcgttttgccgccagccatcggttaaccaaggcggcggatttgaaacattttgattccccgacttatcgcttcaatgctcacctttcaaccgcaacacaactggtgttcatcgcgaagtgagtctttataaaaagctggcccaaattgcctttgatgagtatcaccatgaccgacccagtctcctttggccggtaatgatgtgaagaatcagccatcattgacagtttgagtcagtttttttgcgtacgcggcctcgcgctcaagccccaccattaaactcatcgcatgtgtcaaaaaacgcttctgtgcaggtaaaaagtcatcagcaagctcaaaacttgcagtttcgcaaaatccaagttaatatataaacaaatattagaaaggtttgtttatatggaaacttcaaataattttgtttgcgaaaattcagagctaacgcacggttatcggctcaaaaatcatcattatcaatgccgctactgtccagtcacatttgctgcagatgaagtctatccgcaagatggccattttttcacagctgaagccatgattcgtcaacatgtcgcccaagtccatcatggcgcgcttgcagcgttagtggcacaacccgctggtcaacttggggtgtcatccagtcaacagacagttttacagttgttcgcccagggactcagtgatactgtcatcgcgcaacgactcaaagtctcgccttccaccatccgcaactaccgctttaagttccgtgaaaaggcgcaacaggcacaacaatttctcgccgccatgacgctgctagcgatgccagacgcgctgatcatccctcacgacggtgcaaaaatggtcgatgatcgatatgcgatcacgcctgaggaacgaaccaagacactcaaaagtttcatggacgctgatggtcgcgtgacgaattggccatcaaaagagaaacgcaagctcattattttatcggaaattttcaaaggcttcgatccccagaagaactactcggaaaccgcggttaatgaaattcttaagcaacacgttgaggattatgtcactgtccggcgtaatttgattgaatacggctttctcgatcgaaccgcagatggccgcacgtattgggtcaaggctagtggtccgcgaatttaaaatggcacgacaaatgtgctcgcgggctattcaaaaaagaatttagaataaagattctgcgccgtgccaaactccgcaatctccagccagacggggaggcgacgcgtagctagagcggagccggggcttcgagcgcaaaaatcggtctcgaagtcgccttacaacatcagcgacaaggcccggtccctgtgttgtttgcacggctgagcccgatctggcctacgattgctccgccttggcactgaggtttttaaaaagttatcgtgataagccgaaaggcgaaggattttccgaactttcagaaaatccctcgcctttatttgtcttccatgaatgatatgactatcaaacatcccgagcaggttttctagccggcaattgagcaacctcatcgacaatctgatccaagatgtccagttgttccgcataacgaacggcaaatggctgctcgcttggtatgacttcctctgcttccagcgcaggtcgcgtggataagcgttcagcgtgccgcttatccagccaagccaagacctgatcaaaggtatagcggctgaacgtatcgactgtcagttggccggatagaaaactaccaagtaaatcatggcgagcatcgatgggatagattttggtgcgggctaagagcacccgaaagtcaccaaaaaagatgaattgctgctgggtgcgcgtcaacgccgtataaaagctttgggcgttgagcatcatgtcggcgccgttgacaatggcaataacggtatctgcctgcccaccttgggccttatgcaccgtaatcgcataagccagcgtcaaatcgcgcggcacgctgccaaaactgtagtaacaatattgcttgccgatttggaccacaacaaaatggcgtttggtatcaatatgggctaccacccctgtgtcgccgtttgccacaattgtctcacgccaacgtttagtgccaaaatcatcggtctgttgcaagccattttcgcccagcaccgcacgccgttcccatgttttcggatcaacaagcgggacatgtttatcgtttttcaaaatcatgacccgatcattgaggcgcaagtgatgtttttgattagtgaccggatccacgtaactgctgatatactccggttcgccatttttagccgggttaaccaacgcttgcaactcagcattaaatcgcaagcggccagttgcgccgatgttcttattcacgatcaacaattgcgcatcaatctgctgaccacttttgaccagcgcatcctgatacgccttcaccccagcatcaaacacccggccagcattgcgttggttatacagcgccacattgccgctgacatagcgatcatcgtctggtccaaaaggcagcgctaaccgctcacgaatgcgattagctagtgctaacacgccggactggctatcttgccgataaacgcgcgtcagtgttgtcgccgccacctgttcatcgtctagacaatcttttaaaaagttgccaggaccgatgggcggcagttggaaaacatcaccgacaaacagcacatgcgcctttttgaaattaacgttcttcaaaaccgtgtaggctagcggcgttgtcagcattgagctttcatccaccacaatgagtcgcgcatcgccaaaggtttcccagtcggcatccgcgtcaaactggccggtttcttcacctggcagtagatgcagataagcatgaatcgtggcagccggctcgtgcgtatactttgccaaaactttggcggcgcggccagttggtgcaagcaagacacttttaccttttgcttgggcgttaaaaaaccgaaccagcaaatcggtcaaccaagttttaccggtgccagcactgccattcaaaacgctcaagccatgacggttcacattttgaaaagcggcgcgctgttgatcattaatggttaaatgaaaccgatcgagaaactgatcgagagcatcatctagctcatccggagccatcaacggctcggctgttttttgagcgactttaataatccgcgccaccgatccttctgtggcaaacatatcgcaactcgtcaccaatccatactgctcgttaagtaaaaagccgtattgcaaggcttcttgcggattggcaaacattttcaaatcggcttcgcgtacagccaataaagtagccgcttgctgccggaaccacgtaatggtgatataggtcaatccttgcgtgagtacagcggtgcgaaaaatatattgcagtcctgccgtaagccgatgcggatcattcgctgcaatgccacgcgttttagcaaaggtgtcgactttcttgaaatcaagctgggcaactgacatcaacaggtacggattggcatcaatactttgcatggccaaattggcatccttataagccaaccaaattttttcataggtcattgagcttagtgccttgccccagtgattggccaacacggcaatttccagtttgccgcggatggcggtagcgattttcttaattgtggcgggaccaatgcccgggacactatccggttttacctgatcggttgaaaaaatcgtcaagatcggggtgtcatctgcaaaatgttcatgcaatcggcgccggactgtcggctgatgcaccagcagcgtgtcaatcagctgccactgccggcgcggttctttgggcaagccaaaatgtaaccgcgccaatttgtaagacggcttgttataccgcaatgagccagcatcatcgtaaaccaaatcagcggtgatgatcgctcggcgattgtagtagcccatatcaccggtaatggttgcctcttgggtgagcgtcattttaagcgccggattcggattcagaatccgcacggcgtaaactttataatcaccgttatcgctattaaacagcaacttgatcacttgcagatcaacattttcataaacttgttcctgattagccatgtgcgcccctcctctcaaaaaaaaatcaccgacaaaaactttatagttgcattcttagtttcgttgtctcgtgtgtcgcagccttgtcgagcttcggcgcaatccgaaatcgaaaatcctccggtacggcttgcaactcatgctgagcccactgttggataaaggtcggttgctgccgggcctgataaaactgcaactctgggcgatgcgtgctgtaaaccacgacatcttctcgcccgtgcttcactgaccactgaatggccgccagcagtgcgaccaagccggcagatggtagataaaattttcgcgccgggttgaaatcgtccggtgtcagctcagcatttgctggcgcatccgcgtatgccaactctttgactgcatcgtccaaaaactgggtgtggcgcaacaacgttttatctgccgcatccgtgattttcaagccaaatcgattgccattcaggtcattcagccacgctaaataaacctttgtctgcggcgcaaaatctgcactatcaacctcgtgctgcagattggccatgccgcgatgcagcatgatcccctcagctgtgccgccattaggaagtttaatgatgtgttgtgcctcgcttgatgttgcgtgtgtatctgccatgatcggcctcttttcttcaaataagcttaaccggtatggtggttggctgcaaatattgattagctaaccctcaaaacggcggctgacttgctgctaacattgacttttgagtgatctcgaacatcccattagcatcgacttttactactatcattcttttgatatttttggggttgaagcttagaccggcaatttaagtctcacaaatcggcatttatttacctcaaaacgagacaaaaagttatttttagctttgtgatctcgtgaatttgaaagcgggtttccatgtaaagcctattaataagcgattaaacaaattttgcttgctcactcaattcgtttttgttggctctcgcaaccattcgcgtacaattaaagttgttccaacgaatggaacgatttgacatcaattggggggaacttttatgtcaaagaaattgtggttgagcggtgtcgcgtttgccggtctcgttgtggggagtattgcaaccggttcatcgcttgtagctgcggacaataccgttggcacgacaaatacgacagtcgcagtgacgggtggcacaatcgaccttgcagtgcctgacacactgacttttccaagtgagcctgtcgaagggattgttagaggcaatgtcaacgagacggttaattccgctgacaactcattattaacgatcaatgacttccgcggtacggacgccgggtatacggtgtcggccaaagcgtctgcgatcacagccgctaatggcgatgttctgccaggcgcggccatcgaactaacgccagatgcaccagcagtgacgaatgctgatgccccgacttggagtaaagcggtaacgttgacggattcagatcaaccattattcgccacgaccaaatcgctaaacggtgccggcattagcagttatgatctgaacaaaacaacgttggcaattcctgaggacaacgctgttaaggctgaaagctattccggtgtcatcacctttacattgacacctggtcagccagccgcaccagctactgcacagtaacggtggcgcgaggttgatggttttcgacttttctggttgtacttgccggaagggagttggttcatgtcaggacatcaccagaagactgttcggtcacaattaaaaatcagcgcgggtacccacgtcgcttggatcggcaatcattcacgcaccatatcgtattgaatccacaagtctttcatctctcttatgaattttcatctctacacatgcggcatcaccattgtcttgggggagacggtgatgccgcatgaaaaagaaccaaagttaatgtcttgctcaaggttgacttgcaactgtcagctttgataaccaagtcgcgacacggcaaccagcaacatcagagcgcaaacagaagcgctaaaaaatcggaacatgttcaaatcccaatttgatgttaccggcattgctgatcgttcacgcgcacggtcagcgatccaaaacccacagtaccgatcttttcaaagttcccgaaatgggttgccgacttggtctatcaaaaagcatcaaagaaaccgtcgattttatgatcgacggttttttcgtgagcgcgaaccagcccgggtagaaaccggagcatatgcggccttgggcgtgatggttggtttttgaccattgcgatcaaggtccttatgcgcaggtttctgggctggcaagcgcgttatgacgaagcgcgaaccagctcgggtagaaaccggagcatatgcggccttggcgtgatggttggtttttgaccattgcgaccacggctcttatgcgcaggtttctgggctggcaagcgcgttatgacgaaacacagcgtaatttttacgaaagcagtggtgcgccatgcccaaatgaaccgggcaacaaaacctgcgccgaagcgaacttagccgcatgacttaatgattccgaaactttggcatccaaggttggcttgctcgaagaatacaaggtctcagcaaaggacgtaatataagcatcccctgctcccaacgaatccaccgccttcacgccaagcgcctgctgccaagacatcatgccgtcaaccagagccgccgaaccacgcaatccgcgtgaacaaacaatccgatcacaaccagctgccgcaacccggcgcatcaatgcctccacatcatcatcagaccgtgctttgccagaaagataggcgagatcaatctgtggcgcaatctttttaaacagtttgtcatcgtcaaggatcgaaaagtcataaaccttgcgcgctgtgatagcctgcagaaaagcattcgcatgactttcactattcagatagaccagatcgaaactattgatataggcgatgtcctctgggtcaagtcgcagctcttgtggcggctcgccgaccactttacgccgtgccccatctttgcctgtgatcgttgtaaaagcatttcgaccggcatattgtagcgaacgctgcacatctacgccgcgttcgaccaacatgcgccgcgcaaaatcgccacgcgcatcattcccgaacgtcccgatataggctgcctgcaagccgagttcggtggcaaaaactgccgtattcgctgcatgaccgccaagatacatctgcttatcagccggataaagatcaacgacattgtctccaatcgcaatgactttcaccgatctctccctctttccatcaaacgcggcaactgcagtcttcgatcaaactgctgccatgcaaactcctgcttcctgttaacaaggtcaagtttaccacagcaggaattgggtgtggcatcaagcttgtcatgttttccagaatgcatgatcatcaccaagcctatcagcctgaggaaatgaacaaaacggcgtccaaaactggccgtcgttttttcgttttatatgttattccaagctggtgtctgaaaacttattccggtcatcaataacagtctacaaatttcgatgatgggtattatcatcatcaggtttgctttttcatttcgtcaaattcccaaccaccttaatcttcacccgattcgcattctcaggatgataagccagcggtacctcatcaacttcaacgacttcaatcgtcgtttcatccgcgccagattcaattgctgcggcagtagctttctcctttgcatcagccatcgccttgtcgcgcggaatctgattgtatggataaattcggccgtattcaccggaaacctgactgatagaggcgccaatcgcatttgccacgccgcccaatgggtcacgaactagtttgccgaccccttccaaccgatgcggtgcaatgatggcaccggcaccaacaagaatcaccgttgctggctcagcactcgtcttcattttatcaatcgccacggcgatcatgtcgctgatcgtttgcaaagccgcctgagcgaacttcagcgaaatttgcttggtcagttggggatcgccgacatccgacaaacccaaacgaaccgcaatgtcagtggcggtgataatgttaccaccaaacgtcaatgcctcgtcggtaatcttgtagccaacggaatcggggcccaccgtgacactgccatcttgctgctggcgaacgatcgacccaccgcctaagccaatcgacatgatgtccggca

SEQ ID NO: 48 - DNA, 9617 bp, Lactobacillus paracasei
aaaacggcttagaacgcttatatttgcgttctaagccgtttttgatgtaaagagcattaattgtacccgtcagagtaagaaacgctagcacgggccctttagcgctttttaaaactcactgttttgataaccaatcctcaacgatatttgatttggtcactctgacatggtacttagccaaatccggattttgattcacttcctgttgcttttttgcgaccagctgatccaattttgcaatcgcctgatcggtcaaggtgaacatgacccggtgagtttcggcttgtttcgtcatctcaaaaacctcctgcatggtgatgatgaacggtcgtctggcaaaccaacccgacgttaaaatggcgtcacgttgccggacgatttttggcaaacagttgcaacgaccctggtcaaaacatgcacgttttgaccagggtaaaagatcaaaataaattgagttgcgatccaatccatctcaaaaatcggttcggctggatcgaccactttttgagactgcttggaacgcgcctaaaatcaagcaagagcataaggtaaaactgctatcaaaattgatagaaaccgcagtgcggtttggtttgtcgtgatagcacgctggggtcaaaatgttgaatatttatgcgaaatgcgacactgccaaaatgggcaatgtcgcattttaggggaatattcgacatttgacaataggagcaaaccattagtgccagttgccatacagaattcagtgttgaatatttttataatatccaacatttagcgaaaatggcacctgtctgatcgaatgagcacgtttttggcgttgcagcgtacacaactctatagtggcttgtctgcaacacgagatgtgtatagcgagttacacgaattgaagtatatatgttgctttaacagaaaatatcgagatgcttgtcacgcaacaaaatattgaattaaccgcatctttaaagttgtacaaatatcaactgatctgtttctcaaatgcaactcatatattacacgatgttcaacttgaatgaaactctcaatgcgagtagatgtaaacatcatatgtaacatcgtgcgaaggtcagcgaaaagatgtcgtcagaagctgtttgaattttgattttgaagggggactcaccttccttcaaaataacagggggattgggggcgtgcccccaaacaaaattgacgatcagcgcagctgagattctgtcaatttctcgcaagtggacgtccacttgcaaatctcgcgacagtagaaaatcgaaaaaaaagcaaaatcggtgaatggctgatcttgctttttgtttagaccgcgattgcaaagccgtggcgctaaaacataacgattttatgaaatatggtgcgagcaacttattgtttggattccaattgatcctgagttgtttgagcacaccttgctcccccctctaattcccacaggttcacggccgatgacctattcggtcgcgatcataaaaggtgtggctttgctacatttaactccggctatgcctgcgcgcctttggcttgtcctagcgcgcttcgtgtgcgtggttcaggaaaaacctcggccacggcctcggagagcgttcgcaaaagctcactcaggaccgtcaggccttctcagacacccatatttgcgttttaagcgtcttttagagcaagcaggtaataatcctcatcttttggttaaaacgttatagacactggttttactaactccaacaccacgggccagggtctgtagggaccacttagggtgagccagagccagacttttgatttcagccgttatattttgagataacttcggccttccggggcttttaatggctatttgccggacaaacagatttttaaatctagttttcaataatcctatgacctcgcttttgtgaacgcttatcaaatatagtaccacgatggccaagaccgaaggcttttatgaaaatcaggcctgaatttggtgtttaatcggctctaaaggctactatacaagttttatgaacgctgaaagcaaccatgacaaggacctgactaacccagatgaggaagccgaggcctttttatactgtcgcgagatttgcaagtgggtgcacacttgctcaaaaaaaggaagtaggctgatcagtctactcccttttttatcttgggggctctgcccccaaacccctaggttattttttgctagaccggttgagcgatcgtgcgagtgatgcttcaaattcagcgtcctgtaaaagatgcttcttgagtacttttgataactgcccaactagttccttgacggccccaacttgctccttactgaccgtgccagtcaaattgacggcatgtgtaatctgattcagctggtcgccaaccctacgaatacgcggaagcatggcgttgccatcaattaaactgatttaagctaaaacgtgatttagaagtggacaggaggttacttaatatcgtaattttttcgctcaagccactctacagctaaaggaaaccaagctgaatcatgaatattgacaaaacacctgttagagtgcttagagtcggttggaaggtagttggtctgttcattcgataaagaaagtccatgcggcccccagccgaatacatgtgcttcgtaatcaacactatatttttgcaatgcaagtatatactctgtagtgttttttgagggaaccaattcatcagtattcgttgtccaaataaaggtggggggtgtttttttagaaaccattttttgtgtagcccctggcaaacaagttcctaagatgttacttatttgtcctttaggaaacccattggtgagcgaaaagtctattaatggataacataatatttgtttagtgggttttattacagaaacatttgtatattgagtaatccaatcatcgggaaggctattataccaagacacgacatgaccaccagcagaaaaaccaatggttgcaatcttgtctaaattaatatgatatttttcggcattttcattaatgaactggaatacctttgccatttcgaccaacggtttcggatataagtaagaatcagaaaccaaagagtagtttaaaacgaatgaatggtaaccttttgcaagaaaacttaaggcaattatttcagattcacggtcactaagttgagtatatcctccaccagggcatatgataatggctggatagtttagaatagcccttaggtttgcgttctgtcctctcaaatagcaggttaggctagaatccgagatatccaagacattgtctgctaaacgctttttaattatcctcatttttcattatcacctattcatcttgagaatcattgttgtgttcaagaagatactctcgtgtaattaactttgggagagcttccttatctgatagcaaactaagcaaacttttctcgtttaaatattcttcgtccaacaatagtattgacaatcccaaaggaacattaataccagaaataagataaacattgctattttccatcactagctgtgctattttttgagaaacgctgccactattgatgtctgtcatgaacacaatcttgtcgcttttatcaattccatttagcaatgtcgaaatatcagaaaagtttaagtctgttttctcattatcatcgtacgctgagatagcaattatttttttaagattattggtcagaaaatttaaagttgatttgagtcccaacgaaaacccactatgtgatgcgataacgtatttaatcatattgtcctccaaatcggcttttatactgtcaaaatatggaaaaatgcagcaaccatggcaattaaaattgtcaaccaaattacattggccattttccagtttaattttttgattaaccaatagaagactccaactaataatacagggagcatactcgggagaatttgattaagaatagactgaaatttcaaggtgacaccggcgtttgtcattgataaagcagttttgaaggaaatagttgacggaatgagcgcaccgatgactgtcaggcctaaaacggatattgcatcggtaaaagcagtaagcttgtcgccataagctgttaaaaaatgcataccctgtttgtaaccaaactcaaacattctacttcttagaaaaagaatgcatatgttgaacaaaatccaaaggtatattccaaatgggttcccctgctttgccattgaggctccgactgatccaaagattgttggaatcattgcccaaattattgtgtcaccgattccggctaacggtcccattagcccaacctttgtggattgtacctcatcaagactatcagccttgtccttgtcctccattgcaagtgtggccccaaaaagaattggagctagccaaggatttgtgttgaagtacttataatgattgtccaaggaccttttgagggcatccttgtcatcgccgtaaattttttttaacgaaggtagaagagcatatgccacacttggagctagttgtgtttggtaattaaatgagctaataccaacccttatccaacgccatgctgatttacgcaaatctttttttgttaaaactgttttattttcattcatcttcatcggctccaatctcagaggaatcgtttgactttgatataggtgtttcgtgatctcgattgtttgctttaattttctttcggaaaacgtgaatcatcagcgctgctccaatcagggaaacacctataatgggcatcttgagatatgaactcatgacaaaaccagctaatagatattcgaacattgcactagttggcatgtaaatgagaagcattgcaataccaactgctggtaacatcgcaccagttaactgaagaccagaagaaaaccatgagggcataaagttaagaacgagtttaacgagctgagggccaaaaaataaagataaaaacacaggtagtgctgaaacaaaaccggccgtgtatgtagacgttagtgtcataatctgcataccacgatagttccctgaatcggcgtatgcttgagatttaacagcagtccaaccattaaataacttccagatgacatcgagctgaacaccaagcattccgacgggaagcccaatagcaataccagctcccatacctttgcccgttgaaatagcaattgctgtagtaataattgcagttactggataatcaggcactgaagctccaccaactgcaataacgccaagtgacattagttgaacagttgcgccaataacaatccccgtttttagatcacccataatgagtcctgtcagtagtccccaaaccattgaattgaaggggaacaactgaattgaattgaagtcaaagtgcttcaagtacgcaataattgtaattaaaataatttgccaaacttgaatctgcatatttaaattcctcctcagctttccttgatgactgtggaaacgtcaatagacttatctgatggtacgtactgggagaagattggggtaccgctctcaagaatggcttcatagatcggtaactccgcctgggtaatgtatgcgcgactgctaatcttaattgcactgtttaaatcatcaggacttaccgtaccgcccaatgtaattgaagggatttctaatccgctatttaacatgttcaaaatgatctgaggatgtcgcacaataacaaataccttttgagaatcgtacatatgctttgaaaagtgatctaatgctaccgattcattgatgatggacagggccattcctgctggttttcccaatcgcatactatttttaagcattgcatcatcggcaacttcattatcaattaccattattcgagaaggggtaattaatggagcccattgggttgcgacaataccgtgtagtagacgattgtctattcgaagacttactattgacatttttgaaactcctttgctaattttgttagcgctaacataaattattataaattttcagtattcatttgaagcaacaaacacaaaaagtgtattctgaaacttatagataatgaatatagcagtccttagaaaacgcctacattaggcgaatgatagagggaatcccccccaaaaaattttttcttaatttgatattcagatatctattactttatgattggtgggaggtgtgaaagaaacgagcaaactgaatgatttttatactagcgatgtgaatctgttgaaacttaaaaagcaaatgtcatattacggaagtcattttgaaataccttattcaaagcagagcgtatatgcatattatcgtgaatttaagggtgatagtgacgaaaatcttaagaaaattaattacttcgcgggaaagttgaatccgatttatgtttttgatctatttaaagacaaaggacaaactaatctttgttcggttatcaaccaaatgcgatttcacgatatcttgattgtcaattcttttgatcaactggcgaattctttaccagatttgctatctgttgtaaaaggcattttaaataaagatgcgatcttgatcattactgactttggtagaataagttgcgattcagaaggggatcgctttatttacaatttagaggcattgacaaaatcttctaaaagaatgcgtagtaactccataaaagagggaaaatctcagaaaataaatagcaaaatcggacgtcctaaacgagtaattgatgatagatactatagtatttataaaatgatgaaaaaacagcgtatgagttaccagaaagcatcgcaagtttttaatatctcaaagtcaacgttgtacagaattaaaaagcaaatagaagatgttgattaatttaaaaaggtaagtatgccgaatggaaatcacacggggaagaaagatttaatctaacacctgctcacaggagcatttcttacgatggtcaacagtcattggttacagttggccagaacgctcgtcattatgattgagaaaccttttaaagcgatttttcgtgatggtttttcaaatttgagcgttgctatcaagtgagtggggtgatctaggcgtttaaaggctgtacaacacacagaaattctatttgttaccaagaagaaacaaatgttattattggctttaaagaagcattagggtgtaccctaacggatcgtccagaaacatcttgaaataaggcctaaaatctgattcaaataagtgacccgaaacgattcttaagatcgtttcgggtatttttatgggtagtcgtgtgtagccattgctataattgacatcagattgcatgagatgaggacagcaatatgagcaaaacagtcaaagaacttgcggatgagttgggtgttagccgccaaagggtccagcaaatcattagcaagcaagtagcaagcaaacggccgaagaaagtagcaggccaatatttaatttcgcccgctgatgaatcccttatagaagagaagatagtggggacacatcatgcgaaggtgcaagcaaatagcaagcaattatctgacaaattgcaagcaagcttgcaagaggaagtggcaactctaaaagaacagattcatacaaaagatcgccaaattcaggctaaggacaatcaattggagaaaatgcaaaaacttctcgatcagtctcaacaactccagctaatggccgaaaacaagcttaagaagctggaagcaccccataataagcctgaaagcagttctgattccgaaagcgatcaaacacagaaacgagaaccagaaaaacctggggtggctgaaaacagtccagaacgatcatcttctttttggagccgtctatttggcacttataaataacgaaactttgtaacgtgttttagttctacagggacttagactgtttttttgatatactaagtcagtcgctacgccttttcgcgtgataccgcgcccaaaggtggtgatgctttatgagtcccttcgatattgcgatcatcgcgcctttacttgtcggtgtctttctgctcttggtagaagacaagctgaacaatcgcaagtaaagtaagtagcggccgagttcagtgcttggcaccgggccatcatcttcttgcggaggtgatggctttttgagacaaaaaaatccgtgcagcttgcggactacacggatgtgtgatgtttatgagcctcttcgattaaccacattttagcatatattttgattagttgcatttactgatctgtccttggatgtctgcgcagaaaattattatggatttcaacttggacaacttgtcggccgcgtcttgcttgaaataagtttaaatctaaatcatttattttaagattgatttcatcaatggccggctttagtattttgtctttcaagcgaccatatgtatacgattttggcgcaccaagccatgttttaaattcattaggggttccttgaacaatggaaattgtctgaccgtgatctttgtcagcttcgcgcattagcttgtagagcagaatcgcatatttgctctttagttgtacagtatcggcaagcaaatattgggtatagtaaccattatccttgagcttaagcaaaaatggagcaaattgtttatttatttttaattgaacctgaccgttttcccaaacgtccacaacttcaaaccagcctgtcatggtcaatcgtttttcctgcttattgtatataaaaacgtcttttttccgcatagcatttaaacttcccgctaattgagaataggcatttccacttcgttttagccccaagactttggtcagctcgtacatagacgtgttaattaaattaaaatggtcatcatcaggtttaattcgagcaatgacataatccattatctttaattcacgcgcattcaaatcatgccgagccttcgtaataagatcattatgttctgcaactagaaaatagcgtttgtcatgaatttcttcttgattaaaatctcgatcactcgaccaaataagtttacgaacatcaatcattacctaacccccttacactaaaatacattatagcactatttataatgtgtcgtgtactttttggtgttgtgtcgtgtactttttggtgttgtgtcgtgtactttttggtgttgtgtcgtgtactttttggtgttgtgtcgtgtactttttggtgttgtattagtgcgtttatcctcgtggttgaggcattctcgttcccctaagtacttaaagtatttagaagtatttagaagtatatataatgcgcgcgaggcttgtgtttgtgttttgcttgttaacaaccacaaaagatcttggggagaacctctccccaaaccccataccaacccctggtcgcttcgctccctaaaaaggtgtggcttcgccacgtttaactccggctatgcctgcgcgcctttggcttgccctagcgcgcttcgcttgcgtggttcagaagagcctcagctgaagcttcggcagggctatcgccattcaccgccaacagcacgttgactaaatttgattcatcactaaagcttttcatttgtgccatgaccatatgctgataaaaacggcttagaacgcttatatttgcgttctaagccgtttttgatgtaaagagcattaattgtacccgtcagagtaagaaacgctagcacgggccctttagcgctttttaaaactcactgttttgataaccaatcctcaacgatatttgatttggtcactctgacat

SEQ ID NO: 49 - DNA, 69414 bp, Lactobacillus paracasei
aaacacaatgccaaatgcgacaaaccatctgaaggcgtagtcaaacaatgagaaagatatgatggacgcataaagcgcaaatgcacaaatgataagcgtaaatatttctgcaatcattgatacaatgaaatctgccatcttgtgtcctccttattgctgtggagcaacagatgatggtgccagttgagccttaactgcctctgcggccgcttgagctgcggcagctactttgtcttgattagatgcttcctgatcaactgtcttttgtggataggtttctgctaggctgtctttcaaatccgcataagctttctcaactgcattggcaattgtctgcccgtctgtgctggtgaatccaagcgattttaagccgtctttcacagcttgaatggcagtcgatttcttaaccgcaccgtcaatcgcctttgtcacaccgagctgttctgccgcagttaccgccgcgtttgctaatgggcctaatacctttaccaaagtgagtgcctgtttgttagccagcagttgttttgaaatccaagctccaatgattggaactgccgctactgcgagtgataccaaaagctctgtccagttattcatgattgttttcctttctgaggcgctcattttcacgtctcaaacggtcattatctgcgcgtaatctgtcgttcatatcctcaagctcatcatgcctgttcttccgtttaccctcgtggtaggtcagataagcaataagcgttgaaataatggttgcaatgtatggagtagaatcgacaatgattttagttatcgttgctgtcacggctgtcactccttcgtgccagaatcagcacgaaggctgttataatcgcattgctgatccaacttgagtagattccagttgagattgaggtcagaaattgcagtattgtcaagaacgacattaaaaagctggtagtcgtaagcaacagacgattggtcactgctaactgtgtttcccatagcacccaacccccaatcccgaacccatcaataacaaacaaaaaccccacaatgtcatcgtttaaccagtcagagtaatgtgggggccagatgaaataatggtcattgatgattagaaacaagccaatggcaaccatgccaatggtgagtgctgtatgtgtcgggtgatctctgattttgttaagcatagtcatcacttccttccaaaaaaatagtagctagattttaactgctacatagttatacgtatggttgcagttggcaacttattaatacgtatttgccgattgctgaaacgtaagcccactgtgacataagaccaaccccaaaattaagagctgaagaaaacgttatgagctgattccctgaagggataacgaattgagatgggtcaaatccagccggctgtattgaacccgacgttgatctaacaaagattgtaattaatgcatcacaagcgtcaggattattgactttgattaagttacttaagttttctgaactatttgcaatcagttcaacaaagttctgcgggcccaggtcaaatccggatgacgctgtgtatctgacttgaataccaggcatcgcaaactttttacggttaatttcaaatagtaaaccatcctgtgctctaaaaacaatgctatttccaattccagataaaggcggcccttgaagtctaataatgctgctattgtttattctagtatatttatcataaattagaatggtatacgtttgcccgtcaataaaccccactatatttgttattgctgttgaagaagtgttttgagtaataaatgtttgcccataattaatagatggactatcacctaatgctaatttctgtaaatcataccaggtacctagtttggcgccgctcactccgctaactgtaagaccaatattattgtgcgagtcatcattggatatgtcagccttaattccaagcgatataccattgatgttgagatttctagagaacaaaaatcgtgtgctacctgatggatctaattcagtaaatgcagaaacagccatgttgtcaacggggtaagtgacgtatttgctattgccagtacttccaggagtatctccgactaatagggaattggtgcaactttcggcactacaaccaacatattgatttccaaaacacggcactgcatcttctcccgtgccaaagtagttacgcttatatgtgctgaatccaacgccacagttaactgcacggcaattgatcactttgttatcaattgccgccccaacttcgtcagcggccaaaatattatcggttattgtcccatatccccagtattgaagaccgcttgctaagcaattctcaaatgttgtgcgagatgctttacttatgaaaccgtgtattccatcgtgtgcctcgcaattcagaaccttaacattttgtacgagcccattgtatgactcgatcagatatccatgatcacgtgctatggtgagacaattttcaattgtgatactgtcaattgtgccatggatatcaaatccatttgcaatgtttgctcctgtcacaacgccaatgccagatacttttgaaccagatgaccctgttttgaaataaatccctccaccacgtaataccgttccttctgtcaagtctccagaatcatatattggcttcactccagccaaattaattttcttggaaatcacgatagaatttgaaagcgcgtaattaccagacggaaaaaataaggtatccccatccgcagcattaacgatcatattgttgatcgccgctaaatcatcagttgaaccgtcgcctttaactccaaaagctttagcgtttttactgcgtgcatcgacaccggcatcaagacgatcacccagtgctggataagcgttagcgccacttggcgtgcgtgcattgattacttccgtcagcaaagtgccacccgggtcaatggattcgataatttctttgtttgtgttgacaaactcttcccacgatgaatgagcatcgttaacccactgattgtattgattgataatgtcgtcaagattagacagccagtcttttgcactatcttgtgtcatgtctgcggctggagaaactgcgaaaacaacattgaatgttgactctaatccgtttgcatctgacaggctaaaatacgctagttcaatcttacctggtacttgtcctagttgactcggtacctgataagtgaactccccatctgcagcactaacgatgccaaacccagagctgtcatcaatgaacgctttgccatctgccgtgtttgccttaaatgacagggataagccacccaactgaactggagaaccgttgtcgagcaatgtggcatcaatcaccacggcgccggtcttgtctccctgacgcaataatacaggctcaggtgcaatagcgttttttgtatcaagagttactttgtacgttcttattgccatttggtatcagtccctccattttttccaaatcttcataggtgtcttttgtatcaacgaggcgctgatcctcaaatcctcggcgtttgcctttcagttcccatccaaatgctgaatcagggctgtctgacgaaacgacgaagtagtccttgccacgttcagaaacccagaaatgcgcatcactgtaagctgtcaagaatacctgatagggcttatccgtgttaatcaaatcaaaaacgagcgggtcaatgtccactcgcactgttttatcttctcccgtttttccctcgccaatatcgccgacatagttttctgccaactcatatgcaggagtagcacgaataccatcacgggtaacttgtgcggcgttcttcgatccgctgtaaacgtagaaatctccccagacgctcgtcttgcctactgttacttgaaactgagcattgtgaccaccgtcagcactcacgttgaacttcgagtcatgatatatccacattccgccgggctgttcactgacaagcggagacattagtgaaccatacagattatattgcctgttttccgctgtcgctgttgctggcagttgaaataccggtagacttccgccagtgcttcccccctggttgatactaaagatcgatcctggctgattccatattgcgaacccattgggttgccctgttgcgccatctgttgtcgcagtaagcgtaccaaactcaaagtcatctttgctgaacttaatttcgccattatggagttccataccaaatccattggtgcttgccgttttaaaagctacacctgatatgagattgccaacgattcgttcagcaacaacgccatcagcagtgacggcacttttgaatgtttggcctccatccgtagagacacctaggccggagctgttaagaataacaaccttgtttgagtctgacttatcaacagcgatgattccctgatccgtgaagctcagttgtgttcttgccgcaagaagactattggtagccaattgtacttgtgacgttagccattcgtttggcactagaatcttgccagcggccacgttagatagtgttgactgtgatgtcttctgctgttcggcaaatgagaggctaccacattcaacttcagttttggttcgtgttccgctaatatcgtagtcgctggttactttaatgatccgaaccttgtcactgaagttaaggttctcatcaatcactgtgatatagtcaccagggtttgccattgcgtatttgtagccgacagattgcaagtcaacaaggtttagggtgagtgagatgttccaactcttgtcgactttctttttcacagcagccagcaagttgtcagcaattgtgtaccgctcatcagcaacaggggacgcttcaattgctccaaactttggatagtagtaatcgtacagcggtgatttgtactctacttccaaacgagggcttgtagtgtcatcaggtttgctgtatgcaccataaccgcgcccataggtagcaaagcttgtgttatctgtctgaatctctgctgtatcaagattgaactttttgcgaacgatggtagatagatctgatcccattgctgggacgatatgaactactgtgccttctacatagaactcaacgctcgcttgatcgatgatgtcattgaacaacgacagacggtcacccatgccccaatcttgtttctcaaaagctgcgactgaggctgtattgtcatacgtgtacccagttccagtaaataaagcatcaagataagttgcaaacgggtgcgagccattccatgtctcatagaaaccggtcttgctcattttgtagaataatgcctgaacggcgctgaacgcaacggtgttctctttgtcgttcttcttgtatgtgacaacaacatagtcctcatcaaggaacgataacgtccatcctttggcaatatttgccttaacatcttggccaaagtagattgtcccagataatgacttctcgccattcaccgcatcggttttctcaatctcgcactgggcctgatattcattattctcaacgtctgtgaatgtaatcaataatcacgcctcctatgcgtatagattttggaaaccgataatccggactttgcctagcacgttgcaagtaattcggttaggcttatccggttgcaaaacaaaatatgccttgtttgttttgcttacgatacttagcccattttgtgtataactaaatccgtttagtaagagtacatcaccagcggcaacagggttactagaagtaagctctgtataatctatttttaacgacaatgaggatgcatacccagttgcggttagttgaacagtgaacccttgctcgagctgattgcatggaactgtccctcggtaggggacattgctgataacgtcaatgtccttcggtggcgtttcaccataaggcagcttcatcgtcttgaattcagccgttagcttatacaaaagtgtcccattgacgttgccaactagctccatctcaggtgcttccgtatagactaggaaccgcttgtgagatggataatctttccgcttgtcgtagtaacctccagacgtctcacccggcctttccatcgccacactgggtgttgttttgagctgggtgatgtaatacccgtcaggatcagaaagcagcgcatacagcttctcacgaattatttcttcctcgtctatgtcgccagcacggtagtaaccggtgacgttgattgtcttatcggtgtgccaacctccaaaatcaatgttaccgttgcgctggtcaagctgcatattgtttcgagtgactgacggtgccgattcctcaaattcagtaatcagcaccttgtattggcttaggtagtatcggctaccatcaagcttttcaactaatagatccatatactaccctccaatcggccggaagtagctgctaacggctgcgtcattagcgtctgcttccttgaccatgctgttaatgccgttcttgtcaacattgttttggacgtagatgtttggcgtgattcgttcgcttgcatcaattgactgagtgacgtctccagagctgaactgcgcgcccgtgtttgacaagttgctgatattggccgacatattgtcagaaatatcacttgccatgccagaaaccgtcttttgaacagctccgaatgacttttgcagtccttgattcaagccacccatgattgcattaccagcagggattaagagctttgcatcatagctaataggccctttgtgcttgcgaatccaagaagcaattccaccgacaaagtcctgaaccttactccatgcagcctttaacccactgaagaagctgtccatgatagcacgtccagcatcgagcaaattgaagtgcattaatgcattaaatccatttttgataccattgacgacatttgagacgatattagtaaacccattccaaatgtttctggctccattgacaatgttagtagcagcgtttattacggttgacttgatgttgttccatgctgacgagaagaatgaagtgataccattccacaacccagagaagaatcctggcaaagcattccaaatgtttttagctgtgcttacggtgccattccacaacccagatagaaatgaaacgatactattccaaatagactcagcagtggagacaatgccattccacaagccactgaagaatgagccgagcgcactccaaattgcagaagcgcccgaaacaataccattccatactgcttcgataacagacgtgaatagattccatgctgtttgggcataggtaacaatgccgttccaaataccgctaaagaattgaactaatcccgtccaaatttgaccagcggcagagacaatgttgttccaaatcaattgaaggtctgaactcaggttattccagccgccactaatgaagtcaagaatgattagaattggccccataattactgacttaagcaggttccaaacaccttttgcgatattaacaattccgttccaaatcgaagttagagctggtccgaaagtattccagatgttagttgccacggatacaatgccattccacaaccctgagaagaatgaactgattccaccccatacagaagtagcaatattgacaatgccgttccagattccagaaagaaatgacgttaacccgttccatgcacttgtggcaccattaacaatgcccgtccataaattactgaagaacgtggttactgaattccagccattttgcacacctttcgcagcgctgttgaatgtttgagtaattccgctccataatccgctaaagaatgaagcaagaccgttccataaatctttaagtccagaaacaaactcagaccagatcttttggcccgtttttgttttggtgaaaaagtatgcaagccccgcaacgactgcagcaatagcagcaactagtagtacccatggatttgctgctgaaacggcttgaagaaccttttgtgccgccgcagcaagcttactattctgagccattaagctaagtcctgccgcagcgtccttgctaccagatacaattctggcgagaagcccgcctacttccaacgcgttcccaaaagcagaaaatgcgttttttgcaatgccaaccaccgtaatgacacttttaaatgctgataccgatgccactaacggcaagagccaatctttattttgtcctacccaagcaacaattgatttcaaagtattaaaaatagactttgctactggcgtaaatgacttgattgcttgagaggcaatcgccattcctgcagtgactgcgcttgctgcttgttttatccatcccgaaatgttagttccggtaacagatttaatgaaattatcaaccaccgtcaacatgtttgcagacccgcgcacaacggcagtctttaagtttgcgaaagatgatgaaataccagctgtagaatcaagggctatcttgtgaagtgactgcattccaccgccaccatttttatccatgttgatcaatgcttcagaaaattgatcagcactaacttttccgttagacagagcgtctttcagttgtccggaagtcattcccattgactttgctaatgcttttagggcgggacccatgccgtcattaatcattgaattccaagttgctgcagtaattgtgccactcgacaagtcttgcgataattgctgaactgcagagctcgcttgtgctgaagaaccgccaaaacccaataccgcatcattgacagcactgaacactttttgtcctttttgcacatcaccagttgatgcagccattaattccattccttgaacagcttggtccagactggttggaagtcccatgattgaatcgttaaggccgctcatcgcttttttggtgtctgtagtagcgaaccccatatttttaaaagtacgattggcgttgtttagtgtatcgaaacggctgacaattgatgttgtcatagatcccattgtctgcaaggcttttgtgacaactccggcaccaattccggccaaagctcccattttaagaaatgatttcccaccacctaaaacggaactggaagcactatctgtggcgcttgcggtctcaccttttaattgtttcattgcactctgatatccgccaatatcagcagtgaatgatgcgacaacgtttgccattagctaccacctccaaatgcagcattgagtttcctaatcatttctacatcaggctttcttacagtcccgttgccattgcgattgattatcttttgttcggccttatcaatattcttgtacccagttttaacggatcgtttaggattcttagcattctggacattggcaatattgacggcaagttccatcaaatcgcggcgcatatcgacatcacgcaaaaaagacccttccaagactgaacgagcctcccaaaaatataatcgaaaaggcatatcaggatcatatattccgtgacgagcaaagtcggttaagagagactcttcttgacttcttccagggtatctttcagcagtgctttcttgcccttttcctctgccgtcatgtctttcttttccatcagcgagattccgtatttctcgttcaatttcagccattgtttcatctcgcgtcggaaaaaagccgacttgtgcaattcctcaactacttcatcataaaaggcatcaggatctggctgttcatcaattgcagaaataatatctgcatcagtgtatttttccggcaacatcgccttaattgcattaaataatgctgtcacatcaccagttacaaaacctaaccaaatgctacttgcaccatcatttgcgtttggctgtgaactaaataatttgttagctcgaaatagtgccttaaaattaaactttaattcgactttttcgttctttacttgaatttctaacatgaatatcctcctagattgtcgtctcagatcggccgcagcctactcgtctctgtgtgtgactaattaagcgtgagaagtggtagtggttgtagtaacactgccgtctgcaaactcgcctgctttttcgcctgggcgttcgaatgcgtatagctggtcaagcattgcaacctgttcatcagaaagcgggaacgtgcccggtgtaccgtcttcgttcttgtcagcaagcttgccgataatgttcaaagtgaagtcaatctcggagaaactgtcttcatctgagatgtcggcactgtcaacaacgccataaccgaacatcgctggataagccttgtggtcaccttctacaacggccagacgttcatcgacaatgacacgccatactttaacctgtcggccttcgtgcttggcgtcaatgatgatttcatatgctttatcgcccggaaccatgtacgttgtcagttcaatgctgtcttcgttggtggatgcggcaatgatacggcccatcttggtttgttcatcaagagaatcaccttcaatgcttgtatcgccagactcttggtgagccggcaagattgcagggctgccaattggtgctactttagggtctgtcgattgaataaagtaccaaacatctttaccacgatatggggtatcttttacaaattcgatcccgttgtttactggaattgccataattaataatctccttctagagtaatgagaagcatacagcgacgtaatggtgtgctatcgcccatacttgtgtcgattgaattagatgccgttaatgactgccatcgtgccactttactaagcgaccatttcaccttgcgaacgaagccttcccattcagccggtggagtgtcgatactgtcgtagatgtcaatctgctggccaacacttgaaagtgtccctgtcttggatgacatgtcagcatcaacgtgaacgttcacgaaaaccagtggcaatgtgctcttagcatccggctgaatgaatacaggattgagaccgtcagcagtcaattgtatttgaacatcttcgtaccattgagagagtgtcatttgaacgtggctgcctcctttagtttgtccattgtggctttaatgaagatagattggccccaatcaacagccggacgcataaatggctcagcgtgcattttatacgtcccaaattcaacaaatgaagaatagtctttctccgcctcaatggtgcctgtgactgaagttgaagtttttttgacaggtttgacatttatatttcccgccatgacgcccgttcgcttaggcgcaatctgttttgcctttgcctgaacttgaccggtggttgttttcatcgctgaagcagcagcatcaatcgttgcttccgctgtcgcgcctagttcttccatcaatttgtctagtcctgaccacttaacattaatctcagccattagcagcacctccagacacgatgaatacagttgacttgcggtttacgaatgtcttgttgattgtccatttgacaccatcaagctcgatctcgttaacaggcaatgcaggattctttacgtgaatctcgtaggccatagtgttcacaagaccgtatacagacagctcttgtgcactggtgattgggattgtcaggcaagtgaccgtctcacgcgtctctgtcggtctgtcatgcaatggatcagctggtggtgacttcctgatgagtgtgattcgattgttatatctcatacgaacctcattcccggtcttcggctttgtgatgactcacggtaaacgtcaaggccatcagcatatttagacagatcaatggtttcccatgtatttgatacgttgccttcggtaccgctttgcttgccctcatcaccaatgcggttatacatcttcaccacaacatccttgattacccatgtgaccgcatccggaacagtctggttaactacaccatcttgattgatataagccagaacgcgagcattcacatcactaataaggtcgtttagcaagtcgtcttgaagtgtgtcagttaaaccgatgcgaagtttcacacttttcaaaacatctgtattagtatctgaatcagccatcatttcaccgcctttactgcttgcacatacttgtatgagcacttcgacttgtcgacgaaactcaaatcatcttcaaatggcgtgtgattaacgtacttgcctttgaagaacaagcgtttgtcattcactgtcacgccagcattgtgcatgatcttggtttcattccatcgtttgactggatcagtagcccaacaaaaatcgagctcatcactgatgaatggcccgatgttgaaatacatcatgttccataactgtgaccacatttctgcagtccatttttggatattgctatcgactgtttgcaggtattgccacagtcggttgctgtcggcatacaccttgcgccagtattctgctgacgggtgactgatgatccattgagcaccgccagaattgcggttgatcgtttcaagtgaggccaacgtgactccgacaatatcggccatgcgtttcaggatctcttctccatgttcgcattgcttgatatagtcaacgctgatatagctcaacgtgttactgcacaaccaacgatcaggccttgatttcagcttgcgaaagtctggccgttttcggaagatgacatcgctgtcaaagtagaaatagtcctcgtcctcacgctcagggtcttctgcaagatattgccaccaaagccaaggcttcacagatggaatatattgcttgtctgagcgcttgtcggtgtacgtgtgtacttctactccatatttgcttgcaagcgtttctgtcaccttagaatcatgcacagtgaagagcaaaacgacatctctcatgtcaaacccgacactttgcagattggttaggcagacttccaactcccactcaaaacgctcaatagcgggttggcacaaaataagcttcattctgtcctccaatcagccgcccggtctcccgtactgtcctatttcgataggcgacttagatcaattaattaagcgtgtgaagttgtcgttgtggtagatggtgccacagtcgaagtcgtggtagttgctgacgtcccggcagtgaagattgcctggcggttgtcatcgctgatccactggcctgccttaccagcaccttgcaaagcaacgcccgcaaagttttcggattgaatcgtccgaacaacgttgattccggtaaatgctcggccaatgttatcaggcgagaagatgatggccttaccagccatgtaacgggtaggcgtcttggtgacaacaatgtcacggaagcgaacaataccgttttcatcaatgttcacagcggaacctttgtagctggttaccaactgatgatcgatgattgcgttgtaaacctcggcagtcacgtatgcgcgaaccggaacaacgacttcaagatcggtgtagcgttctgatgctgcttcgaacaccttgttgacatcgttaacatctcccaaatcagcggccgcgcggtcaaccaagtaagctcccaatttgccgttgaaaagacgcgtcttagcttgtgcttgcaagttcaggcggtcagcaacagcagagttcaagtcggtgttgaccgtaaactgatcgatgccttcgttgaagctccagttgaagtcgtacggtacatcaatgtcactgtacacgatctctttcattggcccgaagcggttagaattgctggtgccagagccaaacgcaacgttagggttagtgttgtagttgccaacagcaacaggcacatcatttgccttaacactgaacgcaatcgcgttgttttgaatgccatcgagtgcttgcaaatcaccgaatgtcggggtgaatgtactttgcacgccgaagacggtttgcatcattgcaatgaactgtttctgatagagacgtactggtaaattgttgttttctgtagccataactagctacctcctattttttcttatattgtgacatgattttcttgaatggatcgtcagcaccatcaagggcagaagcaccattcttaggtgggtcggtttgcagcttggcttcaacctgcttgttgacagtttcctgaattgtcttctgaatattctcaacagccgtcttgatcttgtcagcatcacccaaagctaccagagaaccagcaaagtcagtcggcagtcctttatcaacgagcaatgacttcgtacttgttgacaattcacgctgattgagttcagcctcacgcttatctaattcagcctgccgctgtttctcaagctctttggccttttcatcttcggtcatcttagcaagccgagcgccttcgctctttgcgtcctcaagtgccttagcctgttccgcttgccatttagccttagctgtttcaagcgccttagctgcacgcttatcggcctcactgtcaagctgtgcctgcgtatatgtggtaggcgcctgagtggtcgtttcagttgtctgagttgattcagtttcttcctgagtttgtgcttcttctgccatgatggttcctcctgtttagcccaaaacgaatagacgtgcttaacgaccccagccacgccatttagcccagccacggtcacacgtctatcacttcacgctattatttttgggtagtttagggacttgctcaggtcacgagattagtcaaacgggatgttcagcttccggttgtttcatgatatttcatccttggcctctttgaaggccttttttagttttggaaactggattgcaatccaatcaacaatctcttcatttcgagcccagtcagtattgctgtcaagccctgattcatgtagaaaagcatgcacaatctcgtggcgaagtacctgcctaaagtaagtatccatgtcttcccaattacgcgggccctttttgagttcctcaatgattattttctttgtggtaaagtctgtgaatccgtctgcttcttcaagaagcggatagtcttttctgttctgattaacgagtaccttatattcaatacctagaacgtcaactttgaagttttccattatttcctcctaatcatcgtcaacttcatcgccggtatcatacgcagcccatgagcaaagacagttaggatgagccggaatcattccctcggcttgctttagcgtgtaaacttctccgctgtgctgtcggcagatgtcgcacgcgcctgagttgataacccacacgactttcttatatccggcctcacgagcattcacgatgctttgatgagccatgacacggtcgctttctgttctgataatgcgatcagactgatacttcatgacgccgaatttcttgcgaagcgctgggctctgtgtgattgggttgctgtgtgtcagcaatgcgttcttcatcatcttagccagatcattgcgcaaggcgtcttgatttgaccaaatgcggtcgctccatgtggcgccatcgaacattttattgatcactgataaatccgctttgatgtgttttccgtaaattgatgaccccaacttggcagtctgatttgccaaatgtccaagattggtgccgatataagcggcaaccttaatggcaactgctgttgcgtaaacataggcggcatatgacagcagttcatcgttgttggcaactgacttctgcttaacgcctgctgactgtgcatctcgatcaagctgttctttcaattcaggatcgtagtaacgagaatcatcagcatgtgtgtagtcttcgtgtttctcattgaatgcgtaccagaatgccatgaacgctgctgtgtatttggcaacatcacttgctatctggcggtgttgcttgtcttgtttgtccgcgaacgccttgattcgttccttcggtgtcttcgtcattgttcgtcaaatcctcgctgtactcactgtctgctcgttgtttggcaatcatgtcagtgatctcttgtggatcagtgacgcctggtgcaaatctgtacaagtattcttgtggcagtgtcgcaccagcggcaacaagatcagtaatttgtgtgatgtcgtcggttggcaagttgtcgcggaaagtgaattgaatcgtattagggtctgtcttcatgccgcctgacacgctttgatcaagtgcgtagatgattgaatatcgctgatacaatgacttctcaaacattctccgcttgattgctgctaattcgacagtgccaagcagcttgtacttcattgcaacgccagaaacattggctgcaaaattgctgtcagtcaagtccggtgtgtggctgaatttgtgaatatcatcagcaacacgtttcttgtatgcttcggtgccactgacgtcatactctttgttgatgtactttgcatcaatgctcgtctgctgtccgtttgctgtcattcgagatttaagcagcagcatgttggcatctttttgttctttgatcagctctagtttgtccttagcgagcgtcttcatcgcttcgggatcgttggggtcaacaccgcttagaagcgtgctcccgttgaataaggcatcaatgtcgcctgtgatgaccagcaacgcatcattcaagtctgtcatgtagttagcagtgtcagactgtgctgaatcatacaggtcaattagcgagatcacatgctcaaagtctccggttcggaaccggttattgtcatactcgacaacaggaaacgcgcgaatgatctcgctgtgattcagatacattgctccgccaacagtggttggcttgtaaacatcatgctctgtcgctgtccatgtttcggggatgatgtcgataatcgtcttgttgttatcgtcaactaactctactgaatgatagcgaacagccatgattggttgtggatcaacgtcaagcgagtagatgacgaatgtgtcaagcggatcaagacgtatgcaatgctcgattgagtcactaccgtagtaaacatactcatatgcacgtccgtagcgcgtcatgtctaggaacagatcgtagttgagtgcgtccaagtcgttcactcgtgtaatctgatcaagccgcttgtcatcttcgtcaagcttcacattcaccggattgccaacagaatatgcagtctgaaaatcagcaatgtactttccaaatgaatgaacagctcgatggtctgacttgccagtttcaatgcgccgcgaatctggtgttagaatgccttcgtttttgcccttgtagtatcggtcaagcttcttcagacgtggcaactgatactcgtgatggtggaaaatgaacttcataatccggtccggagtgaggttcgtaatatcttcttgatacagtaagtttgattcttcaaatggatccatcatgtcaccccaatcctagatttttgattgtctgaatacgttcttggttgctcatgtaatggccagcagttctgaacatgaacggttccatcgcataccgtaatgcatcaatcgcatggttattagcgtcgactggcgtgttcgtccagttgtcaaacttgtcctttgaataaacgtaggtattgaactcttctagcagtcccttgacgcggggatgaacaacaaaatggtaggactgcatatactgaataccctgtgagacgctgtctttgcccttaccagcgcctatgatgttaggcacaccatatacacctgacagctcggatatgagcctctgctcggcgctatcagccgttatctgcaagccatatcctttgtgttgcccaatagcctcagcaatctgctgtgtcagcattccctgctgatagaactcatcatagatgtacacgacacgattctgctgatcgattgccatgaactcgcctgctgtcgggtcatgtttgaacccaaaatcaaggccaaccgcttttggcaatgcggcaatatcttccatgctgaaatcacgctgctcgaacaggccatcgaacacaaggccttctgcaataccccagtcaccatatacggcaacgcgagcacggttaggattgcgcttgatcatgtccttgaggcttgcaatgtaatcatcgtttagccacgggttatccgtgtatgtggtagtaaagctacgtgtgtgtggtctccgtgtatcttcatcgaagaactcacttttaagccagcttctgtcgctccacggattgaatgtgatcacggtctgatagaatccttgaggatcaggaagaatgcctcgcaaggactcttcaacggtttcaaaagccgatttcgactttagctcataagcctcttcaatccattcacgacaaattacaccaacatcagtcgtgatagaagttatcttgagcgcatcgtccatgcctctaaagaaaatcttttggccagtaggcttataagttgcctcgagtggcgacaccgtgaacttaaaaagatcgtatactccgagatcgcttgcggcttttttcaaagctgcgaatgttgaatctttgtgcgtcccgaaatactgtcgtatgaccagccagttgacgtaagaatgagcaagaatatctacaatcactttgcgggcagtggctaccgacttaccagatccacgactgcctttgtatgatagatagcgtgcatggctcgtgaacattggataataagcaggtgagacaattttaggtatatcaattgtaatatcactcattgtctttctgctcctcattgctatctggcatgacaatattaacgttcacattatctgcgccatctccgttagcttcacgtttggccttggcttccatgatgtcagcctcagcggatgccttgcgcgattgattttctgtcagcgtattgttggcgttgtcacccattccttgaagcttggatagaatatcggccgcttttagcgcatcgctgtttttagtcttgacgtccacgacatcatcaacatcttcatatgcgaacttagagtacgtcttgccttctttgtcatgcatggggatagacacaggcttctttaacgtcacaaccacctgttccatttcctgacggcgaacgagccttgtcagaaattcaaggacctcttgttggtctgcaacggcagcacttttgagttcctcaaggcgcttagctatatatgcttttataccgacattctccgacaatttttccgcatgcgaacgtgcatagctcttagaatatcctgcgttaattgcggactggtacttattccctgactttatgaagttatcagcaaatgcacgctgttttgggcttagtttcatcacatatcaccacacctcccgcgctttttcttgtcttccttagctttcttcagagcttcctctttggcaattttcccgatgattgaggcctcagccttcgacatgtatccgaacttggtcatcaccatttgagccataaaatcacctcacacatagtaaatggcacgggtatcatgatcgctgtattcgaccagctcaaacgttttgtgagcaaccacgccaatatcgttggtccatttgtcggttggcttgcgtgttgatacttgacgctgtacgaatccgcctaggtctttactcatctctgaatgcagatgacccgtaaacagctcgcggttctgtgccgtgcctaacatgaatccaaactcgtctaggtattttgcgaggtaattgttcttgcccttgtctccgtgagtagcaccaatgaagttgtggcctagcttagtgcctttgtaatgctttagcgatatgtcccaagtgatgtttgtctggttgctgtaagcgcgtttcaatagacgagcaaacatatatccgactgacggatcatgatttccagcacaatacatgacctcacactcattggcgttcttaatgattgcttcaatcagtgtctcgaagtattgctccatttcgttcacagtctcgcctaggtcagttgtttctagctgtgtgccctttgctgtggtcgagttgatattgtccacgtgagccagatcaccgcctagaatgagcaatattttggcgtagtggccgcgttcaatgatttctagctgacgcttcaaagattcagcatagacatctaacgtatccccgttgaagtgtgtatcaaatgcaggaatgaccagatagcgatctgattccacaaaaataggagccttagcttgatacggctccttgtgtgtgatgatgtcattcatcaatgattcatattgttccgcttcaactaatggcctaatttgtatcttactttgatacaacgttgcttcaggcgtttgcttccagaagttgcttgtggcacgtacaagctcccacttggtgtaatcatacccgtgagcttccagaacctctctaggcgtcattttgtggcccctgacgactttaagaatggtttcacttgattgcgtgccgtctgaatcgtattcattctttagtggcttctggaattcgataccaagccgtcttgctttgccctgaagcgcatcatagctaattccgagcttgtctgccgtctctcgtctagtaaagccttcagaggcgagcttcctaatgccactgatttgttcatctgtccattgcatctactcgcctcctgaaatatgcataaaaatagcaccccacataatgtgaagtgcttcaatacaaccgccgggattcgaacccgataaacttgcccgtgcgcttgggtagttgtcctatggagccgctaggccttcggttgctcctgttcattgataggcgagccgcatctgccctatcattgcaatctgctagcataacagattggcttactatgtcgcgctaacatagcggttaaatttgttgacgctgcaaaacgtctcaattatcggccgtatatcgctggccgggatttgcacccgacatgatagatgagtgttacaacgtttctctataagattcaaaatcaacgtatctggaattaactgtttttggtttcccttctggataaaaagtaatgcttcttctgccttttatatcttcaaatggtatcaaataaaaagtcttcgtgtccttatgaacagcacacaatatatcaaacgatctggcgttatatttcttgttgtatctttggttatttcctctgatgtgtgaagttacacaactgaccatgtttctcatttttgtgttgtcccaataaacagttttcacttgaactctttttaaaccatcttcacaatcaatgatcaaatcatattcattgaaatcgtttataggtttagatactatgtgtccttttgaaacaaaaaaagcttctgctaacagctcgcttactgttccatttacatgtttttcataagtactcattcgaccactccttctgtatacctattatagcatatatagttaaagctatcgaacgttattcttgtaacgttttaattaaaaaagctgcacaatcacagcgatttgctcgctctcccagtgtcagatggggtcatcgcaagctgtgcccggtcgctaaactggacaatgaggccggtgggatttgaacccacagcatcgccttgctttaatatgctggcagatgattcaatagcaattaagcttcggcctctgtgctgtccgtttatcgtcccctcaacggtaagagtggcttttagccgtaacagacgatacagcacatttcgctcgggctatttaacctttcggccccgaactatatcccgtgctggaatcgaaccaacagccgcacgcagcttccacatcgggattaccttgccacagctttatcatcactgaggctcggaggaaaaatgcggtgtctcaggtttctcacctttggcacaatacaatcataagggtttccgtttttagttcgccactcatttatcaatcaattagtcctcaaatagtcctcattcatcgatcatttattgctcactactttttctgggtgtgacgccaaagtaccaggccgctgctaacaacgcatttttctttctgcgtgtgtaggttgctgaagatatatccagaatgttcattgcatcaccgtctggcgtgtctgtttcgggcccatcgcaatagcgcacccttaataaacgctgatgtgattgtttcggcatcgacgcaatgcaattgtcgcaccagtcgcagaacttacgcgctgatgcttgtctctccaaacgctgctgtgcatacagcggacgctgaacagtgctggcagaagtaccgtctccccatgcactggtgatctttggattgactggcgcttttatgaatccgcgctctgctcggtatttattcaggatatcttcgactgcttcccgatccttttcatcgctaattgataaaagctccatcacaagcgccaccccttatggtataattaatttgcctaaaactcatcgggaaggcgtgccataatggtgcgcttttttgatactctaaatgtgctttcaatacgtgtgtttgctatactacctgtggaggccaactcctaatctttgatttcatttactctcaatcgtacgtctggcctccagcgcgtccttcatcagacgcgcttttttatttgcaatcatttgatccttttccagttagcccaaatccacattgcagcacctgatattaccagcatgacggcaatcattgctttacctccagcagttctgggttctctctgaacctaatctctcgtttcatttctccgcctcatatgtctttatttgcacatcgtcgacccacacatcagcattaactttggaaactcgttctttaacaaagtcgatgaccccctgcctagcttttggtttccaagtacttagattcgggcaaggatagaggttagcatcatacatcaggaactgaagcacatgttcgtttgtaacacgatcatcgtgtagaatttcctcagtacgaattcctgatccacgtgtgaaaccgcctttgaactgctcatgtatgttcatttctccgcctccaatttcacgatttcgcctgtttcctcaacgcgccagacacctagcacccatgcacgggcgaagactgaatcgttgccataatcgaagccctttccccaaagccattccgagatacaactagcattctcaatcccagatgtcagcgacatgtgccccctgttagccttgatatattcgcccaccgcttgcggaatcaccggcaggtcatctggcaacgcggcgtcataacgcttcttgtattcgtctattgcctctctaggccaaccattgaagaacacctgatagccagcaagacggttccaaaccgcctcgaacacgtcctgcttcgtctcattgctcattgtctttctactttctagctctcacgaaccccgcgtgtttgagaataagaatgcgatctgcgtcagtaatttcggcgatttttccggtgctcatggcaacaacccatttcttttctctggggttctccttgaaaattcttaaaattaaattcaaattgacaaaatcgccgtcttcaagctcaacgaacgccatcgtcagtcacctctttagtttcagcaataaatgcgtgtataggcaagtgcaattcattgccgcccttcaacttaacaaggtaacagcacccgtcactgtcacataggcttctaatggagtcgatgctaacaacgtcacgatctgaatggcgctcaacgtatccatctccttccggtgctagttctgcccagttttcatcatatgggtggccgactgcaatgaaccgagtagtttggaaaatgctgccatcattaagggtctcatcgtgatccatcaaagataggctttctagcctgattattttactgctcatcgtcagtcacctcttctttcgtgaaaggtgatccgctcagcccatatagatcaagctgtttctgcgtgaacaaggtatcatcatctgctcccttataattttcaataccattaagcacattcatatgcatatactctggctcattttcagatgcccaccaactcttaggggttagaaccctatactttttctccttcacggtgtatccgtttctgaccgctttcattattcgcttgatgtcttcctttttccttgaagcaaaaagatacttaaaggcttctgccgcctgcacatacgtttctgcgctaatcaacgaatcaatcgcgtctccaacgcttttgcttacttctactttttcaggttcctcaacgaacgcgacaacgtggccgccatgatgttttgcatcttcttcacgctcggctttgtctggtgttacccatgcaccggaaccaaaagtatagcctggatccgcccactgacctccatcgttccttaccgcgtacagtttttcttcgctcatttttcgtcctctttcccgtaaatgaaatgcagaatgtctagtgcgtatgcaatggctcccggcccgtttcctatcacagtagctcggtagaaagcttttgctcgttcataggatattggctcattggtcttactgatgggaacgagcttgtagtcgcgtccatcaagcatgactcctacaaccttgccagtgtctttgctgacgtagatgtcatcgaacgtgttgtcttctgttttcattggttggcctcctaaagctgctcttccgtgaatagtccagtgtgatagtcatatctggcaatcgtgatcggtattttgtagcgaatcatgaacagcaacattcgaagcctagcatcagtggtcaaagtcgcgtctccgcctttaacgtcaacaacttttgtcaactcatcaccgtcatagaagcagtagtctggtgtatatatgcgtgctgaatagcgtttgccattgatcttgaatgccgacaaaatctcaaacgattcctgaatcgttaccttctgtggcttgttgcgtatcagcatgtaataggcgccctctgccttgcttgcaaatcgaatgccatcaatcacaactggttgtgcgttgtatttgcctctgcgtctcttgcgaacaaccattgctaacggctcacaatctcttcatgtccgttgttgcggcggggcagcttgatttcaaactcgcttgcaactcgcttcacgaacgttgttgacttcccgatccgcttcgcaacatcaatcagcgtgtcgcattgtgaggccgcttctgcaattccgcgcgcgtatttggcacgggcttcttttcgcttctttgaaatcttttcaaggccattgttgactgaagtcttcaaagtatcgctgtcatcaacaccggacaccgcacgtttctcgacaattgatttctttgacactatgatccggttattgaactcctgtttctctatttttgagaatgctttgcttttcgagatgtctagcattgctgagttctcgtagcgcttaagcaattcagccttaaagtcgcgccatactttgtctccctgtttgtaaaaccgtaccgttacctgtgtcatgcttttgcctcctgcttaattaatggtgcttctgagaagtccagtgttgcgaagtgcttagccagatcaagcaaattaagcaggcttcctgaaacttcaccgtcagtgcgaatgcattctgacgcttcatgaatcatgcgtgtattggcctgtacaatgcccccaacaagcacgataatgtcttgccactgtgcttcggtaacgcctatgcaacctagatcgtaatcgttctcaatgtccgctatcgtttgattcaagtccatttcatagtcccgcaaacgtttatccaagcgttgcaaatatctatttgtcatttcttcggctgtcacgatcttttcccccttacgtccgttaacttttcaaaattcaatgtgcagtcttttgattttggaataattcggctgattagtttgctgttgtacatgtgctcaagctcgctcatctcgttgttcgttgtgatgatcgttgatagacgaggcatgttgctctcaaaatcaaggcgggcattcgcaacgcgatacatcagttcctgcatgtcgcgtctcacgggcttgatgtctagcttcatgccgccctctgtgccgaagtcgtccagtagtagcacatcagcctctttcattgcgcgctcaatgcccgctaaacgctggcgaatgtctggcgcatcgtattgcaagcccattaggttagtcagctctgctgttgagataaacagccctgactggccttcatctcgtagactcgtcagcatcgccaaagcgagcgatgtcttacctgttccacgagggccaaataaaatcacgatttcaggcgctttttgcatttgtttagccagcttgtatgctcgatttcccagatctcttgatttctgcaaatccatctgcatttcaggccgccatttgtcgaacgtaaacttagcgggaacgttgccaggaaagactgagtagcgataaatggcacgtgcctttttacggttcaatgcggccatagagcgttcatagaagcgcttctcaatctcttcttgagttggcagcttgctaacgtccattcctcgcttttcgataattttttgcacgtccgcatgtgtgaataggcctttagtcgactccatatccccagttctcctttgtttccgtgtgttctacctgtcttccagatgaaaacttgcgatttgcctgaaccaccatggtgtcatactttgatctcagctttgacgcgcttagaatgttggtttgccaaaacgtgtcaagctggcaccagtcgatcatcttgtggatcttctcaaacgggcgatgatctaactcgtgcatcttacgaacgtcatcagcccatgcttgcaagtttggctttctgtgttccgggttgttgcctttgatcttcgaccagagataaacagcctcagccatttctggggaaccgtcagcatattcacgcttgcgtgattgctgactattgctttttatagtctggttagagtcaggtactagtaagttcttatgagctactgattgagctactgttgggacactagttgagctacaagtagggttactagttgagctactttttttgtttttagtagcccaactagtgtcgtaaagctgaacaatttggtatgttggcttggctttattacgctttccaacggtatatttgatgagacccaactggactaactcattacgggctttcttcatgcctgactctgacaggccagtgagatcgacaagcgcggaattctttagggtaaatgcgacttctagcttgccttcatcgttcgcgtagtctaacaactcgcgatacagattgttttggccagttgagatatcgatttgatcccgtttcagctttcggtactcgcgtctctgtttgaagtagtccatatgttcacctcctgccgctcttaatgggcctcacacccattcgtatggttacgccatatcgtctaagggttttaaaatggaagatcgtcatcattaacatcaatcggtttgccgttgttcccgctaggctgacttgctgtactctgcgcggtctgattgtttgacggccctacattatctgtccgctgtactggttttggctctagcaggctaaagttatcggcaatcacttctgtcacataaaccttttgtccttggttattgtcataagtgcgggtttgaatacgtccttcaataccaatcaatgaacctttgtgagcgtaattcgctaggttttctgctgattttctccaaatctggcaaccaatgaagtctgtctcgcgattaccgcttttgcttttaaaacgcctgtcaacagccaaggtgaattgtccaacggcaattccgctcgtggtgtaacgcaaatcgacgtctcttgttaatcttccattaagagcaactgaattgatcacttggctccctcctctccaattcctgacaagtcatctgatagttccaattgaacggcaccgctcaaaattagagcttgagcatagctgagaacgtccaatccattccctttaggacgttttttgccaaggactgcataaacacgttctgacttacttttgtcaattaacggcatgttgtctttcaggtaggcaatgaccctaactcgttttgcttcttgctccgacttatattcgtcaagcagcgatgcagattggccatcatcatcttcatcagcaacaatcccaaatgctagggacaggctaatgcgcttagcatatgtgatgcttgccccctgcttttgcatgtttgcatcatctggaaaagtggctccccatacgatctttttttctccgctgctgtgagtgatttcggtatagattttgtgaattgttttcccgttactgtccatttggtccgtaatgccttgaatgtagctgattccgttgccggcttctttgatagcggttctaactgcgttatcaatggcactgaaatcggcgtaacttccgtagtggcttttttgtttttggaaggttgctttaggacaagttgaacatcgtacagtgccttattcagctcaggagttgatgcttgatctaattgctgatccatcattttgttttcctcctatttccattcctgaaatccttgattcttcatgaaatcgataacgtctaagctgtcatcgccgaagaaaatctcaaccagttccgcttttggataagtagaactagcagcgtcttttaagaatcgctcagggccgtgaatgttgatccaatctttcaagtattccttcgccttgtctttgttaaaggcgccctcataacgcgatgtagcacagctttgatagaaccaaggcttctttgtatcaacttcatattcatcggcggtggccaaaaactcctccgcttgttcgatatccatatctttgggcaggacggtaccgtgataggactcccaatcggcaatggctttatcttcaagcgcttctcgtcgttgataatcgttcagaaccgctgtgttgtaatcaagcatggtcatcgaccgccttccgtgataaaattaagtcataataatatttgcctagctttttatttcccgtagttggcgctacgggatttttttgtgctctttttatcgtgtccattgtttccaacctcctactgctgtggcaccgatcatgatgccggccagagctacaagaagatatttccaaaaggctgatgatgggtcgaacagcaccgacatgattgcttctagcatcgttagtcctccgtgtatgtttccatgaacttgtcaactgcctttgagtaccaacggtcacgagacttgtcgctcttcttgcgaccatcattgccagattcgtatcgtggcatgcctgattgatatgcaatacgttcaaaggcatcggtaccgagtgacagtttcaactttgcacttaactcgcccttgttcatcccatggccaggcaaagcatcttcaacggctttgtttaccatcgcctgaaccaccggcttaagattgtctgcaagatgaactgcaatgagttctgcaagcttttcgtcttcattaactttcaccgctacatccatgctttcaccttctctactggtctgatttgcgactttagtgatccgattagactttccagactttcaaccaatgattcgcctgaatcaatgtatgatctgattttgttgacgtcagttgccgtaaaatgatcactgcctttagatagcaccgattcggctcgttcagcagattcttcaaatttcttttgagccattttttcgtggagataaacgaccaacggatcgtcagtatcaagatcatcagcaaagactcttaatccggtttgatgttcgatcaccgcgttcagaaatcgatcattgccaatcgcaagtgcaaccggaatcagcttatcgttcggtatgcctcttgcttcccaattactaatagcggcctgtgtgacgtgtacgcgtgctgctaaactcttgcgtgtcaggccctcttcttgaaggcttcttgaaaattcctgaaagatgttaattgccataatcacacctcctttaaatgtgtaccgccgatgtagtagtttcacggcgatatatgcgatgattaagctgtagcaaggtaatcaatcatttcgttccttgcacgttccctttcagcgctgattgccatttcgagcatgtcattgtccatggtttcccaaaaagctttgggcttatcatcgcggtagctcatcagtgcttcgatcatttgctctcgatccatctggttcacctccttaacttgaaaactgaatattgtgtgattgcctcccgccgagtgcgataattgcatcgaagggaggtgattaaaatgcactttgtaatctacagatctgaaaacaaccagtacttctttgtcatcaagtcagccaaccacgaaacggttgccacgagtgaaacttacgtgtacaaggagtctgcgcagcgaaccattgacgcaataaagaatggtattgatcaatcgtcatttgtcattgacatgaccgagtagttcatcaagcttattggatagcgcaatcagctgggccgcttcttccaaaagtttttgggctgtttgtgctatttgtttgcgctcattctcgttcatttgactgcctcctctcgctgggcgggattgcgtttattactttccgtgttttccaatccagacaaaattgcttccatgctaacgccgagataattggcaatcttaatattagtagaaacagatccgtgtttttctcctgattccatttgctgaatcattgattgagaaaggcctacggcatgggcaagttcaatttggctaagcttctttttctttcgttcatcttttagactcatttcggttccccctttctataaacatatagtaccacactctacgtaatatgcaacacttttagtgatattacttaaaataatttgcacacactattggtaatacttaaaatctagttaggaggcgacgcactatgactactggcaagcgcattgccgatcttagaaaaaagagatcatggactcaacctatgctggctgacaaaatgtctgtaagccaaagtaccataaccatgtgggagaatgacaaacgcgcagtaagcagcgaagatgttaaaaaactagccaagctttttggaacaaccactgattatatccttgggatcgatgataacttgcctattaatgctattcccgtatcaagcgaagtggctgaccagccagttatggtttatggagaaattcaagctggcgttgccaagtgggctgaacaagatattatcggacatataaatgttactaagagctttgctaagagatacggggcaaagaacttattcgctcttcaagtgaacggcgaatccatgaatcgagaaatccccaacggatatacagcggtattctctaaagatttggaacctgaaagcggtgatatagttgccgttatgatcgattcagaaagtgccacaatcaaacgatttagagaaacgtcacttgcggttatgtttgagccatcttcatgggatccatcttttaaaccatatgtattccccaaagatgggattcaagacttcaaaatcattgggaagtttttatacgcaacaagtgaatgtatttgatgaggcggtgccattttggataatttattgggttgtttgggaattgtgctgattctatttctgtttatctattactggtatgtggcaattccaatatcactggtacttgctatcattagtatttggttagttaagcgcaaaaaagcaaaacaaaaagaaacgtcagacgacttcgtatacacaactccaccgcctgcttttcggcccgtcaagccaaaggctagtaaagatgatcttaatgaagagatatcgaatttagaggaaaagatcaaaaaacttaaaaacgagcagcaagacctgataagaacaaataaagatgctattagcataattgttaataaggaaataaaaataatcgacaggctgaatggccgtgaatttgaaaaatattgtggaagaatgctagaaaagctggaatttgaagatgttaatgtgactatttcttctggagatcaaggcattgacgttctagccaagatggggaaaacgtcatacggattccagtgcaagcactattcttcacccgttggtaataaagctatccaagaggcaatatcaggaaaagaattctacaaagtcgataaggcagttgtcataacaaataactactttactcccagcgctatagcattggcacaagaggccggaatagacacttggaaccgtgatacattaatcgattttgtgcatgatcaagttgttccagaaattgcgaacaaagagcagcatgaatctcaatcacctgtttcaaataatgatagtcaagtcggtgccactgaaccaccaaaaaatgaatgggaggatttttaaccttttctactatatcaatcagtccagatactgatgactataaaagctgaatattttggaggaaaacaaaatgaagaaaacaatactaattggtttgagcctcttgactgtgaccacattagctggctgtggcaattccaatagcgcgagcaagggtagctcgcctaccaagactgaaaaggccgtaaataaggcaaccccaacaaagaaaaagaccgatgcttcttccgtcccaacagacgcaaatcacgaatggttcttcaaggatccggttttctacgctggtaacgaaacaatgacattaacaaagtcagaagtacgagatagcgatgaagatggccagaaagtgctcgtaatttacaatacgattcgcaacaattcaaaaaaagaacaagatccttctaacttttatatggtaatacacgctaaacaaaagacggacacttcaaacgttcaactcgacaccggaatggtcaagatgaacgatgacggtaacagtccattgcaagcgcaagaagacaatcttcaaaactctctgttgcctggtaaaacagttgagaccgtgctcatttatagcttgaagaacacaaatcccgtaactgttgaatttagcaatgctgactttaaaacaattggaaccaaaacatatagcgttaactaacaataatgcccttacttagggcttttattttaatggcaaaacgaacatacgtttgaattttaatcaaaaaatacacatagaaaggatatgggcactgtgcgtaaatggaaagaagttcctcaccatcctaatgtttataggtatgaaacacgacgcggtactcgatatggtattcgtcgtggattcaaaaatagtgtaggaaaacgtgatgaatacacaagatctggatttacaaattggcacgatgcagaaggcgaattaaaacgatttgaagcatctttagttacgggtggcattaatcctctaactcaccgtggtgttaccttgaatgcttattttgcttccttggtgaagaaccgtgaggagctcggcgtttggaggccagctacagttattcaaaaaaagacatattatagaaagcacctacaagaaagattcgggaaccgcccaatgagcaaaatatcacgatcagaatatcagcagtttattgatgagaagatcaaatcgggtttggctcaaaccacgatgcgtacacttaactcagtcatgcagatcatcatgaacgacgctgagcacaacgatattatccgtaagaacatgctaagaggcatcctcattaatggtgccaagccgcctaaagatgtttccattactgatgaagactatgcgaaattcatggccacagccaagaaactcttgaataagtatcaacttacaatgctgtatcttttgactcttggcgagcggcgtgaagaactcgctggcctccaatttcgttcatttaaacgaggaacaaccgaaggcaagccatactatgaaatcacttattacgttggcagaacgcctcagcagccattaggcggtcccctaaaaactcctagcagctatcgtacaaactatgtgacaggcccaattattgattacattgactattcacttcagtatgcaaaaaacattttgacacgtacccatcgtgagatcgaacccgagactttcatatatctgaatgagaaaactgggatgccggttcatccgagcaacatcaaccgaaatctctttcagcgtgttaaagatgcaactggaattgagcttcgtccgcatatgttgcgtcactattttgcaacccaagcacttcaggacggtttgcctcaaatgtccgtcatgcactggttaggtcacaagaacatcgacatgacaaacgactataccaggccaacacgagaaggtagcctgaaagtcattaacggtatgggcccaatcttgtttaaaaacggtaccaccggccctgacggtacaaaatgatattgtaccgccgcttgtaccgtcatgttgtctcaaacgatccgaatatatccaaagcgaaatcaaaaaagcaccccgtccttcacgcaaaaaccgtgatagaacgagatgctttcgtttcattagcagcaaaggctatttgagggtaaccgttgcgccgacgccttcaagttgttccttaagcttgttagcgtcgtcttcggaaaggccttccttgataaccttaggtgcggcgtcaaccatacccttagcatccttcaagccaagaccagtgatttcacgaacagccttgataaccttaactttttcttggccagcttcggtcaattcaacgtcgtaggtatccttagcagctgcagcgtctgcaccagcagcggcgccagcagcaacaggggcagctgccttaacaccgaattcatcttcgatcgacttaactaagtcgttcagttccaaaatggaagcatctttaagttgtgcaatgatgccatctacatctaaagccatgtttgtttcctccgtttattaggtagtttgtaacgtatcattatgcagcaggttcttcgtctttggcttctgcaacggccttgacaaccaatgcaaaatcgcggacaggtgcctgcagaacagaagcaagttgcgacaacagaccttcgcgatctggcattttggacatttccataatggtatccaaagaagcaaccttgttttcgatgatgccgcccttaatcttcaaagcatcaaattggtcagcatacttggccatgatgcgagctggggcaacaggatcgtcattggagaaggcaacggctgtagggcccttgaaaacatcgtccaatgcttcataaccgttagcgtcagcggcacgacgcaggtaagtgttcttcaggacttccatcttaacaccggcctcacgcaattccttacgcagtgcggttacttgttcaaccgttaagcccagatagtcgacaacgacagcactggtagcactcttgaattgttcagaaatgcttttaacgatttcagctttttttgcgatagcttgttcactcatgtttttttcacctccattagtttggttgaagtttttaaatataaaaaaactccatgtctaccaagacatagaggtatctagtgtttccgataccacctcggcaggataattaaggcttacgccccctgagtcttaggcagagtgaatgatcacaaagagtagaataccatggtcaccgacctgtgtcaaaatgttttgagaaaaagaaactttgcaggccggccaatcccatgcaaggtcttaaacgctcgcaaaacagggcgtggttttttagataacagacgccattgtagattgcactttgttattcgtccaaatttgttatccatttctgactaataggctccttgctatcgaattgtaagccccctctgattgaggtatattaattaggtaactattttctgaaaggaagttggcgctcttgccaagtaaacttaaaagcctcgagccatggcagcaaaatctggctgtgttatggctcggaaccttcattgccggcatgggcttcagtgaagtttcgccatttatttcattatatgttgatcaacttggcgattttaccaaggggcaactgagtatttactcagggatcacgtttggggtcaccttcatggtcgttgcgatcgtgagtccgctctggggccgactcgctgatcgccgcggtcgaaaattgatgttgctgcgttccagtttcggaatggccatcatcatcggagcgtgtggctttgtccacaatgtctacgccttaattgccttacgttttctgcaagggctggcagcaggttacattccaaacgccagtgccttgattgcaaccgaaacaccaaaggcaaaaagcggcactgcgattgggattctcacaaccggctacgtttccggtaacttgatcggtccaattctcggcggctttcttgcccagaccttttcaatccggctgactttcatcatcaccggcgttttgctgctgattgtgtttgtcttgagcctaacgatggtccatgagcattacacaccggatccacgcttgctcaacaaggaaaaacgcccgagtttattgtctcaagtcaataatccaaaagctatcatggtgctattagtctccaccgcggtgattcagctaggtaatatgtccatttatccaattatcagcctttatgtcaaagagttgatgcacaatgttggtccaattaccgttgttgcaggcgtcattgcagctttgccagggatttccaacctcatcgcggcaccgcgcctaggtcagcttggagatcgcatcggctcaggcaagattctggtcagtggcttgattttcgcggtcattatgtacattcctcaaggcattgtcggcagcatttgggcgctcggtttcttgcgtctcatgatcggcgtttcggatggcgcgctgtttccaacaattcaaacgcttctgtctaagttgacaccggtgagctataccggcaccgtcttcagttggaatcaaagtgcccaagcctttggttccatggcaggctcgctagctggcggcttcatctcaaatatttttaattataatggtgtttttattttcacagccctctgtttagcgcttaacctagtgatggtgctcgtctttattccacacatctggtcgagccgaccaaaacaacaagcataacgcatcaaaaaaaccgacctgcgtgggcagatcggtttttttattgtctaaattaaatcactgcatccgcgtggcatcaagcaatagctgccaactgatcaatggttttgggtctgggagagctaactgttgatacacagtccacgcatgaatatctgtatcatcaaattcaccattcaccactgaatagcgcgcctgaacttgaaacaatgccgtttgcaataagcgacgaatgtcagcaaactgttggccgcctaaccatgcactggttaatgctcccggttcatcttcaaaccaaaagacatatgcctgcacttgctggttttcgactaagaaacttggttgagtgtcctcagcttcagccaattgttgttcaaaggttgcatggttaaaggtcaccggattatctgcatgagcagcaacatagtttgcaaaactcatttgcactacgtcatgccactgtgccgacgtcaactgggaccgtgaccgaacatcggcctctggggtagcgacaactttccgatagtcactcattgccgtacgacgaaagaccctgaaatgcttcgcctgcagttgcgtgataactgctgattgggcagcataactgctgtactgcagccgatcatgatgatcggccaattgccgcaaatcttcaagcaattgcggcaaccacgcaacatcacccaccacatcaaaatacagcgcattggcatgaaatgaattctcccatactgctgcagcaaacgtcacagcactgctttgcggatattttagtaaaatcgcatgacgattagcaaaatgttgctgtgtgaacgtatcagctgatgccaagaaaggttgaagcatcgtcagtgtcaccttgcgaccagtaagcgtcctgtcctcacgcatccttcttgccttgccatgtgccatgcagtcgggttaacgaataagcataacgactggcaccgtagacgattgggaaaatgaatccgatccacaaatgattggcaaaataatattgcggtaatggattcatatccatggccgcttcgtaagccatctcaaaagcaaaaataaacacgcccattaacaccgctgagagcacaccacgcaccaccgccagccattcataccggcgatattcctccggcgtatctgcttcaatcacatgcagtcgataatgccgcagcgtgatttcattcatcaggttaatcacgatcgtcacaattaacaaaatccatgtcccggcactaatcattttcagactattagcgtcaataaaaatagcgattatcgttgcaatcagcaacatcaattcagcggtcagcatattgcgccccatgatagcgtcataggtgcgttgtttaaatcgatctttgagtgaaatgccataataccattctgtgattttcttcataggaaccctcttctatttattaattaaacaatgttccaatcttaacacggatcgccaatgcctttttcatgaatcacgcgcctttaaaaaatttttccgtgacaataaactacgattcatcaaggaaaaatctctgtgtctgttccagttgtcaaaatattgaaattttcattgacatcacggtttgtttttggtgaaatagtaaacaagcctagggtgtcaagacaccccaggctccattaaaggaggcgcgaaaatgtcaaaaaaaccgtccggccatacgcggctgataattggcatcggcgttgcatggctgtttgatgccatggatgttggcatgttaagtttcgtcattgcagccttacatagcgaatggcaattaagtacggtgcaaatgggctggattggtagtgtcagttcaatcgggatggccgttggtgccattttgttcgggatgatggccgaccgttttggccgtaaagcgatcttgattcttactttgctagttttttcaattggcagcggcatttctgccttcgccacaagttacggcatttttcttggtttgcgattcatcatcggcgcaggcctcggtggcgagctgccagtggcatcaaccttggtttcagaaagtgtgccagttgaaaaacgtggtcgtagtgttgtcctgttggaaagtttctgggctgctggttggctgttagcagccattatttcttacttcattatgccaatctggggctggcgcgtggccgtctttgccactggtttagccggactctatgcgttttattttcgtgaaggcatcaacgaatcgcatgtctttaaaaaagtggcgcggcccggcttgctcaaaaccctcagaaccctttggcgcccgccttatgttcgcgcaaccttgatgctgtggatcgtctggttcatggtagtcttctcttactatggcatgtttctttggctgccaagtgtcatggtactcaaaggatttagtctgattaatagttttggttacgtcttaatcatgacgcttgcgcagttgcctggctatttcgtcgctgcttggttaattgaaaaatggggacggaaaatggtgctgagtctgtttctgctaggcacagccgccagcgcattaggctttggcctagccaccggtttgccaatgctactgactgccggcatgctgctctccttcttcaatctcggagcttggggcgcgttatacgcgtattctcctgaacaatacccaactgttgtccgcagcagtggttccggtatggccgccggtatcggccgcatcggtggtgtggttggaccgttgttggtcggtcatcttttgggatcacactggtcagttggcggcatctttagcattttcaccgccgccatcctcatagcagtcctagcaattgtcttcctcggccaagaaaccatgggcgtgaaacttgccgacacgcttgaatagtctcaacagacaacaaaaaagccttgtaatttgcgggaattcccgcagactgcaaggcttttttactgaagttaacgccgtaatgcgcgcgtaaccgtttgttcattaacaaacgtgaataacccgagatcgccaagttcacgtccatagccggagttcttcacaccgccgaatggcaattcagcattatagttttggctttgattggcaccaaccatgccggtttcaatccgcgctgcgacttctgctgcgtgattagtgtcacccgcaaagactgcgccacccaagccataaggcacatcattggccagttcaaccgcttcatcttcactgtgaaccttgtaaacgcaggcaactggtccaaacaactcggtacgataagccggattgtcctgatcaatgtcagtcaaaatagttggctggaagaaagcgcctggcaaatcaaccggggtattgccataaaccactttagcaccgtgagcaatagcttcgtcaacttgcttctgcaacttgtccttcgccttttggctggtcatcgggccaacattaactgtgggatcactcggatcgccaattttaagattctcaaagcctttcttcaaaccggccacaaaatcatcgtaatatttatctaaaacaatgaaccgtttcgaactggtgcagacttggccgcaattcattaaccgcgtcttgatagcttcaggaatcacagtatcaagatcggccccgtcaagtaccaagaaggcatccattccgccaagttccagcaacgacttcttcagatatttgccagcaagtgctgccacttgcgaacctgctcgctctgaaccagtcaggcagaccccagcaacccgcggatctttaatgaatgtttcactatccgcatggccaatcaaggcaatttggaaggcgcccttatcagcaccgccacccagtacagccttttcaaattcaagcccactagctggcacattgctcgatggtttgatgatgactgcattaccaaccataaagttcggtgcaaacacgcgcatcaattgataataagggaaattccatggttcaaccccaaaaacaatcccgcttgcaagatggttaatcacaacagcaccagcagtactgttgatcggttgcggctgcaacaaagccggcgcccgatcagcatacatgtccgcaatctcagcacagagttccacttcaaaaagtgcttcttccgtgcgcttacccatttctcgcgtaataatcgctgccatttcgtcagcgttattgcggaaataggcagcaactgcatgtaatgttgctgcacgcgttgctggattgacgttccgctcctgcttgtaaaaagcgtgcccagttgccaacatctcgctaatttgcgtcggtgtggtatttgagtatgttttttctaaggtattcgtgttcggatcaatggtctgataagccataattgaaaacgctcccttcatatacttacttaatcatagcttattcacgcctcatatgccaactttagcaaattaatttactggcttttaataacgtccacacagcaattggtctatatcttttgatacatcggatcaaaaaaagacccgcagtgagtgcggatcttcatgtcgtgctagattcagattagaagtctgaagggttaaccttgatgccgggtgccatggtagcagtcagcgccaagctcttgatgtaaatccccttcgtgcttgctggacgagctttcaagacaatatcattcattgctttgaagttctcaagcagcttgtcagcatcgaagctcttcttaccgattggggcatggatgataccagccttgtcaacacggtaagcaacctgcccagccttgatgtccttaactgctttagcagtgtccatcgtaactgtgccagtcttagggtttggcattaagccttttggcccaaggacacggcctaaacgaccaacttgagccatcattggcggtgttgcaacggcaacgtcaaagtccaaccagccgtcttggatcttctgaactaagtcttcagcaccaacgatgtcagcgcctgcgtcttcagcagccttggcttggtcgccttgtgcaaaaacgatcaccttagcagttttaccagttccgtttggcagcacaacggcgccacgaatctgctgatcagcctgctttggatcaacgttcaagcgataagcaacttcaacggtttcatcgaacttagcaaagtcgattttcttaagcaagtccaccgcttcttcaggggtgtactgcttggtcgggtcaacggccttagcagcctctaaatactttttaccttttttagccattctgggttttcctccttgcaaatgtggtcactgggagataagtttttctcccttccacctgattcgctcagctttcactgagaatccgaacagtgcgtcttagccttcgacttcgaagcccatggaacgagctgttccttcaaccatgcgcatagccgcttcaacatcggcagcgttaaggtcttgcatctttgtttcggcgatttccttgacctgatccttggttaccttagcaacctttttggtgtttggttcgccggaaccgtgttcaacaccagcagccttcttcaaaagaacagcagccggtggggtcttggtgacgaaatcgaatgaacgatcttcgtacacagtgatcacaactgggataatcatgccggcctgatcagccgtacgtgcattgaaatccttagtgaaccccataatattgataccggcttgcccaagagcagggccaaccggaggagctggggttgctttcccagcaggaatttggagtttgacaatgtttgctacttttttagccacgagacatacctccttaagtccgtgatgtggttatgatggccagaagttttggcctcccacgcgtatgctgaaaacatacttgaatagattatcattttacggggtaaaacacaagttaaactcgtaaaagcacgtgaaccagtaggactcacattccaacgataacaaacacattcttgttaataattctattttgtgcggtttgtttctgacattccgagcggccacatagcggcgaggactggcgaccgcgaagctagagctgtaggcacagttttgaactcgcgcacgttcacagccatggccgtccacgtttgaggtaacccgcttttgtccattcgaccatccccagatagactaagacaatgatgacggcgcctggccagtaagctgctgggaggatgccgaagtcgaaggctttgtggagcggggataggatcaggaagaggccgactaatagcgccatcatagtggagagaatcacgatagctgaggctggggcgcgccagaatggtactttacgggtacgcaggacatgaatgaccaatgattgtgtgcagagtccaaccacaaaccaacctgcctgaaacatgtgttctgcaggtaaactcgcggcatgtgcgccaacgcccagtccgaaccataagaacaggaaggtggtaatatcgaaaatcgagcttagtggtccaaacgtcagggcatagcgcagtagaccatcggcccgccatggtgtcggcttcgcgagcgtgtcatcatcgacattgtcccaaggaatggtcatttgcgaggtgtcataaatcaggttttgaagcaacagttggatggacagcataggtaaaaatggcaagaaaatgctggcaataagtacggaaaacgcgttcccaaagttagaggcgatcgtcattttaatgtacttcatggcattagcataaacgcgacgaccctcaacaataccgtcttccaacaccagcagactcttttcaagcaaaataatgccactgacatccttggtaatatccgccgcggtatcgacgctgataccgacatcggcttcacgcaaagcggcggtgtcattgatgccgtcacccatataccctaccgtatgcccagccccttgagttgttttgatgatgcgggctttctgcatcggactcagtttcacgaaaagatcagtggtttcaacagcttcgagcaaatcattatcggtcatggcatccacttcattgccgctgatcactgcttgctcaggaatcccgacttcttcggctacgtgttgcgtgatgatcgcattgtcacctgtcagcactttcacccgaacaccatgggcatgcagcaagctgaccgcttctttggcgtctggcttggcgggatcgagaaagcctaaaaagcctgccatgaccatatgttgctcatcatcagtcgtgtaaatgcgttgttcatggacatccgtacgataggcaaccacaatcatgcgcatgccttgcccactcatcatggcattggtttgctcaagctgacgtttgcgttcgtcagttaacggtaggatctcaccatgaagctgaacctgatcacagaccgccaacatttcttcaaaggcaccttttgtgatcatccattggtggtcgtgattggctaccaccactgtcagtcgccggcgttcaaaatcaaacggaatttcatcaattttttctaatcccgctggcaagtccacaatttcgtcgtgatgttctttcacataatcaaccacggctgtatccatgagattgtgccaaccggtttgataattagcattcatataagccaaccgcagcactgctggatcggttttgccggtggcatccacataccgcatcaccacaacccggtcctcagtgatcgtgccagttttatcggtaaaaagcgtatcaatggcgcccaaattttgaatggcatgtagtcttttaacgattactttccgcttcgacatcgccaaggcgccttttgctaagttgctgttgacaatcattggcaacatttccggcgtgagtccaacggccactgctattgcgaagtagaaagcttgtgaccaatcctgcttcgtcacgccattgatgacaaatacgactggtacgagcacgagcatcatcccgatcaacaaccgactgatggctcgcataccgcgctcaaaactggtcggatccgttttgccgctaatctgactggccatatcaccaaagtacgtcgcatccccagtcttcaaaataaccgcagtcccagaaccggaaataacgtctgtgcccataaaaactaaattaggatagtcaaagacactaatatcagcatcctgttcgtagacttcagcgcgcttttccactggcatcgcttcgccggtgaacgaagactggttaataaatagatcgtgggtggccactaaataggcatcggccgggatcatatccccagtggcaagctgaacgacatcccctggcacgacgtcatccatcggccgttcctgcgtctgaccatcacgcgtcaccgctgttgtgttcgcaatcaaggcagccaaggcatggctagctttttgagagcggtattcttgccaaaaatgaatcgtcaccgacagcacaatcatcagactcatcatcatcgcgccatcatagtcagctgtcgcagtcgatactgccaccaaaaagaccaacacccagacaaaaggttcattaaaagccgaaagtaaaatcaaataccatgggcgcggatgttgggtcacaacagtattcgcgccgactgcttctaagcgatccgcagcttcggtactgctcaaaccatctggattggttttcaatgcttggtagactgcttgatcgctcatttgactgtagcgcgtcaatgctgccgttttttcttgggtcgaggcgccatgccccgacatcgtcttctttagcatgcttattctcctataagatacgctggcaggccaagaaaccgccaccatgaggacaatagaaaaatgagcttgatacacccattctttccgtgatcatgtatgatgaggttgttgaacgtgctagcatatgcgcttaagtatcccccaaacgtgtaagcgtgcgggcaattaactttaacaaaaggttaccgtgaatgtaagatagttgtcaaagataaccatagtaaggaaagcctaaaaatttttaaaggggaggttcacgatgcaaaaatctgcacttgatcaagccgctgctattcgcgccggggtgctgtctccagaagaattgattgatagtactcgtgagaaaaggacggcattaaacccagcgctcaatgccattacctggacccgttttgaagcagccaagcaggacgccaatcaactggaagatcacggtcaaccgtttttcggcgtgccgttgatcctgaaaggcttgggtcaagactttgctggcgctccagcaacttttggcagtcgcttcttcgccaaagccaagtccgaacacaccaataactttgttaaggccttgcaacggctaggcttcatcatcgttggtcaaagtaatgtaccggaatttggttttaaaaacatcacagacgcagaactttatggccccgcccgtaatccgtggaaccgcgactattcgccaggtggctcttccggtggcgcagcagcagttgtggcttcaggtattagtccgctggcaaccggttctgatggtggcggttcgatccgcattcccgcttctttttccggcttgatcggtttgaagccaacccgtggccgcgtgccaaccggacctggtgagtggcgtggctggcaaggagcatccatcaacttcgccttgacgaaaaccatggccgatacagcagcgctacttcgtgggcttgccacaacccagctagctgctcctttcatcgcgcccccattacgcttagatctcgttggcgatacacgaccactgaagattgcttacaccacaacatcgcctgttggcacccctgtcagtgacaccgctgttaaagccgtcgaaaccgcggcggatgcgttgcgagcagcaggacaccaagtcgttgcggctgcccctgatgttgacggtactgctttaatgaaggcgtactacatgatgaacggcggcgaaactgcggccatgtttcaggcatttgccgcccaaactggcaagcaggccaccgctgccgacatggagttgataacttgggtgatctatcaggccggcttgcacacctctgcagcagactacagtctctcacttggtgcgtgggatcgcgccgcagaagcatacaaccattttcatgagagctacgacttgctgctgagtccaacaacagccaaaacagcgccccgcatcgatgccgttttacaatcgccggccatcgttgctaaaatgcaacacgccgctgagctggcaccgcaggaacaacaagcgctgatttgggatctttttgaacccagtcttgaatattcgccattcacgcagcaagccaatctaaccggtgcgcccgcaatcagcttgccgaccgccatctcacctgaaggcttaccactgggcatccaattcaccgccgccaaaggccgtgaagatcagctcctgcgcatcggctactggtttgaacaacaaggcttgttgaaattgttacctgcatcgctaaaggagaagatctaatgggctcacttgctgaatggtaccaacgcatccccacgcctgatgatttaacccgagtcgaatcactttttgctaacattcaggcacaattcccgcaactcaagctcgaattcaagtggaatcagcccatgttcactgaccatggtacgtttattatgggctttaatccgtccaaaaagcaccttgctgtggccatcgaaccacaaaccatgacgcgtttcatcccgcaaatcgacaaagccggttacgaccatagccaaatcattcgctttccatggcacaaaccactagacgagcagttgatccgcgacctcatcgcctacacgattgaccaaaagaaagatgcgactactttttggcagcgataggcgtgacatttttcggaaaacaaaaagccttgaatccgatagtatctaacgtttgctatcctcgaatcaaggctttttattttgcacctcacttgctttttacctcatccactccggctctatagttcacgtaccgcgccagtgcgaacagatagtcggacaagcgattgctgtattgtaagatcacggaatcaagcggttgactctcagcatccagctgatccaatgatcgctcggcgcggcgggctactgctcgaccatattgtaaggctgccgccagcggatggccgccaggtagtacaaatgctgtgatcttcggaaccactgccatcattttatcaatcgcggcttccaatccctgtacgtgatcagcggtaatcgtttggtgtcggggcaccgcaacatcggccaatagctcgtacaactcgcgctgccgagcttcgagatcttcggccaaccagtcaaaaccaggcgtggctttggcctgcgaggcaacatagcccagccatgaatcaagctcgtctaaatcacctaatgcaacaatctgcggagaaaacttcggtacctttttcccgttaatctgtttagtggcaccatggtcaccgacttttgtgtaaagtttcaaaatgtgcgcctcctcgatcaaaacgttgcaagccctgccgtaaaatggcgagtacgatcgggtaaaaaactagattaccgatggcatgatacgtgtcaaacggtaacccactcacatagtacgcccaaaagccgagaccattcaaactgccaatcaccgccatgcctaaactgacaatgaagccgtatagataccctagcaagccggcaagaccgatttgcagccaaattcggcgacgaataactggcaaaatagttaccataacaatcacaattaccatgcagcacgcataagcgacaatctgcggcagtgtccagagtccaaagccaagaaataaattggacacgatcaaggtgctcatggtcaaactgaagccccagcgaaagccgagcaacagcgtaacaatcattaaaatatcagtgacaggctgcacattcggaatagggactttaacaatccgcaaaaccgtacataaagcggtcaatagaccaagcaaagccaccgcccgaacaggcgatggctttgttactgatggctgcggcttcatttggtgacactcaggtcaaacaccactttatcgtgattcttgaccggttgttctgtcgctcctttttgggccatcttgccattaatcgtgtagagccagtaagtctttttggcaacattttgctttttgccagcaatttcggtaataaaacctttagaagccttcactgtccagccttttttcaagccagtcatgacaaccgaccttttaggctgatcaatcgttttcttggcaaaagccttgccattttgtttcaactgataagtcactacaatctggttagacttgctgctgcttttggccgcatttccagaactgctgcacccagccagcacaaacatcgcaacgaaaaagaccactaatgaacgtaaaacttttttcaaaataaactcctccacacttttttatttaattgggcaagcgccaccggcacaatcggtttgatcaacgagctcaaggtccttttgatcatgatccgcgttttgaaccgcaaagacagctgcaacggaaccatgaattgcggcacacttttgcttgtaagttttgacatcaatgggttccttaggtgcctgtttgaaaccagcacctacgtaaggcaacatcgacgtcgacttaatgacatggcgatactgggaaagcaaaccagcaatttgatcggcttcttttggttggaaggtgaccgtgcaactgaccgcgttgtcagaccagtacgtctgcaaaaatgcttgcgtggcaatctgttcagcaattgacaccgttccggctgaggcaaaggcaggatcatcagcgtgagcggcgcgaattgggaattcaaccaccatcgtgcctttcgtgtaaacatctggttcaatgtgataaccgcatgcctgcagagctggtaacaacggatcgttgccttggaaccgaatgcgctgaatcagataaccagcataatggaaatgcatcccttctgaaacgccggcaagtttcgccaccgtccctgaaggtttaaccgttgtatgttttcgcgacggttcgcagcccaaagcatctgagtaagcctgatcggcatcgaccacagtgtgatacaaaccatcaacggcttgtttaatttccggatcgtaaatcggtttctggaccattttgccagtttgcggatcaacgactgactcaaacccgctcacaacccgccggccaaagtcattcaggaaccagtcttgaataccagacatggaaacaccgatacgccgattcttcttgatgatatcacgcgaaacctgccagtcataatgactaaaggtcacccgcttggcgaatcgtgctgccaatgtgaaggcctgtttcagcttccatccttgctcaactgcaacaactggaaagacttcaaacagattgcaaggttctccattggccaaggaaatctcaccgcaagggttggtaccctcaacatcaggatcattttccacattttcgccatcagcaattcgaccaaaccgccgtgacagttcaagattcacaatcccgggttcgccatttttggcaatggcgtgggcaatcggcgagtaagcatcgaattgtgtattgatcgcaacactattgttcgacgcccaacgatgatgataaagctgcttttgatcctgcttcatcgtgataaaatcgtcatcgtctgctgagccgagtgacatttcagcggagcgccgaacattgccagcaacgactgttttaccgatcaaattaccaatatcagtcgcatccaccgccgtcaagtgttggccaacgcgagcattgagcaacttgttgatatccaataacatctcaatcaatggcatcggtccagaggccgtaccgccaaaaccgtgaattcgtgcaccctttggccgaatgttggtgatatctaaaaccagttttgtctgaccgcttggattagtcgcggcaaaatgatggtcgatcactttcgcgttggctaacacccaaccttctcgcgtatctggcaaggcacaatgatcagcctgttcaccggcatgtgctttttcccactcgtcacggtcaactgcacccattttcaaagaatcagcataactcgcgctattgcggccaatcacaaccgtcaactcaagcttggtcgcaacaggtggcagctttgcaatattatcctttgtcaccgaaaacccaacgccgccgcctttcatcagttcatcaaacatgaaggagtatggcatcgacacagccggctgcgaggcgggataatcttcaggcacaatgtgtgattggccataaggttgcgggcgaatggcgatgaaccagcaattgttcaaggcatcgccattgcgcttttgataatctgttccggaaatccacaaattacggcctgaaggtgtgcccgccaaaccataaatcagcttaaaaagattccgtgcttctttttgcaatgtttcaacgaccttgggatcaggattcgctgtatgtaggcgcggatcaaggttaatgttaccttcaaccacgcgcttgacggtttcgtcccagttttcagtgcgttgaacatctggcagccaccgagcataagtacgtttataagtgacccagccaagttcaccccaatgtggttttatttcttttttaacctcggcaataaaagctggtgccaaggtgattggtttcgtcataacttgcatatccgtacctcccatatacaagatatggtatatcctcatgaagcttatatcaagatatagatttaacaataacaactggttagatgacggtaactggtggccgacagtgcgttcgccttttccagaaaatcctgagcaaattaaaaaatcgtcagagcaaaaacgtctccgacgattcctatgtgttcaagttagaaaaccggaccaacatatggtcgaaccagcacatgtgctaaatctagcgtcttgagctcggcaatttcttgaacgaaacaagtgatcgagccagctaacatcaggttcattggcatcttgccaacttgaacggcgacgatcggcatatgatgcgcataggcgtacccgatttcaaaagccgtgccaggatcaggcgtatcgccaacataatctaggatagccaccatggttgtcgcctgatgcaagccttgaatgtcttcaccaaagacctgacgctgccagcctggtgagttttcttccaatttagctttattagtatcatcgcggggtgagaaaacaccggtcaccgacttgttgacctgcaatgctgccaagacttgatcaagtcgctttgtttgagccgcatcaaagaatggtgcggcgacatagatttgtgccatttagtttcctcccacttttgtgacgtgaccagcagcactaaaaatcacgctgccgctgccataaatattcaacaatgtcgtgatcgacaagccgattttcatgcaacaggctgtgtgcagcccgcgggccgcggatcacgacctcggtataatctttgatgcggtctttgaccaaatagcgaattgcaaaactgctgttgatcgccacttcaccatcatggcggccgccaattagtaaatcaccagcgatattcagccaccgcagatttgccggtaaattaccaattgtcttttgaaactgttgataaatcggtgcagcatgttccggcccggtgcgggtcaaccgccaatttaagattggtgatcgttgcgccacctctaaatcattcatcggcgcagcaatcgtgactagattggcgacaggcactgtcggcttgctcaaaagatataggacagctgtgacaccacccatcgaatggccgacaatgttcacctctgcaaacgcctgttgcgtttgcaacgctgcgattaccttttccaagccatgcaactgagctgctggacgcaccgccttatctgtgaacaacacttggactgctgcatgatgatttaggttaagctgcccacgcaaatgcaccttgccatctggcgcaacaatcgctacaacatctttgctgagtccataacgacgctggagccgccagagcatatgcccaaacgaatagcgtgtgccaaggtgcccaggaataaacaaagtaggtaccggatccatcaccagcggaaccggttgataccccggccgtgccagcaacaaataatctgccagaccgcctacaaccacgacaagaccaatggccgcaacgatccagaaccagccgctcatgagctaagcctacagcttgtcgacttgatcgaaatccagttccgcggtaacttcgcggtcgaacatttcggtgacaactttcaacttcatcttttccttatcaactgccgtgactttaccgtgcataccggtgaaagcaccatcaataatcgtcactggttcgccaacatcgaattcaacgtcattgtgacgggtactcatacccatagaatgcaaaacattggcaacttcttcaggcaatagtggtgcaggcttagagccagcgccgtgagaaccgacaaagccggtcacacccggtgtgttacgaacaacgaaccatgattgatcagtcatcaccatttcaaccaacacgtaaccagggaaggtctttttcatttcgatcttctctttaccattcttttgttcatgttcttcttcttcaggcacaaccacacggaaaatataatcgtccatgttcatactgctagtccgctgttcaaggttggtcttcaccttattctcgtaaccggaataagtatgcaacacgtaccagcgtttttctgccgatgtaactgtttcagccataatgcgtctcctttaagtgttttgagtcaaaataaaaaaccgtcatcgaaggcggtttttgtactgacaagagtataccaaaaaattggcggtttgtcaggcatcagtataggaaagcctgaaagatcatgttaatgacccaatcaactgccgcaaaataaatggcaaagataatggaagtcatgatgacggtgaaggtatcacgccgcgtttgccgagcagtcggccaagtgacggctttcatttctgcgaaaacacttttgataaatttcatcattctgctccttccatgtttactttgtctcttgatggaccgttacccggccacagtgtttacaaaatttttttaaggttaatcgttctgttcgttttgggttttcgggaacaaaataattccgttgcccacaaaccgagcaagcaagtgctactttcttagctgtcatgatgttccctccagtcacgtccaatatcttaccaagattatggggagatggcaagcagtgagggtgagccataatttcttcgtaggacttgggcttcattcaattccgaataatcgtaggatgatcctaggcgaaaagttttcttgccgtgccaaggcaaagcaatcaataatccatgagaagtcaaaaaagaatacccaaccacagcgtcagcaacaacgtaccaccaacagttaataatgattgaatcgtgaaaataaaggttttatctttacttggtttgcttgtgtaacggcgagtattgttgcgtactagcggccaagttgctagcactagcaggctccaaagtggtaacgcgcgggttaggacacctagaatcagcgcagcgaaagtgatgaacgggatgaggcggtaccattgcaaggcgcgtttgcggcctaggaagtatggcaaggtgaagcgctgatttttgatatcttgatccatgtcggcaatgttgtcagcaaacatcacggcggcatttagaatgataactggcaaagccgcgagtaaaagttgcaggagccagcctagatcaaatgaaaaggtgaaggtgcgccgtcccaacatcaaattaagcggacttggggcgggcatgttgatcagcacagcaatgatgaaagtaccataaccttccacaaaaccggctaacaactcacctaggggcagacgggacaaaggaaccgggccaaaggtatacagaatagccacaccaacaccaatcgcgccgatcacgagcagactaaggttggtgcgcatgaccaaaatgatgcctaatatgacactcaccagcaaaatcacgatggtcaaggcgagcatcccccacggtgacaggtgctcacggccaataatattttgccgttgctgatagctttgatctttggctttaaaataatcctgaacattgttaaaaccagtcacaaacaaggcaatcgctaactgcgcaagcccatagatcaggctattgacccatgaaaattgctgaaatgcccagcctgcatagctaatgcccagcacaaatggcaacatgctagccgccttagcgggtaatcgaataaattccagaaaaagtggccaagttaaccgatgatatggttcgctcataggatcgcccccattcccaagcccaagaccagtaaaccattttcaataacgagattgatgaccgcagtatgaaaagtacgctgtttgctggggtcacgaatgaatcggtggacatttttgatcacaagcggccaagcaagttctatcaccaacgtccaagctggcaatgcgccaaaaatgacgccaaaaataatggctaaaaacccaacatacgccagcagcgcatacacgcgtggcgaccaccagctacccaaatacatcggcaaagtgtgccggtgattacgctggtcctcatcaagatccgacatgttattggctaacataatattagcaatggttgccataggcgtcacgcaagccagccctaatgcaatgatggcaataaagtccccgcgcaagacaacattcggccacccaagatccagtgccagcaatcgacccggtgcaatattgacatacgtggcaatcactggaatgcccagtcccataacgataccagagaagatttcaccaagcggcagccgtgacaacggtaacggtccccatgtatacaaaatgccaatggcaaaacaggccatgcccatcaataatagtagccaatctgtccgccaaaccagcaccaagccgatcaatgaggcgacaatcagcataccgataatcattttttttaccagcttgggcgctaaatttgcccgaccaatgatattggtggttgtttgataatgtgtatctttagccttacgataatccatcaaattgttaagtgcagtggtcatcatgtcaaaaagcagcatcgccataaaaaacaggatcgtattcacggcattaaaagtgtgaaaatacgtcaccgcaaataaagtgccaatcgcaaacggcaagatactcgcaagtttcgtgcgaatttcaacgagctcaaaaaataccgacaacggcataaactacccccttatttttttaacgtcgcaagtgtatagcctgaatccttcaaaagcttaaacttgtccttcaaccctgagctgacataaacctttttatctttcgtaataaaaatagcatcggcatacttcagcttttcaatataggccatcccaccagctaagcccttgtcaaatgttgcggttgacaaggcatcgccatcgacactctttttggtcacaatggaaacgcccattaagttattgtcgaacggatagccggttttaggattcatcaaatgcatatagattttcccatcgaccttgagataccgttcataaataccagaggtcacgaccgtcatgttgctagctggcagtgtgccgatagctgtcccgcgcggcttcttcggatcttgaatgccgacgttccaatcttttttcacattctttgggctcttgcccatcacataaatattaccgcccaagtcgatgatcgcggtggtcactttcttggccttgagggttttaacaacttcatccgtaataaacccttttgcaatcccgccgagatcaatcgccatgccctttttcttgagataaacggtttgcttcttggcattcaaaaccacatccggataatgcaccaaaggcagacgctcatcaatttcactttgtgctggctttcgagcatccgcaaagcctatgtgccagagactggtaatcggaccgattgccaaatcaaaagcaccctcggaattttcgctgtaatgtttggcagcagcgatgacacgataaacactgggggtcacgtgcacaggtttgatgccagcatttttgttaaccgcatccacctctgaccctttttgattgaccgtcaactcatcagccaattgttggacgcgggcaaacgccgcatccaaagcactttgcttgtccttgtcatagattttcaccgtcaccacggttcccatcagaaactgggtatccgaatacggatcgccttcgactaacgtgcgctttgctgccgttttgccggcacaggccgttgcgactaatgccagtaacatcagcagaacgactacaaatcgtttcttcatcattttcctccaaacgtccgcagactttgaaacctgctcgcgctctgtcattatatagggactttgcggcataagaaaagaacctgttcaaaaaagttctgaacaagttcttacttggttgagcaatcgtactagaccgattgcatcaccgaacgtcacaaaagtgtgacatcacattagttgttataaacaatattgtcgacttcaatcttgttagtgttgccattttgagcagcattgacaagttggtcagcatacaagatgaaggtatcggaactgtgggtcgcaccggaaacaacatcaaccttggctggtgactgtttagcaaccagtgacttattcagttcaggaatgtattccttagggccgactttgttgaccttcttcatatttgcttcgtacttcgtatcaagcgtcttggacttgccatctttgttgatgttgtcgtagttgctctctgtgatcttgccatccttaactgtgatggagaaggtgacacgataaccgttgaagtagttcttttcttcaagtgtgtaggtcccgtcctgcatcttgccggtgttgttaacttcgattgtctttgtatcgccagcttgtgcagcttggatcaattgctgtgcatagttcttaaaggtcatactggaatcagtcgcaccagagataacatcaatagcgccaacgttggttccattcttttggaaggacttgttcaattctgggatgtattccttcgggccaactttaaccttagccttcattgccttttcataagcggcatcctttgtcttggacttgccgtctttgtcgacgtaatcatatttagtagaagtaatcttgccatctttaacggtcatcgccatttgtactttatagccatgatcatagccggtttcatccaacttataggtgccatctttcagtgcaccgccagcaacctgtttctgtgatgatgatttcttaaccactttgctgctagatgctttactgcttgttgaatttttactgctggaactactgctgccacatgcacttaaaactaaagcagacagtgcaacaacggctgtccccgtcacaactttacttaacttcatgacatttaccccttttgcagttagttactgcgatattgtgttttcaatcacataattagtttagctagtcacttagaaaaaatcaacttattacgggtattataagcgctttctcattttctaatatcgcgacgtagaccggatttctgtgtttttttacacaaaaatgttcggatttagaaaaagacgtccggaacgttagacattaagtaaaattaaaggctataatggcttagacacatacttgtgaatagtatggtaaagcaaatggtaaggagtgttatgcatggcgaaaaccaatatcgtcgtggttggcgcggggtttgccggggtatatgcgacaaagcacctggccaagcactacaaacgcaataaagacgtgacgatcacgctgatcgatcgccactcgtacttcacctatgtcactgagctgcatgaaatcgcagcggatcgtgttccggaagatgcgattcaatatgatttgcagcgcctgttcaaccggcgtaagaacgtcaaggttgtgacagacaacgtgacaggcattgatcgtgataagaaagaagttgtcacggaaaatggcagcttcccttatgattacgtgatcttaggcatcggttcgcagccaaatgactttggcacaccgggcgttgccgaacacggtttcactttgggtaagtgggaagacgcgattcggctgaagcggcacattgaagatgtcgttcgccgcggttctgaggaacacgatccagcaaaacgcaaggcattgttgtccattgtgattgttggttccggttttactgggacagaaacaatcggtgaactgcgtgactggcgcgacacactggcaaaacagtacaaacttgatccaaatgaaatccaattcagcttgatggaaatggctccgaccattatgaacatgctggatcgttcagatgccgataaagctgaacgttatatggaaaagcgtggcatcaaggtcatgaagaacactggcgttgtcggtgttcatgaagaccatgttgatttgaaagacggctcaactttcccaacctgcaccttggtatggacggctggggttaaggcaactgaccaagcgaaggacttcggtttgaagcaaggccgggctggccggatcttagtaaagaacaacatggaatcccaagacgatccaagcatttatgttgttggggatgtttccttagttgatcaagacggtactggcaaaggccaaccgcaaattgttcaaggtgctgaagccactgcgctgactgctttgaccaatattgaagctaagcttgaaaacaaacaacaagttgaatacaaagcgaactattctggcttcatggtcagtctcggttctaagtatggcgttgctaacatcatggggtggctccatctttccggcttctttgcgatgttgatgaagcatttggtcaacatgctctacttcatccaagtttattccggttattatttattccagtacttcatgcacgaattcttccggacacgtaacggccgtaacatgttccgcggccatctgtctcggcaaggtaacgttttgtggacacttcctgcccgcctcacgttgggtgccatgtggttgattgattgctggccaaagattcaaggcaaggaatcatggttcattgataaactgcgtttgccgttcacgtggctgcagccagccgcaaccagtggtgcttctgctgctggcgccgacgcaaccagtgcagcaaccggcgctgctgccggtgcagcaaaggcaacgaagactgtcttctcactgtcctatcagtatggaaacgatccaatgatggtctttgaaaagatgccaaactggtactacagtatcaccaaggcattgattccaaatcagcaagtcgccttctttatgcaaaaagccatgaccatcatggaaatcttgattggccttgcattggttgccggcctgttcacatggttgacctctgcagcgactatcgcctttgtcggtgtcttctgcttaagcggtatgttctactgggttaacatctggatgattccaatggcgttcgcctgcatgaatggttctggccgggcatttgggcttgataagtgggttgtcccttatctccagaaagtcttcggtaaatggcgttacggcacaccgcgatccttgtacggtaccgacacgcttaaataactgtctacacaaaaggctctgggtggacttacctagagtcttttttcaagagcgggaagctgttgtgaccatcttttccggccataactgctccccgtccttcgtgttcaggcgtagcataaactgcatgccatgaacatgaacttatccagcggtttagattggagcaccagcatgaaacagcccagcacattcaaacgttatctcaaaatgattcggcctttcgattggatcatcgttggcggtctgttccttgcggccttcattccttatgtcatctttgcggtacacgagaatcagcagcaacaagctgaaccacaacgtgtgctcacagctatcgtcacgcatgacggccatgaggtttaccgcaaacgactgactggccataccggcaccagtcgtttcacctaccgcgctaaagacggcgattggaacaaaatcgaagttaaagatgcaggtgtcgcaatcacagaagctaactgtcaagatcaggtctgtgtccggcgcggacgcatcaccaagcctgggcaaaccatcgtctgcttgccgcataaactgctcatcgaaattaaagcaaacaaaggcggcggaagtacagggggtatggtgactgaatgagcacgtataaagctgaccgtacccgacaatatatttatattgccctactctgcgcccaaggggtcattattggcctccttgaacgcatgattccgttcccgttcgcctttgcacctggggccaaactaggcttagcaaacctgatcaccatcatttctctgtttacgatgtcgatccccgacagttttatcctaatgtgtctacgtctcttgctcaccaccctacttggcggcacgctttcaacattcctttacagcggcgctggtgccgtcttgtcttggtttggcatgctgctcatcaaacagttaggtgaaaaacgcgtcagcatgatcggcatctcggcagccggcggcattttgcacaatgttggccagcttttagtggcatcgttgatcgcccaaagctggactgtcatgctttatctgccggtacttgcttttatgggcatccttgctggcatcgcagtcggcatcgcagccaactttctttttgaacacatcgatatcttgcggcgactgcgctacgaccgaaccaagcgccgcaaaaaaggagctacacatgaaaattcatcccatgtggcatgaatacccaacgttagcgccggagctggcttcagcgctagccatgatcgaaaaacagatcacgaccaacaacacaccggtcgccaaggcaatcatggagatgatcaatggcggcggcaaactgttgcgtcccgcttactgtctgcttttttcacggtttcaagacgttgatcgcgagaagatgatcgccttggcagcggccattgaaaccctgcacacagcgaccttgattcacgatgacatcattgacaaatcgcccacccgccgcaatcaggtcaccatccagaagcaattcggaccagacacagcggtctatgccggcgactaccttttcgttgtctgcttcaagttactgtcgcattatgcgtcaagcttacgcagcattcagcaagacagcggcagcatggaaaagattcttaaaggtgaactggatcaaatggccactcgctaccaaaccaagattaccatcgacgactatcttaaacaggtttccggtaagactggccaacttttcgccctcagctgcttcatcggtgcctacgaaagcggcagcagtcccacctttgctaaaaacgctgaaaaaatcggcatgaacattgggattgctttccaactactagatgacatcctcgattacaccagtgatgacgacactctcggtaaaccagtgtgcgaagatgttcgcagtggcgtctactctgcacccttgatcctggccatgcaacgcaatcggcaagctttcttgccactgctagcaaaaaaagatcagatcaccgatgcggaaatgaatgaactgcgccagctcgtcatccaccatcaaggcgttgagcaagcttacgccatggcccagaaacgaactgaacaggccatcgccggtttgcaaaaactaccagcaggcgctgcgcaggatgatttgattcgcttgacgcagagcttgttgaatcggaaagcttaattgaactggcgtgatcgtagctgatggatcgtaattcctgtactggactcgtgactcattagaatccgcgtaatctagtaaaggtctaaactatagaatcctttgccgtgccaaactccgcaatctccggccagatgggtggcgacgcgaagctagagctgtgacggcgcttcgagcccaaagcccggtctcgaagtcgcccaacaacatcagctccaagcccggtcgctgtgttgtttgcacggctgagccccatctggcctacgattgctccgccttggcagtgacgtctttaaagctgtcttagtaatttaaatttatccatgcagaaacaaaaaaggtacagccaaaagtagttgctctttgctagcagcatacttttgactgtgcctttttaattttgttggatgaatggctcgccgtcagccattttccccatacttaagataaagcccttggccattggtcacttatccaaacggttgctggcagcgcgatcacatacacgaccaaatcaaatgaggtaaagtgcgtgtcatagagcttaaaaagataaacgctcgttaccccaagtgatattagtttgtgctgccaaaaccatcgaaggattttcttcatgagtgaacctcattttgactatctgactcgctttggttatctatgaaaccgataaccatcaccgtttgacattattgattgtcgccgtcgtgcttttctcgttgtgccataaaataggtgtaagcaacctgcaacgcccagataatagttagaaatacagccaagatcaccgttatgaaaacactgcctgatgtccatgcaatcaatgcaatggccagcaccccaaaaggaaacatccacaaggtccgacgaagcttgccacgataactcatcgccaagtaattgaagcctcgatccttatttttattttccactagtgaaccccctctcgctgaaaagatcggttacaaataagagcttttgctaaaattggctctcagcatagcatgattgatttttacagacaacttttgatttacactagtagcaaaaagacaagacgcctcagccttcaataggccatacgccttgcctttatatcaattccatcacttatgggtctgcgctgcgacttctttgccaaactcggtttgatcaaaatgatcgatgatgtccttaagctcagcgtatcgcagactggcgccgaacaatggactacctggttcggtcatgatgccgtctgccaagttattgtgcacaacggtatcaaatcccatatgatcgacaaaagctgccacagtagcgactgcctctggatcgttgccggtcacaaatagtgctttgcgtttaggatcgcctttgggccgcgcctcttcttgcaaattgtgatagcccatatgattgaatgccttgacgatcttggcatctttgaaataggtctgaacttgttcactggaagtcgtacttgggtctaagacttcttcgcgaatgccatctgtttcccaccagtagttcattgcatcaatcaccaacttgcccttcagcaagtcggcatcaatgttcttgtaacgactgagtggaattgctaacaagataatgtcactgttagcgacaacatcagcattttcggacggaattgcgccaggaacgagtgttttaatggttaaggcgatttttttgactgatcccgaaccggaaatacgtaccgtatagccagcatctaaagctagaccagcaaggacaatgccgacttttccggcaccgatgacaccgacacgttgaatagccatcatttcaccgccgccttttctgccagaatttccttgacccgcgggatgactttcgtaccatacagctcaatcattcgttcgcgctgtgccgccgtttgattaccagccccgtaaacaagatcaaaccggccgagatcaagcaagtcaatggtcgccgccatgcgtcgggccacggtctctggatcgcccacgtagaaagagccgaccttggtttcgccttcaaactgttcacgactcatcggcgcccacccacgcattaagccaatacgatcaaaattggctttgatatttttaaacgcaacttcaacggcttcgtcttcgtcatcggcaatgaaaccgtgggaatggacagcaatcggaaattccggtttgccgagttccttggccgccgcgtgatataactcgatatacggcttgaaccggctcgcctgaccaccgatgattgcgatgatcactttgtagccaaaattgacagcacgaatcaccgattccggcgaaccgccgatgccaatgtaagtttcgagtttgccgttttcggttttaggatagacttcctgatttttcaaagcagctcggaatttgcccgaccaagtaaccgccttttcattgcgcaaagcatcatacaaccccagtttctcgttgaacaagtcgtcataatcggttaaatcatagccaaataacgggaaggattcagtaaatgaaccccggcccaacatgacttgtgctcgcccattggacagtgcatccaaggtcgcaaatcgctcataaactcgtacaggatcatcggaactcagcactgtcactgctgttgcaagtttaacctgtttggtgaccgccgaaatagccgccaaaaccgtttccgggcttgacacactgtaatctggtcgatgatgctcgccaacaccaaaaacatcaatgcccaagtcgtcggccagcttcccctcgcgcacaatttgccgaatagacgctgctgcagtttgcaagctgccgtcttcatttgccacgatgtcaccaaaagtttccagtccaaattgtaaatgctcaatatctaccatcgaaaagcctcccaaccgataatacttactttttgtaagtcgatgatattatcataggcttttttaagatgcatggcaacctttttggggatgtctgacaacgcgatcaaataaaggataggactgaatggtgaaaaacgagtgtattgtcaaataagccgatgagaaggttacagtcacagaagtaacgtcaaatttgacctgatacattgttttgttcgcatgccacttcaaaaaataacgaactcttcagcagacaattctattaatccttatgacttcaaactgatcagtatctaatgatcagtaggtcaccgctcactgtcgttggaaagtcagccgaaactcgtccaccagtgaaagcggggcaatactgtacggaatgtcatttgtcataagctcaagaacaagtgacttccgcgttgcataatccaactttgttaaatcaataagggcctgattttgatacgcgtctagcacagcatctttattaatgcttgctactaaatgcggctctagccgcattttcaaaaagttgttctgctgttcatgcatattcaaatctttaacaactttccctgcacgaagaaaaagaacccggtcagcaagcatctgtagattgtcaagtaagtgagagaccatgatcaccagcttgccgctttctcgtagttgctgaatttggcttgaaattagcgccacattttctgggtcaagcccattcatggcctcgtccaacaacatcatagaagcatccgagacaaccaccatggcaaaacataatcgctgtttcatgccaagcgaataagtgccaactttttgcgagatataagtctgcatttttaaagcatcaattaattcatcaatcgctctccgactttgccacatattcttgtacagtttcaaatgttcgtaaccactcaactcaccaaaaagttcgttttcaagaggaaatgcacaaatcttttgatgaatttttttagtcagtcgattattgtcatatcgaaggccatcgatctctacatacccatggctaggtgttaggttgttcataatcacatttaagagagtcgtttttcctgtgccattaggggcaacaagtccaacaacttctttttgatccaaagtgagtgtgatgtcatttaaaacgtgcttcttatttggaaaggataattcaatatcttttaacttaagcatgctatgacaaccttgcctttctggtgtgacgtttatgagtcaggcaatatatgacgacttcaaccacgattaaaatgctcatgaacagcatcatcccgaacataaaagtcatctttgtcgtctcatatctaaaattctggaatccaaccaccagttgcccaatattgaagtaacttggtaacaagtacagagaccagttattgatggataccaaacccgggacaaaataaaaagtttcgctaacgagcaaaagcgatgtcatcgcaagactagcaaactcactctttaatactaactgtaatacgatttgaagccggataatgagccacatacctagcagtaagaggacaaaagcttccaacataaaacgacccagcgaaattgtggtgaaggatatgctttgatacacgggtatgggtagtgtcaaactcccaataccaaaccttagcatgttacacggtaacaaaataactaagaagccaagaactaatccgccactcatcagtaaggctgacaaggacttatagttgatcattccccatgctgtcagtggtaggttccttagaattgacgttttctttctatctcttgtaaccaagtcagtgctgatgatcgcggtcgcaatcagcaaagctagcgcaagtccataaaagaaagctcgctcaagctgttgtaaggccgtctgttgattaataaccgccgcatttatgtcgttgtccttcatatgagcatactgctgtaaccgagttcgcgcctctaagttccaataatggccatttcggctctggttacccgatcctgcatcacggaccacgtttggatcgttgtagtactgaagcggataactaagccatggctgcccttgaagaactaagtgatcggtcaacaacagttcgtcattcatagacgcggccactttcttatagtctccttttgctgcagccgctaattgcgcacgctcagccgttataaactgaggaatatatatccccgcattagcaattgtcggatagttaggaaatgccggtttaaaagttttcatgaacttttcgttttttaacagcttatcagtgacttcctgtctcgaaaaattttctaaggttccattttcaggtaagtattgatagcagaaccacaagctccatgcaaaaaagattaaacagacgccccaattcttcttgctgagaaggttttgtttgagctggaaggttaaatatgaagtattcctagtcatttctcgcacctccctgtctcgaaagtatgaagaaaatagccaccgaccaaatcaagatcataaccataccagtaagccaaccaaccgggagatgatcgttcagcaaaaatcgtcctgaataaacataagcgatatttaaataaggaattggcgtcaaataaagaaccaaaggtaatgtctgactaaacgtgacgatgactaatattgtcatgattgaaagaaccgtggcataaaaatttttagtgagcttgttcagccaaattgccacaactgacataaagattgttatcgctagtgaatagagggcaattaataagcccgcaagccaactaggcattgtaatgacactattcattagattaaaggcagtaggatagttccaatcaccaaatccagttaccagtcccataagaagcaacgccactgccggaaaaacaaggaacaacccggcgctcaattgaagatttgctttgatatgagcagtaaacttttcgaaaaaattaaccggcatgttctttagaatgcttttgtgctctagctccactaaccacgagtcccctactaagtaagcaattagaaaaggtgcgcagattgcaattacctgaaataatatggcgccatagtcagcggcattttgaatattatgtcgtggtgagtcatgacttttctgcaacctctgtgcaaccacaagattgccgatgacggattctttagcaggtattagaagcccttctgcaccggcaaaattaagggagtagcttttgagctgtgcttgcgcaagttcaacctgaccattgagaatcatactggcatcctgtatgagcaaaccactatcaatcttccctgctccggaaagttgctcattcaatacctgttgcatcctccctttcttgctcgttttcgaataggcgcgcgcatcatagcgtaaatagcttgattggacggactgttgaattctaaaagtatctatttttaaatcagcaaccttttgaaacttaatcacaaaaaacaagccaatgactagaaaaatcatgaaaagttctacaacaagatttttctgattaaaagtgacctgtctttgaaaaaaagcgctcaactgtttcattttaggattcctctctgcctgctcttcttgattttatatgaaatcaacttaaaaatgaatataaaatgtgaaaatgagcttcaaatgtgaaaatcaagtattactagaaagtgaccgtgcctacagaaactccgaaggcttttagcctaacaagtaattggtttgtggctgattattttatgatggtattcctaataagcaaactggcctacactaaaaaggcaaggtattccgcttctgaaagccacggagtcttgcctggaatttaaatattctattatggatcaatggcagggaatctccgctttgacttgtttgcacacctcggtttgatctaataatcaatagggactaatagcccgatcccaaatggcaatagcaaaatgatacgaaactgtttcatctataaaaaatcttaccaacattaaaaattcagtgctttcatgttttgaaatggatcaccatttagaacatccttcgtgaattatctcaaaatcaaccagttaagctctatacttaaagtagattttaccgacaataaccgcaatgatgatataggtgtcaagggcggttttgaaatgtaggtttatggcggtttaaaaatgtaggttttcggcggtcaaccgacacctttcaagcggtacgatttgccggtaatcttcacaacgtggacatggtgaacaaggcgatccagtattgctgcggtaacggtgggattttgaaaaatctcaacccaac

SEQ ID NO: 50 - DNA, 10574 bp, Lactobacillus paracasei
gatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggtctaaaaagtcctcctttgaataaatggttgttatgagttacaaatttatcgtaacaagttgacaagatggtttgcaatggaaatgctttcttgttactctttcataccgtcagtcgagccagcactcataatatagtggctggtgaattaggcaacattccggctacctgaaacgtgaatttgatagtgaattaagatggattcctgcttatattttacaaaaatcaaaattggtccattaaaaagccttaatagcatctttaggttggctagattgatcgcaatatcaatcgtcactgcgatgctggctaccgttttagtccgcaccaatgaaaggcccaaagggcctttcatgaaggcaaaaccgcgttcaattttcccgcgccgcttctctgcgtcacgatcaacttgccgctgcttagcatccatctttttaggcttacgtcctaaacgtggtcccgacaacctaatgcctagtcgttgacagagctgacgattctcgcgggtacgataaagtgtgtcagctaagatttcatcgggataataaccatgcacgtcgaaataatgatcgatggttgttgctaaatcttggctttcattgaacgccttaaaatcaaatcgttcgatatcgatcatgccatcggcaattgaagcatcaatcttgggaccaaattcggttcgttgtttggctttaccacggttaatcgggcgaatccacggttgtgccaagctaacaatccgtcctgggacccgatgggtccgattttcatacatgaacatttgctggtcaaaaagtttacgaatcacagccaatcgtttggtttgcctttcgttaagagaggcaccgtgggccaacagcacatcgatataacgtagatcacgtcggacatactggagctgtactttgatctgcttgcgtgtttccttagcccaacgccgcggttttctagcaaaagcggtccacttagcttttgcttcacgtttgtaggttcgtggaggcttgatttgcaactgatgagccatgtctaataacatttcttctagattgagccgagcttgatttagcagcgaagtatcttgtggaaaacgaatttcaattggcaccgcagtagcgtctgtgatcaagacacggagctcatcatctggcaataagctttggatttgttcgcgcaaggtatcactgatgatatttcgcactagttccgttatttgacccatgcgtcgtctaaaataaaccaaggttgagtggttgaacggcaggtcggttgtgtaggtgtctagcccgataaagtactggtaagccggggtatcacgaatagcggtaacgaccgaacggtcggttagatgttctgcttgcttgatcaaactggcaccgtaaagcagacgaaagggtttagcagcgcgcccacccatctcagtaaaaagaagttgataggcttcatcgagctgttgccacgggagcatgtcggctaattgaacccactcattgtcggaagaaagtggcacaccaaggccgttgttaaaggattgaaatgacaattgggtagcacgatgtcgataagccatgatggtttcctccaggaaaaataaaaagtgcaaggaaaacaggcgttagcccatgtttactttgcactaattataatctttactattctttgatgctaataaagcttgcagttatgctgatttcaccagccactacataatttttataaagacgttacttgattagcatttttatcaataaaacgttcactaaattcagatcgatctcctacgtaggctataattgttgattcggggataaaagaatggttctaaacgtccctcagttgacttttctgtatcattatcatacgattaatttataaaggagggatgatgatgacagaacctattttaattgatccgcggaatttatatcatacttctcaatttgagaagcaggatcaagaaacaccagcacttcaaaagaaaatgtcgcctaagcctgattgtggtgaaggtagttacattggtaatcataaactagaaaaccgccgtgttttgattactggtggagattcaggaatcggtcgtgctgctgcaattgcatttgctcgtgaaggggcagatattgccttgcaattttatcccggtgaagagccggatgcaaatgaagtagcagaatatattcaagaagccggacgcaaagttgtcttgttaccttgtgacttgcgcgatcgaaatgcaccagaggaaatggtgaaacaaacggttgctgaattaggtgggttagatacaatcttgcttaatgcggcccaacagatttcgcaaccatcgattgaggaattaaccatgaaacaagttgaagatacttatatggttaatattatttcgcagtttgccttagttaaagctgctttaccacatttaaaagctggtagtagcattgtggcaacaacatctattcaagcgtttgatccaagtgcacacttgttagattatgcaacaactaaggcagcaattgctaactttgttgttggtttagcgaaacaattagccgacaaaggtattcgtgtcaatggcgttgctccaggtccgatttggacaccattacaactagatcaagggcaaccagaaaatgccctaccaaaatttggtcaagatactttaatgaagcgggcaggtcaaccagcagaattagcaccagtctatgtctttcttgcatctaatgatgctagttatgtcacagctcaaatttatggcgcgaccggtggcggtgcaatcaatctttgatcatacttagttgtcgctaagtgtttcaattactgtctaaccgagtcttggacaaaggaggttagtgaatgaaacgaattgttaaaactctattgattattgtgggcttacttctaattactgccctagtaccgcttattataattggtgcaccatatgttggtcttgatcagatacgatttctcgatggcttatttctaaatatctattcttggcaatatttattctgggtagccagtacgtttgcaatcttgattctaattggaatcgtatttgtaattttttatccacaattacgtcgtcaatttaaacttgattctaaaggcggacatttagtattagaacaagaggcaattgagggttttgttcgttcaaaactgtcagctagggatttcattaataaacctaaaattaaagttcatgcaactaaacgtaaaattcgcgtaataattgatggtcaattaaaacgaacctcatcattaattgatcaaacagaagcctttcgttctgagttacaacaagaattacaacgattactgggaactaaagaacaagtgattgttaatgttgaatttaatgactatcaaaccaataagcaaactactggtagtactcgagtggtttaaggagggcataagatgaaggctttttggcggcactttatgttccccattattggtgggggtctagggttatttttagcaatattatttgtttcgattggtttttttaaaactttattactgattattttaacaattattggtacgttaattggattttatgttaaacgtctaggaattttggacgggttgttaaaacaatcagatgattattaggaggataaaaaatgacacaaaataatcaaaatggattagatacaagaaaagaatcattatcaacaacaaaccaaaaggcagctcatttacgcagtgattcagataaaacaactgatcaaattcgtggtaaattaacttatgacgataaagttgttcaaaaaattattggtaacgccattgaaaagattgatggcttattagatgttaacggtggtttctttgctaatattgctgataaactggttaataccgataatgtgacttctggtattaaaactgaagttggtgaaaaacaagtcgctgttgatatggatgttgtgattgaatatggtcgtgatattccagaaattgcagacaaagttaaacaagttattcatgatgaagtggctaaaatgacccatcttgaagtgattgaggttaatattaatgttgttgatattaagaccgaatctgaatatgaagaagattctgaaactattcaagataaagtaacaaatgctgcgaaatcgacgggccgttttgcttcaaagcaaacggataaggcaaaggaagcaatctcacaaggaacaaataaagctcaagaaaaagttaaagaaaatactgaaccacgagttcaataaaaaggaggaattatcatggcttggctttggtcattaatcgtcggtgctattattggtgtgattgcaggtgcaattactggtagaggcaatagcatgggctggatcgctaatattattgctggtctgattggatcagctattggacaagcattattaggtacttggggaccttctcttgcagggatggcgctaattccatccattttgggtgccgttatcttagttattattgtttccctcattttgggtcgcaaaaaagcatagcctaaactttaaaaatattgtttagctaaagaaatatccctcgtgctgttgttattcgtgatgaatatcaaatagcacgggggatattttttagtgaatcaaattgcttctcttttttcaattctggattgtgctggtagcgtcaagaatcttgtgtaaatgaaatgccttcgtacatataatatgtatctaacttaaataaatgatgcttccaaggtgtcctggagtcctttgaaccctcggtggatccgcttcagagacttctcgttataaacattaaactgagaaaccaggaagcgatccagtgaatcttccgttggaaattgttctttgtggtgggtggtgcgcttgagatgcttattaaagttctcaatcaggttagtggagtatagtgattgccggatagctggtggaaagtccatgaaagtgagtaaattcggcattttaagcagatctttgattaatttgggataggtctgatgcctgttgttggcgaactcattcagtttcagttcggctgcttcacggttggcggcccgatgaacttgtttaaagtcactgatcacggccttgcggtcttttacgcgaactttgttcatcagattccgcccaacatgaaccaggcaacgtggctcctatgctgtaattacgcacaaaaatagtttgtgcgataattacagcataggagccgtactgatcaatccgctcgttaatactttgcgcatctctattggccgcctcttgtgttgtcatgttgcttacctcgaagataattatacgaacatacgttctacatgcccagcgtcttttgccagcagatccataacgccaaaagaccaaccgcgagtttcggttggccttttaaggtgttggtataaagttcaagagattcaagcggaacaagctcagcgtgatgacttctcggcatctggcagtttgacgagttgttgcgattcttcagaaattcgatctttgattcaatgctgaacttaagcagccggcgaatctttgggcgccgcttcggcccacttttcggcttggtagcatatgtggccgtgattttcctttcgtgcgcagcgatggcgctttgttgctctgtggtcgcatggtcgtccaagaattttaacatttttacggcaggaacaattttaccattgctgtactctcgaattttgtcgtgcctaacataagcaatcacggcaacctgttcgtcatcgtcacaccctgggaccaacatgagatgtcctgccacgtgttctgggatctctaaatcttccgggacgagccagcggtactgcttaggcgtgatgccgtcagcagtcgcgaagtaccgaatgacaatattagcctcacccagggctttcacagtgcattggccatgcggcttcttccatgccttcagggtagcgtgcgttcgatcaagtgaggtctggagctgactaaggttctgttgatgttgccgggcctgcgactgaattgccgctttttgatcaagcgacttggcctggtcgatcgcggctttgatctcatcttctgattgggcctgtctcagttgcttgagcgttgcctgaagggttttatcatcaaggtggctaagctgacggacagctttggctgccttgtctcgttgctgtataagacgtttttcaacctcagccgggtcttctactttgttgatcgtaaaaggacgatgtcgatttggccgccctcccctactcttcgactcaatgaacttcatgttgcggttactgattttaaatttttcggccttagaatacttctccgcacatgatgttgcattagtcaagggacacttcatgatttccacttcgagggaagccaaaagatttacacatttacacatgtgtaactttattattgctaacatagcaggcaatttagattgtgtgtaaatttacacatttacacatgtatcaacgacttctacgctcgtcagttgctttaattctttcaatggcttgctgataaagacgtaattcgtcgggcctatcggcagaaatttctttaacagctctatctactagctcagcaattagttcatatacatacttatttggcgacagttcgagaagtgccagcagttcatagtattgttgtcttggaattcgaatggttctgcgcgcatctttgactttatgcgtgactggggttgtctttttttcagcactaggatcaaaagcttttagaccagatcctttgtatgtctccttgaccggaatatcttctttataagccatatctggagagtgcttcttttctttattgaagaatccgatagtgtttttctttgtgtcagccattggttacttcacctacaatctttagtctttgaagaaagtcgtctgttagtggatctacgatgtcatcaaacaatttctggttccagtatccctgccgagagaggcccattctcggagcggcttgaatacgacgtgcaaagggaatgatgtgatcgaatagattttgttggccaaaacgggcaatagcgtctttaatgactacttgatcgattgccccacttttagaaacttgattaggaaggattccaagaacgtcagttctagccccaaaggtttctacaagttcggtcaagtcatcgcttatgaattgaatagcgccatcaaggctatcagactgagtttgaaaagcaataatgacataatcactagcaaatgtcgcatttcgaacatattgtccggcagttggtggtgtgtcaatgaagacaaagtcataatcagctttgataggttcgataagccccttaaggagagaaacttttttggattcaacggaaagatattcgggatcacctttttctgcaacaccgtatttcttactaagaaaggtttcaaaacctctaaagtcaatttgagatggtaattcgtaaagattaggtacgatttcaagaacagcgcctttaaagcttccgtcacgcacagcagccatcattgacttatcaattgtaaagatgttgtctggatcatgttgttgtttggtgatccccatggatttcgtcaaattagcttgggggtcagcatcgatcacgagaaccttgtaaccacgttctgccaaatcataaggaagatagcgcgtgatggtcgtctttccaactcctcccttagcgttggcaacggttattgttagcgggcgtttgagatttagcttggattgcattaaaattcctccaactttatgtgtaaatgtacaaatgtgtaaatgcgtaaatgtgtaatacaaaaccacagtcgtagtctatcacattttcacgtatttgagtacacatgtacacatttacacataaagatcgttttaattattgtaagaacgggatatatttctgaaatgtgtaaatgtgtaaatgtgtaaaaggtctgcggatatttttacacatttacatatatgtaaatgtacaaatgtgtaaatgtgtaaatgtgtaaattcgaatcaaaaaaccaaaaaatgctgttgcaccaggcttgctagtactgtactgtctagataaagaaaaaagcttcaaaccaactgcaattggtttgaagctcgctgaatataacctcttgataaaactaaatgggcttttagtttttgacactctgcgtctctggcaaccgtatgcgcctgcgacagccaaatgtgtctatattatatatactatccggttttcgtctatttttcaagaggtgcatacggctatttgagtgcaccttcttgagaaatgggcggcgcctgtctttagccagattatttttgttgcgacaaagggcaatttgggttgaagtgcaaagcgaaaaatacaaacgcgataagtttaggaaaagcccatttccatatcagaaggtggagtgggccttttttgtgcccaaatctggtgaaaggagttggcaagcatggatgtactgggcgcagcaaatctttctgaagcagccattgtggcaatcttgcatcacggtttggcccgcagcaaatacaaacatagccaactccggccagaggatcggcaaggggcgcggccgactggtgcgatcttcttgacccggaccaaggatgatttacgtgaggcgatcgggtttgtcgcgacaagccaggaggcagtcttggacaacgagacatgcagtcattggacgcccaatattttccgctttggcacctatgcggatcgtcgctgccatgtgctcaaaggtcattcggaagacaacctgaagcagatcaataccttcgtggttgatgccgactttggttcgggaaagcccagttacgacacggcgctactgaacaaattcattgtgaaccaaaacgatcaacaggagctttggccaacattggtcctcgaaaccccccacggttaccaggcttattatgtgctggatcggcccgtctttgtacgccggacaggtgatcagttgccggcagttacggcggcgaagcgcgtaagcgaagccttgcgcgctgctgtggctaaagacttgccacaagttgatgttggggcaaatcactttggatttttccgcaagcctagtgaagagaacgtctgtttttttgagccggccctcacccacgattttggcgatcttcaagattggaccaagttacaacatttgacgtttcatcatgacaacaaggcgcactaccccgtcaagcaaacggaccagccgtggtttattgccctcactcacgctcaggtgccgcgcggcgatggcatgttgggccgtaataatactttgctgacgctgtgcttggctggctacagttccggctggtcagctgaggacgcctatgactttgcggatcaatggaatacggatcaacgggaaccacttagtgatcaggaagtccgccggatcattcggagtgcgttctcaggcaagtaccaaggagccagtgcggcgtatattgctgaactgaccgcaacttacacgcctgatgctccgaaaacaacgggtcctcaagtttggcacaaacatgcgaagccacgcacggaacgaaagtacagtcacttgcaagagtgggcgggcgatttggtggcctacgtggttgaacgggctggtcaggctgtcgaccagatcaaagtcactacccgagagttgcgagatcaactaggcatcagcagtcaggtgctcaccaaagtgctggcttacgtggcggactatggcttgctgaaggttgttaagcagtacgggcgtcatggtgggctgtacctgaccacgcgtcagatgcttggtcggcagcttcaactggatcggcgcgcgcaggcgatctcctggcacgattttgtgacggggcaattgcgcggacgggctcaaaaagaagtggtgaaaggccaggtgtcgttgttgccagaaaccttgacacgaagcggtccataaatgctctactttgccattacatgttctagtttagctgttgtttgctttcttcactgacgagcaagtagaattcctataagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgacgttatgatctttatgacgtattcaatgccatcctttactcgcttactacagggtgtcaatggcgtgaattaccgcacgatttcccggaatggcataccgtctaccgctattacgatatgtggcgagataaaccagacccgacagctgattcgctattagaaaggcttttaaaaaaactgtcgcttcctatcgttttgcacagggccgatcggcccgaacgtcgtttgtgattgttgatgctcaaagtgttaaaaccactgatttaacgaaaaatagtg

SEQ ID NO: 51 - DNA, 166559 bp, Lactobacillus paracasei
  misc_feature (17001)..(17076): n is a, c, g, or t
aaccaccacgtcccgtcccaaaattgtgcgggttgaatatcaccggaaatacgttgagtatcggaagtattcagattaggaaattcattaatactcttcatatttttttatcaaaacttaattatttgccagatggttgttacttaatttaaaacgacttatccgtcatgtcaaatgttttcttttgctatttgaaaattttttaatttcaaattttaatcaaaatgcaattttaaaaaaggaaatttattactaataaatcagttaaattccacgaagcggagcttttgaaaaggtttaaaagatcttacatagaagaaaacgaaaagcgccaaatactttaacgtggcaattattctctgatgagcgactcatttctttgataacgtctgtataaaaagatcaaagctaatagaatgccaattaggccgccaccgatatgagagtacgatggtatggataaccatggatttgtcgaaaggttttggtatgtgtataaaatctgcgagcatacggcaaacacaagcaagcctgatttgaacttaactttcgtgaagcgcttagcgttagcgaacaagaagacgattattgtaaaggaaaataagcccattatagccgtagaaaaaccaatagccccatatgtgtatccaattgttgtcaaaaattaccaaacgtggccatctagtttgtacagataagtaatgaaagtatcagccaataagtttccaaaaacgccagaaaacagaagtaccattaaatattgaaatctagtaatgttggcggatatgatccaagttagaagtgctaggaaaagcatgttgccactaagatggaaaatatctaggtgtagaaaaagcgcggtaaataagcggtagtactggcctgaaaaaacttcaacaggagagttccaacaatatcgagttaggaaaaatgatattgaagatgtgaaaaattctaaatatgtaatcccgaaacagacgatgacgatccaaaataaaggactcgtgaatgtaagcttcactttacttgataactttctcatggtttgtcctcccccacatttcaccaccagatattgtgaatacgaataaaagtagtcggttatctcatcggtatagataactaccttatacttatgggaatggatctacgcgattattaccgccctccatgagtgccgccttcaaagagttccctcagccactcactgaaggggcagttgctagagccggcttcgccatcaccataattatcatcgaggtgagcaagttgaataccaccggagatatattaagcatcggacgtgctcagctcggaaaattcattaatgtatttcataatgttttccaccaagctgaacaacttgcatacgattagttgttaacttaaaacggtctttttacgatgtcaagcgttttcttagtaatattgcttgcttttttcaaacgtttctaatcggattgcaatttgtagaaagtgacctttttactaataaattgttatattacaaaattcagaaaattcgtagaggctcttatatttgtgaaagcattcatatctgaaaattttatttacaaaatttgaaaataatcatggcatattcagcaattgattttttagaaaattcaataaagctttttccctgtgatgagcgaggctttccaagctaagccgcactgtagactgcggtctcggtatggcgcgattgtgatcttagcagtgttgttgtctttgataacgggtgcctgctatcaatctgagcgatgtggccattgagaacaagagctactgggacacgacggtcaatttttagccgaacgcatcctcttatgagaagctgtcctagttagttgtcagatctttttttattgattaaggacggtcagctgatcctgatattgctgagctgcggctgatagattttagcctcttctgggttagcagcagcatgataggtctgactggcgtatttgtgaaacccccaaatatctgctaatatatgtagaaatcttttaagcgaggtataaaattgctcacagtaaacaatgtatcaatgacgttctccgaccgtaagctatacgaagacgttaatttgaaattcacgcccggtaattgctatggcattattggcgcaaacggcgcgggaaaatcgacttttcttaaaatcatccaaggtgaactgaccccaacgactgggacggttagtttgtcgccgaatgagcggatgagcagtctgcgtcaggatcactttgcgttcgacaatcaaacggtgatgaacactgttttgcaaggttgggaacgactttatcaggtgatgacagaaaaagatgctttgtatgctaagccagacttctctgaagctgacgggaataaggcagccgagctggaaggcgagtttgccgaaatggatggctggaacgctgaaagcgacgcgtctcagctgttgcagtcattgggcattgcggaaagtgagcaccagaaactcatggctgatctgcctgaaggggagaaggtcaaggtgttgctcgctcaagcgttgtttggcaaacccgacgttctgctgctcgacgaaccaaccaacgggcttgatccgcaagcgattaactggcttgagaactttttagctgactatgaacacaccgttttggttgtctctcatgaccggcatttcctgaatgcggtctgcaccatgatgtgtgatgttgacttcggtaagatcgaactttatgtcggcaactacgatttctggaagcagagttctgaactggccttgcaactgcaaagccaagcgaatgctaaaaaagaagaacagatcaagcaattacaggaattcgtggcgcgtttctccgccaacgcctcaaagtcaaagcaagccacttcacgtaaaaagcagcttgaaaaaattacgttagatgatattcggcctagcacacggaaatatccgtacatcaagttcgaaccagaacgcgaaatcggtaacgatttgttacgggttgagaatgtttctaagacaattgatggtcatgaagtactgaaaaatgtcagcttcattttgcggccaggtgacaaaacagggatcatcagccgcaatgacgtgaccgccactgtgctgatgcagctgctggcaggtgagcttaaacctgacaccggcaccatcacatggggtgtcaccaccagccgtgccgctatgccaaaagacttgaatcctgaatttgatcatgatgatctgaacattctcgattggttgcggcagtttgcaccacaagacgaacaagataacacgttcttgcgtggcttcctcggtcggatgctcttttctggggatgaagtgctcaagcaactgaatgttttgtctggtggcgaaaaggtccgttcatacttggccaaaatgatgctgagcaaggcaaacgtccttatcatggatgattcaaccaaccatcttgatctggaaagcatcaccagtttgaacgatgccttgatcgacttcaaaggttcattaatcttcaccagtcatgaccatcagttcatccaaaccattgctgatcatattatcgaggttgggccactcggtgttgttgaccgtgcggacacaagctatgatgaattcactcaacacgaaactgctcaggcacaggtagccgatatttatccggctgataaaaagaagtcaaaggcgtaattgccgatatcaccttgagcgttacagcttgtgacatcatacgcagttactatacaggcgaacaattttccgcagtcagggaaattgttcgcctgtttgtttgctcatggataacttattggaatttataaagatcccagtgccaaggcggagcaatcgtaggccggatggggtcgaagcgccgtctccgctctagctgcgcgtcgccagccccagctggccggagattccggtgtttgcacggtagggactcttgcatagagcttttctgcattgtttggaatctagcacatcataattgtttgaattttagaattcttgctcatctctacttcaattttgtttttcaaacccatctgatagataatatcagcataagtaaccgacaagataagtgtgtgtgacccgcgcaagttgttattgaaagtctcaccaatctggtcacatcagctaagaaagcagtgatcaatatgtcacaacccattacgattcttctcagcgtcaccggctttattgttgcgatgattgtcctcaatggtttgttaacctggcagcgacagcaaaagctcaagcgccaattgctagctgactggggcacttttcctgaaaaacggccaaaaggtgagcgctatttaaaagccgcctatcttgatcatgaagcccaagttaatcacgattgccaagttgacgacctgacttggcaggatcttgatatgttagacgtgttcgaacagctgaacgtcacccaaagtagtgttggcgctgaacgggtctatgcacaattgcgggcttatgatttaggcaaaccagctgttgacgaggcgttgattgccttttttcaagatcatcctgacagccgattgaaagtgcaaatggcgtttgccggacttggcatcgagccggcgaacaatagccaactttatctacgaacaaccaccaaaaaagccttgccgaatgcatggcgattcaaagtaatgggcggttttccatttatcggtgtcttgttgacgctattgtggccggcaattggggtgaccttgatggtggtcagtttgctggtcaacgtgttctactacattttgaaacgtgaaggccttgatgccgaaattacgtctatgggttaccttgtccggacgattatcaaagcagaacgtctcgccaaaattagccaaccgactcaagcagcattgcgacaagcagttaaaccaatgcgcggcatcacgcgatttgcgtttgtcttccggaccaagaccggcagcatgggcgacattttaactgagtatcttagcatcatgttcatgctgagctttattgcctacaacacagtgctcgatcgcttaagcagccaccatgctgaggcgctagccctgtggcaacggctgggcgatttagagttggccattgccattgctaattttcgcgcggcggaagcgactacaacgcagccagtttttgctaaaggcggcatgaacgctactgacttagcccatccattgttgaaacatcccgttgccaacccagttgactggcagaaaaatgcgttgatcaccggtgccaatgcttccggtaagtcgacctacgtcaaaagtattgcgatcaatgccattttggcacaaacgatcaataccgtgacagcgacaagtttcacgatggagccaggagaagtcatcacggctatggcggtgcgtgatgatctgagtgaaggcgatagctattttgttgcagaaattaaagccattcggcggctgctcaatgctgttgccaaaaagaaacgcgtctatggttttatcgacgaaattctaaaagggacgaataccgtcgaacgaattgccgcttcggcgagtgtcattaattggctaaagcaatatccgagtttggttgtggtcgcgacacatgataatgaattgacggacattatgggcgatcaatgcgtcaactggcattttcaagagaaagtgacgaaggaggatggcgttgtctttgactatttgctctatcaaggcccggccacttcgcataatgccatagcactgttggcaaccatggactatccaacgtccttaattcacgatgcgcggcagttggctgcggattttgaacgtagcaaagcatggcctaagtttgttaaaggagggattcaagcgtgacagatgcagataaaatatttgaggctattcgtcaggatcccgataacgctgactttaccgcccaaggatgggatccgctatatcatattgaacctgaagcaacgatcctcatcgccagtcaggcaccaggacgaaaagcacaaacgacaaaaacatactggaatgatccaagtggtgaccgcttgcgaacttggatgggcgtcaccaaggatcagttttatcacagcggtaaaattgcagttttgccgttagatttttattatcccggcaaaggtaagtcaggtgacttgccaccgcgtaaagatttcgcggccaagtggcatccttctttgttggcgttaatgccaaagattcaacttacaattgtgattggcgcctatgcccaaaaatattatttaggaaagcatcgcgaaaaaacgctgactgccactgtcaaaaatttccgggcgtacttacctgactattttccaattgtgcatccttcgccgctaaactatgggtgggttaaccgtaatccatggtttatgaccgatgtggtgccggcattacaggcgcaggttgcagacttgatgaagtagaatgaattaatgtgacgcgctcgcaggagtctacacataccgaccttgaaaaagtcaggccatcattcacatccctcaaataaatgcgaacagattatcgcaaaaggtttttgtcgtcctagatctcgtgcataacttatccggatataaggatgtcattgccaaggcggagcaatcgtaggccagatggggctcagctgtgcaaacaacacagcgaccgggctttgtcgctgatgttgttaggcgacttcgagaccggtttttgggctcgaagcgccgtcacgctctagctccgcgtcgcaagccccatctggccggagattgcggagtttggcacggccggggatttgttagcctagctcttttctggattatttaggatttgacaaatcataaggtcacttacgttttgattttcaggtgttactgtgcagtcacaaaaaagctgagatcgcggaaacgctccgccgcgatctcagctttttaagtagccttttgcttgaataatttaatgagtgattgaacttatggtaatgtcacgaaaatgagtgcgccaacaacgccgccagctaaaggaccgagaacaggtacccacgagtaaccccaatcagagccgcctttatgtgcaatcggcaggatggcgtgcgccaagcgtgggccgagatcccgcgccgggttaattgcgtaaccggttgtccccccaagtgacaatccgattgcagtgatcaagatgccaacgcccatcggagctaaacctgctgtccatttgccttgcgcaaaagctaataggccaaaaatcaagacagcagtgccgatgaattcagacaagaagttagcggtatagttgcgaatggctgggccggtcgcaaaaacgcctaaggtggttgcttggtcattggtcttcgcccagtgtggatagtaatgcagccagacaatggcggctcctaagaaggcaccaagcatttgggctgcgacaaacggcagcacccatggccaagaaaattgaccgatggcggcaaaagcgatggtcaccgccggattgagatgggccgggccaaggaaagcggcggtataaacgcccatggtgacagccagtccccaaccaagggtgatggcaacccagccagcatcctttgcttttgattggttgagtgacacgccagccaccacgccgtcaccaaggagaatcaggatgaaggtgccgataaattcacctaatgtttgtgtccacatgttgattcctctttctattcaggatgaaccggtgctggtgccgtttttagataggccagttgactgtcggcaatggcagcattcaaggcggccagttgttgggctttcaccgagtcgtcccatcccagtgtttgcgccatttcgtcaacaaccggctgtttcaactcagccagtgtttcagcgtggaaaagaagggcattggttcggcgcaagagataatcaaccggtgtgagcgtcatttcttcattgagtgaataacgcagactcatggtttccttcagacttaatcctggcgcagggccatcgacagcgtaagtgagcactcggctggtattggaaccgaagcggttagccagatcttgggcttctttttccgataaaccagcatcaacgccaatccgaatatagaaggccatggtttcttcaacattggtcggatcaaaatgtccgccggaaacttgcagctttttggaatcgactgctggcgcgtcaacgttgaaacggtcgaccagaatacggcgaatcagcgcgagggcaccagccgccattttccgatagtctgtaattttaccaccggaaagggtgatgagtccgtctgtcgcttggtgaagcgaactgccgcgagaaacttgggatgggcttaatccggcttctgcatgtgctgtttccagtttggaaatggcatgttcaacatcggcgcgggttgcttgatcgtcttcataagcgttcacaacctcgatcaaggccgtgaatgaatcgtctgaaactttgccgctgttagcaccgccgccgttataatcggaactgccgttgtcgttgatcagtggtcgcaacccagcccaactagcttcaatatcgtcgatcgtcatatggctttcggggaagcgtttattgacgactttcagcagataatcgacatcttcttgctcaacgcggggatgttcataatcgccggtataatctgtatcagtggtaccaaaatacgttttgccttctcgcggcaccacgaagaacatccgaccatcgtttaagccagtatccatgtaagttggttgcggaactggcaagcgagaaccgtcaacgactagatgaacacctttggttggccgcaaagttggcgcgtgtttttcgtgatcgtcaagtgcattgaacttatcagcccatggaccggttgtgttgatgaccagtttggcatggatatcgaattcagtgtcgtccaacaagtctttaacatgcagcccaaccacttgaccagcgtcattgtgcagcacgccgaccgctttaacatggctggccatcaagccgccaagttcgtcagcttctttgatgttttcgatcacaaggcgtgcatcgttgttgacgaaatcgagataaacgccaccgccttgcaggttatcagcggacaattgtggttcacgttgaaggacttcatcttttgtcacggtataattggcgtactgagaaccttcaacaccagccaatcgatcatagagatccatggcaattttgacgctgaacatgtcaaacgtactgccggattcttgataaattggcaacagcattgggaatggccgcgggatatgcggcgcgatcccttgcacgacggcgcgttccttaacagtgtcagcgacaacgccaacatcaaaagatttaagatagcgaataccgccgtgtaccaatttggtcgaacgcgaactggtgccttccgcaaagtcctgcatctcaatcaaaccggttttgatcccgctggcagctgcttgaatcgccaccccagcgccggtaatgccaccaccgacgatgagcaagtcgagctcggtatgctttaattgatgaatcgtttgtttgcgcgtttcgttggaaaataccattttgttctccttcattacggatcgagtcagtctcgatcattttttggttgacagatcaggctttcttcgccttgtgcttatacatttgggttgcagcaacagcttgctgccagccttcataaaggtggtcgcgatcaggcgcgcccattgttggttcaaaacgtttgccaagcttcacgatactttgcagttcatcggtattgttccagaagccagtcgccaaaccagcgaggaaggcagcgcccatcgccgtcgtttccaaattggctgctcgttcaatcgggatacctaaaatatctgcttggaattgcatcaggtaatcgttgttagctgcgccgccgtcaacgcgcaaagcttggatcgggataccagtgtctttattcatggtatccacgacatcacgtgactgataagcaagagattgcaaggttgctttgatgaaatcttcgcgagtcgtgccacgagtgatgccaaaaatagccccgcgagcatcagaatcccaataaggcgcacctaagcctgtgaaggctgggacaacataaacttcattttgactcttggaagcccgtgcggcggcttcggagtcgcttgaacgctcgaccaacttcatggcgtcccgcaaccattgaatcgcactgccggcaacgaaaacggaaccttcaagtgcgtaggtcaccttgccatcaagcccatagccgatggtggtgagcaggttgttgttggacaaggtcggtttttcgccggtattcatcacaatgaatgcacctgtgccataggtgtttttcaccatacccggctcaagcgccagctgaccaaaaagtgctgcttgttggtcaccaaccatgccggcaatcggcacggtactgccgaagaaatgataggctgctgcattgccgtaaatttctgaattgctgcgaacttccggtagcatttgcttaggaatattcaacaattggagaatctcgtcatcccaggctagtttatggatgttgaacaacatggttcgtgaggcgttggtatagtcggtgacatgaatggcgccgccggacagcttccaagaaagccaagtatcgatggtgccgaaaagcagttcgcctttttccgcccgttcttgcgcgccaggcacatgatccaaaatccagcgaatcttagtcgctgagaaatacgaatcaattagcaaaccggttgaatcatgaatcatatcgctgtggccatctgccttaagtttgtcagcgatctcgctagtttgccgcgactgccagacgatggcgttgtagattggcaacccggtctgtttgtcccatacaaccgtggtttcccgttgattggtaatcccgattccgacaatttggcgtggctgaatctgtgattcaataaacgccgtcgcgatggtcgacaaagcggcattccaaatttcattggcattatgctcgacccatcccggatgcggaaaatactgcggaaattcccgctgtgcatcaacaactttttgaccattgtgatcgatgatgatggtccgtgtactcgtggtaccctcatcaatcgccagaatgtacttctgatcacttgtcacaaataactaccccctgtgaaataatattgtacacaatgaaaacgtttccagaaatagttataccgtacctcgtggcattctgtcaactttaaacttatgcgtatcattagttattttaaaaagctaaaaaaccgatcaaaattctgtaaatgagatggaaatggaggttgtgctgcaaatgagatatcttgaataaaaaaacgcgtggccgatgaacgttttcatcagccgcgcgtattttgcttaggatcatctgacctgctattggatgagctggcgcatgcgatggatccgctcaaaaatctggtcttcctgacggcgatcagcccaagaaaaattgtgcatcgtgctattcgggcgattaaccttcgtgtacaaaatggttggattataagcatatttgccaggcgtatgcgcgacaaaatccgccgtgaagtaatagtcctcagcaatgcgtaattgttcatcatagcgaatattaccggtagttaaagcatcacgagagaaagccttgttccaaatataaccgcccacttcggagccgtggcgtgagacttgatcaaacatttcgcgctgtgacaacaattggaagcgattaggcccgccgcggctgcgatgccaccagtcataaccaaccgcagtggccacaacacccgatgtgaacccgtgtgataacgttccggcaaaggtcggcgcgattaaatcgtcaccgtcaacaaacgccacagcttgaccagtggcacgatcaatgccaaagtttcgcgcagcaccgatgccacgatggtgattaaaaccggtcgcgtgaaaattagggatacctttaacaaaatcagccactgtctgagcggtaccatcagtcgaggcatcgtcgatgagccaaagttcaaaatcaattgtttgttgctggatactttttaatgtctcaggcagataatgacctaaattgtaagttggcacaacgatggttaaatctaagttcgacataattgcctccttgaagttcgttttgatcattatcgtcaaattacgggtaacgtcaatcaaaatgattcatgtatgaagttgggttgttgacatggggaatgctaactatcggcgccatgtggaagggacattctgaacctgctagaatttttagtaaaaggaagttgctttaaattcagcgatttttaaatgaccggtaaaacaaaaacaaaaaaatttggctacagcgcttccaatccgtcattatttttagtaaaataaaaacggttacaaaaatcagtagcggataaataagcttaacttcaattaggaggtattgacggtgaatagtacagatgtcacgaaaggttttacggaacaatttggcaagcaggcggagcacactttctttgcaccaggacgcattaatttaattggtgaacacaccgattacaatggtggccacgttttcccatgcgccatttcgttgggcacttatgcagcggttggcaccaatgaggacaacgcttttcggttatactcggccaacttcccaaaggttggcattattgacatcccattttcagatcttttccaagataagcgcggcttgtggacagattacttccaaggtatggcgcgggtgatgaagacggcgggtgcgaacttcacgcatggcctcaatgtctacatcaacggcaacttacctgatggcgctgggttatcaagttctgcttctctggaaatgctggtcggaacgattctgaacaatctttttgatggcggctttgaaccgttggagctggttcagttcggcgttaaagtcgaaaacgactatatcggcgtgaactccggtgtgatggatcagttcgcgattgaaatgggtcgcgcaaatcaagcaacgctgttggatacaaacacgatgaaatacgagtacctgccagttgagatgggcgataacgtgattgtcatcatgaataccaacaagcgtcgtgagttggctgattccaagtacaacgaacgccgcagtgaatgcgaaaaagcactggcaatgctacaaaaaggcattgaagtcaaaagtctgggtcaactgagtgaagacgaattcgacgagaatacttatctcatttacgatccaatcctgatcaaacgcgcgcgccacgccgtctttgaaaatcagcggacattgaaggcttcgaaagcattgcaagatggcgatttgaagacctttggcaaactagtctctgcttctggggtttcgttggcttttgactacgaagtcactggcatcgagcttgatacccttgtgaccaatgctttgaagcaacggggtgtgcttggtgctcgcatgaccggtgctggctttggcggttgcgccattgcgattgtcaacagtgctgatgttgaagactttattgataatgttggcaagacttatcgtgaaaagatcggctatgacgcccatttctatgtggccgatattgccgatggtgctaagcaactgaactaactctgctaaaatagaaaaagtgttataaagtagagcgtgagccagaccgatttctagtctgacgaacacgttttaaaaaagggagatattttattatgacaattgcagttttaggcggcgctggttacatcggttcacatacggtaaaacaattactcgctgccggcgaggatgttgtggttttggataacttgattactgggcatcgtaaggcggttgatccacgcgcccgtttttatcaaggcgacatccgcgactatcattttctgagccaagtgttcagccaggaaaagattgacgggattgtccattttgcggcgttctcaattgtgccggaatccatgaaagatccgttgaagtattttgataacaacactggcggcatgatcaccttgcttgaagccatgaatcaattcggcatcaagaaaattgtcttctcatctacggcagcaacttatggcgaacctaagcaggtcccaattaaagaaactgatccgcaagtaccgaccaacccatacggtgaaagcaagttggccatggaaaagatcatgcattgggctgatgtggcttatgggctgaagttcgtggctttgcgttacttcaatgttgcgggtgcgatgccagacggttccatcggtgaagaccatcatccagaaacgcatattgtgccaattatcttgcaggttgcagcaggtacgcgaactggtttgcaaatttatggtgacgactatccaaccaaggatggtaccaatgtgcgtgactatgttcatgtggtcgatcttgctgatgcccacattttggccttgaagtatctggatgccggcaataagtcatccgcgttcaacattggttctgcgcatggtttctccaaccttgaaattctaaatgcagcgcgtaaggtgactggccaagagattccagccacgatgggcccgcggcgtgccggtgatccaagcactttgattgctagctcagaaaaggctcgtgacattttaggctggaagccaaactatgacgatattgacaagattatcgaaaccgcatggaactggcacgaaaatcacccagaaggatttggtgaccggaattgaccgcgattagcaatcacgttggtaccattgtgaaactcaatcccgattacacccagatggatgcagtctatctgaccaacaaattgttgaatttgatcggagatgctgcccttgacctgcctggtgatgctgatccattgacgaaccttgatctgatggtgaaagctgcgcaggagaatggtaaaattccagattcacaggcagcacgtcagattttggaagcgcagctgatggaccttgctaccccgacaccaagtcggatcaatcaactgttttgggataagtatcaggcgggaccacgggttgcaacagactggttctttgctttgagtcgcgcgaataattatattcaaacgcgagcgattgctaagaacgttgtttttccagctaaaactgagtatggcgacctcgaaatcaccatcaacctgtctaaaccggaaaaagatccgaaagacattgctgctgcggcacatgccgcccagtctggctatccggcgtgtgccttgtgtttacaaacggaagggtatgccggtcgaactgactttgcggcgcgaaccaatcatcgcattattcgctttttgcttggcggtaaaacatggggattccaatattcgccatatgcttacttcaacgagcacgcgatttttctggatgctatccatgaacccatggtgatagaccaaagtaccttcagcaacttgttggccatcgtttcaatgtttccggcttattttgttggctcaaatgctgacttgccaattgtcggcggttcgatgctgacgcatgaacattaccaaggcggtcgccatacatttccaatggccaaagcaccaattgagacgcaggttgaaattagcgggcatccgcatgttttcgctggcatcgtcaagtggccgatgagtgttattcgcttagtgagtgctgattcggacgagttgataaatgcagccgaacatgttcggcaggtttggaatcagtataccgatgaaacagttgacgtccgcgcatttgttgatggcaaaccgcatcatacggtgaccccaattgctcggcgcgttggttcggaattccagctggatttagtgctgcgcgacaatcaaactagtgcagagtatccggatggtattttccatccgcatcaggacgtgcaacatatcaagaaggaaaacattggcttgatcgaagtgatgggacgtgccattttaccagcacgattgaagtcggagttagctgaagtccagaagtatttactgggtgaagcaaacacgatgaaaccgatgcacaaaacatgggccgatcagttgaaagctaaatatgattggaccccggaaaacgtcgaggctcaaatgcaggcagcggttggtcgtgtatttgcccaggtcttagaagatgctggtgtgttcaaacgcgatgaagttggtcaaaaagcatttgctcgcttctgtcgggcactgtagcaacaggctacgttgctgaagccggcaaggagtcaatggaaacggagaaaacgatgaccacgattacagatattgcgaaggcggcaggggtttcaattgcgactgtctcgcgtattttaaattatgatacgacgttggctgtcacgcccgaaacgcgccaacgcgtgttgaaaacagccgaaaagctggcgtacaaaccacgtcgacgtaaacatgtgtccccgcaaaccaccgttgccttgattcagtggcgcagcgagcaagaagagttgaatgatctgtattatttacagattcaatatgctattgaggcacgggcggcctcagctggctatcatttgcagagcttgcatttggagcagttgggagctgagacgacacaaaacgtccaaggtgtgattgcgttgggtaagtacgacgctggcgaagtggcaacgatcaaagccttggcgcaaccagttgttttcgtggatcaaaatatgttggcatttgactgcgactcggtcaccagcgattatgccggtcctatcaagcaaattattcatcattttcaatcggtagggatcaacgacatcgggtttctcggtggcgttgaaacgagtcgcagcggacgcgagcagtttcaggacgtgcggacagccgcgtttgatcgggtgatgtacgcagaaaacttgatgcagccagcgtttcgttttattggcgcgttcacgcctgattcaggttacgaactgatgaaacaagcgatcaccaaactcggtgacaccttaccgcacggtttcattgtggccaacgacacgatggcagtcggtgcgttgcgcgctttgaacgaggctaagatcgaggtgccgcaacgcgtctctgtgatcagcttcaacgatgtggcggtcgccaagttcacgacnnnnnnnnnnnnnnnnnnnnnnnnnnnnnnnnnnnnnnnnnnnnnnnnnnnnnnnnnnnnnnnnnnnnnnnnnnnngttcccccgcgaagaaacctgtccataatgacctcaagtgcaatgaccaaaagcgggtcatcatacttgaggtcggctgatgctttggtttctaaccgcgctggcttacgctcgtttataaaggaggacaagatggacgtttcagttgaaccatacggtcagtatcaaggccataatttgtatgagctgaccttgaccaatgatcaaggcatggttgtgaagttgttgaattatggtgcaaccttggaaaaagtgttgttaccagaagctgatggcttgcacaacatgattctgtcgctgccaagtcgggaagattacgcaaaagagcgcaattttctcggcggtacggtcggtcgagtggtcggccggattcgtggtcatgtttggcagcatggggatgtgaaaattgatctgccaatgaacgaaggtaagaatcacattcacggcggggatgacggtctggatcggcaagtttataacttccgtattgaccagacagctaccacagctagtgctagttttacctttgttgatccagcagggcataatggctatccgggcaacgtcaagctgcaagtgacttataccttggagaatacgaataccttgcactatcgtctggatgcagttagtgatgaagaaacgctcttcaatccaactaaccatacctattttgcgattgaccagccaaacaaaattgatgccaccacgctgacgattccagccgacgattacaaaccgcttgatgcagaccatctgccagatcaaggctggcagccagttgccggaacggtctttgattttcggcaagggcaaaagcttggcgatgtcattcacactcgagcagcgcaaatcactgcagaacggggcattaatcacccattcctactgaaacacggtcaaaccctcgcggccaaactccagactgacaaacatactatgaccctggcaaccactgcgccgtccgtcgtcgtttacaccgccaaccactttgacggtaccggtattcctcacaacattgatcaatttgatggcgtggctcttgaatgccaatttgctccggtcagcggcgatgatctttcggcgatgacattattgccgggcgaaccatttacgttggtgaatagttgggcgtttgaataggcagcttaactttttaatgcctcgggatgttctgaacgaacctaatctttataaagaaagaagccttccaaatcattggaaggcttttttgacgcaacgagaaaagtttagaagttcttgtgttaagctgcttttttggttagcattgtgaacaaatagtttcaagttaatacataaatggttacgcggtcaaaagacatgcaatgtgacaaaaggagtcgatagtatgaagacaaagtttcttaagttgccggtctatcaacaaggacttttcttaacgttgatatggctaatggtcgggattggcgtgatgctatatcgctggccaacaagtgatcaggattttcaaacaaccgcctattggcttgcaccgaatttgattcatatgcaaggtgaggtgaccgctcaatggtttccgtttgcgtgtgcagtgacggccggtgtgagtctttatgtcgtcaagcatattaaaagtagaaactgtgacactagagaaggtctttatgtacttcagaatttgtggcccatctggttggtgacaatcgtagtatttttcttattaaatctttggctaccacaaacagggatgactcgtttttcgagttttgatcgacaagtactcacgattgcaatactgtttcttgatattactttatttagttcttacatgctttggttaaacttctgggtgccggttggccgggtacataatgtcattaaggttctattttgggcagtgcttttccttggagctggatttattatgagccacattcaatttacgtttgccagcagctcctttagcttggacgatctaggacgacgtacatggttaacactgccattttggccaagctggtttttaggtttactattaacggcggttatttggtggcacacttttcgtcgacttcgaatgacggatgattctcactaaaatagagagaccggccgtgctcacacaactcggcaaaaagattgagggggtctaactgctgacaagcgtacaacctagtcgggcgaaccaactatccaagatgaacaatcaagccttaaaaaaacacgctttttgtaaaagtaaacgcttacaactataatttagatagcgatatgaaccgtttacgtaactaatattgaacgcgtaaaaatgttaattgggcggcaattagggaaggagactttctcatgaaaatgaaattgcaacgcctaccaattgcactacaaggcatcgttctaggcgccatctggtttttgcttgctatagcattcatgctgtataacactccgactgcaaaaaatgaagtaccaatcccctttccaccacttgtaccgcagatgtttcgagtagatggtgttgtaaaagctgactggttacagttcattttctggttcattctttttctcacgtggtacgcgatctatcgggttgtcagactaaatgaccaaactcatacgcttcaaccggtgctgcgagcggtcgtaccaatatgggtatttgcaattacaatcgtctttatcgcaactttctggacgccgataattgggctaaacggcttgtcggttgttgaacgatccttagtaacactggggttactagttttcacagttctatttgtgggtgcatttcggttgtatggtgagattttacgttacagttcgagacaagggaaagttttcagaataatttgctggtttacacttctttgcgcgtcattctatgtcatatggcatctacagttcaccgttcaaggagcgcccattttaaaaaatacgttcttgttcggtggtctcagccaagacgcttgggtcgtacctttttggccaagttggctgattggcatggcgcttgtttccttaagcttgttaattatcagaaaaaaagcaatcaacattcagtaccgcgaaaaaacaatgtagtcgataaaaattgcaatatatataaataaataggttccaaaacaaatagccggcaatctaattgccggctatttgtttagatttgttcttttatgttgtatccaagagaaatattattgatagcgacttcgactttgcaaagtcatgttgctggcttaaaagtttgtagcaacgaggatgaggaggaggctgatgtcttataaattaatttgccaacctttcaaagattttcttgactactgaaagcgtttgaatataataaagagtgaacagaaacaaacattaattaacaggggttgagagaatggctaagacggttgagaatgacctttttgatgcagcgttagcatttgtcgaggatggtgatgatcaggatacagtctttaagcaagtttccgatcaattactagtagccggtgccgttaaaccggacttttatgaacatctaagcgaacgggaaaagaactatccgacaggcatcgatatgagcgttgtgaacgctgaatatccgaatgtagcgattccgcatacagaaggcgaattcgtcaatgttagaaaaattattccgatccgcctcaaaaagccgatcgaatttgccaatatgattgcgccagatcaaaaactcaaagttagctttctgttcatgattttgaataatgatcccgagggccaggccaacgtcttggcacagatcatggattttctgacaacatcttctgctgaaacattagctaaattattcggagcagacgatgcggcaacaatttacaacgttttggcaaccagttttaaaaaataaggaggaagtttgttatgacagtcaagattttggcagcttgtggtgcgggtgttaattctagtcaccagatcaaagatgcaattgaaaaggaatttaagaagcgcggctatagcgttcaggcagatgccgtgatggtcaaggatgttaatgaagacatgatgaagaactatgacattttcactccaattgcaaagaccgatttaggctttacaccggcaattccagttattaacgcaggtccaatcttgtatcggatgccagcaatggcgaaacctgtttacgacaaaattgaaggcgttatcaagaaggaaaatctgaaatagtctcatggtctgatggcgatgaaccgtcagatacatataaggagtgagaaaattcatgcaaaccattattgatttggccaatgcggtcttcaagccagttattgatttaggggcagcaccgattatgctgatcgtgctgaccttaattgcttgggcggttggtgttaacttctttcatgcgttggaaggcggcatcaaacttgcgattgcgattaccgcgatcgggagtgttatcggtttattgacaaccacctaccagccggcgttaaatgctttcgttaagtctacagggatcaatctttcaattactgacttaggttgggcgccactcgcaacaattacttggggttcaccgtatacattattcttcttagcaattctggtcatcgtcaacttgattttgttattcttgaatcggacaaatacgttggatgttgatatttttgatatctggcatttatcatttactggtttactggctatttatttcggggctaacctctttattgctaccattttggtcatcttcattggtattttgaagattatcaactctgatctcatgaaaccaactttcaacgacttactggacgattgggaaaatccaatgacaaccacgcatttaaactacatgatgaatccagtcatcatggtgtttgataagttgtttgacaaactgttcccatggttagataaatatgattttgatgctgcaaaattgaacgaaaagattggtttctggggcagtcgttttgccattgggatttatcttgggatctttattggtctgatctcccaccagagcgttaagtcaattgcgacactggcctttatggctgctacctgcttggagctgtttagtattatcggttcttggttcattgctgctgttgaaccgctgtcacaaggtgttactgattttgccaacaagcgtcttggcggacgtatgttaaatatcggccttgactggccattcttagccggccgtgctgaaatttgggccgccgctaacgttttggcaccaatcatgttacttgaagcattgatattgcctggcaaccgcattctgcctttaggtgggatcattgccatgggtgttaccccagccctgctggttgtgactcgcggtaagattattcggatgatcgttatcggtgcgattgaactgccgctcttcctttgggcaggcactctctcggcaccatttatcacacacacagcgcgtgcattgcacgcacctggtattccggcaacagggctcttctcttcctcaactaaggaaggtccaatcgaacaattcatcgctgtgcttgttggtaaagcttctaaaggcgaaatgatgatggtgctttacgctgccctagcactgattgcatacaccgcattattcttctggtatcgtcatgaaatgatgaagcggaatcagaagtactctgatgaaggtaaagaagttgctgacgacgttaagttcgttgcaacgcatggtgctgcaggatccgcggactaaaattcttaaatcttttaacttacaatttcatcatgagatgcataaagagcctccatcgtttttgatggggctctttttgtttcatcaatggaaaatagacgttattactttttgagaaacaagtagaaggacattttaaagaggcacaaaaaaagtcgcgatggccttcgcaactttacgtgatgattgaataaaaatggctgaattgatttaccggcttgcccgattctcacgacgctttttacgatcaaagacatggtccattttgagtagctgatagagggcatagcaggcggtgaccatcactaatacttgtgtcaatgagtttttaaaaataccgttcatgattgccacgaatgtcacaagggccaaccacagtaagtaagtttttctacgagccgtcatcagattacctccattggcttttgaataactctattataccgcagctaaagcgctaacactagtcaaaaaagaactaaaattaacaatatcgaacactcaacacagctcgtattattgaggctaaataagattgtggttaataggcatcacctgcattgaagtggtaaagcgcggagaactaaaagcaaagaaaaataaaaaaagctccaactgcatccacaaaacgcaatcggggcttctgtttacttgaaaaatataaagctgttacagtctaataaatcgaattaaagtcttgctccattctcaatgggggggactaaccacgttctttcgatgaatggcgtaagtgcgatgtcgacgtgggctggtggacaccttaaagtgacaggacacattttggatgctgtctgggttgttaacacaggcgcattcgcccattgtaacttagtttaaatgcttcacccgaacgagttcgccggtgacgccaacttgaataccttgcttgatcttgtctgtccgacttgcatggacgacttgaaacttgttttgcttaacgattagcttgttatcagtgtgatagtcggctggcaatggttggttgctgccgcgcacaagcatcacgataaacttgaagccgctggcatgtgcttcgcaagggctgtaatgaagggtgtcactgaagaattcaacaaccgttccagccgggacgaagaaaagcttcgcgtctttttcggcattgaattggtcgtcgtgcatctgtccgcgcttaccgatcaccatgacaacatcggtgaagaaaacgttcacttcactgccttgatggaattcaaccgcagtcaaagcttccgcgtggccagcacattctcccgcttcaattggcaagccggcgtaaacatcacgaccgatttgctgcaccacgggaatcttttccatgtcggaatttgacgggacatagagattggcttcgctaggggcggggatggtgacgtgctgatccatgaaagctttgagctcactgacgtcatactgggcgtaggtgacaccatagtcggcaaacgctgcctcatctaagctgtggatggttttatctggattaagggttcttagctgatcaatggttgacatagatggacttctttctgaatgttaataggattcgatggtgactttggcaaaatactcatcaaacttacctggattgacgaagccggtttctgcttccatggtgttcaacatcccggttgtcatcgccgttttcatgatgtcttcatccgatttgccatcatgaatgcccatggctaagccagccaatgttgagtcgccggagcccacaggattaacgaccttaatctttggaatggcagcgtgatagaacttatccaaatgttttacgaaggcaccagccgcacctagggacacgactatccaatcgacaccatcaaaaatcgggtccatcagatcgtgtttcaaagccgtgtagtcggttttgtcaacatcacggttgagcaggccgccaagttcttcttcgtttggcttaatcagcaacggtttcacaggtgcttctaaagcggattttaaagtggcacctgatgtatccagaagcactttgacgtttttttgacctgcatgggcaatcatctgggtgtaataatcagccggtaatccttgcggcatggaaccggagatggtgatcaaatcacttttgtctaacaggctgtcaaaatggctgagaaatttctcggcatcttcggcagcaattgttggtccggcttccagaatttcagtctgttcgccgccatcatgtaacatagcaatcgaactgcgggtttcggcatcaatcgggaagaagtcatggtcaataccgtcacgatcaagctgattttccaaccacttgccaaaatagccgccaataaagccagttgctgtgatctcgtgatttaacatatgaatgacgcgagatacatttaatcccttaccgccagcagttttccgcaccgttttcacccgattgacggtgtcgattttgagatgttcgagcgggtaggagacgtcaatggatgggtttaaggtcactgttaaaatcataagtattttcctccaaaaatgtgatgatgagctgggtcggatacaaacctaatcacggaagacgttataaaagccgattccctgaggagtcggcttttatcgtcttcacgcgaattaggcgtgttcgaccttgtccgtccaaggagttgccgtttcagctaagaccttgtttaagcgatcgatgtttgctttgccttcggtttccagccatgctttaccagcagcttcgccttcagcagcaaatggtttcacgcctggtttccaggttgcccggccgcagagaacaccgttgaaggtggaacctgcttgcttcgcaaatttcagttcttcgaggaacaattcgtttgaaacgccagcagacaggaaaatgaatggcaggtcggtggcgtcggattgggctttgtaatacttggcagcctcctccttggtgtaaaccggggtcacgccttcatctgtgaagccttcgacaaacttctgatcaactggaacctcgacttttagaacagagacattgtactgtggtttgctgaattccttggtgatcttgatcaccttatctggcttcacctttgcccatgcagccgtcccagtttcattgagggtgccatcgtaggaaaccagttccaagaacaatggcaaatcgttagcctttgcttcggcaccaacgcgttcaacgaaagcatacttgcgatcattgatggcctcaggttcgtctggatcgatataaagcaagaatttaacggcatcgccgccttcattcttaatgcgcaacgcactttgatcatcaatcagatctggaaaacggccaggttcggtagcatcataaccggtcttttcatatgaaagcagcaggccagcctgaggggcacgaactttggcagccggcagaccatattccgggtcaagcagaatggagctggcatacttggttaattcttcggaaacagcctttttgaaatcaacgatggtggtttcatcagccggcttgttagccgctgctgcaagcatctttttcagggaaccgcgttgatcaatggccagagcagagatgacgttgttgtcatcggacaattgttgcaaatgtttgtattggccagcagtaaggttgacagtcatgtagaaattcctcctagaaagtagtgtcgaagtgataattagtcgtggtagacgccttcagcccacttttcgagttcagtatcgaagaagtgtggattgtctttttgttctggatttggcttagcaatgttgtcaattttatcgatgatcttcttgttctcaggggtttctttataggtggcatccagataagctttgacaatatcttggatcatatggataccaactgtggcaccaccgatgcccaatacattggcgtttaattgttcacgtgcataaacagccgatgtcacgtcatcacacatagctgcccggatgccgtcgtttttgtcagcggcggttgaaataccgataccagtaccgcacatcacgatgcctaagtcagcgcggccgtcagcaacatcttcggcaactttcttaccataaataggatagtgggtacgatgggtgtcataggtaccttcatcaatgacggtatagcccatatcttttaacatgttcgaaatttcaattttctgcatcgtgacgatgtgatcgttaccaatagcaataatcataagtgtgaagcttcctttcttcttttaggctgtaggcaaggggactaaatcattttttcgagcatgtcgaggcggatttggtgacgaccgcctgcatattcggtgtccagataacgttggatgatcacaagtgcccggtcataacctgtgatgccagtaccaatggcaattgccttggcaccgttgtgttcagcggtcatatgggcggtgttttcttcttcaacaaccgcggtgaccatgcccttgactttatttgaggccattgctgagcccacaccgtaacggtcaaacatgatggctttatgcgcatcgccgctcaacagttcctttgtaacagccaaagatgaatcaacaaagtcttcagcaggttctggggtcatatccttaacccgatactgatgatcctctaaatactttttaacttgttccttcattgcgaatccatctttgtctgcgccaataatgacatccatgttcttattctcctttatttgttttatctgtgatgacatgtgtgaacgtgttgtaatgttgaagatcatcgcgactgatgcccggatcggtaatcaagccatctgtctgatcaagatcatagaagctatagaagtcttgccgattcaacttgaaatgatctgcgaccacaagtttcatgcccgcattgtctaaggcaatacgttgtgtctggccttcttcggggctagcattgctgatatgattgtccgcaataccgttgacactgataaatgctttcgtggtggtgagatgtgctagcatttcgtttgctaagctgccgataaatgcgccagatcgagcccgaagccgtccgccaattagttgcagtgaaaagaaatccgcgcgatcctgaaaactttgaaaaacagggagactattggtgatgatgcgcacatctggttttttgagatattgtgcaatcatttcgttcgtggtcccagggccgatatagatcgtgtcgcctggtatgatcagtgcggcaattgttgcggcgatttttcgcttttcattcacatgaatcgatcgcttttcatttcgggataattcagtcagcggtttaaagttggtactttgggcgccgccatgaatgcggactaattctttttggtcggcaagctcttccaaatcccgtcgcaccgtcatcgttgaaacaccaaggctttccccgatttcgttgacagttacaatacccttgcggtcaactaaattacgtattgtcagtaagcgctcgtcttttaacatatcctcacctcgcacgtgtgttcattgttgtttgattttgtttcttattacattgttcaagttaccaccgagttcaatattcgtcaagcctataaatacgatgtctattaagatttcatttgtcttgatgataaaagatagagatcacaagaaaacggtttacaatgaacaaacggatataatacagcatttaaccaaacagaaaacaacatacacacacagaaatctgctttcacgaacgttttcacaaaaatgctcatgctcggtgatctgtgtcggatggctttttagctggtgtagatgagaaatccatggcataaattcaaaaaataagtttaaaaaaaaccgccaatagttgcatgtgcgcacgcaccctttggcggtttttggttggaaattgtggataaacgtcattttaacgtagtatataataggaacaacacgtcaagctaaggttggcaaagtcagcaaatcacttgcctgttgtagcaccgcaacccgaggcattacttcattacttggcggcgtggtccaacctgcaagtgcaaaagcaaccttggcgtcggcagctgcctgtgcatcagtcggtgtatcaccaatgtagatcgttgaggctggctcactgcccaaccgttcacgtgcgagggtgatgggatcgccaaagggtttgttgcgtttggcctcgccagcaaccacgatcgcatcgaagtaaggactaaaatgaaactttttgtcttcttcaatgaactgcgtcttgtcttttgacgtcactaggccaagcttgtaggtttgtttgagctgattgagcgcatgctgcataccgggaaaccaagcaatgtcggtgaggaattccttcgaatcttctcgccattgctcatggacttcaggaatttctgcggcactgaatccgagttccgcgaggctgtcaacgcccgcacgtccattggtccaggttaattcatgaatggggacctctcggccatggcggcgtaatgttttttgtaagccatacaaatacgcctctacattgtcgagcagcgtaccatcgatgtcgaagataaaagtgttcatgatattcctcccaataaagataattgtagcaagtaagcgataacaaggaaaggcataacgatgagattcttacacacagccgattggcatattggcaaaaaactaaatgattttgatttgcttgaggatcaacaagctgtgtttgaacagctggtggaaacggctgagacgcataaagttgatgccattgtcattgcgggggatctctatgaccgcgccttgccaagcgaagctgctgtttccgttctggataacatgttgattaagttgaatcgtgaccacggctatccgttgctggtcatttcaggcaaccatgactcggcggtacgcctgcgcacaggtcgggcatggtattccgctactaaaatgtttgttaatacccaagtagccgaagcttttacacccattgagttggatggcgtgcaattctttttgctgccgtattttgaaccctttgctgttcgtgactattttcaagataagacaatcacgaatgtggctcaggcaattcgcccgattgtcgcgaaaatgaagactttatttaagccagatatgcgtcatattctggttagtcattttttcgctgctggaagtgaccatagtgcttcggaaacgaaagttaatgttggtggactggacgcggtaccgctggatgatttggcagcatttgattatgtggcactagggcatctgcacaaccatcatgctttgcatggtgaaccaaagattcaatatagcggtgctttgctaaaatacacggtcagcgaggcccatcaagaaaaaggggtctatattgtcgatactgagaccatggatcgtgagtttgtgccgttgaagcctaagcacgatttaatcgagttaaaagctagttatgccgacttgacggctccagcatactatcagcagcaggatcgagacgcctatattgggattgatttgaccgatacgcaagtaattccgaatgtcatggcgcaattacgccagatttatccgcggattattagcctgcgccgtgagaacggcgtgaatgccgtcaagcctttgcaagagcggcagcgtgatttggatccgatgagtttgctgcagactttttttaaagatatgacacaagatgatttgtcggccgcccagattaagtgggcgaaggcagggttgacaacggctaaaaaggagcagaaataatgcaacttaaacaattacacatgcaattttttggcccgtatgcagatgcagtcgttgattttgacgattttcgcaccagtcccttattcttgatcagcgggccaaccggcagtggtaaaaccacgatttttgatgctttgatttatgccttgtatggtgaaacgtcaggtgagcgtgacggtgggcaaatgcgctcaaattttgcaggtaacagcgatttaacaaaggtgacactcacctttgatcatgatggcaaacattatttaatcgagcgccaaccgccgcaattgcaaagtaaaaaacgcggcgatggactaaccgaagtcaaagctaaggtgttgctagctatctcttcagatgaaaaacaagtggctgagtaccgtaagaaaaatcaagttcaggaacagctagacgccgttttacaccttgatgcttcgcagtttcgacagattgttttgttgccacaaggggattttcgccgcttcttagatgctgatagcaatgcgaaagaagatctactgcgtgacttgttcggtactcagttgattcaacgttggcaaaccgctatgttggcgcagatgaaggccaagggagcagccattcaggaccaagagcggatgttagacgttttgatgtcgcagtttgacttcgagacggctcctgacgagcatgctacgatggcggataagctgtcattaatgagagcaacggtggcgagtcaagcgaaagttgtgacagcaagacaagcgaccgcggcgcaaagtcaccaacgatatcaggaagcacaaacggcactgcaacaggggcaacaattggcgcaggcttttacagagcgagaacaagccgccacagctttagcaaaactggcggagcaaaaacaaacccatcagaagcaattaaaacaaattgaacaattgacgtgggtacagcaacatgaaaatgctgctcaacgtgttcaaaaggctggacaagatcttaaagcggcaattgtgcagtctgaacaaacgcaagcagctttaacgacgaccaaacaaaaattttctctggacaagcaagctttagcacgcttgcaggccaaatcagaccagattgaggcccaaaagaaacaactgaatagtttacaggctgttcagcaacagttgacagccatcgccgaacaaaataaacaggtgattaaacaagcagcgattgttaatgaggctgagcttgcgttgacgcacgcacaacagcagttgacagacgcccaaaccgttaaaacacagcagcaaacaagtctggataacttgggcttggatgagctgataaccacggtcaatactcagcgcaacttattggctgccttagtgccacaggctgctaattatcaggaagcccaagctgatgttgcgcagttgtctatggccatcaaaaaaacccaagttacgctggagcaagccgaaacgcaggtagcagccacaacctcgcatttgaacaagcttcagcagactcagattcgccaacaaattgcacatttggctgctaagctcgagcctgacagcccatgtcctgtttgcggcagtactagccatccgcatccggcgcttgtggttgacgaaccattggtgagcgaagcagcgttgaaacaagccgatcaggaacggcaaaaggctgccgcaagaaaaactatggtcgagacacaattggcgaatcttgaaacccaactgaaaactgcgaaggccaaaaccgcacaggcaaggcaggcttttactgagcattggcaagaacaggccaaactgattgcaggcgttgcggataaaactggtattttacaacaattaacggcgttgaaaacactggcggcaactaacgagcaccagttaacggaagcgcaaacgaagcacgctgctttgcaagttgcgctaaaaaagagtgacaaggccatcactaccggtacgacaaaagttcagcaatgcgaagctagtttgaatacggctagaattgatgcggctgaagcgcaaagtgcgttgaagaccatgcaaaagaacctgcccgcggaagcgacggatttggcgacggtcgctgctcaagctacaaccctgcagacaaccattacaacgtatcaggctcaacttcaggaggcgcaggcaagggtcaatgctttggatcggcaattagccgggttgcaagcagacgagaaacacgccgcggcacaagtgactgctttgaccaaggaacaggcggaagcaaaagcaacctttacgatagcagtcacgcagtattttggtgctgatggcaagcaacggttcgccgagttgcagctgcgggtatcacaattaccgctgttgaacgaacaggttcaaacttatgagcatacacagctcaagcaacaaacgttattagatgccgccaataaaactattggtacccaagcacagccacagcttgatcagcttgaggccgaagcaacagcagcggaaacgacagcaacaaacgaccaaacggctttgattaagattagtcaggcgcatgatgctgctgaaaaattggccaaacaagcggccactatctttacggccaatcaaacggcgcttgcagcctatgcggatttacaaacactggccactgtgatgaatggcaatggtcccaagaaactcagtctggagcgatacgttttgcaggcttatttgcaagaaattctgaatgtggccaatagccgtctgcaggttttgtccaataaccggtatcaatttgttttgcataccagcttggggacgcagaagatccactctgggttggaaattgatgtttacgatgatcaggttggtgagaaacgagctgtgcagacgctatcaggcggtgaaagcttcatcgctgcccttagcttggcactggctttaggtgaagtgattcagcaggaaagcggcgggattaatattgatgcattgtttgttgatgaaggcttcggcagccttgatgccaatagtcttgatgtggcgatgaatgcgttagaatcattagaaggcgaatcgcggctaatcggcatcatttcacatgtgaccgagctgcggtataatattcccgatcagttgcaagttgagccagcaggtacgggccgcagtcgcttaaagatccttcactcggcttagcacttttaaattgagtgtgccaagtctacgtgaaagtggtataacagagattgtaagggtcaatcctacgaactcacaccaaaaagaggcgacatcacatggcatcattgagcaaagaacagaaaaaagctttgatcgctaaagtcgaaaaggagcgccaagaccatcccgaaaagaagtcaaagaagtctggcttcgaaacgattgacgaagaagcagaacgccttgaaagcgaaaattaatgttagttgagtcgctggtcctgaacagttaactgttcagggcttttttttgcagagcgcaaaccggcccgcttagaaaccgaagcataagtggccccgaacctaaacggcagggctttggtcgtttaggttcggggtccttatgcgtaggtttctggatcggtttgcgcgttttcaaagatctatagcccaatattcattttcgagacagccagatctgcaacttttgcgccccagtgacagtaactgtctatgatggcaagaacggtatttatcgccattaagctagcgcttttacccatgacgccgcatactagtcgtgtctattgagcagttgccgcaatactaagacttttttaataatggtctacaaaggaattaaaagctataacgcatgtgagagtatgcaaagaagccgattaatcagcttttttcaaaaaatattagcacttagcgttcacaagtgctagtttgtggtataactataggtggagcgagggagaaggaacaagagcttcagagcaaatgtgtttctcccgaatcgccaaagtctctatattgaaaggaagctatctgttatggctaatgaagttttgaatcgtcgtaataatgagttgatgaacaatgtgaatgatccgttctttgacaacttggcacgccggttcttcggcccggtatctgactggatggattgggcaacacctgccatcaccagcacggccgtcaacggattactgactgatgttaaggagaccaaggacgcttacgaagttcatgtggatgtacctgggattgataagaacaacatcaagatgaactaccacgatggtgttttgagtattaacgttcataaggacgatatcaccgaccacgctgataagaacggcaacgtcatgatgtccgaacgtaactacggcacaatgagtcggagctatcaactaccaaacgttgatgcaagcaacatcaaggcagcctatcaggatggtgtcctcaatatcaccatgcctaagctgactgaatctaaggagtctggtcacaacattgaaattcaataatgttcgtcatcagctgacccaagatttacggactgcattgcaagcatgaatagaagcggcacttctgccgttagtgggcagaacccatgagtaagcaaacaaaaatcgatgagaattgccgcagttgcagtgatcattgagtcgttaaagtcatcccagcgatacgtatggtcgttggggtgatttttttgtagagcgtaaactgacccgtttagaaaccggagcataagcggcctcgaacctaaacgactggtttttggtcgtttaggttcgaggtccttatgcgcaggtttctgggtcagtttgcgcgtttcggagaaccaaaatatcataggtgggctttggtcgtttaggttcgaggtccttatgtgcaggtttctgcgcctttttgcgcgcttcggcgagccacaatatcatgacagggctttggtcgtttaggttcgaggtccttatgcacaggcttctcgaccttgctcgcgcgtttcagcttgcaacaaggattcccactcaccaactaaagcagttcaatatttcccgtttttcaagtccatggtaagctagtggttatgatgacaaacaaattaatgaactggccgccggaaaaagtggcggcttttcaaaaggccttattgaattggtatgatcaacatgcgcgtcaattgccgtggcgcgaggatcatgatccttatcatgtcatggttagtgagctcatgctgcagcaaacgcaagtgcagacggtgattccttattatgaacggtttatgaatcaattcccgaccgtgggagccttagcgaaggcgccagaagcagaggttctgaaggcgtgggagggcttgggttattattcccgcgcacgccgtctgcaacaggcagccaagcagattgttgccgattatggcggcgtttggccgcagacctcagaaacactgcagacattgtctggcatcgggccttacacagccggagcgattgcgtcaattagtttcggggaacctgtacctgccattgacggtaacgcttttcgagttttcgctcggttgtttaaagtggatgcggatattgcccggccacaaacgcgtcagctcttttttgacttgattcagccactgatgccaaaagatcgacctggtgattttaatcaggccgtcatggatcttggctcaagttacatgtcggcgaatcacccagaccctgcacattctccggtgcgagattttgatgccagttatcgagatggggtggtttcggcttatccggttaaaacgaaaaagccacgaccggtgttgcatcgttactttgcgttagtcattcgctcggagaaaggctatttacttgaacagcggccaagtactggcttgctggctgatttgtggatgtttccgctcgttgacatggcagatcttgaaagtaccatgatgagtgcgcagttagatgaggtcagcacgttgtttgcggcatcgtcagggatgcagctgacgtttgcggatcttggcgcgaaaacggttaagcatacttttacacatcagcaatggcaattgacgttgattggggtcgagactgcggcgagcgatctcagctttttaccagcacggtgggtgaaagcggatcattttagtgagctggcgttgccgacggtgcagaagaagttgaatgcagcgctggggatgaattagaaattggtattgggtgagtggcttagtgattttgaaacatgttcatcagctcagaaactgggccgtctcacccgctggctgaaacgtgcgaacaggcgcagctcggctatgccgagctaaccgatccgtttcacgccctgagtcaattgcttacatttcgccgttgagcgggttatactgagtgcaaatttgattggagaggtgagcgttttgacagttaatgtaacaagagatatcgcttacggtgacgcagcattacagaagcttgatttttatgaaccagagaagtcaaatggggcggcgatcctcgacattcacggtggcggttggtttcgcggtgagaagaataaagaaggcgagatggctgaacggtttgccgcacttggttatacggtggcggtttcaaattaccggcttgcacctgaagccttcttcccagcagctcgtgatgacgttttagcagccttttcatggttgcgggagcatactaaagggttgcaacttggcgtttttgggtccagtgcaggtggttcgctgtcagttgacgttgggttagccgaaggggtaccgacagtttcttggtcgggcatcttcgacattcgtcagtggttcgcagatcatccagcagtcgttgcccagccggatacgaaaaccgattttgtgaaaacggcaagtgcgaaaattgaccaaggtggtcgtaatgatccattttacaaatggttcattttgaattatgttgattcagatgaaacaaagttccctgaagttgaaccgtttgaccgtttgaccgctcaggctggacctttgtatctggctaattcgcaggaagagattattccgattagcggcatctatcaattggcacatgccgctgaaaagcttggcttacctgtgaccttgcagtcgattccgggcggtcagcatgctgaaggctatcttgatgaagcgtggcagggtaccgttgcgttctttgcgcagtatttgttgaaaggataatcgtggaaacattagtcgttgtgagtcatcctgaaattgaaaaaagcgacactcagcagtttctaaaggcgagtgccgcttctttgtcgcaagtcgtgtggcatcatttagaaagtcggctaccctttgatgtgacggcggagcagcaagcaatcacgtctgctgatcgccttatttttcagtttccgctttattggtatatggcgccggcaagcttacatcagtggctgacagatgtttggctgaaacagtttgtttatgatgcgcgaggtggattgctacacggcaaatcacttggttttgtcgtgacattcagtcaaccggcgaccgcctatcagcttggcggtagcgttggttttagcatcagccaatttttgacaccatacgcggccttggcggctaaaaccggcttgacgttattgccgcctttgacaattgcccaatttgccaatcaaacggatcttgagcatcaacaattattggtgcgttatcagcaatatttgacgcttgaccatcctgaccgaccagatgaacaagcacagtggtttattgatcgattgagtggcaacgctgatacacaattgttggcggatcaattagcagcacagacggatgacattgatcgcttacgtttgacattacacgaattaaaggcaggcgagtcggaatgacaacagatgaacaatggctagtgaacgctgctgcagtgcaggaaaaacaggcaacatcttatgaaaatgccgccttttttagggcactacaagcattcgtcacccagcaggcaaaacgtcgtgaaagtcttgaaggtgaaatcgatggccgcagttggaatcacgaacaatggtgaaagttcagtctgacgacggaggggaaataactcaccgtatgctatggttaagttagcaaaacaaaggagcctaaaaaatgcaaacaatgtttgatcgtcttcaacgttggtcatggctgcgcggtttgctgatgattttaatcggtgcctggattttaatcgcaccgcgccaagtctatcgcagttttctctggatcgtagctgcagtcttgattattgcggcaattccaaagctgattgacggcttttcagcccgcaaagcatcaggcacttacggtacatcgctttttacagggggcttttacctgttattggcgctgatggtgccggtcatcgttcggccactgatgagtctcgggccattgctgctgggcattgtcttgatgatttatggcgtcaataaaattttaagtgctcgaaatcgacaacaatttgtgaacgtctcggtttggccgactgtcatttatggtgtggtgttgctcatcatgggcttcattatggccttgaatccgttcagaactgtcatgatggtcttctcattctttggtggcttactcgttgccatgggcattttgcaactctttacgcgaccacgtgcctaatcactaaaaaagcattcgacatctaaaaggtggggaatgctttttttctttgcctagatcttttgctggctgataggcagaataattgtattccaccgagtagatggctacactctgtgcaaaaggatctgacaacgcttaacatgcgtgcttagaaactggcctatacgcgatttaaggctgaagtcgtcgcctttctgggctggagaacacgttgaaggaggaaaaaatgatgcacaagtttgattggcgggaagttgaacgtgacgagtattcgcggtctgaggaacctagttttgtgaagttgacaacgcgcagctatatcacagcgatgggggtggcaccagatcgggtgacggatcaagccttcacgtcactggcagcagcggtcacccaaattgctgagcggatcagcgaaggaccagatgctggcattgatattccgaactttaaagcttaccatccctatccattgcaggcggtttggtcagggggcgataaaatcagtaagcgccacatttttcgattgtggttgaagcaaccgttgtttattcatgaagaccagtttgaggctgcattgacacagctgcattttgaaccagccattgcccagcagcttcacttagaacagttggcagaagggtttgaaattcaaagctttaattcaacaccactgacggatgaagcacctgcgattgcgcgtattcaaacagtgatcaatcgcgaccatctcgttcctaaatttgatgatcgtcatcgcgaggtttatttggaaggctatcaaggagaagtaccggtactttaccgggtgccgcttgacgaaaacttcggtgaagttggcgatgagcaggttgcatataattaatctgaatcgatggcgccatgaaaaagcgatcagctctttttaaaatgagctgatcgcttttgttgtcttaattagaattgtgggtagacaatcttattggcccagtgattgatcgggccgtactgatgaccgactgcaattggatgaccaatggcttgattggtgaaacgcttagcaatgcgaatggcttcctcaactgagttgcctttgccaatttctgcggtgatgacggcggaaagcgtgtcacctgtgccgttaacccggtcggttgcatgataaggttcacttaaccagaatgatttgccgctttccagcaaaacaaaatcacgcacagttggttgcgtaggatcatcatgggcaccttttaaaacaatgttcttggcaccggagtcttgtagttgatgtgcggccgcttcagtctgagcgtcggtgtcgagtttcataccggtcagatgctcggcctcgtaatgattgggggtgaccaccgttgctagggggatcagttcatttttgacagcatcataagcgtcttgttctagcaacatcgcgccgtgtttagtgataataacgggatcgacaactaaggcaccgaaatcatattgctgccagtttttgataatattttgcaccagtgcgcgatcggcaagcatgcccgttttagcagcgcgaatatgcaaatcagcagcgagtgacttgaactgggcatcaatgaacggtaatggcatgaccatactatcctgaatcccgtaagaattgcctgcaacagccgcggttaaaatagtagcaccataaacgccgcgcatgaagaaactatgcaaatcggcttggacaccggcactgccgtcactgtccgtaccgccaattgtcatcacttgtggaaactcattagccacgtgattccctcctcgtaaacgtgttcactggtgcagaagccggcacatcaggatctgaagcacactggccaaagctcagccaatgcgcttgaggtcgcttatgctccggattctaaccgcatcagtttacgctcttcctgataaaagactgtcatgacttgccaatactgttactaattaaacgcccgtttttgcggcaagacagctttaagccattcgccgataaatggatactgatggttaagttcgatgatctgcgtttctggatcaggatacttcagataaaccatattattagccggattgatcatcactgtaaagatcttttgatttggtagtggcaattcgtaaacgccagctttggcaccttgtcgcatgaggatagcgttgttggatgcaatgacgaataattcatccaatgctggtgaattactgcctgccgaaacacgaataatgagcttgagacggtgattgaccaattcttgcggcacagtagttgaggcccactcaaagcggtcatttttgacttcttcagagccaagatcttgccagtcgtggccatcttcgtctaggacttgatacccaagtacttttgcatcctgatctaatgacgtaccaatgctaaagtcgccggctttgatgactgccttttttgcaacgagtggtttgaggttatcaaaccgcgtcttgaaacttagtccgttaacgggttgcaagacagtttcatcaacagtggtgaagcgatagccgccttgattgagcgctttggctaaggcagacagtgccttaacggtttcggcatcgtaggtcatggcattgctgtcagcagcggtgatctgcaaaagtgtcggtaggttgaccgcttttaatttggcatcgtcactcaagggatccacaatcgttaacaatgtgttgttgtcgtcctgcgtcgtctgaatcaccgcaatttcgctgtggtgagcatctgccgttgtatcctgcagccacaatgtctgcaaaaatggggtagggattgacgtcaagttttgcaatgcctgatataatttattgcccaagagattcgtgtagcttgccaataaggcggtcaatgcctcatcatttgattcccacaatggcgagtttgctaaatgatcggcttcttgctgatatgctgtgccaatttgttggcgtgcctgagcaacggtgagtggttttgtaatcagggcagccaaatgtgcatcattaagattaagcatgcgtgcgccctccttcaagctttaatgactgcatgaaatcatccttcaagttagctaagatattttcaaattcagcgactgagctgtaagtccccatcactgcttggaattcatagcgcgtgatggctgcggaaacttcgagttcgcgtttgcgcttgtcgaaaatatcatcggcggtaagcttttccttgtcgaactgtgctttcagtcgcgaggcatctcctgaaggttgtgaaggcgatgcttggtcatcatcactcggatcaataaagtttttcaacaagccgcggaaaccgctgttgccttgggttgcttggccccgctctggggcgttttcggcttccaagttgtcgatttgggtgtgcaatgaatcgacgtcacggtaaacctctttgcgcatcgcatccaactggcggtctagataatggtcgggatcgtcagaaaaagcttcgagttgtggtaggattcggcgctgttcgtcagctgactgcgtgattgctcgcaagatgacgttaatatggccaaactcgcgtcggtggtaccaattaccaaagtagacggttccttgatcattaacttcaaaaaaggggatgtgctggcgcagaaaatcaatgagaccgatctgcagaaaatcatgcagttccgcctgtgcgtttttgtcataagccaaaatataaccaggcgtttcttcgatgtctagccgcagattttcagcggttgcatccagtccctgataaaggcgataacgtgactttttatgccaagcatcggtaaaatcgttgaagaatttcttttgataagtaaggctagcttcaattgacatttaatatcctctcacattctatactaatgatttaagtgtaccgcataactggcaatataaggaagttttcttgtctttttcaagcccagaaggcagattcagccgtaaatgctggatacatgctagaatatggacgagaggtcgttgcttcctataaacgcgctcgtctaaacgcgctcgtcaacccagcaagttgcatgtaggcggattgacctgcgctcaacatgaaatgaggtaggcaaaatgaaaattgctgttttgggtgctactggtcgcgcgggcagtgccattgtcgctgaagctcggcgacgcggacatgaggtgctggcagttgtgcgtgatccgcagaaggccgctgatcggcttggtgcaacggttgccacgttggtgaaggaaccgttggtattgactgaagacgatttggatagcgttgatgcagtggtagatgctttgagtgtgccgtggggttcgggccgtggttatttacatctggactttgccacgcacttagttagtctgttgcgcaacagcgatacactggctgtctttattttgggaagtgctagcttggcgatgccgggtgcggatcaccccatgattcttgactttccagaaagtgccgcaagtcaaccgtggtatgatggcgccctttaccaatattacgaatatcagtttttacaaatgaacgcgaatgtgaactggattggcatttcaccaagcgaagcctttccaagtggaccagcaacgagttatgttgccggcaaggatacattgctggtgggcgaagatggacaaagccacattacgaccggcaacatggccttggcaattctggatcagttggaacatccaacagcaattcgagatcgaatcgttgtccgcgatgcggattagctgcttgtgcagcgattaaaaaaggcgactttgcaacttcctgaggcgatgttaggaaggtcaaagttgccttttgccatttttgcttggtggactattaaagacggtaagcgagcctgctttcgctgaaacgggtaaattagcccagaaatctgcacataaggacattgaacctaaacaactaaaactccgccaattttgtaggccctcgcaaacgtgttcgcagtcgcagaaacctgctttcgcgctacacaaaaaaacccgcgtattgggggtacgcggggtttcctgtcaacaccattgggggtggtgccgacttctttttactttggaggagtaaaaatgaaaaaaagttgggttggggtagtagtaagaagggggtaaacttccttgctacatagagaagaataatctgtaattgtgaattttttatgacgttctggaagaaaaattttgaatgtggttttttaatgttctttgctactttttgatattgtgagcaaatgttattgaattttaaatggtcaaagtgtcaattagttgaaaatatgtttatataaattgacaaaagctgttgtgattgaagccttaatttctcgggcgaaacttaaatgaatgaattgcgaccgttttaagcgttaatatcgttatcttaaggtataataagtgttccaaaaaaacatggcaaaaattttgccggaaaagaggtaattttgatgggggtggtagtatctaactttcatctggcgaagatcacagctgaagaaaaagtgaaactaacttctggaaaagatttctggacttctgagcatcttgccgataaaggtataccaagttttcggatgagtgatggtccccatgggctgcggtatcaggcactggcagcggatcatctcggaatcaatgatagtgttcctagtaccagttttccaacagctagtgctagcgcagctgcgtgggatcctgatctcattcaagcaatgggtaaggcgattggattagaagcgcaaagtttaggcgtcgatatggtacttggtcccggggtcaatatgaaacgcaatccactttgcggtcggaactttgagtattttagtgaagatccattcttggccggaaaacttggcgctgcgtggattaatggtatccagtcgcaaggtattgctgcatgtctcaaacattttgcagcgaataatcaggaaaatgaccggctttcatctgattcgctggtggatccgaccgccttgcatgaaatctatcttgaggcttttcgtattgctgtcacagaaagccacccagaagcggtcatgtgttcctacaacaaaattaatggcacctatgcaagtgataatctgtatttgatgacccaagtgttgcggcaacaatttgggtttggcggggcagtgatcacagattggggagcgttgaatgataaggttgcggcgcttaatgccggtacagatttagaaatgccaggcgacgatcatttatttgatggtgaggcgctgcaggcttatcaacaaggcacactgaaattggccagcttagatcgagcggtgactaagattgccgaaattgcccgcaaacaacggcccaaattccagggatcgcgagagcaattattgcaagcaaatggacaattggcgcaaaaaattgcggaaagtgcgattgttctgctgaaaaatgaggccgccatgttaccattacaggctactgacacagtcgcggtcattggtgagctggctaaagctacacgcttccaaggggcagggtcttcgcatattaatgcttccgagatcgtttcagttttggatggccttaagcaaaaaaaggtgtcatttgattatgcggctggctatcgacttgacgatcaggatgattcgcaggcgactgccgaggcattagccttggcacgcaaccatgacaaagtcgtttttgttgctgggctacccgacaattatgagtcggagggctttgatcgccaaaatatggctttaccaaaagttcaaaacgatttattgcaggcagtgaccgcagttaatccaaacgtgattgtcctgttagttgccggtgcaccggttgagcttccgtgggtggatcaagtcaaagctgtcgttaacctgtcacttggcggtgaacgtatcggggccgcagctgccaacgttttgacaggtgctgtcaatccaagcggcaagctagctgaaagttatccgctaaaataccaagacgtgccctcagcggatgtctatgataaaaaccctcggtcggtgccgtatgttgaaagcacatatgttggctaccgttattacgacaaagcaaaagtgcaagtcgcctttccatttggttttggtttgagttacacatcgtttgccttgaaaaacattcagctctcaagtgatcacgtaaccgatgatcagccactgaccattagcttgcaagtgaccaacactggaaaggttgatggtgcggaagtggtccaggtctatgttcaagaacaacaaccacgaccattacgaccggaaaaatcattaaaggcattcaaaaaggtttttgtcaaagctggacaaaccgttaatgttgctctcgagctgaaggcacaagcctttaaggagtggcgtgaacagacacaaacatgggtcttgcctgaagctcaaaaggcgattgctgttggtaccagtgtcactaatattgatgccgtcttaccggttagcttcacaggggaaacttttaataactttgcaacgattccaaattggtatacaacgctttccgggaaacctagtgttcaagattttgaacagttgacagaccagaaagtaccggcaccacatgaatttgtaccaggcgaattcactcgactcaatacaccgcgagaaatgaagaaacactcattgttgctgcggctagtggcgtggatcacggtcaaaattcgaactaaagattatatcgacaagcaaggacccgaggcgaagttccagcaggcaatcgtattggacacgccactcattcgcttggcgcaacaggccagcggtgcattaaagttaagcatggttgatcgactcgtagctgcggccaatcatcagtatgtgaaaatgatttttagataacagatgtattgtaaaatcattaaaaattttccttgacgaatgacgattggattcggtatgctgattctcgtaccaaacagatagcgtgtcagcagacgtgatttctgcgactgcgaacgcgtgtttaaaggagtgttgaccatgaacttagtacggcaaacacaacttaataactttttcggcggctttttcggatagcggtttgcagtgagatgcaaaccgcgcaagcagtggtttgcatccataaggccgtcacattaaatgtgcacacaacgccgcatggatgaacaattatccatgcggcttttctataccgaaaaatctcggggccagtcgcatggtgaaaaccagcggctggtcctttttgcatcatacgactatgttgaccgttccggatggctgaattgtcactcgtcactcatcgataacgcgctcgccagcgcagcaaccgcgctggcgagcgctcacaggaggatttttttatgaaaaagcatcgactacttgttatcgctactgcagcgctggttggcttaacgctgatcggctgcggcaagaaaagtaacgccgccagttccaaaaccgttaagatcggtattttgcagttgattgatcaaagtgccttgactgaggctaggaaaggctttgtggccgagttggccaaagccgggtacagtggtgatcgcgtcaaaattgattacgtcaatgcccaaggcgaccaggctaatctgaaaacgatgagtgatcgtttggcaagtgataagaatgatgtgaatcttgcgattgcgacccctgcagcacaagcactccaacaagctgacaaaaaaacaccgatgttattcaccgccatcacggatcctaagtcagctgggctggtaaccaatcccacaaagccagataaaaatgcaaccggcgtgacagatttagttgcggtagccaaacaaattgacttgcttcatcaaactttcccggaagcaaaaactgtcggcctcatgtataacgctggtgaaccaaattcggtttatcagatcaaacaagccaaagctcgtctgaagcaactcggtttgcgttaccaagttcgtacagcggcgacaactaacgatgtgcaacaagccgccgagagtttagccaaaagcgtcgatgccctttatttaccggccgataacgttatggctgccgcgatgccgaccattggcaaagttgccaaggcccagcaaataccagtcgtcccagccgcttcgaccatggttcaagacggcggcacgatcaccaaaggcatcaactaccgcgaccttggcaagcagacggccaaaatggctattaagctcctaaaaggtaaaactgttaaaacattaccagttgagaaaccagcaaaagtcgaaacagttcgcaacgaggcaatgctaaaagccgtcaaacaaacggttaaattaccagaataactgctatagtaacgttctttgacattcttccccatacaaaaactgaaatagccgaatgtaagttttttgtttgtgttgacaagatgagaatatgagtatacgctttgagacaagtcagagagaacatctctgcatgaaggagtgttgatcatggatcgagtcaaaacaacacaacttaatcattcttattattacggctatttcggataatggtttgtatctcatggatacaagccaatcaggtttgtatccatgatggccgtaagtgtttaacttgcaattaaccgccacatggacgaattcatccatgtggccttttctttttccgggaaaaaacaatggccagccacatggacgaaaaatccagtggctggctatttttgtaagagcgcgagtcagcccgggtagaaaccgaagtgtaagcggccttggtcgtgatagtcgtattttgaccactgcgaccgatgtccttacatgtaggtttctgcgccagtgagcgcgtttgcacaaagtgtgaagcaccatcaccttaacccgtacatcccaggaggaagaaaaatgaagatcaaacgaatggccgctattgcggcagcagcactcactatcatggttttagccggttgtggtaaatcaaccagtgcagcggctgacaagagtcaggttaaaatcggcattttacagttgattgaccagcaagcattaaccgccgcccgtaaagggttcacggaagaactggctaaagcgggctacaaaggcaagaaaatcaagctggattacgtcaatgcccaaggcgatcaatctaatcttcagacgatgagccagcgcttgcaacgtgataaaaacgatctcaacttggcgatcgctacaccggctgcccaagccctacagaaggcagacagcaagaccccattgttgttcacggcgatcacggatccaaaagcggctggtcttgtgaccacaacagccaagccggacaaaaacgctacaggcgttacggacatggtagatgtcgctggtcagatcgactttttacacaaagcctttcctaaggccaaaaaagttggcttattattcaacgccgccgaagaaaactctcaagttcagatcaagcttgcgaaggcagcaatcaagaaactggggttaaccgccgttgaaaaaaccgccgcgaccaccaacgatgttgaacaaagtgccactgcactgatgaaacaaagtgatgttgtgtacattccaaccgataacacgatggcggcctcaatgccgaccattggcaaaatcagcacgaaagaaaacattccggtcgtcaccgctgacgcgacaatggtgaaattagccggggtggcgacagtagggattaattacgaagatctaggccggcagactggcaaactggctgttcaaattttgaaggggaagaaagtcagcgatctgcctgttgaaaaaccggctaaaactcgattggtcactgattcgacccggatgaaacaatttggcttgacagaggctgccttgaagcaagctgaataatcgatttcgtgtcataacgcgctggcagtcgcagcacccgggctgactcgcgcttctaccataacgcgctcaccagcccagaagcctgcgtgtaaggacctcggtcgcaatggtcaaagagcgaccatcacgcccaaggccgcttacactccgctttctacccaggctggctcgcgctcacttaacaaaggagcttttcattatggacatcgtgacatcaagtattgcccaaggattactatggtcggtcatggcgattggcgtgtacctgactttccgaatattagatattgccgacatgacggctgaaggcagttttcccttgggcgctgcgattactgctcatgcaattgtcacgggggtggggccgattgcggcgacgctcatgggctttgccggtggcgccgcagctggtgcagtttcaggctttttaaccaccaagttgcatattccagacttgctcactggtattttgaccatgaccgggttgtattcggtgaacctcttcatcatgggcaaggctaatatcagtttgattgggactgttaagacggttttcaatctggttgacagtggtgatgccacgaccaccggcatcatcatcggtgccattgtggtcgccattgtgataggtattctggtattctttttccataccgagatgggcttagctgctgcggcagtcggcaacaaccagaacatggcggcggccaacgggatcaacaatgatgcgatgaaaattatcatctacatgctgagcaatggcctgattgctttatcaggcagtctcatggcgcaaaccaatggctatgcggacttgtcgatggggattgggaccatcgtcattgccttggcagccatcattatttcggaaatcctattgcgcggcgtgccgttatgggcgcggttgttgatgatcattgtcggcgccgtgatctaccgcctgattattgcggttgtgctggatcttggtgtcgacccgaactacctgcgtttcttctacgccttgatgttaacgatcttcctgtcattgccgttactgaaaaagaaattgcaactcatgacaattcgtcacggtaatcggcgtcaagctcgcattgttcaggcacagatgcaagcagcaaaaaccgattcgatgagtacacatgctggtgatcagcaaaaggaggtttagccatggccgtacttgaagtgcatggactgcatcagtattttgaacaaggaaccgtgaacgagaatcacgcgctgaaaggcattgatctcagtcttgaacgcggggagttcgtcgcgattattggtggcaacggcgcaggtaaatcaacgttgctgaacagtatcgctggcacgctcccggttagtcaggggcagattttgattaacggtaaggacgtgacttatcaaaatgttgctaagcgggcgaaggtaattgctcgagtctttcaggatccgcgttccggcaccgcctcgttgctgacaatcgaacagaatttggcattggccgaaaaacgcggctcttggcgtaacttttgggccagtggggtcaaacggagtgatcgccaacattttaaggaaaaattggcgacccttggattgggccttgagaatcgcctgggtgccgaaatgggcttgctttctggcggtcaacgacaggcagtaaccttgctgatggctactttaaaagaaccggcgttgttattgcttgacgaacacacagcagcgctcgatccgcagacaagcgctaccgtcatggctttgactgataaaatggtgcgcgcgcaacatacgacaactttgatgatcacacacaacatggccagtgcactgaaatatggtgatcgcttaatcatgctggatcatggtgaaattgctgttgatgtccgtggtgaggaaaaacagcacctgaccgtcgaagacttattgacgatgtttaaagaacgcagtggacaagagtttgccgatgatgctgttttgttgagttaaagctggcctaaaagaagttaatgaatagattctctatgagaaaacaaaggacgactgatttccgccattggaaaatcagtcgtcttttggtggctatcagttgtgcttcaaccgtgtttggttgaagcgcaactttgatggttaaaaaatcaagcatgtcagagattagtggttaattcataactgctgccagcaaatacagatactcagtagctggcacttttccattagcccatgtccacaatcgtccgggttgtgtggtggttaaagtgtttcgtcaaggtttgtggcaagtcagctagtttgaccgtatcgacaggcattggcgccaatttgcccaatgtctgccatgcggctgctcgggccgcagcaggggcattgacggaatccacaccgagcaagctgacattgcgcaaaatgaaggggaagacggtcagcggcaaggcagttcctgcagcattgccacataacgcgattgcgccgccataacgcatacttggcagcaaactggttgtgaatgatccaccgagcggatcaatggcaaagtcaaagcgttgcttactcaaagtctttccctttggcagctcgtcaagtgctaatgttgccgtggcgccaagtgacataacctgtttttgctgatctggtgtccgcacaataccgattcgattcgtgaagcctgcttgctctaataagcgcatggcaacactgccgacaccgcccgttacgccacccacaagaatctgcggtgcatgctcaggcgtcatgccgtgcgcggtcaaagcagcgacacataaggcagcggtcaaccccgccgtgccaaaactcatggcgctagcaagtgtcatggctgatggcagcgagattgcccaagaagccggaatgcgggcatattcagcgtaaccaccgccttgactgacccctagaccatgaccgctggccaacacttgatcgcctactttaaaattggcatcttgactagctaccacagtcccacttaaatcaatcccgagaatctgtggataatctcgaataatttgattctgcggttgataggcaagcgcatctttgtagttaatatctgaataagcgaccttgatcaataaatcgcctgctggtaagtcatcttcgtgcagggtttgaaaagttgccttttgcccatcgtgaaccaatgcttgaaatgtttgcatagaacaagcctccttggatggtattcttctacctattgttggtggtgaattgccatgctcattagttaactaaagcatatcagataacgatgatatcgcaaaaccaacgttattctgccgaatctgataaggtggcctgacgccatggcgctaattcgtgccgatgttgacggcgcttgtaagtttcaacaaccaacattggcagccagatggcaccgaggacgatggcccattgcccgactgttagtggcgctagctgaaaaatttgttgcaatggcgcaatggttgctaaggcaacgatgactgtcatcgtcagtaaaaggctaccagtcaggatcggattgacagtcatcgctgaccagttaagccgaccacgggttttgatggggaaaatgtccagcatcgaaccgatggctaatgtcagaaatagcatggtcatgccgatacttggcacatcggggctgaccacgaaacggccaacgaagtagatgccaagaatcaagccaacataggtggtcgtccgcacggccacacgtttgccgaggccattgctgaaaatactggctgcttttggaatgggtttcaagtgcatcatgccaggttcagccaattctcggctaaggaagaagccgggaataccatcagcaaggacgttgacgatgagtagctgctcaggtgtcatcacagcaccccagccaacgaggacggccagtagcatcgtgaaaatttgggcaaaattaaccgaaatcagaaattcaacggcttttaaaatattttgatagaccgttcgaccttgtgcgacagcatcgataatcgtagcaaagttatcgtcggtcaaaaccatatcggcagcatttttggccacatctgtcccagtgatgcccatggcaatgccgacgtcggcagctttgagcgctggcgcatcattgacgccgtcaccggtcatggcgaccaccgcatcttgtttttgccaagctttgacgattcgaattttatcactcggggtagtccgcgcgaacacgcggatatcagcaatattggccgccagatcctcgtcgctcatttggctgaggtcatggccggtgatcgcttgttggccgctttcaaggatgccaatgtctttggcaatggctttggccgtaccgagatgatccccagtgatcataaccgttgtaatgccggcctgtttagcagcgcgaatggcagcgggcacttcagggcgcggcggatcaatgataccaatcaatcccaacggttgtacggcggttagctgtgtttcccagttttccccaggatcggtttcaaattgttgatagccagccgccagtacccgcaatgcttgtgccgtcatttggtcatggattgcggtggcagtttgctcccagttttcaggcgcaaagttaattcggtcaactgctcctttaataatcgctagatagtggccatccggcgtgcgatgcaaagtcgccatggttttcttgtcagatgaaaacggcgcttcagccacacgcggataggtttgctcagcctcggtccgactcagatcgtaatgatcaagtagccgaacaattgccagttcagtcgcatcgccgatatctggttcatcatcagcagttaagtgtgcgttagttgcaagaccgagatacttgaaaaaacgggtgtcattggctgacaactttgttttggcgactttatgaatttctttgccataaggccaaaaatgggtgattgtcatgcgattctgtgtgagggtcccggttttgtctgaggcaatcacgttcacgttcccaatggtttcaacagcggtgacttggcgaataatcgcgtggcgcttggccatcttctgaacgccatgagccaaactgagggtgacgatgacgggcaaggtttctggaactgcagcaatggcgaggctgacaccaagcatcaagctatctgtaaagccctcctgatgaagcaaggttgctagcaaaatggtgatgataccgcccaagatagcaacgaaggatagccgcttgccaagggtgtttaaccgtttggccagtggcgtcgtctgcttttttgtctgattgagcagtgcagcaatttttcccagttcggtgtccatgccggtagccgtcacaatcgcagttgccttgccgctggtaatggctgtgccagagaaaatataattggcagcatccccaagatcatcaggagcagtggccaaggcttctgccgttttggtcacgcccagactttcgccagttaaaattgcttcatccgcttcaagttcttggctttgaatgattctggcgtctgcaggaaccgcatcgccggccttgaggagaatcaaatcgcctggaacaagctcggcggcctgaatggtttgcgtcttgccttcacgaacaacggtgacggtttgaatcgtcatggctttcaaggcagcgagtgctttttcagcgctgtgttcttggtacaaagcgatcacaacattgagaatgacgatggcgccaataacaatggttttggtccagtcactgtcagtcgtcaaggccagataggcagagagaccaacggcaaaaagcaaaattagcgaggtgatatcgctgaggtgatggccgatttgccggagcaagctaggctttttagccgcggtgagctgattgcggccattttgctgcaaacgtgcagctgcttctttagcagtcaggccggttttggtgttcgtcgttaattcagcggccagatcgcttggcgttaagcgcgtcaagtgcttggtcgttgttgtcatgatttcattcctttcaatttgtcagggacacgatcattacttacttataataaccgtaacataaaaatattggtgttgtaaaatttaaaatgagtttagacatgagcaccatcggctagttcaaacatatttgtggcatttagcctattcttttgtgctcaaaaaagccgctagcctgatgtcgtcattcaaacaacaggttagcggctttcttgattttaaatagtggcgcttgtggctagttttgtaatgcgtgataaggataacttgtttgttgcgtcgtttgggttttgaagccgtatgtgtcggcaacgatatagagcggtcgatggcggctttcagcgaacatcctcgcgatgtaggtgccgagcatgccaatcgtgaaggtaataccagcgccaactagcaaggtgatgatcatgacccaggttaagctagtgaggtggcccagtgccaaactaagcccaaagagcgcgaccgcgatgatcaggaagaagccgcttagccagctagctaaagttaacggtactgtggaaaaactagtgatcccatccatagctaagtgaagcatttttctcagtggatagtgcgtttcaccggcttcccgttcttgacgatcgtactcaacggcaatttgtttgtagccgacccaagtgaccatcccgcgtacatatgggtcctgttcattcatctgcttgagaacattgacaacacgccgatccatcaaacggaagtcgccggtatcgacaggaatgttgatgctagtgacagccttgagtaagcgataaaacatttcggcagtcaacttcttaaaccacgtttcaccactgcgtttgcgccgcttaccgtaaacgacgtcatagccttcacgccagcgggctaacatttctgggataacacgcggcgggtcttgcagatcggcgtccatgaccaccactgcatcgccgctggcatagcgaatgccggcagtgattgctagctgatggccgaagttgcgggagaaatcgactaaccgaatcgccggatttttggccatggcggccctgatttgatcagcactgtcgtctgttgagccgtcattgacgaaaattaactcgtatcgttccggccgtgcacgaacgtaatttgccaaaaccgttaaagtttcgccgatgccagcactttcgttataaaccggcaacacaatcgaaatgaatggattcttttcttgtcgcatatcggggactcctttcatagagagatcaagacgctttatttcaccatgctggcatcaagttcatacaaggtgccgccgcccatgccgcctcggctgccaaagccttgcgtgctggacgatgaagtgccgccatattgacttgcggcaacctttttgccgactttggtgacccaagcttcaatcttcgaattgcctgagcggccagaggaaaggtaatacttcatatcgccctttttaacgagcgctttgaactgtttcagggtgatagctggatcagtcccgttaaagccgccaatggccatgaccgctttgccagatttgatgatatacggggctgcagtgctggcgttgccggttgcaaacaggtatttggcattgccttgatgtttttcaacatactttaacaagccagaatctgctgtgccgttgccgagtccaccgttaccgctagaggagagcagtgacggaccggcagaaggaataccagccgaggaaccagctattgttggcgttaaggaccagaatgctggtgcggccatgattgctgcgatggcaacgcctaacgctgttttacgccatgctttagtgcggccgatgaacagaagtatcaaaccgagcaggccgccagcgatgactaagaatggctgccattgataatagagactgacataccaagcctgcaagcctgtggtgaccacgattgcgattggcaaaagccatgcttgccaatgtttcagatcggttttgaattgtttgaacatagtgacagttccgatgccgaataaggcggcaattggtggtgccaacatgatcatgtaataaggatggaagaagctggcgatggagaagaagccagcaacggggatgagccaaccaagccaaaagagcaagtgattttgttgaatggttgtctggtaccatttccgtttgcggtccaaatagtaggcaaaggcactgatgaagccaatgattgcagctggcagaagccaactgatttgtggacctaaatcagattgcaataggcgtaatggaccgactgtcccgatggagaaagcaccaccagcaccgccacgttgactgccttgacgaccacgtgtaccgcccttaaacgtcccttttttgaagttggcaggcattttgcgacctgtaccagcgcctctttcggtcgtcacagcgggttgcttcccagccgcgccagtcttagtgccgggcatttttgttccggcaggtggtgttttgcctgtgttgccggcaccaggcgttccagttggtttcctagcagtcgtgccacccggcgccgtgcctttagcaccggttggcggtgtgccagcagtgccagtggagccggtcttggatttggtacccataccagggaaggcagcaccagttcctgtagtttgtccgagtaatcgttcagtgccgttgtagccaaaagccagctccaattcagagttagtttccgaactgccaacgtaaggccgttgactagtggcggttgaatccacctgtattggccaagcgagggtggtgacggccatagcaaccatggcaatagccaaggtgcctaagcgccgccaaagtttctgattggaagccagccagaagaataagagcaaagccggcagaatcataaacgcctgtagcatcttgatgttaaaagagacgccgattagcgcgaaactcacaacaacgagccatggtttgcgattgctaatggccttcatgaggcaccaactggcgagtaagagaaagaattgaagggttgcatccatattattcgttcgtgaatcagcaacaacgatcggtgtcagcgttaacgccagcgcagtaagccgtgctgcccaaatgttaaagcgcggtttgatcatgttgtagatcaaggcgacgctgccaatcccgaaaagaatggatggcaaaacaacggaccaaccatgtacgccaaaaatttttgccgaaatagccatgaaccacaaggcaactggcggtttatcaacggtgatgaagccagcgggatcgaaggcaccataccagaagttatgccagctttgaatcatactggtaatagcggcggtgtagtagtcgttagcgttaccggcttcccaaatattccaagcatatagaaaggcggctaggatcagaatgccaataaaccaccaatcaacagtccactgtttaatttttttcatgtgcagcaactcccttttctcgaaatacccagaacttgcttaaaaggaagttcgttgggacagtgatcatcaatgcgaacataggcgcaagcggcttgggtagtcgtaagaaatcattccaaaaacttgtcaaaactaaacttagaatgaaggtcaggccataggagagataataacgcggtgccaccgttttgagttggcgtcgatcccttgccttgaacacccatgtgtcattaagaaataggccaaaaatggatgtcagcccgtagccaacccccatggcggctgtcgggttgatcagctgatataatgtcaagtaaatgagataagttaaaatggtattgaccccaccgaccaagccgaagccgatgaattgtttcagcttttgacgcatcaaaccgctcccttcttggtgaatgggatcattatgagagttacagcataaattaaccttaaagtcgggcattctatttcttaagatggctttatggttatcatgatatggtcagatcagcagatataaggttaccaacaaataagtggggcagaacatgacagttaaaccgagaattcttgtgatcgaagacgatccggatttaaacgagagtattactgattttatccgcgcatttgccgacccagaagccgccttaaacggtgctgatggtctgtatttggccgaggaaggtatttttgatgctattattttggacattatgttgccagaattaaatggttttgacgtactcaagaagttgcgggcaaagcaaattaaaacacctgtattgattttgacagccaaagatgcgctgaccgataaattgcacgggtttgaacttggcggagatgattatctgacgaagccgtttcatcgtgaagaactcattatgcgtttgaaggcgttgttaaagcgaaccggtcacttctttgacgatgacggcttaactgctggtccttttgtggtacatgtgacgagtcatgaggtgctcatcaacgatcaaccagtggccttgaacggtaaagaattcgatctgttggtttatctattacaaaatcagaaaacaatcatcaccaaagatcagatttttgatcgtttgtggggatttgattctgaaacagctgtcagcgtggtggaggtttacatgtccaacctgcgcaaaaaattaaaaccgctaaaagttgagcattggatcaaaacgattcgcaacgttggctatatttttcaggagccggagggcagtgaatgaacgcagaaaaaggtattaaacatcagcaacgtcgcttattcatcgggcaactgttgagctttgcgggcttgtttgtggtattaggtatcattgtttttttcttatatgagcgctcaatttatcaagacattgatcacaccttagagcagcaacaagcaatgattcttaatccaaacgaagaaacgacaaagcttggtccgcagcaacccggtacgagagtcactcacccagcacctttccggaccaacatggtggtctttaaccaaaaaggccgcatcattaatcaagccatgcttggtgagcggttttatgcttactttaaaaatttaaaactggatcgatcagcgcaaaacaagttacagacattgaccacatcaactggaacattccggacgctattaatcaaagcacctaaatacagcgcagatcctcagtatgccggtcactatgtgttaattttgcaaaataccgatgcacaggaagcagcgattcgatcatttcggcacgttctgattgtcaccattattcttttttgggcattggcactcggcttgtcatactggttgtccacacgtgctatgcggccaattgtccggtcatggcagcggcaacaggatttcgttgccgacgcagcacacgagttgcgggcgccacttgccgtgattcgaagcaagcaggaagccctgctgacgaaaccacaagcgaccatcattgacgaaagtgaggcaattgcgacttcgttgggtgagacgaaacgcttgcgtcagctgaccgatgatctgctaacaattgccaaagccgatagcaacaccatcgaaattgaattggttgatcaaccttttgaaaaggcctttgaaccacagctgtcttcttatcaagatattgctgtcagtcagcagaagtccttcacaacaacgctacccaaggccggtcatgcactgtttgacacggcgaggatgaaacaactgttagtgattttactggacaatgcctttaaatatacacaggcgggtgattctatctgggttgaagtgacacagacaccacgtgattggcagttgcaggttggcaattctgggccgagtattgcggatgctgataaagctcgcgtttttgaacgtttttatcgagaagatgcctcgcgtagtcgccaaacaggtggtagtggacttggtttagcaattgctcggtggattgtgaccatgcatcacgggcatattgaagtcaaggatgtccatcctcatggcgcacttttcatcgcgaccttcccaaataagccgcgtatgcgttgatcaaaccaaagaacatagaaaaagctgcgtcaaaaatcaattgtgatttttgacgcggcttttctgttacgagttgttaagaatgcaccgagattacgtttcttgaaaatagcagttagcgagcagggttatttcgaacaccattggcttcggtgaagtcaataaagcccatattggtatcaatatcaccgccgtcaccactcaaaaccaaggtattcagcgttttgttaaagtggacattcatgtgggcattcaaatcttcttgcgaataacccttgatcagaattggcccaaggttactgtcaatttcagtgtcataatccgttgccggatcgctagcttttacgacgttaagtgagaactggacctgcatatggatcatcgcatgctgcgaataaggacccaccccatcttcaaacgtaagcagcaactttttgtcatcgcccagatgcggttggattttttcagtggcaccttcatcaaaatgaatttgcataggatcagctcctttcgccgttaacataggctgatttggcgttaaaagcaactgatttgtctcgcagggaaaatgacgttaaagccatcaaattatcgagtaaaagtgagtttattgtgattcaaatatcgacgcaccttaaaacttgcgccaagtttgaaacaagtttcagcatcttttaaatcaattccagtaatgtcactgatgtgcttgagccggtagcgcaacgtgtttaagtgaatgaaaagttgcctggcagtgtgggtgaggttttcaccagattcaagataagcgtccagtgtcggcaacaactcagttttattctcagcatcatgatccatcaatgccttaaccgccggattgatgaaaaatggcaaaatttcggcatgatcgacctgtgcccgcattaagtcaaaaaaggcatcctcacacatggtgacgtgagttggttgagatttaagcttcgcagtgcgactgcagacggcataggcagcgatggtatcttcaggccgcgtatattgattcgaaacgatcaaacgacagttggcacgatcggcaatggtcgctaaatcagctttaaattcagggttgttgtaagttggcaagtcgacagaaactaaggctagacattgatgatgataaagtgtgatcaaagtttgtgagaaaagcggggttaataaatactttagtcgctctttcaacgctgccaaagattgtccagcacgcggctcacctttaatcaaaaccatgcttgttggcaatgttgcatgttctttcgcaaactgagcggcaaaggtaccactttgttgttcggtaagcagcatggtgagcagttgatcgcgttttgaggcggcggtcggcatcatccggtttttgatcaaggagctggtgataattttggcttcggctttgaagaaggcagtttgttcagcggtgagcggtctgacgcaggctggcatgacgaggtagcctagggcattgttgcgataggccaatggcagacataaaagcagcaagggcagctgtgattgctgaatgagaataacttgcgggatcaagtctttagcgggtctgaattttttcaatgcctgttggacctggacagaggtaatagctggcgctgtcaagtcactaatggccggcgcttgcgtggattgcgccacaggttgcccgacaagatcaagaacaatcaagggattacctaatgtccgggaggcttgattaagaatcgtgtcgaagtcctctgtgatcgctttaatagcaagctgattaacctgtgcttgtaaacttgtttcggacgtcaaaagacaaccagcccgatcgaatagttgagcaagttgcgactcgttttttagctgcgtttgagcacacagggacagttgtgcagtcttgccaacagatcctttcaaagtaatcgtttgatcagcagatacagcaagatacagtgaggtcggatgtggcgaaaaagtcgtatcatcgtcaaattgcaggcttgttatttcggggttttggagactggtatcaaaggctaatgggactgtttggtcaagtcgttggagcaaagtatttaatttcattatttattctcgaaggtgacgtgaaggtggcacgcgtcaattagcaaaaacatacaaatttatttgttcattcatgtgcaaactgtaccttcatcatacgttttgaaagcgctatcgtaaaggcgtattcgaaattgtgaataagcacacacatgaatgactgcgtgtgtggattcacgccacataggaggcaagcaattatgaaggattttaaggacaaggtcatgttcatcaccggggctgcccacggatttggtcgggtcattgctgaagaaggggcaaaacgggggatgaagctcgccttagtcgatatcgacaagccggctttgaatgaaacttatcaaatcgttgtggcaacaggggcggatgctgtgatgattccgactgatgttaccaaagaagacgaagtcaacgcagctattgatcagacacttcaaacatttaagcaaatcgatctgctgatcaatgatgcagggattgctttgccaggacgtatgtgggaattaccaacccgtgattgggaatggatcatgcacgtcaatgtgatgagtcaggtttatgcgatgaagcggattattccaattatgatggcgcaaaaaacgcacggggcgattttaaacgtcgcttcgatcgctggcttggtcgataccccaggcatgcctgcatatcacgccagcaagtttgctagcgtcggtatgagtgaagcaactgcttatgacctgcagcgggccggtgctgatattgaaatgcatgtgatgtgcccaggttttgttcagacggatctttatcacactgaagaacatcggccaaagcaatacagcgatccaagtgatccttactatcaaagcgaggctttcctgaaaggtcaacagtttgccaaatatgtgatcaccaacggtatgccacttgatacgattgcggcgacggttttcaaagcacttgaagaagatcagttctacattttgacccacccacagttcaacccattgattttggatcgggtcaatcggatcgtcaaaaatggtgcaccagatgtccatgtgatggatgggattatgtagttagttactttcgataacacgcgaatcagtgcctcaaccgcgctggcgagcgttcacaaaaaaggagtgtcaaaaatgtcgagttatgttgtgagtcaagaagacgtgaagaactttctgaatttaccaagtatgaatgatcaagaagggatcagttttgcctatgccacggatccagacgccttggccaaattgattccggcaccgttgaagttggttgcaccagttgtgtgtggctacgtcgtccacatgggtaagccgtcgtttggcggaccttatctggaacaaacgctatttgcccttgttagctacaaagacaaaatgatgggttcctatccactaaccttgctcctgcatggccctggtgctgaagccggcttggtggcaggcaggtattcctaagaagctcgccgatcacatcgaactgcggcgcaatgacaacagtgccagtgccacggtggaacgtcacggcaagacgctgctttcggttgattgggaagctggggatgtcaatgatccttccattttgcaaacatttggcagccaatttgccttaaacaaagaatccgaaatgaacagttttttcttcccccatgatcttgtacaggataaacaaggtgcgaaccactttgaaaatgttgagctggtcgccacgcagatgaagtcgttggctgatcgagttgagccagggaaactgtcgattcaacttgcatcaactgaagatgatccattcggtgaattgctagtgctcaagccgcttggtgcgatgtggtatcattttgcgacttcgaccatgttcaacactttgcatctggaacaagtcgatgccgataaaaccgccccttatttgatcaccggtcgctacgatcgcagcatgatgaatccgctggcaacgacctatattatttgattgaaaacggttaatattgatattaagaaatgagacaaataaaaatgacagaaacagtagcaacaaaaaaattaactaataatgacttcgcagacgtgatgtttgatcgccactcagttcgggtgttcgatccatcagttaaaatcagtcgcgacgagcttcaggaaatgattaaagaagctaccaccgcgccatctgcctgcaacttgcagtcgtggcactttgtcattattgatacaccagaaggcaaagaaaaattgaaaaagtctgccatgaaattcaactatccgcagatcaattccagttctgccatcatcttcatcgccggcgatacgcagtctcatgaagtttatcgtgatgtttggaccaaggtttatgaagacggcaaaatcagcaaggaaaagttggaccagattttcaataccttcctgccattatatgaaaatgcttcacctgaatttctgacattagatgccaccatcgatggcgccatggttggcatgcaactgctgctgacggcgcgggcacatggctttgatgccaatccgtggtccggttacgacttcaagacgattattccaacattgggacttgatccaaaacgctttgtgccagttatggcagtggctattggtaaagcagctgagaagccgattcatactgatcgctatgatgtgaagcagctgattgactatttggactaatatgacggcacaaactgtccgagatgagtgggcacgtttaattttttagaaatagagaggaagtttacgatggtcgatgcagtagagaccgatccattcggcaaagttgatgcgattgatgtgttggatttagccagtttggaggcgcgtgcggagaaaattcttggccgtggcgaatttggctatatcagcgaaggctctgacgatggttacaccatgcgccgcaacaccaccgcttttacagatgtacaaatgctcccgcgcgtgctccaaggagtggagaagccggatcaaagtacgacctttatgggagcaagactggcatcaccgctgttaactgcgccgatcgccgggaacacgctggcacatccaagcggtgaattgggcttagcaaaaggcgcaaaagaagccggtattatgatgtcgcaaagcacctttgcttccaagacaattgcggaaactgctgcagtcagcgacggtgccccttatatgttccaactatacatgccaaaagattggtcgtattgccaatatctgttagatcaggctaaacaagcaggcgcattggcgatcattctgacggccgattcgacacttggcggctatcgggaaaaagacgtgatgaatcattatcatctcaaaggccgcttagctaatcttgaaggttacaatactgggcagcagggagttggcgctggcggtttgtttaaagaatccatgcagaaactggatcttgcaaccatcgataagttggcctcttattcagggctgccaattattgtcaaaggcattcagcatcctgatgatgcggttgcggcgattacagctggtgcagctggcatctatgtttccaaccacggtggccgccaactagatggtgcgccaggtgcgattgaagccttaccagcaattgcggctgcagttgatcatcgcgtaccaattatctttgacggtggcgtccaacgcggcacccatgtcctgaaggccttggccctcggcgccgatcttgtcggcatcggccggccattcagttatggcttagccctcggcggctgggaaggcgtcaaggcggtagccgatcacatgaagatggaaatcaacatcgctatgcaactaaccggttgtcaaacgatggccgacgtcaagcagatgcagattaaaaccacttttgcataatcagagaaaatgtccacctgataagggttgggcatttttttgtttcagggacaagatgatgattgttttggcaaatgctaacaacaaaaaatgccagcgacagtagacgaaattgtctaactgtcgctggcgtttttcgaaatcaacactgcctgcccagcaagaaatgttgactattccttttacgctatgagcgcaggtttgatgttcggtgaagctaattgccagaagaaaatcactcatggatcttaacggacttgaaccgtcgacctcctgcatgccatgcaggcgctctcccaactgagctaaagacccgccatgaaagctgatataaaatggatccaaacggacttgaaccgtcgacctcctacatgcgaagcaggcgctctcccaactgagctatggacccaaaacacaagattcattgtactgaacttccggtctgctgtaaagaggcatgcttgtgaatatcagagaagaaaagctgccgtgacggacttgcacaatgaatcgaaacgcttattttgaataatctcgacgcgagattaaggcggtgaagatgttttcaaagaaaccgccaatgataaagataagccaagaataagcccaaccgcccagaacgaagctagcaaggagatagatgacaaagatagccggccaatagacttggtgcaaaagtgctatatcttggcgtgctcgtgaattctgatgatgtttgtgcggttggctccaatgggtagcgtcatcagcagtgacattgtaccaagcagttgagtttgccgcagttgtcgcgtaagcataacgttttagctgagaataattgatggagacatagatgatcaggtagctgcctaggccagcaattgctagaaatagcgctccgccagcattttcactgataaaaccaggaatgtaggcagaaatgatgggtgggatgagagagccgatgcagatcataataccagcaatcaacccggcggcaaattgacgggtgtattccccggtggtcttgttggctagctgtttggcactggctgtgatcggccggtcattaagctgctttttttgctggctgaagacggtgccgccccagatgaacagaccaactgcaagtgcagcaagcagaaacatgccaatcacaccgaatccttcccagcggcccccgcctgtgtaggcaggcaaggcgatactgacggcgcaaagcaaaacagcaagggcaatttgggtggcaaactgatcagccatgtgccagaagctgcgaagttcggtttcagtaatcgcatcttcatcggcttcttcctcagcatcggtggggtccgactgtgttgttgtcgccgttgcttgtgctggcattcccagatcagcacgtagctcgtcaattgagccaaacgcgctgatgacagcaccaatagcggcttcttcgcttttaccttcgcgcaacagatcacggtaataatcacgcatgttagcgagcatatcggctttggcttgtcgggttttgtcattatcaggtaaggaagcaaaaagactatctaggtaggtggtgatggtatccatgggcgattcctccaaggttaaagattcgttagcggctgttttaagaatggatcgacaacggttttgacacgttcccattcggctgctttaacagcaagaaaattacggccgcttggggtaatgcgataataagtgcggggcttgccattggtgacatcccctgggtaatcatcgatgtagccatttttgctaagtcggttaaagacggcgtaaagggttgtttctcgaatgaggtattgaccatctgtgcgctcacgaatttctttgccaattttatagccgtaggaatcgccttgctgtaaaatcgcaagaatgagcgcatcattatacccacgcatggcgtcactgctaatcacagcatgacctccctctatcgttatggactgatgcaaagcacgtttcagagtgctttacatcagtactgcatctgttgaagtaatactagcacgattactctatcaggtaaagtaaaaaacaccctcatctaagatgaaggtgttgtcgaatagcggcttattagtggatgaaaactgtgatgaaagtcaccagcccgaacagaataccgggcatatttgagatgataatcggccagtctttgtatgttttagtccaaccatagaaggtccacaaagtggcattgatcatcgcaaccagtggttgaatcggattaaccggattcccggagaagttggcgatgatttcgggaatataagaaacatacattaaaatacaggtgaatgtcgcgactttactcaataacttgagtcgtttcactcgaacggggtcaaccccttcaggatactttccggtgtcaacgcgcattcataacgcctcctttttggataaaaataaccataacactaaattagtctaaacccaaggcatgtgtctgggtgtgatagaatcaagaaggcgacagaccgcggataagcggctctaaaaattttctgaaaacaagcagattaaggaggattacgatggcagaacaatcggagaacaccgtgacgcgaacacaaaagcaagaaggtgcggatgcgattatggataagggttacgtcactgagcgggatattccggaaatgatgagcaaaacatggagcgaacaacttcttgatgctgttaatgatgagttgcgcttgcgcacggtgaccaatcgtaccgtgttacagcaatttcactattacatgggcaacggcacgatcatttatgatccgggtcagctgaactctgaaggtgccaagatcgccttacagcacgccttaggtttccgcaaataaagctaaactgcttgtgatggttatcggcagtttagctttgtttgatggtcgtgagtggtattaagcaaaggggccagtcaaaacaaccttgcccacttcatggccaccttcaactagagcggtcgcattcttgagggtgtcaaccgagatggtgtcaaaatgcttggtcactgatgccttgatttgatggtcctgatagagtgagactagacggctcagaatagcaccttgagaagccacatgataatcaaagtcggttttggcaaacatgtactcataatcaaaactggcagccttatctttaacaacggccaaatccaaaccagtttgtgggccaacaatacagcctatgtggccaaaggcacgaatcagctgactggctgctgccaagtaaggttctggttgataaagcaacgcgataccgtcgactgtttgcaagccggcatgttggacttgggcaatcaaatcctgatggtaatccagtggtgttgcaacgccgtgatcaagcagccaaggatgattttttggactgctagttgctaggacggttaaaccgctccaacgagctaattgacaaagcatggagccaacgccgccagcaccgttgatgactaacaagtgttgtcctttattagcgttgaattcggggataaagcccattttttcgaagagtaattcccatgcggttaaaccgacaagtggcagtgcagcaagatcggcatctggggcatcagctggcgcggcagcgagtaagcgggcatcaactgcctgatattgctgattactgccgggacggtgtgttgttccagcataaatgacgcgatcaccaggcttgaagccggtgacattggcaccgatctgtgtaatcgtcccgactgcatcatagccttgaatttgcggtgtttgatgctttccagcaacttgtcggcgtttcgtatcaacaggattgacggagaccccggcaacagccacgatcacttcgcctgactggggctgcggcattggcagcgtgaactgttgaagactgttgggtgccgtgattggcaacccttctgtaaagccaattgcaagattttgtgtcatcgaaatcgccctttctgtaaataaagacctactgtgattgtaacctttttccacgaatagttggaagttccggttttttttggtaaaatgtgcaagatattgcaaggaacagtatggtgttggcacagttggcggttgataaatctgcaggttatgaaccattgattgtcatactaccggttaccatcatgaagacagcgtgtgacgcggcagcgtttctaagtcgaagatcacattaaaggaggctgcaaagtgaaaaaacttggtactaagcgcgaattgatcggtgttgtcattgtcttgctgttggcagcagtaggatttgcgctctttgcctggtatacgatgcggccaacagataccattggcacgattgccacgatttcttttggacttgttttgtcagcattgattggcattgttctgattttagacacggcagcgaccacgcgctggcgccgattctgggtcgatctactttttgcggcattgatgttgaccctgattgattatttcttcttagatagcacggcaccatggcagatgttggtggcaggagcaggggtcgctctggcgattgtcgcattgctggccattagaaaaatcgatgagtaagttgctaaaagagtcagatgaatagggtataagcctagtgaaagtaaatgaaaactccctgaaaattttcagggagttttttgtcgatacttgctgatggtaacaacttgtggcaaacgctatttgttattgcatcgctagttcatgcgttggacagtcacaggcactgtttttggcaaaactttcgtgagttccgtcataaagttttgaagactagcttggaaagtcaggcgaaccatgcgccgtttgctaagagcaaaaacggcaacaacccattcctgaccattaggcaaactaaccggcgtcaacgtgatgctggacatgttcgcgtaaggaataacgcgcgccagaataccattcgcgattaagcgcgttggcgccaatccaccggtaccagccatgatcgacaaaaccaaaaagattgagatgaagacaatgtaaggcaaattgtcgacccgagtggtcataaaccaaaagcctaggaaaactgcccacatcagctgggtgacagcgtaacgagaagcaacttgaattttactttgccaataaagatagtaaccggcaagcgccatcaggatgacgtcaaggccgatcagaaaaacattaaaattattcatgaggaactcctttttgcttcgtgtcatctgtggcatgctcggcttcatagagcccggaaacctgttgataccaactgaagaagcgggtgaccacgatcttcaacacggcgaatcctggaatgccaagaataacgccgactaagccgaatagattacctgctgttaacaacacgacgacaatggtgatgggatgtaattcaagtttactccccatcacaagcggtgagatgacttgtgtttcgatgagccattcaatgaaaaagacgatgatgacagctaagatcattcgcggggaggttagggcacccatgatgagcggcggaatcatcgccaaggctgagccaaagtatgggatcaaattcagtgggcatgccaataagccgaagataagaccataacgtaaaccgatcactgaatagccgaccatgaacatcacggcaacgcataaggcaacggtgatttgaccttggacataagaaccgaccttttcattcatctcatgcaacatttgcttgactgaccggcgaagtttagttggcacgatatgaagtaccatcggcgtaaatttgtcgccgtcttttaacatgaagaaaagaatgattggcgctgttgaaatggtgatgacgacattaccaacaatgccaattaagttctgcagttgagaaattgtgccggttacgaaggcaccttgtttaccagtgaagaaactttgcacttctgctgcaatctcattgagatcatgctgtgagagaatattctgctggtcattcagattatccaaccatttgccaatttcatcaaagatttgcggcgctgaatggacaatactggtaatttgattgcttactgctggaatgaagcgcaacaatccccacgccaacaaaccgatcagcacaatgaatagcaggccaattgcccagccacgatgaagtccgaacttttctaatcgattaataatcgggacagtaaggtagaagagaatgccggcaaagataaacggtggcgcgataatcccgagaaaatccagtactggctggaaaacccacgcaattttagtgaaaacgaaaatcacgagcaatgccagtaacaggtcaactagcaggatcataaacttgctattaagaaagcggcgatagagccacgagtcggtatgtttcaagggggtaccctcctctacaattgtgatacctgttggatgtataagcttcatgacaataacaaacgatgagagcgactagccagatttgcggcagggccctgttcacgctcattaaaacgcgttcacaggcacagaaacctgcacataaggacctcccaacaatgacccaagcccggccatttaggttggaggccacttatgctccggtttctaaacgtgcctgttcacgctctgtaccattaatgatactcgactcatggtcatatttcgaggatagccgtgttaaaagcgagttgatttgatgttaaaaaagattacataaaatttacaaacaacatggaataatcgttacaaatctttaaaagccctaaataaaggcatcaaatgtaaattttatgtatacaaaggctttacaaaactcaaaaattgggtatgattagagtcacaaccaaaacggtgagtatatgtcggtttatccgatacggagaggagtgaccccacatgacaatcctacggggcgcaaaatggacattaattactctgaccctcgtggcaaccttgctgttattcagcaactttgcgacagccggcattttgttaatcgcgcttgatattttcttgagtttcttctacgcggtcatcaaaagcagatgtgatcggcgtcagatgcataagatgccattattgcataattaatttaaggatgaggtccacagatgctttttatctgtggacttttttgctatttaggcataaaatcattgcaaacgttcgttcgctttggtatgctttgtgtaatcaattagaactgaggcggtgagcggatgccaacacaagcaagtcagaaacgttggaaacaaattttacaatcaatctatgatgcaatcgaggatcatgggtacccgcccacggttcgcgaaatcggcaaatcagtcggtctaagttcgtcaagcacggtggcagcgtacttggagaaattgttggcggcgggacttattgctaaggatccagcgaagccgcggacgcttgaagtgacctcagccggacgtgacttcattggcgttcaggatcacggtattccgatcgtcggcacagttgctgcaggggtcccgattacggccatcgaaaatatcgatgattattttccggtaccagacgatcttccgtatgccgctgacgaattattcatgttgcgagtccaaggtaattcaatgatcaaaatcggcattttagatggtgaccagattattgtcaagaagcagaatgacgccgagaatgggcagattgttgttgcaatgactgaggaggatgaagccactgtcaagcgattttataaagaaaagaacggcattcggttacatcctgaaaatgacagtatggatgatatgtttttcccggatgtaacgattcttggcatcgttgtgagtttatatcggccggcattagtttaaccatttgaagtcgtgaatgactaggcatggcaacttaaatccaattaaaaatgtcccatcaacaaaagagacatcagctgtgatcccacaaaatataggatcacggctgatgtctttttgctcagacactttattggttttgttgggcgaggcgatcgagatcgtcttgtggcacctttttataaacgggaccatcgggcaactgctttaagttaccggtttttgttaattgaaattgtatcgtattagcagaggcttgcggctgagctttaccagtgaaggtgaagattcggcctttgagggtcaaatcagcagcaaaaataccactatcagtactttcaaagacaccatcccgattggctaatgtttcaagatagtagccgctggtggatgaggtgactcgaattgctttggttgcatcttttgtttggacgaacgcatggccaaccaatgtacctaaggtcgctttcggaacagcttttttgaccgtgtgcgattgtgatgttgcgctcgatgatgatgttgtctttttgggggttgaggtagtttgtgagcagcctgataagatcaagattgctgctagtagcagatagcgctttttcattcgacagcaactcctagtgaatgaactggatgcaagtcatcacgattgggatcacgatcatcgaaagcagcgttgtttcggtgaccatgatagcagcgtaatcggaatccgcatcgtacagtttggcaacaacaggcgcattggtcatgaccggcatgcaagattgcaaaataaagatttgtttcatcaaagttgggacaggggcgaaggcgacaagcgccgtcatgagtaacggtgcaaagaggaagcggccactgaaaatacccaaagcttctttgctgattcttaatttaccccagcctgcttgatgcaaagcaatgccaatgaagaacatggagccgggaacagttaaggcaccgatataagtcagatcggccatcaagaaagtcggcaatttgatttttaaaagcacaagcacaatccctaacataaaaccgagtaacggtggtgagaacactttcccaagtgcctttttcaaatcaaatttagctgggcgcgggccgtcaccttgaataaggtaaacgccgatggtccaaaaaatggtggtgttggccatgtagtagaccaacacatatggcagactactcggcccaaataaggctaagttgacaggcaaaccgataaaaactgtgttggagttaaaaaacattgacttaaaggtacccttacgtgcatgtggcaccttcaataagtagcaaaccagaaatgataaggcaaataggatcatcatggaaaggactgggaaaaacaaatctggcaagagtcgcagcaacattggcgccgtgaattttgaagcaatcgtgacaatcatgtaggctggcaaagcaacttgggtgacaactttggcaatgattttacttgaatggtcattaaaccacccgcgtgctgtcagaaaatagccgattgcgattagaatcaaaatttcaagaacaccaaaaacactggaaataaatgcggtcaaatactgacactcctttataaaattattttggccgccgcagtgtaaaggtgcgtccaagctcggcgtatgtcggcccggcgaggcgggcaatcggcgccaaagcggtgggatcaatgtgaagcgttgtcggatcaagaaccgtatcggcaaaatggaatcgttgcacttctaaaatgaaaagatcagtcaaaatggcaccatcagcgttacgaatcggcacgtattgataaagcttggtttcaaatcgaacacgcgctgcctgcaaccccggcacctgaatgtccgtacttgcaactaacggcaggttaatcaacgacaactcgctttgatcaggtgctaagcgggcagctgtttgattcatggccttcgtgagatctgcactcacgatgtgaacaacggcctcgtggcgcgccaatagatttgcagcggtatcctttgcctgaccccgatcacgtaaaactgctactgacaacagtggcagttggtttgaaatcccggtcgtaaatgaaaaaggcgctaggttgatgaggccagtcgtgttttgcgtggtaatccaagcgattggccgcgggatgatactgccagccagcaatttatattgatcacgcgcggataagtcggcggcagcaaggttgaacatcgtggtcctccagaaagttggtaacgcggcaggtgcgttaaattgagtgggtcgcatttgggtgtggtcatcaacttgattttgcccaccatggttgcaagtttagcgcaggcagttggcggcgtcaaagtggaaccatcatttggcatcattggtgtcagtcatggcatgttttttaaagtcatcagaaggatgtcattgatcatataaaaactgacacctgaaaaatcgggtgtcagtaagattttttaaggaaattaattaactgggactactgcttgaaactgccgagctgctgtctggtgacggggatggttgttcactagatgcgttcgaattgccgtcagtttgggactcgttttgaccgttattgttatttccattatgattgctgccgctattatcaaccgtgctctgttgactttccacactcggctgaacagaaggcgctggcgccgctgatgatggtggctcgcttggttggctaacgatgaccggtgcgctgctgacagtgcttgactgtgtgctggctgtttcttgcgtggttttgaatttagccagactggttagctttttcttcgatttgcttagtggcaaattggtctcaacatagcgataactgtgcggtgttttgtttttcagcgtaatcgtgttgttcaactcggatgtgagcgtcttggtgtagcttcgaacagtgccggtcgcgccatcgactgaatactggcgaacggcagtcggcttattgttcttgtacgtcgtcgcacttgcatattcataaacattagcgtggtcggatgtcaatgttagtttgccatttttacgcttaaaactgccggtgtcgttgacgacaaatggatgcccatgaggatcgagaatgagcaggcgagtgtaggtttggtcatctgtcagcttaacatagacggttaagtcatgttgatcacggtctagatcgatgaccgtgcccgaagccttataagtaccgctgttaaatgggtgtgtgacggtgactgaagatgaaacactgctgctggaagacgccactgggccttgaactttagcaccgcgaagaacgagccacataaaaacagctacaaaaataaccgcggtaccaataccggtgagcgtgagataaagcgttcgacgattcttgcgaatacgttcacgtcgcatattgtgcctcctgaaataagatgaaaaaggtttattttaatataaggaatgtccagtagaaaggcaatcttttaccaaatgcttaacctaaccgttacacaatgacatccccattagcaagaatcaaggtttgaattggcacatcaaacggctccacaggccaagccacttgcggaaacgccatcacgggtggtaccagtgtgatcgtggtgccgcgataagttgtcaggaagcgatcataatagccgccaccaaaaccgatgcggtacttgtcagccagcgaaaagccaatgccaggcaccaaaatgagatcaggggcggcatgaatctgatcggcttgataaggcggctccgggataccaaaagcactggtgatcagcttgtctttgccaggatcaggtaggaaaaccatttgccgcttgggcatgacccgtggtaagtagacggctttattggcgtcgtgggccgcctgaataattggctcggttgggacttcaaacggtccgcttacggtaacaccgatgctgtgaggacgttgccacataggtgtttgaactagtgcggccaaaagcgctgcactggcagcctgagtcgctttcttggcggctttcagacgttttaactgaagcgggcgaaattcggctttgcttggcatagtgacctcactttgttttgagtagttcgcttagaacaacggcttggttatgcgtttcgtccttggcaccatagagcataatgactggctcttgttcatgttgcttcaatgttttgatgaagtctggcaggtcaggattagctgctaactcagctaagtaccgcttcttgaattcagggtacttttcaggatcgtgaccaaaccacttccgcaactcagtggacggcgcaatggttttggcccataaatccaaagcagcgttaactttgctgatgccccgtggccaaactcggtcaacaaggacacggaatccggatgcttgcggtttttggtagatgcgttcaagtgttactttcaaaatcatcacctcactgactattctaccagccttggcaactagtggccgaaggggaggatagatacgttataataaaagagaacgtgaactggcgcgtgtagcaatccgcgtgtgagcattttggacgggattggcatcgcggacaagggtgcatacagaacggcctctgcgccagtaaacgcgctttaatacggccaagaggtgttgaaatgattacgcgttatcagatccagccacgaggaaatatgcaggtaaccacagacgatcaggctaactggattcgagtttcggcgccgttgcctcaagaactacagacgctggcgacgacatacgggctgccagcaacctatctggcggcagcaaccgatcaacatgaaaatgcacgagtggagggcttaaatccggcagatcaggtaccagggttgattgttttgcgttacccagttgaaacgaccagtgaaacggggtttgatcaatacaatacggtacctatgaccatgattctactgaatgatcgtgtgatcacgattacccacgattccttacaagctttcgatgatttggctcaacaaaaactttctcctaagcctgaagagtttgcactggaagtcctgtggttggtgctgcatcaattcgtgattgcaatggacaagctgaatgatgaaaccaagcaaattgagcgcagcttaggtaaggcggccaaaaacacgcaactttatcagttgatggccatgcaaaaagggctggtgttctttgatgcggccttggatcattctggtacgctgcttaaagccttacgcgacggcgagcgcttttttaatacgaatgggtacttacggcggttgcatgatgttgaagttgaagtggtcgaggctcaaacgatggttcggatcaccgagaagttgctgacgcagtattcaactgccgtgagtgccattgtttcgaataatttaaatttgattatgaaggtgttaactagcatcacaattattttgacgattccaaccattgtgggtggtatatatggcatgaacgttcgcttaccgtttgccaacgcttactgggctttttggtggttaatcggcggcacagccatcttgtgcggcttggcggcatggtggttgtggcgtcaggattacttttagcattaggtactttgaaaatgggtgtacaaatccccgtgacgtatcgctatcgtcacggggattttgtgcgcgtccgtcagcctgagtagaaaccggcgcaagtacgaggaacgtgatggccggccttaatccttgcgacctagatccttatgcggagctttctgggttggtgaggcacgatgttgcagacgaattagtctgttttcacgactgacatgacagcgttagtttgccgcaaggatttgattaaagtgctgcattgctggtgtcaaaacgcggtctttgcggcggacaatggaaatggtgaaaaccggctgttttggatcagtgagtttgacagccgcaagatggtcatcaggattgatggcgagatttgtcaaaaaaccgataccgacattttgcgccaccatttgcttaagaagttgcacatcaccggtttgatagaccacgttggggatgaatgccgactgttgttgaaaccatgtgaaggcgcgagtgtggacgaaggcttcactgagcgtcacgaatttttgcatcgccagttccgcgaatcgaaccttgtctttttgggccaacggatctgattcaggggtaataatgacaaatggcgccgtgccgatttggctgatcgtcaaatctggctcctgtaatggtccactggcgccaagtaaggcaaaatcaagatcgccttgtttgatttggtttagtaaggcggcggatcctgcttcaactgtttgcaattgtggcattaagccggcggcaataagctgcggtgcaatttttggaaagaagtagttaccaataattggtggcaagccaaatcgaattttgttggtctgatcccgcgcaatttcctgctgcgccaaggtcaactgctgaaggatcacttgggcgtgtgctgctaactgtttgccagctgacgtgacaccaatgtcgtgatgacgccgatcacgaataatgagttgcgcttgaaaactgtcttcgaggcgcttgatggcggtcgtaatcgttggttgactgacggcaaactgctctgctgcttgtgaaaagttgcgggtctgcgttagcgccagaaaatattcaaaatcgcgtgtgttcaaagtgttacctccatgaaacggttgatggggaatagaagaccaattctttgattaaagcatataaaaatattttatcactcctgctgggtttgactataagatttgtcggcgtgtaatgtgacctgctgtaaagaagaaagcccgagcaatggctggttgctatccgcgctggctggtgcgcaccataacgcgctccccagcgcagcaatctgcgtgtaagaaccttggtcgcaatggttaaaaaacgaccatcacgcccaaggccgcttacattccggttgctaatcgcactggctcgcgctcaactataacgcgctcgcagtcgcagaagcttgcgcataaggagcttgaacccaaatggccaagatcgagccattttgactcaagcccacttatgctccagcttctaagcgctcctgctcgcgctcacttaaaaggagtgttgattttgaaatatacaccagagcaaattattaacgatccgtttttaaataaggggaccgcttttactcaagcagaacggaatcagtatggcttgaatggtttgttgccaccagctgtccagaccttggaccaacaagtcaagcaagcttatgctcagttaaagaccaagccgactgatctggctaagcgtcagttcttgatgacgctttttaatgagaaccatgtgctgttctataagcttttttccgagcatatcaatgaattcatgccgatcgtgtatgatccaacgattgccgatacgatcgaaaattacagtgcgctgtttgtcaatccgcaaaacgccacttatctgtcgattgacgatcctgatcatatcgaaagcgcgctgaagcatagtgccaatggccgtgatattcgcttgttagtcgttagtgatgctgaaggcatcttgggaatcggcgactggggcacccaaggcgtagatatttctgtcggcaagcttatggtttataccgctgctgctggcattgatccgagtcaagttctcccggttgtgctggatgttggcaccaataatgaagcactattgaatgatgatctttacttgggcaatcggcataagcgggtatatggcccgaagtatcgtagctttgttgatcaatttgtcaccacggcagagaagctattccctaatttgtatctgcattttgaagactttggtcgcagtaatgctgccgatattttaaatgaatacaaagaccggatcaccacgtttaacgacgatatccaaggaacagggatcattgtgttggctggtttgcttggtgcgatgaatatttctaaacagaagctgaccgatcaagtttatctgagctttggtgccggaacagccggtgccggcattacgtcgcgggtatatgaagcctttatcgaagaaggcttaagtcctgaagaagccaaaaagcatttctacttggttgataaacaaggcttactttttgatgacatgtctgacttgacaccagaacagaagccatttgctcgcaaacgcagcgaatttgcaaatgccgatgcgttgacgaatcttgaagccgttgtcaaggctgtccatccaactgtcctagttgggacatcaaccgtgcctggaacctttaccgaaagcattgttaaggaaatggctgcgcatacggaacgtccgattattttcccgttgtccaatccgaccaagcttgcggaagccaaggctgacgatttgatcaagtggacagatggccgtggtctgatcgcaactggtgtaccagcggctaatgttgactatcaaggtgtcagctatgcgattggtcaagcaaataatgctttggtttatccgggccttggcttaggcaccattgcttcaacagccaaattgttgacagattccatgatctcagcagcagcgcacagcttaggcggtattgttgaccccgatcaacctggtgcagcggtattgccgccagtttccaagctggatcagttcagtcagactgtggcaattgcggttgctgaagatgcggtgaagcatggtctgaaccaaaagccgatcaaagatgctaaacaagcggttgcaaatatgacatggcaaccagaataccggccactgccggattcactcgaaatggacttgggggaataaacgttgactgcattaagtacatccattcaaagtgttctgacgattgttttgctgatcgtcgtaggttatgtgttgcggcggcaaggacgctttgatgatcaatttggtaaaacaatttctgatttgttaatgaaaatcgccttgccagcatcgattttcatctcggtcttgcaacgcctaacgttggataagttggtgagtctgtcatcaggccttgtttatggctttggtgccgtcattttaggctacctaatcgctttcttactggtttggttattaaaagtgcgcccaggtcggcgcgggacgttcatcaacatgtttgtgaacgcgaacaccattttcatcggtctgccacttaacctcgccttgtttggcgataaggcggttccttattttctcatgtattatgtggtgaacaccgtgtcgacgtggactgtcggggccttcatcatggcgtgggacgatccaacccagaagaaatcagaaaaaagcagtactggcttcaactggaaaaagttgttgccagcaccgttagtcggattcttagtcgctttggttttcctattgttgaagattccgtttattcacgtcggttggttaagctttgcagtgaatgctcttgattatgtgggcagtttggtcacaccgttgtcattgatttacatcgggattattttggccgatgccggtctgaaagcgatccgctttgaccgtgataccatcgtggctttgattggccgttttgtcattgcgcctgcattaatcgctggcttgattctgctggggatgcatgctgggttcaacgtaccaggtcttgaagcgcaaaccttgatcattcaagctgctgcgcctggattggctgtattgccaattcttgctactgaggcgcatgccgatgttgagtatgcgacaaacgtggtcacaacatctaccgtcttgtttgtggttgtcgtgccaattttgatgatgctcgttcagggcttagcttaaacgtacgaaaaaagaagccgattatggcttcttttttttgtgcgattaatgttgatgagcttctagataggctaaagcgcttgtgtaatcaggctcatgtgtttgttcggtgattagttcacgatatttgacagtgccggtgccgtccacgatccaaacgctgcgagcatcggtgtgattatcggccacaaacaagcccatagccttgccaaagtcgccattttgatcagacaacaactgcatttttttcacgccttcagcggcacaccacgactgttgttcttgtggggtattggttgaaattgtatagaagtcagtatgatcaaacgcatccatatcttcattgaaatgtttggttgagatactgcaaacgcgtgtgttgatgtctgggacaacgctgattaacgttaatcgcttgcttaaatcctgcgtagtaacgggttttgcctgtgcattagtaacggtgaacgtcggcaactgctcgccgagttcgattggtgtaccattcgttgttaatgcttcgccatgacgggttatttccaaaaggctcactccttatatcgttaatgtggaatcgttcaagttcagtatcagtgtaccacgattctgaatgccatcagtgtagcatgcatttggatgaaacgaaattcgaacaattaaatttgctaaaattcattagcatatatattgacgcgaatataattatttatgtacattaacaataagcaaaatcatgccagatttttacaattgacgtaatcgaaaatgttagcgagcaaataaccggcactgcaggtgcgagaaggaggtggtcgaatggaacaagcattggttgtttacgcttcggagacagggttcacgcaacggtttgcccttggcattgcccaagcactgcattgtgaattaattgatgtgcaatttgtcaccactgcagacctgcaaaaacgcaaacttatcatctatggcggccatctcgtaggtgaaaaagtcttgggtctaaaggccttctaccgcgaatttcaccagtctttacctgatcagttgatagtctttggtagcgggattatccgacgggaacaagtggcaattaagcagatcaagctacagtatcagaaccgctgcgtcatgcctatcgatttttattacttacaaggccaacccaagctaagtcaaatgaacctttttcggcgtatccagacgagccttgctttaaaacaattaggcgccagtcattgcccggcaattcatgaaaccattcaacctcttttgagggcagtggtgcgcttgttggatcaggcaaatttatgatcgataaaatcgtaaaaaaagccgtcacttgggcggctttttttgctggggtactatgatgcgaaagtatttgtaagtagacgaagcgacatcagccttggatgagcatttaagcgatcaattacatgctcatcttttgaaaagtcctgggacgctcattgaggtcgcacatcatattagcgagatatggcaaaaacaatatgatcaggtgattcgacttgacgagcttgctagtcagcaataaacgcgaaaccgtttataactaagaaaaagactgggaattagcgatcaaccgttcattgcgccggaatggcacaatttagcggtgatggcttttcctagcctttcatgatgaggtgctacttagaaattgtggtgctaaatgtctgaggcagtttttttgtcattagccattgatttcatgactcagtgaaataatctcatccactgttctaccgaggaaggcaatggtttgcttcaaggcggcatctgtggtgacatcgacaccggctacccgagcagcagcgactggattgagtgagtcgcctaagcttaagtaacgcaaccagcggtcaacggcaggttgtccttgttgttcgatggcttggaatgcctgagtagcaaccgtgagaccagcggagtacgagtaggaatacaatcccatatagtaatggctttggcgcatccatgtgagctcggcgccttcttctagttcaacagccggtccccagaaatcagtgagcacctgacgtttgatggcattcaacgccgctgcatcgaaactgtcgccggcgtcaatgcgttggtaaactttgcgctggaacgcagcttcaagtaagtgggtgacaaagttatggaagtaggtgtcgttgagcaggcgggacaaggcgaagcgtttcatctgcggatctttagccgtttgatcaagatagtgggttaataggagctcattgaaggtcgaagggctctccactaaatagtcattgaaatcagcatcaagaatattgtgtgctttttcagagcgaaccatttgtgccgtgtgcccaagttcatgaattaaggtgtaaaccgcaggcagggaattactccacgtcatttcaacataagggtgaacgccatagggacccgcagtgtaagcaccggagtctttgccttgattggcagggaaatcaatccagtgatcggtgaacgcctgcatcatttgcgcttggtaatcatggcccatgatggcggtcgccttttcgatgtcttgcttggcctgatcaagcgtaatcgttggagagtaggcaggatcgatatcgatctgaaggtcggtataaccgatatgatcaagtccccacaattccttcacgtgggtgatatatttgcgcatgatcggtgccagatcgtgcataatcacgtcgatttggcggtcgaacatggcccgactgacttcctgatcggccagcaaataatcgatgacggaatcatagccgcgcatggtggcagtgattttttcacgagtgacttgtgctagataaccagccgccatcgtgttttgataccgacgcaatgtctggttgaactttgcataggctgcacgccgcacttcggtatcaggatgcttctgataattttcttcatacatcacgaatgacagcggataggttttaccgtgagccgtgaaggtgccaaaatccatatcgccgaaaatcgtttggtcgcgaatattgctaggcgcttggaaaacaggtgataactcggctaagaccttctcagcagcaggagccaaagcgccttttttagcaattttgatttggcggaaaaagccagcatagtcaggtgccttggcaacaacggcatcaaggacctcttcaggtaactgggttagttctgcttgaaagaagctcaattgaccaccaatttcaccatctaaagccgtggctttgatttggcgatcacggagtttaggatcagtggtatctgtcgaatacggcataaatgcccagtgtccaattttactatcaagttcgataatcgagccatagtcgcccagggcatcaacaatgatggccggttcggtcaactttccttgatatagatggacaaaatccttggtcaaagcgcgtacttgcttaatggcttcggtgtaagcaaactcatcagcaaaaatcggcgttaaatcccaagtcagttttggatcaacctcttgacgttttggcagtgcggtttcactcatcgaaaaaacctccttcgcttaatgggtaaagtatagcattggtctgcatgattttgttctgtggaatcgcatggggtagatggaaacgcatatcctcaaaaagcgactcgtggtaaaatcattaaaaaggatgtgttatatatatgggaatcgacaataatcagctcgtggcgcgctattttgatcgcaaagctgatcatgcagcattcttcaaggcgttagaagcctatttggatgatcagattaatgaactgtatacaacgttgaatgatactttcgcagatacggtgacgctgtcattagatgtggccatcgctaaggcgcaccaagccggcgccaagattgacgatccagcagctgaagaaattgcggcaactaactatttattcaaagaactctcttctcgcggtttgtggctgcaatcacctgatcaaaccgaaccgaacaccatcatcgctaaattgaatttcggcaatcggcggacttattattaagcctgattgatcatcaaacgagaagctgagacatcattcatagtaacgaaaaagaggcatgattttctgacttagggaaatcatgcctcttttactgcgtcatatggataacttgttaggatctaaagatgccagtgccaacgctgaacaatcgtaggccagatggggctcgaagaaccggctccgttctagctatgtgttgcaagcccgatctaaccggaaattgcggaatttagcacggcaagggactctttttacatcaccatggcaatttacccgcggtttctgtaaatgtcatattcaaatcagggctatcgtcagcggcgagtttgacgatttgagcagcaccttctgcaaccgtttgttcgccgctgcgattaccaccaaaatctgtgcgagtccacccaggattgactgagttgacactaatgtgatctggctgtaactcttttgcaaaatcaatggtggcgaagttcaccgctgcttttgaggcttgatatccaagtgaattcacctgaaagaagcgactgtcaggatcgctagccaaaccgagtgaacccatgttgctgctaacgttgataattttagctggagcacccttttttaacaacgggatcatcgcctgtgtgacactgactaagccgaaaaagttgacgtcaaagtcttgacgcattgtcatcacaggcaattgtgaaggtggttgatgggcatctaaggcaataccagcattattgatcagaacattgagatacccatgtgaggcttcaatttgtttagcggccgtcgcaatggtgccggcttgggtcacatctaagatgaccaattctgccgatacgccagctgtgtgcaacttgttaatagcctgttcaccgcgtgcctgattgcgcgcaccgacaagcaaatgctgaccgcgtttaccaagcgccattgcggtttcaaagcctatccctttatcggcaccagtgatcaaagttaacgtctgtcgtttaatcatgatccccacttctttcaattattgaccctatttttctggctgatgaggggcgtattgacgatcagggaaccagattggaatttcacgtcgggcacttgtctcactatcggaactgtgaatgacgttgcgaatagttttgtcggcccattcacggccaaaatctccacgaatcgtgccgggcgctgcttcggcgggattcgtggcgcctgtcattttacgcaccgcttcgatcacattgaagccgctcacgatcattgccaccatcggaccgcccgtcatgaagcgttcgattcttggaaagaaaggctcgccaacaagtgctgcgtaatgctgatgtaactgatctgccgttgcatgtgtgactttcagtgcatcaattgtgaagccgcggtgttcaatccgcgtgatcacatccccaatatgtccgtttgcaacaccatccggtttgaccaagactaaagtttgttcttctgccatgtgtgtgtgcctcgtttccttaactattttcagaaaattcctgcaatctcagtatacacgagtcaccgtcgaacaaaaaaggtcgttgggcattttcatcgttttcatcgccaattgatttttgacaaaacacggcgaccaagaaattcttgaattaacaagtaaaacggaacagttgagatcatgagtggcaaataaattaacgcgagttgccactgccagagattgacaagtgaaaaaattgagctgaagacgaagaagacaagaaacagggcaatgctgagaccacccagtaggccaaccttgagtcggttgaaaggtcgggcaacgacgagcagaacattcaatgaaatagtgccaatcaacatggctaccattgatgaagtggactcaaaactcaagtggaagaaagactccatccatgtcagcagtaatgtgtagatgacgacactaatggcagcaggagcggcaatggtcatgaccttctgcatgaattgaccagtcacgcgttcgaagtttggttccaaagtcaggaagaaggaaggaatggcaaccccgatagcagaaaccggtgtgaggttaatcggtacaatcggataatcaagtggcaagaagacaaaaatggtggctaggatgactgaatacatcgttttgaccaaatacatggatgccacgcgttcaatgttgttgatgactcggcggccttcgtttagaacgccggtcatggcatcgaagtttgaatctaacaaaacgaaatccgcaatagagctggcagcatcggcaccagatgccatggcgatactgcagtcgctttgacgcaatgccaagacgtcattcacaccgtcaccagtcatggcgacggtgtgccccaaagcttgataggccataattaaagatttcttctgttcaggtgtgacccggccaaaaacgttatagcgtttcacaagtgtttgataatctttggcggttgcgttgtctgcaatggtgctcatgtccacactttgatcagctccttcaaggcgagcttgcttggcaatgttggcgaccgtgatcggatcatcacctgagatgacttttaaagccaccccttgcgttttgaagaagtcgaatgtattaatggcagttggccgcaattcatcggtgatcaaaatcagaccgagcagttggggattaaccaacggatgcactaatttggttgctgtgccaatggctaaaacccggtagcccttagcagctgcatccttaatttgatttgcaatcggtgttggtaattgatcgccgaatgtgaactgcggggcgcccataaacaatacttgaccatcaacaacggcacccgaccacttacgcgcagaggagaagggcattgtctgcgtgacttgctgattggtatcgttttggaaggcggctttgatggccattgctgtttcgttgtcgtcatttagagcataaacaatagcggcggcggctttggtgactgtcgcttcagtttgcccaatcatcggcaatgtttcggcgactttaagtttgccactcgtgatagtaccggttttgtcaagacagatagtatcaactcgtgcgagtgcttcaatggccggcaaggcgcgaacgagaactcgtttaacggcaagattgcgggcggatacggctaatgccacatttgttagcaaaaccagaccttcaggaatcatgccgatcatggcggcactggttgttaaaatagcccgattatagttgcctcggcggatcatcgagacggtgaaaagaattgcgccaatcgggataagcacataagttaacacgcgaatgatgcgattgatcgttgccaacagttgacttttgctacctttttcggctttggctgccaaagcaagctttgccgcaaaagttgcggcgccaaccgcggtgacttgcatggttgcctgaccggaaacgataaatgcgccagaaagcagcttgtcgcccacttttttagtgatgggtcgagactcaccagttaaaggactctcgtcactttcgagaccattcgttgcgacaaccacaccatcgacaggaatctgatcaccgcgtttcaggtgcaccatgtcatccataaccaattgttcaagctcgattttttgtgttttgccatcacgaatgacggtggctcgagcagctgccaaaattgacattttatcaatctggtgcttcgcctgaatttcttgaatggtcccgatcgccgtgttgatgaccgcgacaccgagaaagagtaagttcttataactgcccgttgtcacaatcaaagcacctaaaaccacgttcaccaagttaaataaggtgaacgtatttactttgataatttggctaattgatcgcgttaatggttttaacggcaagttatgttgacccgcggcaaaccgttcttcaacttgctttgttgataatccctgatccggcaaaatgttctgctcagccatcgcatgccctccaatgcttttcattcattttaccaatcaatcccagtagatgacgaataagcgacctgtttttattaaactttgaagagtcttataagattgcgaagtggcttaatgttgttcatcaaccacgaaactcgcataatggaagacaaacgacaagaaagaagcggttgtatgccaaaacttaatccagacgggacgcaattcatcacgttatcgagtgggtaccatttgtggacacagacgcaagggaaaggtgatatccatctcatgaccttgcatggtggcccaggcggcaccaatgaagtctttgaaaattttgctgagcggctagcgccttatggtgtgcgcgtgacccgttatgatcagttggggtcattttactccgaccagccagatttctccgatccggcaaatcgtcagcagtttctgaacattgattactatctgagcgaagtggagcaggttcgacagcagcttgggattgaccacttttatctgcttggtcaatcgtggggcggtgtgctggcaattgaatatgcattgaaatatccagagcatcttaacggagtcattctgagttcgatgattgacaatcttgacgaatatattgtgaacatcaatcggattcgggaaactatgttttcaaaagaagatgtcgcttacatgcagcaaattgaacagcagcatgcgttcgatgatgcaaaatatcaggcgcttgtaagtgagctaggcgaacactacttgcatcatgcaaaagatccgcagccgcgtcacttaatcagtacgctggccacgccagtttacaattattttcaaggcgacaatgaatttgtgatggtgggtgcgcttaaagattgggatcggcgtgcagatatccaccgtatcgccgtacccacctacctgacgttcggcggtcatgaaacgatgccgttggcagccgcggaacgcatggcgaagacaatcccagacgctaccttacatgtcacgccgaatgctggtcatggacaaatgctggataaccccactgactatttcagtcatttaggtgattggctggtcaaaaccgacacgaagacggcttttcattctaaataacgttataataagaatggtaaggtaagtttttcaaaatatggaggtgcttgcatgtctgaatatgatgaattaaaaacaagcttgttcgaacctgtacgagcgtttgatcgggcattggaacaacagccggatttaatcattccattggcagttgttcacttgattccaattgctctgacacttggcggcgggattgctatcattcggggtcaccagaaactgcgtgccgaaaaagagcgcacgaagcagttgagcttgaagctggaaatgcataaacatcatcatggtcggcgtaattggcggctggcgccagaacatcgcggcgagcaggatgtttttgctccagaatatttggagaaaccggctggtaaaaatcgtcacgcccatcgtcggcattaggttgatttgatacatgaatagatcaaaagcctgagcaattatctattgctcaggcttttttgcttaagtatgcgcagctttacgtgttgatttttcacctgtgaacatgtttatcgtcgtgtccaaagccgtatgtaaaaaaattttttgcccatttttttacatattactaaccacaaaaactgccgcgaacttttatgcgctgtcattgaaacgggcgacaagatgcgggacaatgggtgcacgataatttaggagatgatgttgatgccagttatgttaatgcgtactgctacccgagaagatattcccgcgatgatgaagattattgcttctgctcggcaatttttgggcgaacaaggtatttcacaatggcaaggaacctatcccgatcaggctgcggttgaacaagatgtagcgacaggcatcgggcgagttttggtcgttgatgggcaggttgccggcatagccgctttggtggaagggcctgatccgcattatctcaaaattgatggtgctggttggttggccgatgtgccctatttggcagttcatcgatttgcgcttgatggcagcattcgtggtcatcaattaagtaaagttttctttagtaatattatgagtgaagcctatcgacgcggtgtctatgacctgcgcgtggatacgcatgcccaaaatgtgatcatgcagcatgccatcaccggaatgggcttcgaatatcgcggcattgtttacatggatgaaccggttcctgaacgcaatgcttatgaggttcgtttggcacactaacagaaagacacgaaatggaggagatcgacatgcaggacattggcaatttggcactgatcttagtcacaacgctggttttagcgcatttaagccgattgttgaatatgcccgctgtcattggggaattattggctggtattttgattggaccggcgttattgggctggttggcaccaagtcacacgatttcattatttgcggagattggtgtcattattttgatgtttcttgctggcttggaaagtgaccttgatttattaaaaaaatacttcaaaccaggcatgttggtcgccatgatcggcgtcattgtaccggtggctgttgtgttcgtttttggacgcagttggggcttcaacatgacaagcagtctattcttaggcattacctttgccgctacttctgtttcgatctctgttgaggttttaaaagagctacatgccctagaaggccgaaatggtgcgaccattctcggtgcggcggtggttgatgatattctcactgtcctcattttaagtttcacggtagcagtccttggtgagcaaaagaccgcgagtttgcctttctgggtgcaaatcattgaacagttgctctactttgccggcatttatttggttgtcaggtgggctgcgccatacttaatgggtttggcagaaaaaatgtttccgtcgtcggctgtgaccattatgtctctgctcatttgcctcggtatggcctatctggctgatcttgtgggaatgtccgccgttatcggcgctttcttcgctggcgtggcagtaggccagacacgtcatcgccatgaagtggatggtagtttgagtgcgattgggtatgccgtgtttattccggtgttctttgtcagcgtcggcttgaatatgcgatttgatacctttggccgcgatctagggtttattgcgattttgaccttattagccttagtcacaaaatgggtcggctgtggggttggtgatcgtttggccggtgcgagttggctacagagtaatgtcgtgggtgccggcatggtttcccgtggcgagatggcattgattgtcgcccaaattgggttcgaggccaaactcatggacgctgaatattactcggcggttattgttgtgattgtcctgacgacattgattgccccaattatcttgaaagatgcgctacggcgtgaacaggaacctgtataataaagatgcgcgtctatttaacgcgacataaagccgagcgtgcgtgcgagttcttaaaaatgtgttgactgggcaatcattgcgggactggcggccgcgtttatgagggggattcaaatggctaatttgttttttgactttgatggcaccgttgctgattcggaagtcggtatcgttgcaggattaaaatatatggttcaggatcgcggattgcggccgctggacaattcggcctacacgcaatttatcggaccagcgctgattgatatgcttcccaaggtttggccagaacttgatgacattgaagttaagcgggccattgatgctttccatcattattacgaagaggaaggcctttatcaggttgaattgtatcctaattttctggacacgatggcaaagctcaagcaacaagacaaccaactttacattgcctcggctaagccagaaacaatgctgcatcgccttgtaaagcacttttcgttggaccaatattttgctggtgcgtacggtgcaagtgacgatgaggaaacccgggtcacgaaaaccgatattttgacctatgcgctaaaagacagtcaagttgcgctcgatcaaagtgtcatgattggtgatcgggccaatgatatgattggtggcaaggccaatcatgttcaattgctgggtgtgacgtacggctttggttctgctaaagaactaaaagaagccggtgccaaagtcttagttgatcaacctgcagatattcctgcaggactggcgaagctagcaaagatcaacgcaaaatagtgccctaatcaagcttgattaaggaaccagacaaaaaagacgtgcctgtaaatggcacgtcttttttgtctggcacgagataccgaattattgatcgtcctcagaagtttgttggggatgaatcagtttctcaccaatttcattgagcaagtcaacaaactgtttggctttgtcctcgccaagtgcagtaacccactgatcgaagcgatcagtagcagttttagtgatctccgcctcaacttgttttccaagcggcgttaatcgtaaagtgttacgccgacggtcagctgcaaacttggtctgggtcacgtaattgagattgcgcagtacgcgcagttggcgggccacggccggtttcgtgacgccccgtttggcgacaatggcagtcaggctaatatcgggatcatgggcaatatcagaaagaatccgaaattgttcaaaactaagatggtattttgccatcggtgccgagattagctcattaatactcttgaatgttgaaaaataggcatccacatatgcctgtagcaaagattcatcagtcatctttcttcctccaaagtttatcttaacaaatcataccgcaactgtaacttgaaattattaaaagttgcggtacactttttagttatgtaaagggctttaactacttatggaggctattagtgtgcgaaaacataaaaaagcttggctgattgggctgttatcaatcttcggtgttctgcttatgggattagttggcgccagtctgtatttctaccaatatgcatttgtgccatcaaaaaaatcttttttgagtggtggcgaaagtcgaattgtcaaggacggtaaggcgtggcttaaaaccgttcataaggaaacgtggaccgaaaaggccgctggtgccgatttgaaactggttgccgactatgtgccagcggcgaaaccaacgaacaagacggtggtggtcgctcacgggtacatgaacaccaaagaattcatggcgccgcaaatcaaaatgtttcatgatgcagggtttaatgttttggccccagatgatcgcggccatggacaatcgcaaggaaactacatcgggtacggctggccagatcggctggattatttgaagtggatcaatcaaatcatcaagaaacagggccagcaaagtcaaatcgcgttgtatggcgtctccatgggcggcgcaacagtgatgtatctgagtggcgaaaaattgccatctcaagtcaaaagcattgtcgaagattgtggctataccagtattattgatgaactgacttatcaagccaaagcaatgttcaatctgcctaaatggccgctgattccgtcagtggcactgacagccacgatcaaagccggttataacgtatttgatgccagtgctatcaccgcgttgcacaaaaatacccgccccattttgtttattcacggcagcaaggataagtttgtaccaaccagcatggtgtatcaaaactaccgagcagccacaaaatccaagaaggccttgtgggtcgttaaaggggcagggcatgcgaagagttttcctgatcatcaacaagcctacagcaagcgagttgtcggctggtttaacgcaaactggtgaagcgcagcgttactgggcggcattggtggcagcaacccgctttaaaatcgcgtagattttctcagcatcacttggggtcccgcgtaattcgtaatcggccaagaagggcgcatcgaattctttggcatagcgtttagccgtgagacagtattgttcgttaaagttccgattgccagaaccaatgatgccaatgcattgatcagcgttttcgccttctgccagatagtcacccatggcagtggtcatcaactccttgacgccgttatcaataccattaccgccgtcaagataagttggcaccatgacaaaaaatggtttggtttcaccgtcactttgtgtggcatcagaaatttctttcagcacaattgttggattagcagcattctgatcatgttgcgtttgtgcatagactgccaagcgatgggcaaaagcccgagtattgccagaaatagaaataaataaaacgtggataggttcagtcattgtgatggcctcttttcatgattgtgagcatggcacaagcctttgcagtcgcttgctttttgccgatatgccaaacgaagaacagctaaaaagagtcgcggtacagcagccaagtgcttgcaccacggctcttttttgcggcgttagaattcttgataaactgccggatcttgatccttgagccgaccatccggttttgtcagactgtcaatggcggccatttcttcgttcgttagtgtaaagtcaaacacatcgagattggtgcgttgacgggcaaggtgtgcggactttggaatcggtaagatctgatgttgcagatcccagcgtaagataacctgaccaacatttttaccgtgtgccgcagcaatttttttgatgcttggttcctgtaaaaccgcgccgcgacccaatggactccaagcaactgtttggatattgtgcgccgcgtcatactcacgttgcgcttgttggttgaagtaaggatgcaactcaatttgattaacagctggcgtcacgtcggtttctttaattagccgatcaatatgctcaggcaaaaagtttgaaacgccgattgagcgaaccaatccaaatcgttgtgcctgaatcaaggcttgccaagcttccacgtaaagatcctctttaggatttggccagtgaattaaatagagatcgtaataatccaaaccagcacgataaagactttcttcgatggtatcgatggcttcttgataacgatgatgacgacctggcagttttgaagcaatcgttaattgactgcgcggaatgccgctttggcgaacggcctcaccaacggcaccttcattttcgtagttaaaagcggcatccaacatgcgatagccgacattgacggctcccaccattgctcgaacgccattagcaccattaagtttgtaggtgccaaaaccgattgctggtaggacgttgccgtcgtttaaggtgtaattcattcttgtgaacctcctttaagatgtgctcatagtcaaacaggacacagatgactagctgatgggattgaataagtgctcggaccaatcagttaagaaaccaaattcatcagttcaacagttcctatacgtcgctgcgtccgcttttttaagctgcacaacactatatatagtgtagtccaaacctagtcatgcatacaagcatcgacaaaccttcgtgtataataaagccaaaagatagcgcgcaaaccagtctagtttctgtgctggtaggagttttacgcgtttacaaagaggggattatcacgaaaacacaacaatggcgagccgtttcacgaagctggtttgcactattcacgatgattttttgggtattattatttgtcgaagcttttagtacagggatgatgctcacaattggctcaccagcgcggaccgaggcggttatcgtcaagagtaaaggcctagatcaattgacgcaaacgttgaatcagcagttgttaacaactgcagcgaaaagtggggcatcactggataaaagaacagtgctcgtcactacggatgatacccagagactggctaagaatatggtggcagccagttcactacatcagccacatgtttcgttgacgaccattgaagagagtgtcacaagtcgcttacaaacggcagcgactgtgcagcatcaaaattttgatcaaaaaaaagtactcgccagcttgaaaacaacgcttgagcgcgaaattaatttacacgtgatggcacaaggctggggattagtttatccattgctggttttgatgacgcaaacagctgtgattgtcgcggcgatcctgatggcctttgttttgctcattatgatcaaaaccgctcattcatggcggcgtttcttagcagtaactggtcgttcgacctatgtcatgggatatgttggcggattcatggccatgtttgtcaccgcgaatcctttcttaggtgctgtcgtatcacgcattgcgattaatcaacaactgacacgtgatctgattctggcttactcgccattatggcagcgcgtcgcaggatggacgattatcatcggtttgcttgttgcgggtgtgagccactttttcccgcgcgctcaggctgaggacgatgacttattaacggctgaaaggagtgctttatgaaactaaaacgctgggttgttatcgtatttgcggcggttgtggttatcgctggagcgggttggtactggtatcaggaacaacccaccgatacaccgacgacagagaaaacgacgattggtcaaaccgcaacgctatacttgcatggctattcagggggtgctggctcgactaataccttgattcgacatgctgagcagtctggcgcaactaaggtgctcacggccactgtcgctaaaaatggtaaagttagctggcaaggcaatgcacggcatgtcagcaagccgatagttcaggtgatttttcaggataatgtcaatccggattacgccaagctagcgggttggttgacgaccattaatcgcgaactttatcaacgttacggcgttcgccaggtcaactttgtggcccattcgatgggcaatatggcagtgatgttctatgcaactcaaaactcagatcaccctaaattgccaaaaatgcgggcttacgtggcgatcgctggccattttgacggtattatcggcatgggcgatgagcctcatcgtattaaacttgctccaaacggttatccgacgccgccagatgagaattatgccacgttagccagaatgcgcgatcgttttccaaaaaatgtgaaggttttgaacatttatggcgatgtggatgatggttcagactcagacggtcgtgtcgcaaacaattcatcgcgctcattgcagtacctagttgaagggcgcgccgccagttatcaagaaaaagaatttgttggcaaaaaagcgcagcatagtgcgcttcatgaaaatccacaggtggctaaggcggttgataattttatttggtgagggtatgcgctagtttttgttagggtcatacggcgtgacaacgactttgccactaagatagttggccatgtaaacgtcgccagtttcatagccttgctcctgtagctgtgctttcagccagtcttcatcatgatcaatggcatcaagtgcggcgggatcaatctggccatctagaatcaacggatatttgatggtttcatcgcctttgaggatgacattaagctgaccattttgttctagataggcttgccgaacgtcgcgaagatcgtttacgccagcagtacgtaatttgtaagccaaatcatttgccgaaagaccgacttgagtcgccgtctctacacgaattttgccatgctgcacgaccaataaaggctcgccgtcaatcagacgcttgatccaacggttatggttagttaagtatttcgaactgaaaacaatgagtgtccaaatcagcagtacgtttacaaattggagcaagccgatatcagtattgtaaatcaccccgccgataataccgccaaggacgtaattctgcatttgatcaacaatcgttgctggggcaaggttacctttgccggtgagcttgatttgggcaacgaacacaatgaagcctagtaagagtttcattgccgtgatgaaatatggatctctaaaaagttgcatgacagcctcctacttggtcacaaagtttgcttgaggcacaatcaaggtggttttatctagctggtagctattgttgtccgcattgatcgtcaccgtaaacatggttttcgttgacttaccgatggtgacgagcatgccagtgtgaaccgtgttgctgttagcatagacttgttgcacacccacctgtttttgcttggcaacactgcgcaacagtgtcgcgactgcctgtgaatcagcggttgcggtgcggctcgcttgcagatcacgaatttgaatgccgatggttaatagttcaatcaacgcaactaaaattaatagatcgcgatatttgtttgtgtgtttgtggcgcaaaaaatagatgagataggcgacaatcacaacagctcctgccatgatgatgatgtaacggaaggtactttgccaagtagtttggcgagttaagacgctgtaagcataaaaagttgttcccatgagacacctccaaaaaagtaactaccaaaagcataccagaaacagaacatgacagaagttattcttgacagtttgattggcggtgttatgataatgccaacttagacagacagattgctttgcggagaagagtacctgaagcgcagatcacaagcgagcctgaacagtgaaagcaggcgatcagttaatcagggaagatgagctccaaacagcttttcagcggttcacgccactgaaacgggcgcacccgttaccatgccgggtatcaaaattggtaccgttaaggcattggcatcaaaaccagtgcgaataagggtggtaacgcgcaaagtcgccccttgatcagaaatggtcaaggggcgactttttttgtgagcgcgagccagcccaaacccactttccaagccattgtaagcaccgccccctcccaacattctttccgcaaaagtcatcactgcgtctgtcgacgaaaaataaggaggaccaccatcatgacagaaaaagttcaaataaaagctcctttccgcgccgatttagtcggcagcttgcttcggcctgaacgcttaaaagcggcgcatcaacaacttgcgatcggtgaaattaaacaagatcaggaactcaacattcaacacgcagccattgagcgtattgtcaaacgacaagttgaacttggtttcaaagctgtgacggatggtgagttctcccgccgttattggcatctagactttttatggggcttgaacggttttgaaaaagatgatagttggcagtatgaacacgacttcaaaggcggcattaacgcagcagctaatgtgcatcttgctgggaaagtcagcttcaatcctgatcacccattttttgccgcctttaagtatttgcagagcattgtgccagaaggggttctccccaaacagaccatcccgagtcctgcattgctctttcgtgaccatcgcagcgataactgggcaaaatattatgacagatttgatgattatttggctgacgttgtccaagcctatgtggatacgattcaacatttctatgatttaggtgcccgctatcttcaaattgacgatactaactgggcctacttgattcagaatctaaaagatactgaaaatgatcccaaggcgcatcagcggtttattgacctcgctaaattggcacaccgcgtgatcaaggcggttttggtgaaactgccagaagacttgaccgtgacgtcgcatatctgtcgcggcaatttccagtcgacattcctgttttccggcgggtatcaatatgtggcagattacatcggtgatttgccgtatgacggcttattcctagagtatgataatcagcgttcggggtcttttgaaccgttaacaaagttgtggcacggcgatactaataagcgcattgttctaggcctgatcacttcgaagtttcctgaattggaagatgaggatgccgttatcaagcgaattaacgctgcgactgagtacgtaccgctgacgaatctggcgttgtccactcaatgcggttttgcttcaaccgaagaaggtaacaaggttactgaagatgatcagtgggcgaaactggctctggttcaaaaaattgccaagcgagtttgggcggatgcttagattgttttttcacttatgtttcggcttctgagcgctcctgctcgcgctcagatttttttaacagataccactgttgtgttatatgataaatgtgtcatcaaaactaaaagggagatttctatattatggcaaaagttgaaagtttcaccttggatcacacagctgtcaaagcaccttatgttcggttgattacgacagagcatggtgcaaagggtgatgtgatttcaaactatgatttgcggttggtacaaccaaacacagcagccattgatacggctggcttgcacacgattgaacacttgctggcatcgttattacgcgatcggatggacggcgttattgattgttcaccattcggctgccgcaccggtttccacttgattacttggggtgagcacagcacaaccgaagtggccaaggctttgaagtcaagtttagaggccattgccaatgacattacttgggatgacgtccctggtgttgacatcaagagttgtggcaattacaaggatcacagcctgttttcagcaaaggaatgggcgaagttaattttgagccgcggcatttcaaatgacccgtacacgcgtcaggttgtctgaggcttggtttcaaaagtatctcaccagctcgaaattgccgcataaaaatggcactgctacaactcgctaatgagtttgacagtgccattttcatgttcgaaggattattgaaataagtggattagccattgcccgccataaatcaaactcatactgtaggcgaggatcgtgataggtttgcctaaaataatgatccaaaaaaactttttaaaggtcattttagttaacccggcaagcagacacaaaacgtcgtcaggagcaaccggtaaaatgatagcaagcgtgaaaaagcgatcgaagcgttgctgatttttggtatagccgatgtatttgttataggttttttcagagatcagataagtaagcagcggcttaccaaatcgccgagcaagatggaaattgataaacgagccaattgcaataccgatgtagttgtaaaaaaagcctgtccatgggccaaacaaaatcacgccagccgccgtactgacaccgccaggaatgatcgggatgacaacctgaatgacttgaatgagcataaaaaataaagcgccggctattccgaggcgagcaatgtaagcctgcagagcattgatgtttgaaagaatacctaagtcataccagtaaatggctactgctgctaataagataacaacaacgatggtggcaaaattaatcagacgacgcacattttttggattcatttatttttggcctcagaacagttcatcatcaggaaaacatctatgctacaatgaatcaagcataccaaacatacgtactgaatggagagcttatgtacgagtattttgaaggcattattcaggcggtgaccccggcttacatcgtcatcgatgtgcatggcatcgggttccgtctgctggtagccaacccttatcattttgaagctggcgagcaaaaacgtgtttatgtgcagctgatcattcgcgacaacgaccagacactttatggattcgaaggtgctgcggataagcgtacctttaaccagctattgacggtcacaggcattggcccgaagtcagcgttggccattttggcgaacgtgtctagcggcggcttggcgactgcgattgctcaagatgatgtgaagtttctgactaagtttcctgggatcggtaagaaaacagctgcccagattatccttgatctcaaaggtaaaatcacaacagatggacaaccagcggcagcagcgattgcgccagttgccagtgacgttgattcggaacttgcagatgcgttagcggcactcgtggcattgggctacccgcaacgcaccgttgatggtctcactgacacactgaaggcattcagtgccaagacaactgatgcctatttacgcgaaggcttgcggctattaagcggcaaggcttaggcttgattatactgaagctgaccgttgacgacaacggaagcggcttttgaatcacgataaaatttttcccgtgcttttaatagcatgtaaactagagaggaagtgggtttttggcagacgcagacaaggatcgcttggtttctggcgacgttgacgattcgaatgaagcacagattgaaaaaagtttacgtccccggatgctcgcgcagtatattggtcaggatcgcgtcaaacatcagttggaagtctatatcacggctgccaaacagcgcgaagagtcattggatcatgttctgctctatggaccgcctggtttgggaaaaacgacgttggctttggtgattgccaatgaactgggcgtcaatattcgcacgacatcagggcctgctatcgaaaaaccgggtgatttagtggcactgctgaatgaattgcatcccggtgatgtcttgttcattgatgaaattcaccgtctaccaaaaattgtcgaagaaatgctttattcagcgatggaagatttttatattgatattgtggttggtcaagggccaactgcccaccctgtgcatttcccgcttcctcccttcaccttaattggggcgacaacgcgcgctggcatgctttccgctccgttacgtgatcgatttggcatcagtgaacatatggcgtattattctgctgatgacctcagtgagatcgtcaaacgatcagcaacaattttcgatatggcgattgatgctgaaggtgctcatgaaattgcccgacggtcgcggggaacaccgcgggttgctaatcggctgctcaaacgtatccgtgattttgccgaagttgcggggcagagtccagttgatatacaaatggttgaccatgcgcttgaccagctgcaagtcgatcagcaaggcttagaccaaattgatcgcaaactgttgatgttcatgattcgtgattacgaaggcggccccgttggactctcaacgattgccgctaacatcggcgaggaaatggcaacgattgaggaaatgtatgagccttatctgttacagatcgggtatttgaaacgaacgccgcgtggtcgcatggtgacgccagccggatttgcacatatggggctgtcggctgagcaacattaggcaacatgctaaccgcgctggctcgcgctcaactataacgcgctcgcagtcgcagaagcctgcacataaggaccttgaagcctaaatggccaaaattcagccatttaggcttcaagcccacttatgctccgacttctaagcgctcctgctcgcgctcagctataacgcgctccccagcgcagcaacctgcatgtaaggaccttggtcgcaatggtcaaaaagcgaccatcacgtccaaggccgcttacactccggttgctaaccgcgctggctcgcgctcaactataacgcgctcgcagtcgcagaagcctgcacataaggaccttgagtcaaaacgaccaagatcgggccattttgactcaagcccacttatgctccggcttctaagcgctcctgctcgcgctcactgattaaaatgaatggaagcgaatatggtgcaagagaacaaacgttatcacaaagtagaagacaaacattatcagttatcggatttcgattatgacttgccgcatgaattgattgcgcagacacctttgaaggaacgtgatgccagtcggctgttggtattaaattctgaaactggtgagatgcaagataagcatttttacgacattcttgattatttcaagccaggtgatgcgttggtcatgaatgatacgcgggtgatgccagcgcgattgtatggggttaagccagagactggtgcccatatggaagtgttattgcttaacaacacgtctggtgatgattgggaaaccttgatgaagcctgcgcgcaaggctccggttggcacggtgattgattttggcgatggcttactaaaggccacagttaccaaggaactcgaacatggcggtcgaatgattcactttgactatgacggcatctttatggaaatcctcgataagttaggcgagacgccattgccgccttacatcaaggaaaagcttgaagatccagaaatgtatcaaactgtttattctaaagagttaggctctgcagcggcaccgacagccggtcttcactggaccaaagatttgctgaaaaaagtgcaagaaaagggcgtcaagttggtttacttgacgttgcatgttggcttgggtactttccggccagtagttgaggaaaacatcgaagcacataaaatgcacagtgaattttatcggttgactccggaagcagcagcgacactgaatgatgttcgcgacaatggcggtcgaattattgctaccggtacgacatccattcgcaccctcgaggccatcggtaccaaatttgatggtgccatcaaggcagattcgggttggactgacatttttatcaagccagggtatcagtggaaggttgttgatgcatttatcaccaacttccatttgccaaagtcaacgttagttatgctcgtggcagcgttcaccgggcgcgatacaattttaaatgcgtataagcatgcgatcgacgaaaaatatcgcttcttcagctttggcgatgcgatgttcatttactaatcacgaagctagtttctgctcactttagtgtgtttactagcccggcaacttgtctgtaaagagcttagccgcttactttccgggtgttaaccgctggcttgcgcgcaactatcacgcgttcgcagtcccagcaacttattcgcgctcactaaaaaatcggcttgcttaaatgcaagccgattttttaacggacgggatcacatcaacacataccaacagacatgtctcgatttttcttttaacgcatcgctgcgtggaacaacgtattcataggcgatcacaatggccgggtcaaaacccgggaagtgcgaaaactacggtaacggtaatcccgtccttaacttcattctaacagggaagatggtatgagaaaagcggaaagctcggactttcttgaagggtaagccaatcatgatatacatgcactcacttttaaataacaagtaactctgttaaactgacgtcacgagaaaatcaagcggcggtgctgcgagggcattgccatgaatgaggagaatgtatggaaccagcagttaagtatcgtctgattcatcaggataagcatagcggtgcgcggttgggtgagttgatcacgccgcacggcacatttcccaccccaatgtttatgcctgttggcacacaggcgagcgtgaaaacaatggcgcctgaagaattggatacgatgggggccactgttatcttggcgaacacgtatcatctgtggttacggccggggccagaactgattgaagaagcgggcggcttgcacaattttatgaactggcacaaaggtatcctgactgactcaggtggctttcaagtcttttcgctagccgacactagacatattactgaagaaggtgtcactttcaaaaatcatttgaatggtgccaagatgttcctgtccccagaaaaggcgatcgcaattgaaaacgcgttgggacctgacatcatgatgagtttggatgaatgtccgccgttttttgaaagctatgattatgttaaaaagagtgttgctcgaaccagtcgttgggctgaacgtggcttgcaggctcacaagaatcctgattggcaggcgctttttggtattgtgcaaggtgccggattcaaagacttgcgcgagcaaagtgctaaggatctcgttagcatggattttcctggctattcgattggtggcttgtctgttggtgaatcaaaagatgagatgaaccatgtccttgatttcactaccccgctgctgccggaaaacaaaccgcgctatttgatgggtgtcggctctgcggatgcgctgattgatggcgccttgcgtggcattgatatgtttgactgcgtcttaccaactcggattgcccgaaatggtacttgcatgaccagccgcggccggctcgtcattaaaaatgcgaaatatgcgcatgactttggaccgctggatcctaattgcgattgctacacgtgtcgtaactatagccgcgcctatattcgccatctgatccatgttggtgaagctttcggtattcggttgacgacctaccataatctctacttcttactgcacttgatgcagcaagtgcgtgaagcgattgccaatgatgatttgctggctttccgtgaagatttctttgaagcttacggatacaacaaggaaaaagcaaagaatttttagattatttggagtagaccgcctaattctgttacactgtttgttgacaaaataaaaataagaggtgcctaaattgaatggtaatatgacaatgatcattatgctgctgattttcgtgggcttcatgtattttggcatggttcgtccgcaaaagaaacaacagcaaaagcgtcaagaaatgttgaatcagcttaaaaaaggcgaccccatcatcacgatcggtgggttgcacggtgtcattgattcaatcgaccagcaagctgggacggttgtcattgattctgacggcatctatttgacctttaacttgagtgctgttcgcggcacagcaactcgtcctgcagcgcctgcaccagccgctaccgtgacaaaggctgaagaagcgcataatacggatgaacaacgcgaagctaaaccagttgaagaggctgcaccaaaggctgacgatcaaaccgatgccaaaagtgatagcaaggcagaagacgacaaatagattcgtcatctgatagagaattcaatataggtgacgtaagggaaggtgtttagccttctctttttttgcgttttaagagcggatcggcgcaaatcacagggagatgtcaaaacaacgatgcttttttaacaaatggctttaaaagacctacaagcaagaaaaaaacggcagatccacctttatagttcaaaaaaatacaaagtgaaatacgcaataaaagccaatgaacacaacaatatcagtgagcaagtcgctttttcgtgaaaaaattcaccaaaattgtttacaaaatcacaaagaccggttatgatgttcttgtgaaatggttaacaaaaaattccgcaaaacacttggaggtaagctcatgttaaagaatactgcgaagactgctaccgaagttgatgttaagagtatggttgacgaattggttgcgaatgcgcatgccgctttgaagatcatgaaaactttcgatcaagaaaagatcgatcacatcgttcatcggatggcaatcgctggtttggatcatcatatggaattggcaaaactcgctgttgacgagacgggccgtggcgtgtgggaagataaagcgatcaagaacatgttcgccaccgaagaaatttggcactcaatcaagaacaacaagaccgttggtgtgatcaacgaagacaaacaacgcggcttggtatcgattgctgaaccaattggtgtcattgctggtgtgacgccagtgacgaacccaacttcaacgaccatgttcaaatccgaaattgccattaaaacccgtaatccaatcattttcgccttccatccgggtgcccaaaagtcttcagcgcgtgcgttggaggtcatccgtgatgaagccgaaaaagcaggcttaccaaagggtgctttgcaatatatccctgtaccaagtatggatgcgactaaagctttgatggatcaccctggtatcgccacgattttggcaacgggcggtcctggcatggttaagtccgcctattcatcaggcaagccagcactgggtgttggggccgggaatgcgccagcttacattgaagccagcgctaacatcaaacaagctgtcaatgacttagtactttcaaagagttttgataatggtatgatctgtgcttccgaacaaggcgtgattattgattccagcatttacgatgatgtgaagaaggaatttgaagcccaaggtgcttacttcgttaaacagaaggacatgaagaagttcgaaagtaccgtcattaatcttgaaaagcaaagtgtcaatccgcgaatcgttggtcaaagtcctaagcagattgctgaatgggcggggatcacgattcctgataacaccacgattctgattgctgaattgaaaggtgttggcgaaaagtatccactgtctcgtgaaaaactaagtccagtactggccatggtcaaagcagatggtcatgaagatgccttcaagaaatgtgaaaccatgcttgatatcggcggtttgggtcatacggcagtcattcacacggctgatgatgagttagctttgaagtatgccgatgctatgcaagcttgccggattttgatcaacacaccatcttctgtcggcgggattggcgatctttacaacgaaatgattccaagtttgacactgggctgcggctcatacggtggtaactcaatttcgcataacgtggggacggtcgacttgcttaacatcaagacaatggcaaaacgccgcaataacatgcagtggatgaaattgccaccaaagatctattttgaaaagaattctgttcgttacctcgaacacatggaaggcatcaaacgggccttcatcgttgctgatcgaagcatggaaaagttaggcttcgtcaagatcgttgaagatgttctggctcggcgtgaaaatcctgttcaagttcagacttttgtcgatgttgaacctgatccatcaactgacacggtcttcaaggggaccgatatcatgcgctcatttggaccggataccgtcattgctatcggcggcgggtctgttatggatgctgccaaagggatgtgcttgttcaacgatgccggggatgctgatttcttcggcgctaagcagaaattcttggatatccggaagcggacttacaccttcccgaatctgaataagacaaagcttgtctgcattccaacaacttctgggactggttcagaagtaacaccttttgcggttatcaccgattccaaggctggcatcaagtatccgttagctgactatgcattgacgccagacatcgcgattgtggacagtcagttcatcgaatccgtaccgccagtggttgtcgctgattccggtttggatgtgctctgccacgcaaccgaaagttatgtttcaaccatggccactcattacacgaagggcctgagtctggaagcaatcaagttggtgttcgaaaatctggaaaagagttatcatggcgacgtcgaagcaaagtcaaagatgcatgacgcttcaaccattgctgggatggcctttgccaacgcactgttgggcattaaccacagcattgcgcataagattgggcaagcgttccatctgcctcacggtcgttgcatcgcgatcacgatgccacatgttattcgcttcaatgcgagtcaaccgaagaagcgcgctatctgggcgaagtatagctacttccgcgctaacgaagactacgcagaaatcgctcgctacctcggccttcctggcaagacaactgatgaattggttgaaagctatgttcaggccttcatcaagctggctcacagtgttggcgtcaagctcagtttgaaggaacagggcgttaaaaaggctgatctcgacaagcaagttgatcgtcttgccgaactggcttatgaagacaactgcaccgttaccaacccgcaagaaccgttaatcggcgacttgaagcatatcatccttgatgaatatgaaggcaccgaatccactttctaagatgtttgccgctaatcatttcacaatgatcggcgcagagaattcaatggcgacattatttgagccgatcacgaaaaacacgtcagtaaattggcgtgtttttttgtgtgactcatggcataatggagtacagtgactgcaaattaaaagtaaggatgtaaaatgacaccgaataaagaggattatcttaaattgatttttgagattggcggcgatacacagctggtctctaataaacaaatcgttgccggtatgcatgtttctgctgcttcggtcagtgagatgatcaacaaactgggcgaagaaaaactggttgcgcacacgccttatcaaggtatccagctgacatcagctggccggaaaaaggcggccattttggtgcgtaatcatcggctctgggaagtatttctggttcagtgccttaaatatccagctgatgcggtccatcaagaagcagaaaaactggaacatgccttaacgccggaaatggccaaacggttgtcagccatgttgggcgaacctcgctattgtccgcacggcggtgttatttcggatgccaatggccactatctccaacaaagtcgggtgacattaggcacgttagatgttgggcaaagtgggcatattgaacgcgtgattgatgaagtttcgttgattgattacacggttaaaattgacctgcggctggatgatgaattcacggtgactgcgaaaactttagatgccgtgatcatcaagttagcccgtaccggaaaagaattggcggtcgatgcagatcgtgctgatcacatttttgtcgaattgtaattaagtctagagaaagcagggtcgtatacatgccagaagagtcacgtgctgtgattattatttttggaggttcaggagatctagcctcacgcaagttgtatcccgcactgtttaatctttaccgtcgtggtgtcctcgctgagcattttgcggtgatcggcacagcgcggcgtccgtggacggatgatcattatcacgaggttgttgaaaacgccgtcgctggcgatgatgtggatcgtgaccaagcaaaagcctttgcccagcatttcttttatcagagtcatgatgtaaccgatgcagatcattacattaccttgaaaaatcttgctgcaaaattggacgatcagtatgtgactggtggcaatcgcatcttttacatggccatggcaccagatttcttcgaaacaattgcgagccatctgaaatcggaacatttgctgacggagcgcggtttcaaccgattaattatcgaaaaaccgtttggtcatgattatgccagtgctaaagaactaaacgattcgttaactgcaacctttgatgatgatcagattttccgaattgaccattatcttggcaaagaaatgattcagaatctgttggcttttcggtttgataatgccatttttgaaggggtctggaacaaggattacatcgacaatattcaaatcacactttccgaggcggtcggggttgaggaacgcgctggttattatgaaaaggccggcgcgttgcgtgatatggtgcaaaaccatgtgatgcaggtgctgtcttatctgacaatgccaaaaccaaagacttttacggctaacgacattttgacggccaaggatcaagtgtttgccgctttgaagccttatgatcttgcaactgctaaagaaaattttgtgcgtgcgcaatatgcaagcgccgaagtggatggcgaccaagtgctgggttatcggcaagaagaaggcgtggcagcagattcacaaacagccacttttgtcgcaggcaaaattatgttagatatgccgcaatgggagggtgtgccggtttatattcgcactggtaaacggttaactcggaagtcaacccagctgacactgacatttaaaccggtcgcaagtccgttattcaaccgagaaaccggtagtcaaccagacagcttgaccatttatatcgagccaagtgaaggctattcgttgcaattgaatggtaaggcccttggcacaggctttaatattgaacccgatgagttgcggtatcgtcatgatccggaagccgccgctgctgctccagaagcatatgaacgattaatcaataatgtgcttgaaggcgatcagacaaactttactcattggtcagagttatcggcatcttggcggttcatcgatgcgattcaagcagcttggtcacaggaaacagaaatgccgacatatccggctgccacgatgggtccgcaagcagcgtttgatttgttagctcgtgatggccgccaatggttctggcaaccacgccgaattaaactggcggactaggctttcacagataaacaaaagggactgtgacccgaaaaggcggtcagggtccttttttagtgaacgcgagtcagcccgggtttctgggctgacgagcgcgttataggtggttcgagtagaatcggtcttgatcgttaaagctgaacgtgaactagcgcgacagaaagaataacagaacagttgatacgaggaaggggaagctcatggcgttatttgaattaccattacaaaacgatacttcccggaaaatcattcatctggatatggacgccttttatgcttcaattgagatgcgcgataatccgcaattgcgtagtaaagccttggtaattgcccgggatccgcgtacaactggcggcaaaggtgttgtgacaacggccaactatgtcgccagacgttatggcgttcattcggcaatgccggccaacgaagccttgcaacttgtgcctcgctcaaaactggtgtttaagacgccggattttccaaaatataaagcagtgtccgcgcaaattcacgccttgtttcatcaagtgaccgatctaattgaaccagtggcgttcgatgaagcttatcttgatgtcacggccaacaagatgttcccgagtacgatcgccttggcattgtggctgcaagatcaaattagtcaggcaacgcagctcacaagttccattggcatttcctacaataaatttatcgccaagcaagcctctgattacaataaaccggttggtcgtacactggttttgccagaacaagccttattatttttggatcggctgccgatcaaacagtttcgcggggttggtaagaaaacgttgccgaagttaaccgacttaggtgtcactgatggcaagtctttacgggccctatcgcaagatgatttgctccggatgtttggcaaaatgggatttgtgctttatcaacatgctcgtggcgttgacaatcgtcctgttgctgttcggacggcgaagtcaattggcaaagaacgaacctatggcacgcctctaactgacgccgaggcggttcagacacagttacacaatctggcagggatggtcgtgacatcgttgaatcaaaaagctatgcacggcaaaaccgtggtgctaaaggtgcgcgatgttgacttcatcacgcaaacaaagcggctaacccaagatcactacttcgaaggcgaacaagccattttcgatgcagcgtggcagctctggggcagtgttgccatgtcgaacttggccatccggttacttgggattaccgtgaccgggttggatccgaagcagtatgagaatttggacttaccgttgtgaagacagacagcgaaggggtgcttgctgtaggggctttggtagcggcatgcgctacttgagctaattaatgcggtttagcgcacgtttttcccataacgcgctcgccaacccagaaacctgcgcgtaaggacactgaacgcaatgaccaaaacccggtcatcacgttcagtgccgcttacgctccggtttctaaccgggttggctcgcgcttagtctgtcatagtacagccgtaacctatggtatactaacgatagattgcagtggggtgatggtatggcgacaaagcatgagcagattttggattatattgcaaacttggctgttggcaagaagatttccgttcggtcgatcgcgaagcatttgaaagtcagcgaaggaaccgcttatcgagctattaaggaagccgagaataccggctttgtctcgacaattgcgcgtgtcggcacgattcggattgaacaaaaaccgttaaatccaattgaatctgtgacattcaaaacactggttgatttgattgacgccaaagttttaggcgggcaggccggtatggacaagaaattggacaaattcgtgatcggggcgatgacaccagctgccatgcggccttacatcacgcgtaactcgttgatgattgtcggaaaccgtgaagatgcacaacggctggcactagaagatggtgctgcggtgttgatcaccgggggattcgaaactagcgcggcgattatcgctttggcggatgatcagcagttgcctgtgttgcaaactgcttatgatacctttacagttgcaaccatgatcaatcgagctttgtcagatcaggcgatcaaacaggatattttgacagtagctgccatttatacgccgttggcccaaattcaaaccattggtgttgaggcgacggtcggtgattatttgctgttgcccgatccgcgatatccattgccggtcgtgacgcgcaatgggcgattggttggcgtcatgcggccatcgctggttggcggtaagaagccgacggtgccgattgaacggttgatgcagaaggatccgcaaactgtcaaaccttaccttagcgtgactgctgtgggtcataccatgcaggataacggtttaacggccatgccggtggtggatgatagctggaatctgttgggaattgtgacccgcaacgcggttttttcaagtctcacaggcattgcccacagtcgcgaactatccaataccattgccgatcaggtcagcgctcaactgaccgccatcacaccgcaaccgccttacgttggcggttacgagttgaaaaccgtgccggccatgaccaattcgcttggcactatgagttttggagtgctggctgaagccattaacggttgcactacccgttatttgcatgacacggggcggcgaaacgtgttggtcgaaggactgaatttaacaacatttcgacccatccagttagaaagtgtggtcaccgtcttgttacgtgaacttgagatgactaggcatgatgcgacgctggatgttgatgtcttaagcgacggggttcaggttgctaaagcgattgtgacctgccagctattagaaaggaattgatttttgatgattcaaaccgatattattaacgccatcaaggcaaacgatccaatcattatccatcgtcatgtgaacccagatccagatgcgttgggttcccaagttggcttagcagaaaccattcgcgctagttttccggataagaaagtgtatcaggttggtagtgacactggcaatttgagctggttggcacaggaacaaaccattactgatgacgtttacaagtatgctctcgtgattgtgaccgatactgccgatacgccgcgagtttctgatgagcgcttcaacaaggggaaaatgctgatcaaaatcgatcatcatccgaacgatgatgcgtatggcgatctcgtttgggtcgataacaacgctagctctgcctctgaactgatttacgatttaatcgccgccagcaacggtgttttgaaactcagcgataaggctgctcgcctaatgtacgctgggattgttggcgacaccggccgatttttatttaacaatacgaccccgcatacgttgcaggtggcggctgagttgattaaaaaggattttgatccaacagccattaataatcggatgaacacggtgacgttggcacaagcacggttgcaaggctatgttgtcgatcatctgaaaattaccccagcaggtgccgccagtgtgacggtaccacggaccgcgatcaacgagctgaaactggctgatgatcaggtaagcgctgttgtcggcacacccggccgactggataccgtcattgcttgggcagaatttattgaacaggcagaaggcggttaccgcgttcatctgcgttcaaaaggtcccatcatcaacacacttgccaaagcacacaatggcggtggtcatccattagcaagcggcgctaaggcagctaattttgacgaactgattcaaatcgagacgcaactcgatcaactggtcaaagaatattcgacctcaggaaagtaggcattatggagaatcaattcaaacaatttcaactaaaaccttttgttatcgatggtctcaatgcaatggccatcaccgccccgacacccattcaacaaaaagttattccagcacttttgcgtggtgaaaacattgttgggcaaagccagaccggtagcgggaaaactcacgcctttttggtacccttactcagtatggtagatcctaccgaagatgcgactcaggtcgtgatcactgccccttcacgtgagttagccaatcaaatttatgcggttgcccagcaactcatacaaactgagccggcgattcggattaaccgtttagtcgggggaatggacaagcaaaagcagatcgacaagttgcaaaatcatcaaccacatgtggctatcggaacgccaggtcgaatcttagacatgatcaaaagctatgatctagtgccatcgtctgtccgtcattttgtggtcgacgaagctgacatgacgctggatatgggcttcctcgaaacggttgatgcgattgcctcgagttttccagatcatctgcagatggctgttttttcggcgactattccgcaaaaactggaaccattcttgcgcaagtacatggataatccaacgacgattgaattgaaaccgcagtcggtgatagctgacacggttgaaaacattttaattgcggcaaaagggcgcgataaaaatgagttaatctatcagcttgtcacaatggggcatccctttttagtgctgatttttgctaacaccaagaccagtgtggatgctatccatgacttcttgaagcatcaaggtttgaaggtggctaagattcatggtggcattcagccgcgagaacgtcggcgcgtgatgaaggatgttgccgacctcaaatatcagtatgtggtcgccactgatcttgctgcccggggtatcgatatcaagggggtctcaatggtcatcaatgccgagattccgcgcgacaacgagttctttattcaccgagtgggccgaaccggtcggaatggcatggctggtacagcggtgacactgtacgaaccgggacaggaagatcaaattgccgaattagagcatatgggcattaagtttgcgccgaaaatgatcaaaaacggtgagcttgtagacacttatgaccgcaatcgtcgagttcaccgcaaaccgaagcaagaagacaccagtcttgccattcgcggtctggtgaaaaaggcaaagcaaaagcacatgccgaattatcgtaaaaagattcgaactgcggtgttattagaacgcaaacgaaataccaaaattgctcggcgccaagcgctgttagcagaaaaacgcaagaaccgcaaacgagggtgagcatatggcagtcaacgacctgaccctgccgacctggaacacgctggatgaagcgcggcagaagtttatttttcagcaactcacacgatactttctaagtccgttattgtctgttgacgatattcggccgttgacggtgactttttttggccaaactttgcatacgttcgaggcaatgattggcggggaatggttacggttggtcccggggatgcctaatgttagcttaggttttgcggctgatcaacaagggcggttagctgattatttggggcaaagcggactaaccatgcaagacctgagccatcagctttcgcctgaacgacaagttgatataccagcgatgctcgtggcaacgagagcaacgccagcgagcgaagagattttaggccgagtcagtttaacgacacgtatttttaagggcaatcatatggcctacgcggctgttcgtgctcaagtgctggccttgctggaccgccatggcagtcttgatccattttctcaatccggctggccagcaactttgactagcggatcggtgatcctgcgacttgccagtgcgcaccattatcaggtcagcatcagcaaaaactggcaaaaatctgagctgcaaaaagcacttagttacttcggcttccgcctgccaacccaagatcaatatgaatacttgcaaggcggaggtgtcaccagcctattttcattcggcaataccctgccagccgacatgccacgctaccttcccaatcgcttcggcctaactgttccggtcacgcgatccggcagtgagctaatccaagaagcgatgcaaaaaagcacaccactttccgcgcaaccaaccgcaaaagaagctttggcactgtcgccgttttatcagttggcaggcgaagggaacatgggcacggctttatatcggcgcgtggcgacaattacgatggattgagaatctgtactcgttggcgtttgaatgcgcgctaaacaatcaggatgagacaataatcaacaacaagttgaccctttttttcagaaaagctataatgagttttcgttaggacatgcgttgaaccctgcacgagacagaaacgaccgcacagctgagaacggtcgcgtcaggctaagatgtgctccctgatattagttaaacgacaattaatgaagtggtaatgactcgcatcattgcaaccaaggtggtaccgcgtgcaagcgcccttggcagcaatggtgctttttattttgtgagcgcgagccagcccggttagaaaccggcgtgtaagcggccttggacgtgatggccgagttttggtcattgcgccaaggcccttacatgcaggtttctgggctggcgagcgcgttatagttgagcgcgttataacggacaccaaacaaggaggaactttttgatgaaaaaaatgtccagtggtgaaattcgccaaatgtttctggatttctttaagagcaagggccatgcagtcgaaccgagtgcatcacttattcccgttgatgatccaactctgctttggattaattccggcgtggcaaccctgaaaaaatattttgacggatcagtagtgcctgacaatccccggatcaccaatgcccaaaaatcaattcggacgaacgatattgaaaatgtcggcaaaactgctcgtcatttgacgttctttgaaatgcttggcaacttttctgttggcgactacttcaaaaaagaagtcattccttgggcgtgggaactgctcacgagtccaaaatggtttggatttgatcctaaacggttatacgtcaccgtctatccaaaagataaggtcacgaaagaactttggcagaaaactggggtgcctgacgatcatattgtgaaggcggaagacaatttctgggatatcggtgaaggtccttctggtcccgattccgaaattttctatgatcgcggccaacaattcaataatgtggctgaagatgatccagaaaattatcctggtggcgaaaattcgcgttatgtcgaaatctggaacatcgtcttttctgagttgaatcatttgccagatggccgatttgtggaacaaccgcataagaacattgatactggcatgggtttggagcgactggtggcggttattcaaggcacacccacgatttttgaaaccgatttgttcatgccaatcatcaaagcaaccgagaaaatgagtgctggcaagcgctatggtgtcagtgcgcaggatgatgtctcttttaaaatcattgccgaccatgcgcgaacagtgacctttgcgatcggcgatggtgccttaccaagcaatgaaggccgcggctatgttttacgtcgattaattcgtcgggcggttctgaatggtaaaaagctgggcattgatcatgattttctatatcaattagtgccggttgttggtgagatcatgaagagttattacccacagattctggccaaccagcagtttattcaaaaggtcattgaatctgaagaagcacgcttccgccagactttggacgccggcgtgaccttgctcaatcagatcattgctgacttgaaacaagacggcaagaaagaaattcctggagcagatgcgtttaaactctttgacacctatggcttcccagttgaaatgaccaacgaatatgcgcaagatgaaggtttgcaagtcgacatggctggcttcaagaaaaacatggctgcgcagcgtgatcgggcccgcaaagcgcgcggtgatcgacagtccatgggcagtcaagataaagtgctgatgagcatcactacgccaagcaaatttactggctggaccgaattggatcataagcacgcctccttgcagaccattgtggtgaatgatcaactgcaagatagtgtcagtgaaggcaccgcccaactgatttttgacgagacgccattctatgctgaaatgggtggccaagtggcggaccacggcgaaatcaaggcccaagacggcacggtgttagctgacgtgagcgatgtgcagcatgcgccaaatggccaaaatctgcacaccgttacggtgaagggcaaactggaaacaggccagcaatactggctaagtgttgatccgctacgccgtaagaaagtatcactcaatcacacggcaactcacttgctggaccaagctttgcgtgatgttctgggtgagcacacacatcaggctggctctttggttgaaccggattacttgcgtttcgactttacgaattttggtcaagtaacgcctaagcaactacgccaagttgaaacgattgtgaaccagaaaatttgggacgctttaccgattacttggaaagaaatgccaattgaagaggccaaaaaacttggtgcgattgcgatgtttggcgacaaatatggttctgtcgtgcggattgtcaagattggcgattacaacaccgaattcgatggcgggactcatccaaccaactccaatgcactcggcttattcaagattacaagtgagtctgggattggcgccgggattcgtcgggtcgaagcggtcacgtcaaaagaagcttacgaatatttgacccagcaacaggattggttgagcgaaactgctgagaatctaaagattgaccaagtcaaaaatgttccaagcaaagtgacccaattacaggcggatttaaaagccgaacaaaagacagtggctggcttacaggccaagttggcagcccaagcggcggcaggtatttttgatcatcctgaggaagtcggcggtttgaaactgattgccaaacaggttcaggtggccggaatgaatgaactccgacagttggcggataaatggaaagccaagcaggcatctgacattttggtactgggtaccgaagttagcggcaaggccaacttgttggttgctgtcaatgacacggctaaccaagcaggctttaaagcgggcgatttgatcaaggccattgcaccaaaagttggcggcggtggcggtggtcgtccagacatggcgcaggctggcggcaagaacccagctggcattcctgcggcgttgtctgaagcaaagacagtgattagccaaaaggcttagctgattaggccagatggtcaccatcgataatgaagcggcaagtttttggaaatttcgaaaacttgccgcttttacttgaccttttttctgagattggtgaagtccatcacgcaaagttgagcggtcatgttaaacttaagaaaacgatttcatcgaggcggggagtatgaataggttgcggttgtcgttgactggcttttttggaccaaacgaacactatctggttgccgaacaacatggtggcattaaaatcatatattcagttgatccgcgtgtttcaacacctatttttttacggaccattgcacaaaatcaaataggccattaaattagtcgataacgacgattggtagccgcgcagaacaaaaatagcatttattcacttactattgctcaggaattgtacatttgcttgtatttcaagtaaaatggtctgtgaagcggatagaatagaggtgtaagaatgagcacattagatcaaaccgttcattttgattttcgagataacaatccgaagaatgttcacgaaacgctggagacagtttacaaggctcttgaagaaaaggggtataatccgatcaaccagattgtggggtatctgatttctggggacccggcctatattccacggtacaatgatgcgcgtaatctaatccggaaacatgagcgcgatgagatcattgaagagcttgttcgaaactatcttggcaaggagcaagcttaatgcgcttgatggggttggacgtcggttcccgaaccgttggggtcgcggtcagtgatcctttgggctggacagctcaaggtttggaaattattcggatcaacgaagacaaggagcagttcggcatcgcccgcctcaaggagcttgtgaagcaatatgaggtaacggcgtttgtattggggttgcctaaaaacatgaacaactcgattggaccgcgtgcggaaaagtcacaagcctacggtgaactgttgaaaacaacgtttggtttgccagttgatttcattgacgagcgactcacaacagttgaggcttcccgcatgttgattgaagaagctgatgccagtcgcaaacggcaaaagcaggtgatcgataaattagctgctcagatgattctccagaattatctggatgcaaaaggtcccttgaccaagcaataatcagggcaagtgatggcatgacctccgcccgtgttgaaggagaaacaagatggcaaataatgaacatgtaacgcccggcgaagacgatcagcagattacgctgattgacgaaaaaggcaatgaagaattgtatcaggtcttgttcacatttgattcggaagattatggcaagagttacgtattgctgtatccggcgagtgaaagtgacgatcaggaagtcgaaattcaggctttctcatttacccccgacgaaaatggcgatgccagctcgggcgatcttttcccgattgaagacgatgctgaatgggatatggttgaggaagttttgaacactttcttggccgatgacgattcgaatctgaaagattaagtcttaactcacggcatgtaagaccaccagaatattggtggtctttttgtagagcacgagccagcccttacacgcaggtttatgggctggcgagcgcgtttacgagcgaagcgtaaattgccagcagcctaaaaagggagttaaagccggcccggttttgaactggcgagcatatgatgacgacaagcattaccccacttaatattcgctggcaaaacagataaattgagctgtgtcgcaatcaaccccttaccctacttgccggctatggtagaatacactttgagagagtggaggcattcacgcaatgagcgaagaaaagcgtcgttttaaagccgtgatcggtgataaaacgtacacgattatcggaccagggtccgaacaacattttataacggtcacgaagttgctgaatgaacggctggagcaagttaaaacactggcgccagatctatcggccgaggaacaagccattttagttgccttcaattctgtttccgatcaggtcaaactgttggcggcgcaacaggatgatcatgagcaggaagagtagtgggggaccgtgttgatttcattatcgattattttaattttggcttatttctattatagcggcgcgcgtcgtggtgcggcgttgcagtggttgcatgtggccggttatgggttgagctttcttgctgcaactgcacttgctcggccactgggggcgcattttactttggtagtgccttacccgtctgctacgaatgccggtcagtttgcattttattcagataaagtcggcttgacgcttgataccgcattttatcgcggctttgcttttttagtcgtgctgacgtttggctggttattaactcgagtaggggcattgtggtttcacgacttgacatatgccgcaatgggtcatcgacgcagtgccattattggcggctgtgctaatttagtgattggttacatttttctgtttttgattttagccttgctggcattgattccgattgccggtattcaacatggcttagaccatgccatcgttgccaaggtcatgatcaaatattcgccagggctaacacaatttgtgaatgctttatggctatgaatgttgacgacgctcagggacgatttatcacgtctttgagcgcttcttggttataggagcaattatttatgaatgaaaagattttaaaaacccttgaatacgacaagattcagcaagcattgttgggtcaggtcgtgacagcaaatggccgccagctggtgcaggccatgcagccgctgaccgatccagtcgccgtacaacaggcactagatgaaaccgcagacggcgcatcggcgttgcgattaaaaggcggcattccggtgccgcaactcgagaatattgatccggcgcttaaacgagtcgacattggggccgttttgaatggtcaagaactagccagcatcagccgtgtcttgcaaacggtgagtgccattgataaatttttgactgatttacaggatcagattgattttcgccagctttacacacttcaagaatcgttaaccgtgttaccgcaattatcacggcgcttgaagacagccgttgatcctgatgggacattgaccgatgaggctagtcctcagttgcatggtgttcgtgaacagatcaaaagtattgaaggcgagatccgcggtaaaatgacaaattatactcgcggcgcccaatcaaagtatttaagtgacccgattgtgacgattcgggatgatcggtacgtgattccggttaaggctgagtatcgcgccaaatttggcggtgttgtccatgatcaaagtgcgaccggccaaaccttgtttattgaaccgcaagcaattgtcgccttgaataatcgactgcgtgaggcacaactggccgaggtagctgagattaaccgcatcttagccgaattgtctaatgaattagcgccttataccggtcaaatcaaggcgaatgcggcggttcttgggcattttgacttcatcaatgcgaaggcgagattagccaaggcggaaaaagcgacagagccgttagtgtcggctgataatgacgtattgttgcgtgatgctcggcaccccttgatcgatccgcataaggtggttggcaacgatattccgttgggcgacaagtaccaagctatggttatcaccggcccgaataccggtgggaaaacaatcaccctcaaaacattaggactgttgcagttgatggggcagtccggattgtttattccagctgatgatgaaagtcgtatcggcattttcgatgaagtctttgcagatattggcgatgaacaatccattgagcaaaatttgtcgactttttctgcacatatggacaatattgttcatattctcaaacaattgtcacaaaatagtttagtgctgtttgatgaacttggcgccggcactgatccgcaagaaggtgcggcgctggcgatcgcgatcttggacgcagtgggtgaagttggcgcgtatgtagttgccacgacccattatccggaattgaagttgtatgggtacaatacagcaaagacgattaacgcatcgatggaatttgacagcaaaacgctgcagccgacttatcgccttttggtcggggtacctgggcgctcaaatgcgtttgatatttctgcacgtttggggctgccgagcgtgatcgttgagcgtgctaagtcaatgatcagctcggacagccatgagctgaataatatgatcagcgacttggaaaaacagcgaaaggcagcggaaaccgcttatgaagccgctcgtcgtcaactagccgatgcacagtctgtccatgacgagctagcggcagcctacaagaagttcacaacggaacgcgatgcccagttgcagcaggctaaggacaaggccaactcattggttgacaaggcccaaacgaaggccgataaaatcatcaatcaactgcgccaaatgcaattgacgaatccgggaactgtgaaagagaatcaattgattgctgccaaaacggcgcttaaacaattgcatcaagacgagccgcttcagaaaaatcgcatcttgcgccgggaacgtgagaaacaggcattgcatgttggggatgaggttaaagtggcaagttacgatcaaactggtaccttgctggagcaattcgataagaagcattggcaggttcaactaggcattttgaaaatgaaggtaccaactgatgagctggaaaaaatcaagccaagtaagcaatcagcggcgcaacgtccggttgtcaaagtaagtggcggcgggatgagcggtccatcgaccacgctggatttgcgcggcgagcggtatgatcaggcgatggcggatttggatcaatacattgatgccgccttattggctggttatccatctgtgacgattattcacggactgggcactggcgcgattcgcaacggggtgacccagtatcttaaacgcaatcggcaggttaaaacgtatggctttgcaccacaaaatgccggtggttcaggagctaccatcgtaaactttaagtagcaggtagttttttacacttgattgtgctatgatttagttacaaaaagtaagaggagggatccgttcatggttcaagcagtaacagattcaaactacaagacggagaccgacactggcgtcaccctaacagatttttgggcgacttggtgcggcccttgccggatgcagagtccggtcatcgacaaattggcagaaagtcgcgatgacgttaaattcgtgaaaatggacgtcgacgccaatccagagacaccaaagtcttttggcattatggccattccaaccttggtcatcaaaaaagatggcgaggttgttgagaagcttgttggctatcaaaccaaggatcagttggagtcaaccttgaacaaatatacggcttaatgaataagtgaacagacacgcatcgacgctactggtcgatgcgtgtttttttgcactaaacatgttgaatgggatgtcgcctaagatgaagctgacaggcgttaatttcaaaacttaaaatattgaagattttcttgatgctgatgaattggtctaaaaataactaggatatcaatagttatgttaaactttttctaagtcattgtgtgggtatttgggacggtggcagcataattgttttacataccagtttcaaaaagggatagcttaggctccataacgcgttcgccaccgcagaaaccgaagcataaggaccttggacgcaatggcccaagaccggccatcacgcccaaggccgcttatgcttcggtttctaaccgcggtggctcacgcttctcatattacgaaactgttagctcattgttacgcaattcgttggcgtcattttttctgaaaacctataatgaatgtgtaaataaaaacgtggggtggcatcatgttcgcaaaattaaaagctatgtgggagaatcccacttttcgatttattttttggaccattacgtattttcttatcctgttggtcttgatttatctctacggctacagcgggattaataacagtaaattcatttataacgagttctaaaagcgttcactggcgcgactagaaaccggagcgccagtgaacgcgtctaaagaggaggagagccaatatgatcgataatgtaattactgcgatcgatcgggtcgccgcggaacatccaacgcgcgttgcttacgattatgaaggcacacagtacacttacgcacaattaaaagaaggtagcgatcgcttggcaggcttttttgctgaaaccttgcctgagcatgagccgatcattgtttacggcggtcagactttcgatatggtcgaggttttcttgggcctttccaagtctgggcatgcatacattccgattgatacccatagccccaacgagcggatcacgcaggtgcaggatgtcgcccatacaccggctatcatcgaagtagcgcctttgccgattgcggttccggatgttcagattattcgcgcaccagagttgcatgaagctgagaagacgcatgcacccattagttcattgcaacatgcggtcgttggcgatgacaattattatattattttcacaagcggcacaaccggcaaacctaaaggtgttcagatcagtcatgataacttgttgagttacgtgaactggaacatttccgattttggtctcaaggaaggcgttgtggccatgtcacagccaccctattcttttgacttgagtgtcatggatttgtacccgacattggttttgggcggtacgcttaaggcattgccaaaggaagtaacggacaatttcaaaacgttgttcgcaaccttacctaagctaggtttgaatgagtgggtatcaaccccgtcgtttgccgaaattgctttgcttgatcctaatttcaatcaagataattaccctgatttgacacatttcctgttctgtggtgaagaattggtcaataaaacggcgcaggagttgatcacccgttttccaaaggcaaccgtgtataacacatatggcccaaccgaaacgactgtggcggtcacaggaatggcaattacgcaggacattgtggatcaatatccgcgtttgccaattggttttgctaaaccggatacggaaattttcgttgtcgatgagcaaggcaatcaagtgtcagcgggtaccgaaggcgaattgatgattgttggaccaagtgtttcaaaggggtatcttaacaatcctgagaaaacggccaaagctttcttcaatgttggcagtcaacgcggctatcggtcaggcgatttggccacgatgactgaggatggcatgattttctatcgtggccgaactgactttcaggttaagctgcatggctatcgaatcgagcttgaagatgttgatcataacttaaatcaggtttcctacatcaaacaagcttcaacggtaccgcgctacaacaaggatcataaggttgctcaactgattgcttttgcagtggcgaagcccaatgacttcgaaagcgatatgaagctcactcaggcagtgaaagctgagctaggcaaaatggtgatggaatatatgatcccgcagcgcattatctatcgtgacaaattaccgctgacagccaacggcaaagtcgatcggaaagcgctgattgcagaggtaaatcattaatgctgaacttacaaccatatgagaatccgcaatactttgtttatctcatcattgctttactgccagttatcattggcatgttcaagggtttccggatgcactggtacgagagtcttttctcaatcgtttttctggtgatgatctttgatgccgataagtggccgcaaggtaaagcactgttgggatatgttgttttcaatctgctcttggtctatgcctacttcaagtatcgtacgcgagaaggatcaaaaaattcaacggcagtcttttatctcagcgtcattttgggcattgcccaattagtcgtagtcaaatttacaccgttgttccaacatcatggttccattcttggatttttgggcatcagttatctgacatttcgggttgtcggtaccatcatggaaattcgggatgggtcaatcaaagatttgaacatgtggaaattcattcagtttctgctgttcttcccaacaatttccagtggtccaattgaccggtatcgccggtttatcaaagactatgatcgtgtccctgatccagagcattatgcccagttagttactaaggcaatgcattatttgatgcttggatttttgtacaagttcattcttgggtacatttttggaactttatggctcccatcggttgaacatatggccatggtcagtcgtaccggcgcatttctaggcttaagctggccggtcgtaggtgtgatgtatgcttactccttctatctgttctttgactttgctggttatagtttattcgccgttgcgatctcgtatttgatggggatcgaaacgccaatgaacttcaataaaccgtggatgtcatacaacattaaggatttttggaatcgttggcatatgagcctaagtttctggttccgggattatatctacatgcgttttgtcttctttatgatgaagcataagttgattaaatcacggatctggacagcctttgtcggctatctggtgttgttcctgattatgggtatctggcatggggaaacttggtattacatcacgtatggactattccatgcgatgttgatcaacttgacagacgcttggctgcgattcaagaagaagcacaaagacttcttcccgcacaacaaagcaacgcattactttgcgatcttcatgaccgctaatgctgtctgcttctcattcctgattttctcaggattcctagacacactctggttccattaaggtaacgttgttacaggcttgtcgctgtgacgacaagtcgcggattaaaaagaaagaggtacttaataatggctgacgaagcaattaaaaatggtgttttagatattttggcagatttaaccggttctgatgatgtgaagacaaatttggatctgaatctgtttgaaaccggcttgttagattcaatggggacggtacagctgttgttggaactgcaaagccagttcggcgtagaagcacctgtttctgaatttgatcgtagtcaatgggatacccctaacaaaatcatcgcaaaggtcgaacaagcacaatgaaaaaaccgatcgggaagatcctttggcgcggacttggcccgctgctgatcgctgtgatcctggtcgctgcgttgatgctcgtgccatttaagtttggccgcagcagccaagcaacgattagacaagcggccagctctatgtcggccaacgtgcttaaaggcgagaatatcaaaaatgaagccatggccgaaaactatgttccgtttatcgggtcatccgagctgtcgcggatggatgcctttcatccttctgtcctggcacaaaagtatcatcgcaactatcggccattcttgatggggatggctggcacgcaggatctcacgcacttcttgtcgatcaatgcgttacaacatgtgaatgggaaaaaggcagtcatggtgttgtcaccgcaatggttcgttcctggcggggttcgcaaggcgcagtttgattacttcttttcgcctgcacaaatgacaaccttcttgttatcagcgaatcctaactcagaggctgatcgttatgctgctagtcgattgttgcaatttccatccgctgactctgatcgcatcgccaatgatgctttgaagaatattgcggcagggcagaagttatctgacagtcagtactggtatttgaaaaaaatcaaggaacccatgtctgaccatcaggatattttattctctcagctgttcttggataataatcaacctaagttaaccaaagcagccaagacgctaccaggtacttacgatgctgatgtattggatggtctggcaacacaggatgggatgaacgaaacgacgaacaacgcgtttgagttgaaaaatgatttctacaccaaacgggttaagcgtaatttgcctaaattaaaaggctctcaggcaacatggagctatgtgaaatcacctgagtattcagatctacagttggtattgaacacgtatgcaaaaaagcacatggaggtactgttcgtcattccgccgatcaatgccaagtgggccgcttatactggtctggatctcgggatgattcaaaacacggttaccaagttaaagtatcaactgaagacccaaggttttaatcacgttcttgatttgagtcaagatggtgctcagccatacttcatggaagacacgattcacattggctggcgtggctggctgaagatggatcaaactgtccggccatttctcaaaaccaccaaggctgcacccgtgcactacaagctgaatgatgacttttacacaacgcggtggcagcagcgtagtgctaatggcttgaactaaaacttgtcgagattcaaaaagcatcatactcaaaaaggagtctaaacgtaagcaactgcttgcgtttagactccttttgattgagcagtaagcatgcaaacccaaaaataggacagtcaattatgatacgagtcttttagtctattttttggttggttggtgatcagtttccaagtcaatcaggtgttcagctcgcggttgggtatcttgattatccatcacaacggtcagaacaacgttttgctcgcgacgttgaatcgcactgccgccttcgactgcaaaacctaaaacttgttgcagtgcttgcgccaagaaccctacttctaattgaaaatcaggatcttcatatgtacgaattcgcgttgccacaacgtcaccagcgagtaaatattgccgttcctgccgcttttgtttgagcggggtgagcgcgccaaagccaacctgcgtgaacagttgcggaatggctgtctcatcgacaggcaacttagcagccaaatcgcgcccagcccaataaaggatgttgtgctgttcctcgccaagcatattcggcagcatgagatcacgcatcgctgtcaacgcaaagaacgaaaccgagcctggaaggttcagcagggtggtatagtcagattttgccatgttgtgcctcctgtttctattcgtctagtatagcggaaaatccaaagcaaagcatgattttctcaacgcttgcaatttttaacaagaaaactcacaataaagtttcagagagcgtgagcaggcgcggttagaaaccggagcataagcggccttgaagctaaatggctgggctttggccatttagcttcaaggtccttatgtgcaggtttctgcgcctgcgaacgcgttttagcggatccgagggccattttgcgaccaaggtccttacacgcaaactctcggacctagaaatgcggctaaaaacgatctgtctcacacctctacagcttcacccaaagcccgtgaggcagaacattttaaaaagaatcctatgcagacattttggcaacatgaactactttgcttgccatccctgcaaacctgtttcaaaaggagaatatttcatgaacaagcaaccaatcggctttattgattctggtgtcggcgggctgacagtcgttaaagaggcgttgcatcagctgccagctgaaagcagtgtttatctgggcgatcaggctcgtttgccatatggcccgcgacctgccgaacaagtacaggcgtttacttggcagatggtcaatttcttgcttaaaaagcatattaaaatgctcgtcattgcctgcaacactgccaccgcagcggcattacccttaattaaggctaacttagacataccagtcatcggggtgatcaaacccggcagtcgggcggcactgaaggcgacgcaaactggtcacatcgggattatcgccacagaaggcaccgttaaaagcggtgcttatgtgaaggctttacgcgcaaaggcgccgaagattcgcctaactagtctggcggcccctaaatttgtctcattggtggaaagtaacgaagcccactcacccattgctaaacgggtggtggctgacaccttgcaaccattgctgcatgaagacattgacacgttaattttaggttgtacacattacccgattctgcgcccgttgattcaaaatgtgatgggtgatcaagtgaccttaattgattccggcgccgagactgtgaatgatgtttccatgctacttgattattttgatctagcaaacaacagcggcgacaccccaactcacgaatattacacaaccggggcaccatcaatgtttgacgaacttggcgaagcttggcttgaactgacggcgccgatgcacgccaaacatgtcaacattgagggtgaggcagatcacgctatggctacagtgcctgaagcaaagggtaaaacgattgtcgttgccagcaaaaatcaaggaaagattaaagaatttaaaacaatgtttgaacctgctggcatcacggtgaagagtctagccgacttttcaagcgtgccaacagttgacgaaactggcacaacatttgaggagaacgcccgacaaaaagccgatcagtatgccaaagatttgcagttgccggtgattgcagatgattctgggttgatggtcgatgctttagacgggcaacctggtattcgctcagcccgttatgcaggcgatggtcacaacgatgcagctaacaatgccaaactattggcagccttggcagatgtcccggaagatgatcgaacagcgacttttcatactaccttggtgcttgctaaaccggatcatccggaagcagacttggtggtacatggtgatgtgagcggactaatcactgcgatcccacgtggcacagatggttttggctatgatccattcttttttgttccagcgttagggaagacaatggcggaaatgaccgctgaagaaaaaaatcaaattagtcatcgcgggaacgcaatgagggcacttgaagatgtttggcaaacatggttggaggcaaacggatgaaaattttagcagttagcgatacccacggtgatcgagagattctcacagctttgttgaaacaacagccgcatcttgatggctatttctatgccggtgactcagaattagccgctgatgatggcctttttcagcagtacgaggcagttgaaggcaacatggactatgatcctaattttcccatgcaaatcacgaccaccattcaaggtgtgacagtcttcatggcccatggacatcgttttggggttaattttggcctagataaactcatcgctgcgggcgaaggggttcatgctgatctgatcattttcgggcatacccatcagttgggtgtggaggaacacgcggggattgtgattcttaatcctggttctatcagccagccgcgtggccagtttgccaaccttggcggaacttatgccactgttgaatttactgcggataacgttcatgttgattttttgaagcgtgatggggcaatcgtgccagaattaagtcgtgatttttcaaggaaacacgattaaaaaagatctcactagcaggacgctgtcaattgacagtgatctgcaggtgagatctttttggctagcctttgatgaatagaactttgtaggtgaagacggctaggatggctgctaaaatcggagcaacaaccggtacccatgagtatccccagtcggaactacctttatgtttaagcggcagcagtgcatggagaatgcggggaccgaggtcacgggccgggttcaaggctggcccagttggtccacccagcgaggcaaccaaggtcgcgaccagaaaacccagtcccatgtgggcagtacccagattattttggaaaaaaggagccttggtaattccgagggcaccgataaaaagaatataggacccgatgaactcgttgacgaaaccgttaagcttgctcttggtggcgctgatcgtgctgaaggtgcctaaaacatgctgtgtattggttgtgagatcataatgcggtttgtatgccgcaaccaccaataactgaccgaacatggcaccagccatctgtaccgcaatatatggcaagacttctgaccatgggaacatgccagatgcagcgagtccaagggtaaaggcgggattgatgtgattgcctgaaatcgcgccaaacatcatcgcaggaatcatcaccccagcaccgtagcccacggcaatgagcaaccagtcagagccgttaccttttgtcccttttaaatcaacgttggctacagagccatttcccagtagcaccataatcgcggtgccaataaattcggcggctaaacgcacgcctagatcgtatgtcatttgtttcctccaagtagttaaaataatacccaaaagcttatgaaagtataaatatagctgaaaatagtgtaccaactttttggggaaccgtccatttaaacgactagtaagcgtgggcaggtttctgtgcctgcgaatgcgctgctttacgcattatcggacgaattcgctcgaaaggtggttgaatcaattaaccaattgtccgtcttttgacggatggcagcgagtaacgtaagcgttaagatgaaataaagaagttgcctgaagctgaatttttaggcgtactcaggtaaaataggactgtcaataaaggagttgctcatatgttaaatccagtcattgccaatatgctgatcgaaaatcggcatcacttcatgatttcagccgacatggttgcaactgtgtctgaaaacaatcctttgagtcatgcctttttggtattgaccaaggtgcggtatgcgaaaattcccgtcctcgatcatgattcaaaattcaaagggctcatctcactgccaatgattaccgagaccatgcttggccttgatcacatgagttttaattcactagatacaatgacagtcaaagatgtgatgcagacagaggtcgcgaccattgatgatccctacgacttggaaaatgtcctacatttgctcgtcgataacccattcattccggttgtccaagatggttactttactggcatcgtcacccgtcgtgaagttatgaaggggatcaataatattggtcacaacatagataagaattttcaattagaacccttaacagttacggtacctaaagaatcttaacttagaaaaaacgtcgcattgctaaaagcagggcgacgcttttttatatcagcgagcacattcagtgacagtcgtgatgccaaacttattttttctcgtcagcatctggtttgtctaagaaaatggtggcgagcacgccgatgacgaggctaatgacaaccatggcgatggcgccgaggtgaccagtggctggccaataaggggcgataccagcctcgataagaattacgactgctgccaagacaatgccgcaaacggcgtagtagacttgtgcttcaaaatgggccaataagtaggccatcaatttagctactgctatcagacctgctgcagccccaatcatgaacgggagcaacaaggcaactgatcccatcgcagtttgaaacgcggaccagttgccggatgcagcagcacgagcagcatcacccaactgacccacagcattgtaaaccgtaccgtattgatcaatcaccatcaacatgactgaaccagaaataccgggaattgccatcagtgaaactgcaaaaacgccggcaaaagccatgacgccagcatcgctgacacttgtcaaacgtttaatggcaatcagattttctggatcagtgccaccaagtttagccagcccgtatatggcaacgaagccaaagaccactagtagtaagtaccaccatgaaaactttttggttgtcagtttacggtaaatgaacggaccgatacccagcactaaaccaataaagaagccatagcttggcagcggccagcgggtggtgatgaccagaaccgccttagtggaaagcaggatgccgatcacagcacccaacccaatcggtgtcaaaaaccgcatattttttttgggatcatcgcgaaaatggttgaccgcatttaacaatcggtcatagaggccgacgaccacagcaaaaatactgccagaaagtcctggaatgacaagtgcgatgccaataatggcacctttaacgaaatttagcataacatctccttttgaattgggttaagccgcttgatgataacgtgacaatggcacggtggttcatgaaccactttgcaagtttaacggcggtgtgacaacttttatgcctgcagaattcaaggcagcaacgtaggcgcctaagaaagtgcgttgcaggctcacctgttcgccattttcggcgtaaaaaagaacctgataggtgaaagcaccattcttttcttcagttagcccaagaatgtcaggctcctcggtaatggttgtaaatttcggtaccaaatcttgattcacacgttcaatggttttccgaactagatcgagatcagcacttggggcaagcggcaatttaatcagcacctgcatattgcttcgcgaaaggttgctgacgatggtgatgttgcgattgggaatgaaattgacagtcccatcggaactcttcaccaccgtcgtccgcaaaccgacattggtcacggtaccggagatggtgccgagtttgacgacatccccgacatcaaattgtgcttctaaaaggatgaagaagccggtcacgacgtcgtttacaaatccctgtgccccaaaaccaactgccaaacccacaaccccagcaccggctaacagtgtccccactggtacgccgagaatcgataagatggcgtaaaggtagaagaagagtaccagatagaaaaaaacattcaccgataacgcatgaattgttttgacccgggtgcctgtcagatgtgcccgtcgttgatagcttttaaaggtgcgattgagcgcaaagcggccgagccggtacaaaattaaaaataagacggtgaaaaacagcaacgacagcactttgtcgataaaagtgcctacgattttatcccaatcgatggttgtaaaatatttcagccaaacgttggtttgctcgttgacggttgttgctgtgacgatcatgtgtatcacgtgactgcctcctttacattggcactattttaccagaatcggtgggtgtgtgctgggagatttggtttgagtgggcggtaagattctccgaaacgcgcaaaccggcgcagaaactttcacgtaaggatcttggatgcaatgaccccaaaccggtcatcacgcccaaggccacttacgttccagtttctaagcgcgccggtttgcggtcttaatttttttgcaccgttcttgtcacgatgttatgattgttttaatcaactggtttgaaataggagggtgttggatgtcaggtggagagattgcttggattatcgcggctgttgcgtttctgattattgcacttgcaattgcgattattgcggttcgtgtttctggtgtgacgaaagaagttaagggcacggttgccgagacgaataagacgttgaacacgatcaacggagagcttggcattttgacgaaggaagttgaaggtcttttggctaagagcaacaccctgcttgaggacgtgaacggtaaggtggcggcaattgaccccgtctttactgcgatcggcgaacttggtgagagtgtctccgatttgaatcaatcaacgcgcaatttaactgagcgtgttgcgcatggtgccaagaacggagccaaggcgaccgttgcggctcgtatgagtgccaaggcgttttcaatgttgacgaagaaaaaacataacgatcaatagcagggggaagaatcatggctaaaaaaggacattttttgcttggatttgtattcggtgccgctagtgccttagccaccacttatttattaacaccacaaacaagcgatgaattgaagcggcgtgtgaagcacgcttctgaagacttggcagatcgggcagttgattatttcgattatgccaaggaagctagcgctgactggaaacaaagtgccacagattttgttgatgaattgaagcgtaaaggcgacgatgctgatggttctaaagcattggcaaactatgatgctgccaccgagcaattgcgtgatcaactgaatacggcaacagatacggactcatcagcagactttgatgacattgttcttgacggtaaaagtgcttttgcgcaagctaaagatgatgacgagggcagtgatactcgcaccgatgaagtgccagaaccagtagaaccagaagcagttgcaccagcgtcaactgataccgcaccggctagcagtgtcgcacctgatgaaccgcaagcatctgcgacaaatgataagtaacagacatgcatcacttagtcacaattgatgcaaaaaaggcgacaaacggattgttcctatgattggagcaagacgtttgtcgcttttcgcatcagttattgtcaatttgccataatcggtggtacttcatagatcaggcaggttggggccttttgcagcaaccaaacgacgacttggttgccaaggtcgcagcaccgtctatagatcttttttaaaggagagaatatgctgaacagtgaacgtcaagcgcagatcaaggctgctttaagtacagccgctgagccgcttagtgcctcaagttttgcccggcagtttgccgtgagccgccagacaattgttggcgacattgcgttgttgcgcgcacaaggtgagccgattattgcaacgccacgagggtatatgttttctcgaccggccgcccatgagtttttgttgccttgcaaacatacgccggcacaaactgccgaagagttacagttgattcttgaaaatggcggatggatcgaggatgttttgattgagcatccgctttatggacaattgcgcggccagttaaacatccggacagtggctgacatgaaactgtttatgagtcggttgtcgcgctatcatggccgactgttgtcagaattgaccggtggcattcatttgcatacgattagcgttaaaagtgagcgcgatatgcccaaaatcaaagcagctttgcggcaggcggggatgctatatgaacaagtggagcagaggtagtctgatgccgctaaaaaagccgtccggaatctttccgggcagctttttttgtggcatatgaatacgactatattgcagttttttagacctgtcctagccgttaatgaccgtgaattcctttgaggtgtgggtaaatggttcgcagccggtttcggtgacgtggacacagtcctcaatccgaacgccagcaacaccaggtacatagatgcccggttcgattgagaaacacattcctggctgcaacagcaaatcgtttccttccatgattgatggaaattcatgtgtcgacatgccaatcccatgaccaagccgatggttaaagtaatcgccataaccagccttagtaatgatgtcgcgggcaatcttatcgagctcggatgctttcaaaccaggcctgacagccgccattgcggttaaattggcctctaaacagacatcgaaaatttcccgcggcttgccggtgacctgaccaaatgcaacagtacgggtggcatctgacatatagccatggttgtcagtcccaaggtcgaacaaaaccaactcgtttggttgaagcttggtgcccattggttcaccatgcggattggcagcgtcgacgccggcctgcacaatggtaccaaagctcatgtgcatgacgccttccttcatcatggcataatcgatttcagctgccacttcttgttctgtcgcgccagctttgatcgcgttaaagccggcctgaaaggcgcgatctgcctgggcaccagctgcttccatctgtttgatttctgacggtgtcttaatgagtcgctggttctcaatgaaccgggatgcgtcaaccggaaaggtagcatccggaaattgtttcatgagagcttcaaatttgaagacagctagattatctttttcaattgcccattttgtcgggttcgctgtcaccgctttgatgtgattagccatgatggcaaatggatcttcgtgatcaagataaccgaagacttggtacggccagccagcttttttgacctcttcaatcgtcagctgaggggtgaataggaaaggatcgttgtcaggggtgacaatcaacgctgtgatgcgttcctcaggatcttgaaaaaagcctgtgtagtagttgatattgattgggtcgctaatataggccaggtccaacccttcttttgcaacccaagcttgcaaagcagctaaatgttcattcatattttttcctcctcaacgtgttcactggcgcagtaccatgcagacgcagtgcactttttaaccggactagctcgcgatctggcttaaaagtcatgcgccaatcaagcatcgtggtaaaatagcacaacttaaaactttaacttttagtatatcacgtgactagcttgatgggctttctgaaaaaggcggttgtgaaaatttcatgtaaaattcagtaaaacgcttgcattgctatttctattctgttattttggaatgtaaatagaacttcgtgatttcatcttttcacgactaaggagaaaatcaattggaaaagcaaacaattacaatttatgatgtcgcacgcgaggctaatgtctcaatggcgacagtgtctcgagtcgttaatggtaacccaaatgtgaaaccagctactcgcaagaaggttttggaagtgatcgaacggcttgattatcggccgaatgcagttgctcgtggtctggcaagcaagaagacgacaactgtcggggtaattatcccagatgtcacgaacatgttcttctcaagcttggcacgtgggattgatgatgttgccacgatgtacaagtacaatatcatcttggcgaactctgatgaaaacaatcaaaaagaagtcacggtgttaaacacattgttggctaaacaagtggatggtttgattttcatgggccatgaattgactgactcaattcgtgctgaattctcacgcagtaagacccctgttgtgcttgctggctcaatcgatcctgacgaacaggttggcagtgtcaacatcgattacgtggctgctctcgaagaagccacgcgtcagttattggaaagcggcaacaagcgggttgctctggcgaccggttcattgacgcatccgatcaatgggcagttccggctcaagggttacaaacaggctctggaaaaggccggtgttgcttatgacgaaagcctgatttttgaaaatgagccaagctaccaagctggtttggccttgtttgataagttgcagaaagttggggcaacggcggttattgcaggtgatgacgagttagcagttggccttttggatggcgcaattgataagggcgttaaggtgccggacgactttgaaattatcaccagcaataacaccaaactgacggaaatgactcggccacaacttacttcgattgatcagccattgtatgatattggtgcggttgctatgcgcttgctgaccaagatgatgaataaagaagagatcgaggaaaagaccgttatgcttggcttcgatattttgaagcgtggttcaacgaaataatgccagcttttgtgagctgcttagcagacatgtaaagtcattagggtaaagaaaaaggcttccaagcaaattacttagaggccttttttcttgcgttgaaacgaaaactcgtgatcgtgttgttactgaccgccgccagtcgttgttgcaggtggggtctgttgttgattggtattattagtgccaccagtattcgtaccgccaccagtcgttgtacctgtgccggttgtcgtgccagtttctgtggtcgtcccagtaccgccagtcccaccagtgccggtggcgccattcgtgccgccagtccctgtggtttgtggttcgcttggctggttttcagatgttccttgttggttttgctgacttgatggcactgtcacgctaggagcactgctaggtgtcgtctgagtatcttcagttggcgtgatcggggtttcttgatgttcttttttggcttcagttgaattgccattggcatcggaaacctgaccatagccattttgtttgccatcaagatggtcgaagaacaactgataattagctttactgccaccgatcgcaaaatcatttttcgtggttggctgccaatcattgtaaaggctggtgacggttgagccgccagttcggtaggtgtttccgtcaaaagtcaaggtgccggcgggttgcccagtttgtttatcgacagtcactgatttaaccgtatccgggcgtgccagtttctgattaaccttaaattgtttaggaatcgtctggtaaactgcgttggttaatttagcccaataggcttcattggtcatggagccagtctcatctagtgaataagttgtgccatcattattgtcatagcccatccaactggcgattgttaccccaggtgtcgagccaataaaccagatgtcccggaaatcattgctcgtccctgttttcccgatcaggttatcagtgttgaagtggagttgataattgaggctttccgcagttccggaatcaatcacgtttttcaacatttgattcatgatgtaggtcgtgcccttagagaagacttttgttttcttaaccttatgttgatagattggatgaccagacggatcgacaatctccgaaatcacgtaggctggtacgtgctcaccttggttggcaaaggttgaaaatgcgctggcttgttctttgacatcaaccccgtaatcagtcccgcccaaagcgagtccaagctgactatagtcatttttggtgagggtatcgatgcccattttatccatatagtccttaacattaacggtcggcttgatgtgtttatataagttgactgctgggatgttgtaggattgggcaagcgcttcggtggcaggaataaagcgattctgaatctgaccgccgtagtctgtcacgctgtaattgttgccgagatcggttttaaaatcagccaacgctgtttgcgagccgatgattttttggtcaacggccggcgcgtaaactagcaaaggcttaatcgttgatcctggcgaacgcaatgtatagatatgattgagttcaccagagactccgccaacgaagcctaaaacagccccggtttgattgtccaagacgaccgaaccattttggactggatgtttaatggtttcggtttcgccagtcttcggattaatttgtgtgctggtataagtctgaccaaatgtgctgcgtgttgccttcatcacaaattgcatccggtcgtaaacatctttgttaatcgtgcttttaatctgataatttttcgatgaaaaaagattagcagcttgccgcagatagtcgttgtttaaggcgttgtctttcgccaattcggcggcggaatggccatcgtttttagccaactgctcagcaagtaatgattcggcttcgcttaacaccatgttgtacacgtagccatattgattgtcgtcttcttcagcattctcatgctggagaaaagcacctttgatatcaaatgccttggcgtcgacatattgtttatgactaatgaccccagctcgatacatccggaatagaacggtctgctgacgatccacaccatctttgagattgcttttaagggcgccagaagcggtatacggggtgtaaataaacggactttgtggcaggccggcaataaacgctgcttctggcaggttgatgtccttcgccgagacgccgaataggccttgggcagctgcctcaaccccagctatgttttgacctttattgttacgaccaagtgtggccacattcaaatacgtggctagaatttgatccttgctaaaatgattatttaaacgtcgggccagcataatttctgccgctttacgtttaaaggtcgtttctgagcttagaaacatcattttgaccacttgttgtgtcaatgttgagccaccggtttgattgcccatgccagttaaatcagagaaaaaagcacgaatgaccgctttgggtacaacgccatcatgccgatagaagtcttcatcttcagtggcgacaatggcttttgtcagccaaggcgacatttcattcaaatcaaccttggttgagaccaaatcgcttttaacattgctgagtttgacgttgtgagcaaaatacatgctggaagtgcggcttgtattggaaagggtggccttcatggcagcttcggtcggaatcggggtggcatcgataattgaaacgaaatagccgccgaataaaccgaggccaaagacagtcgcaataccgagcacgccgagtaagtaataaacaatggttttaatactttgtaaggtgacgttgccgtaaaagacaacggcctccttgccagttaagtttgttgtctctgcttcggaatcaggacgccgggtcacaaacgcagtgaaccagtggcgaaatcgagtcccgagcgttttgactcgatcaaagaacttcttcaaatgcttgtcccaccttaaattatggtctagtacgccttagtataccttaaatattaagcggattctaaccggggatttgttgaggcgtgtgaaccgacctagcctaaaaccggggtgtaagctgcttgaggcgtgatgaccggtttttgacggggtcgttgtctgcagattccaaggctagtgagcacatctttgacgcagtggcgaagcctaagcgctgacttcgcaaacagcttgtcacgtctcatcaggtgtgtaaaactgatagcatgtagctttaagacgagaataggagcttagtatgtatcggataattttgtttgatgttgatgacacgttactggattttaaagcaggtgaactaaaaagtctggcaaagatgtttgccagactcaatttgacttactcgccgcggattgaggcaagttatctgaaaattaatgccagtctatggcgcgactacgaagcggggcgcatcacgcggccagaattgtttgatgtgcggtttgccaaactctttcgccatcatcacattgaggctgatccgcatttggcagaacgcacctatcatcattttttggatcaagaggccattttgctgccgcgagttctgtataccttggatgcgttgcaggattatcggctgtttattgtcagcaacggtatcgagcctgtgcaacgtgaacgcttggcatcgagcggtctgattgattactttgaagatatttttgtttctgatagcgtgggcagcccgaagccgaccgtggccttttttgactatgttgccaaacgcatcccgcggtttgaccggcgtgagacattgatcatgggcgactcgctgacctcagacattcaaggtgggatcaatggcaaaattgattcgatttggtttaatccacattttcagccaaatcgcgatcacatcacaccgacttatcaactcaacgaatttagcgatttgacgaagctattgacgcttaactgaagtgacttagactgtttcaacgagtcggatggtgccgcttgagaccaccaatgtgccaagatctgtttttaatagtaaagcgccgttatcatcgaatccgctgatcgtcccggtcagcggattttgtgtgccgctgaccgtgatgcggcgaccaacccacgctgctcgtttgcggtacgctggcatgatggtctcgggattggcaaaaagccgcatcaggtgggtcaaataacgaccagccagctcgggacgcggatcatttgcagggacctcgcgcaaaatggttgtcatcggctgatcatttggcaaaggatcgctggcagcagggaaaagatcgacgccggttcccaaaatgacagcattttgttccaacaacgcttcggctaaaatacccgcgactttcttaccagctttctgtagatcgtttacccacttaatctgagtgctgatgccaaactgatcggcgattgcttgttgaagcgcaacaccagcagcaggtgtgattagggcacggttaatttgtggatgaaacgcatagctgatgtaaagtccagcatcagctgggcttgcaaaatgtttaccatgccgtccaacgccagcggtttgctggtcggcaattaaaatctgtggcaaggggccgccgttttgaacggacttttttaaaatgacatttgtggatgtgacggtgcctgctgtggtgacagcggcacgcaaacggggatcatctaaccatgggtttaaagcatcaggttcaaacataaattgcttcctttcagacgttttgataacggttaacgccaacaaggccgacctagtttaaaactaagacggccttgcatgaactgaatgtcgataaaatgacgcccagagattacttgaccaggcgactgatggcatcggcataaatggcaacagccgtgatgatatccttaatcggcatgtattcgttagcttgatgcatcacattttcttgacctggcatttgggcaccgaatgcaacgccgcgcttaatgatacgaccataagttccgcctccgatcacttgctcatgtcctgggatcccggtgtgatcagtgaatgtttggagaagtgttttcaccaatggatcatcccctggcacatagtgagggccttgggcatgaccactgatgcttacggtgaccttgtcggcgcctaatgtcgtctcaatctgatcacgaatggtgtcagcatctgtcccttgcggataacggacattcacaagcacactttgttcgccatcttgagtaaaggtgaagatgtctgggctggcggtcaattcgcccatcagcttgtcggtataattgatgcctaacagcttgcctcgtgagtcgttgtgcaagtatttagcgaccatcaggagataagctttaccggctggatcaaatggcaagtctgccagtagattggccaagtaagtgccagcatttttgccatcttttggctcctgtgcatgtgcacctttgccgacaacttcaatggttgttggattacccaaagtaagggtaagtttgacgccagcctcatccgcccaagcggttgcttgtgtggcaaaagtttctggtaaattgccggtgatggtcgcagttgcgacttgcggcaccatgtttggccgaatcccggccgagaagttggtgagcgttaactcagctggtgcagcggcaattggcttttgatcaattttgaaactggcaatgcctttttcaccgttgatgattggaaattcagcatctggtgagaagccaaaatccggtgccggctgggtttccagatagcgatgaatcccgacccattcggattcttcatcggtgccgatgataaagtggatctttttattgattggcaggccaagatcacgaatcaactttaaggcataataagctgcgatgcttggtcctttatcatcgctagtgccacgcccataaattttaccgtccttgataacgggtacgaatggatcagtttgccaacctggacctgctggcacaacatccacatggccaaacaaaccaaagatctcgtcaccgctgccaagctcaatgcgaccggcaacgttatcaacattaagtgttttgaaaccatcgcgttcggcaatggtcaaaaaggcttccagtgctttggccggtcccgggccaagtgggtacgcctttgtttgatggtccgtatcgcgctcagagttgattttcaaaagggttgtcaagtctgaaaggagttgcggttctaacttctctgcttcttgctgccaattaatcgtcatgaggttaacctactttcttactgtcattgtctttaggatagcatgtttaatcatgggaaactaataagccgtccatcaaattgtgagggttgatagtcacaattgatgaacggcttatgattgagagtggttcggcgattaaccgatgccaacgacgctagcattcaacagtggtgtgtcaaaggccgtgtcgcctaatgcccagtggacaagtggcttttgtgcagcaggaatactgcgatattgactcatccaggtagtcatattttcagcatctggcaacagttgcaaatcttgggcgtttagccaaccggttttgatctttacatagaggtgattgccttcataccgtgccgctgtgatgtgatggcgcgtatggttcgcgatgtgagcaatgacatcttgttgatgcaacggatcagcgtatactggcacgcgaaatttttttccggtgacaacagcattttgattaatgaagaggctagcccatccggcttgcggcgcaagattgactgttgtcgctggaacgaaagcattgtcgccaatttgataataggtgttgccagcaatcgttaccatgctggaaatcatcacaggggtttcaggcgctaattgttcatggcgcaacgtcggctgatatggattttcgtaaatgggtaagggcgtggtactggagttggcaccaagatcgttaatatcggttgtcactgcagcggccttcaatgcctgaaattcatgccctagagccgtatagttggtgacgataccgtcaatgttgagattcaccagccaagtccataatgagcgattttcgttcatctcgtcccagatgtagacttttttgccaagatcgtgaagttgggtcacaagttgcggtgtcactaagtccgaactcaggttgataccatctacgtaggttaagacatcaaaattgattcgtttaagtgagccaacaataaggatacggggcacattgggcaaaacggcttgaagcctttttaagcttgcagcggaaaatgagtgaaacatcacacgattttccatgtgatacttttggattaatgccgctattttgtcttcgagatggggatgaggttctccctttacgattttggtctcaattagaaatttatggttggtttgttgctcatgaatgaagagatcttccaagctgtgaatcggctcgccatttttggtatgatattgctgaagctgagcaaagttcgttgtggcaattgccaaattagcgccggtcattcgttggatcgttgagtcgtgttggatcaccacgacaccgtcagcactttcatgcacatccagttcgacatagtcggcgccattattaaaagcactgtcaaaactttggtaagtctcttccggataattcaatggatcgccgcgatggccgatcagcgtgaaacccgaaagcagaaggaataaaggcagcaatagcactgccagcgtgagtcgcttgcccatacaggctgctcctttccagaaaaaaacatcataccataaacatagcaccgcaaagtagccgggacaatttttagaacacgacaagcagtggctaaattgataaaggagtatgaagaacatggctgataaatttcaagttttcgatttaattcaagaaatcacacggaatgacggtagtcgctattttgaactaggtaacgtcatgatgaacggtcgggcggaaaaggcggctatgaaggggcttattaaacgtgtgcggatcgttcaactaaacattccccattcaactgctgtgacagcttacgaacagtacatcaacgatcattatgaattcccgtcagctgatttgacgagctgggaagagtgggacaaaccagaagggccagtacgtcaggcttaccacgagattctgaagcagaaccatgttggatgagtggtgatatcgctggatcgtcagcgacagtaacaatttaaacaaaacctaacaaacactggcattcacactggtaacgttggcttgggtgatgctagcagcggtgcggtggctttagtctcacccactgcgctaactaggtgagcaccatcgcgaatcgtcgcgtagttggcttgattttcgattagtttggtacacgccgcattttgcgtcacgttgacgccacttatataatgtagggcatatgaaagtagggcattcactaggctaattttggccgggtgaatgtgaggaggcgtcagcgtgaagtattttggtaaatggcttattccgttcgttgcggcaattgcggtttttattggcatgcagtttgatagcagtctttacgccaaaccagtcggtcgtgtcgaatcagttcaagtcattaaaacgaccagtcatgatgatgaggatcagaatcatgatcggctaaccaagcaacaggttaaagtgcgtttactgaacacagcaaaacgcgggcaaagcgtcaccattcataatacgtactcgttcagcggcggtttagacaatcagttgcggccaggtgaacaaatctttttagatgtcgataagggcgtctatacgctcaacaacatcaaacgcgatgccatccttgcggcgttgcttgttttgacatttggcctaattttcttggttatggggcgtcacgcttggttaacaagtattagtattcttttgaacacagtgatcttttttatcgcggtaacgtgggaaattggcagtaagcaatggcaggcgtggtggttgtttgttggtctagcagtcgtatttacaattctgactgcggttttcattgttggttttaagccgattgccgtcacaatttcactgggatcgttactggcaactggccttgctgtggcgctaggctatggtgtactgacgttgacaaattataacggtgtgcatctggaagaagtgaaatatgcgacgcaaatgccgcaattgctgttcttcgctcagattgttattggttcattaggcgctgttcttgatgaagcgagtgacatttcagtggcgatttttcagttgcatgacagcgccaaagaacggtttcaggcaggtatggcaatcggccggaatgtcatgggaccgctaatttcagtgctctttatgatctttattgctgatacttttgtggaatcagtgctatggattcgtaataataactcgattgcacaaacagtcatttgggtgatggggcttgggtttgcccaaagtttaattagtgccttcggaattgtcctagcggtgccaatgacgagcggtttagccgcgtttatggctaaaataaagaaggtggcagcatgaatgcaattcttgccttggcactattgctactagtcatgatgctcttgattgggggcaaacaaggcctagccaatttctttgcgctgacggtcaatgctttgcttatgattttagtcgtgattttgatggcgagcgggttcaatccaattattctcgctgtggtattcggattgattattttagccagcaccattttcttgagcacgagtcatgtagcggttgcgggcccagcgtttgtttccgcgttgctaatcatgacgttgcttgtggggctcattatcttgactatgacgctcagtcagacggctggctttggaccagaagattcagaaagtcttgaaggcttctctgtttacatcggggttagttttccgcatattttgattgcaacaaccttattaggcacgctgggagccatcgcggaggcggccattgccgtagcggcggggatggatgaaatcaaggatcaagcaagtgatgccggcatcaaacagatggggcatgagattattggcacggcgttaaatacattgttctttggtttttttggcgggttttcatcattgttcatttggtttgcatctttgcggtatccgttcagccaaatcatcaataataaaatctttgttggggagttgttgcaagtcttgatttcggtcattgccgttgttttgacggtaccgatgacaacttgggttgtgacaactcgtcatgcgcatcgcagaaaggaataatatgcagtatttcattgcagacactcatttttttcacgccgatctattaggccaaaacgattttgcaccgcgactgttcccctctgttgaggctatggacacggcaatgatcaatgcttggaatgctcgcgtgggggatcgggatattgtctatcatttaggcgatatcgcgatgaatcctgagcattttccgcaaccaccagaagtgcttggtatattaaaacagctgaacggtcgaattgtcttcattaaagggaaccatgattatgagtcactgttcaagtttcttcatcgaaatgatcctggtgtgaatggacagccaaaattcacgtttcatgatgttggcaccattattaaggacgaccatacacaattcattatgacgcactacccgttgatgatggggattgtcaaacaaacactgaatttacatggtcatattcatcacaacagcgtcaatctcgctgagaatatcaatgtcggggtagatgcaccggaacgcgatttgttgatgccacacctgccatttgggacgccgctgtccgctgctgaagtgcatgaaatttatcggcttaaggcccaggcgttagcccaaaatcgatgaacaaccgtttgtttgaccgcccgcttatcagagcataggataaaaataagaaagcgcgccggtgattcaccagttagagtatttatttttgccggcacagggaggtttctcgtggaaaagttagtgatcctgcataccaatgatctgcattctcattttgaaaattggccgaagattcggcggtttatgttgggaacacgcgctgcagaacaagcagaaggcgcgagtgtgttggcatttgatgacggggatgcgatggatcgctcagcgcccttaacggaggctacgcaaggtcagatcaatgtgcaattgctgaatgaaattggttacgatgcagcaaccatcggcaataatgaaggtgtcggtaacccgcatgatgtgctggaacatttatacgatcatgcgaactttccagtggcactggctaatttattcgaggttgacggcagccgaccgacatgggctaaaccgtttgtgcgaacgcaaacgcgtgctggtacacgcattgcgattgtcggattcacggcgccattttttctgacatatcgaccaaatggctggcaagttaaaaccgtggcggatgtatttccggatattttgaagcaattatcaggtacctatgacgtgttaattgtgctgtcacatttaggaattgaggctgatcggcacttagcaaaacagtatccagagattgatgtcgtgatcggaggccatacgcatcatttattggcagacggtgagttacatggcaccaccttattaacagctgcagaaaagtatggccattatgtcggtaaagtgacgctgacgctggatgatcagcatcaaattatcacccgtcaggccgagacatttaaaactgagctcatgcaagcggcagccgctgatccgcgtgagatacagggctatgagagcaaaggaattgctttgctcaagcagcatcaggtggcgcggttgcccaaacagctatcgatcaaatatgatgggccttcaccattactggatttaggtttagaagcattggctgatggcgctcaggtggacgcggcgattttaaatgccggacttttccttatgccgctgggtccgggtgttgtaacccaagcggatttattaacctgtttgccgcatcccatgcatctgttaaaagtaacgctgagtggtaaggaactgtggcgcttaatcatggaaatggaaaagaatcgaatgttcctgcgacattttcatatgatcggcatgagttttcgtggaaagatttttggtgacattggttaccgggggattagcgttaatcgtgaaaaacgggttgttctatggcatgggaaaccgttggtgccagaacaacaatatacgtttgtgacggtggacaattttctgttcattccattctttccaaccattgagattatgggcagcaatgaattgctttttcctaagttattacggaatgtggtgggcgagtacttagctcaaaaatatccattatgatttcgtgatatactttgcgaagcatcagcacacataaggaggtgagcacatgggcgaacatgaaccgcttatgcaacaaattgatgccgcattgaccccagaagctgataaagattcgcgggtggtcattgttaacggtgatttactaacgattgatggtcgccgctatcgccttgttaaggatcaccgaaatgcttttgatgttgcgcgtttgaacgaacgctacaacgaaattcttgataagtatgattatatcgttggtgattggggctatgatcagctgcgtttacgcggattctataaagatgatcgacgcggtgtcagcaaagaccagctcatcggcacacttgaagattatttgtatgaatattgtaattttggctgtgcttactttgttttggcgtgtttagacaagtcagtgacaaaagggcagccgcatcgtcgtcagggacatcgtgaggcggggcagagatcagaaacgatcaaaccagtgcatcgccagacacccccaacaaatcggcgcaacagccaaaacaataagcataagccacggtcagcaaaagcggaaaaaccgtatacggaaaaaacaacccgaccaaccaaaattcgcggcgatcaggctaaaactatcaatcagacacaaccacgcaagcgacattttacgattcggcggcgtgagactaataagaagtagggacgaacttgaagtataaaggctatatgatcgatcttgatggcactatctatcgcggtaaggagcggattcccgctgcaaaggatttcgttgaacgactacaggcggcacaaatcccgtttttatttttaactaacaacacgaccaaaagtccagaagatgtggtcaaaaacttagcagagaatcatgatattcatgtccaaccggcgcaggtatacaccccggcactagcaactgcagcgtatctgaccgaccttaatcatggcgatgtgacgggtaagtccatttatatcattggcgagttaggcctcaagcaggcgttgctggatactggattacgattaaatgaagttgatccggattatgtggtcgtcggccttgactatgatgtgacttatcataagtttgaactggcaacactggcgattaaacgcggggcaaagtttattgggacgaatgctgacaccaatctcccgaatgagcgcggtttggttccaggcgcgggctcattgatcgcgctagtggagcgcagcacacagcagcgggctttttacattggcaaacccgaaccaacgattatggagaaagccttgaaaaaaatgggcttacctaaagaagcggttgccatggttggcgataattacaacacggacattaaggcagggctgaatgctggtattgatacgattttagtgtataccggcgtttctacccgtgattatgtttccaagcaagtccatcagcccacacatcagattgatgccttgacggattgggaggtctaacctccatgaagcgtattgcccaatgggtagcattgtggctagccatcattagtgtccttgtgttcatgacgattttaagtacgctgatcacttttccagtttatgcacacatggatgacctaccgcagattgccgtgatgtcccttggccggctttatcagaattatttgcagctgatggcttacttaaatttaccgtgggttggtactctgcatatgaatgatttccccacaagcgtacatggcgccattcattttgcggatgttcgccacctctttctcttcgatataggggttgctgtggtcacggtcccatttgcggtacgctggttgcatcaacttcgcattaccagaaaaagatatttgttggttcgtccgtttatgatcggggccgtggtacctgttgtgttgacggctatactagcggtgaacttcgaccaatttttcatcacgtttcatgaagtcctttttcgcaatagcgactggctgtttgacccagcaactgatccgatcatcaacgttttgcctgaaggattcttcatgttgtgttttctgacagcatttgctttgtttgaagctgtcatgatctggggcatttggcgcgggcgtcaagatgcgaaggtggcatgattggcagcgcaagcaaaaacgcatcgcttgtcacgtggaatttaccacatgacaggcgatgcgtttttttgatgcaaatcattttgctcagcgttcagtagctttagctgtccgggttttaatggcagcaatgaccatcggcagaagggaaatgatcacgataccgatggcaaccaacgaaaagtgttctttcacgaaggtgacattgccgaagtagaaaccgccgaaaacgcacatggtgacccagaggaaaccgcctaacaggttgtaatggataaacttgccgtaatgcattcgggagccgccggaaacaaacggcgcaaatgtccgaatcagcggcataaagcgggcgatggcaatcgtcttaccgccgtgcttgtcgaagaaagcctccgcctgcttcagtttgtcgcgattgatcagccgtccaaaccagccattgccagtggatgctgccgaaccaacgcgtttgccaatttcataattgacggtgtcgccaataaccgcagcagccagaaagacggcgaagagaatccacacattcaggttatacgcggcatttgcagccaacgcgcttgcagcaaatagcaatgaatcaccaggcaggaaggggaaaataacgacacctgtttcgatgaagaccatcgcaaaaaggatggcgtaggtccaagggccgaagctattaacgatggtaatcagatgctcatcaatatgcatgatgaagtcgaacagttgggtcatcttgtgaactcctttaatgaattacagcttattatacggattgatgtgaaaatttcatgaatcctgacagaattttaccaaaacatcaataaatgtcgtcttcaatttctggatgtgaatgagcaagtcgacttgctgcagcagcagcagtggctcccacgatatcatctaaaaaggtgtggataatgccaggctcatgggcgttcagcttagctaagatccctggcttgatgcgatcaatataaccgtaattggtaaaaccaatcgaaccatatacattgacaatcgagaaggcaagcacctcgtcaacgccatataaaccttcatcttcagcgatgattttttgcaacggttcttccaaactgttagcttctgctgccttgtccaaagcaataccagtcatcacagcattttgaacttcacgtttgcgtagaacaatgcgcacattttgtgtggcttcttcaagtgtcagcttggggatgaagcgttcttgcaggaacattacaagttcgccaatatcggatatccgaaccccgcgttcatgtaacagttgaatcgtgcggtcatacaatttttcttcattcgtcatgtttttgctccttgatgggtaaattgcgcagatgagcgttaatgatacagctgagtactgtgcaaggcctgacgtcgatctggatacaagcggcttaaggcctcattgatagcggttggcgcttctccaaaaccgctggcaatcagcggcaacttgccagcatagctgacagcatcgccaattgcaaaaatgccgggacgactcgtctgcatttgtgtgtccaccagtataccattacgatccgtgtcaagttgccaagcctgtaggtggtgtttgtcggtgacaaatccataattgatcaacagcttgtcgacggtgagcgttggctgtgcctcgccgcgaacttccttcaactgaatcgctaactgatcatcttgaggggtgactgattcgatcaggtaaggcgtctgaattgtcacactgcttttttcaagtgcagcaacactggcttccaagccgcgaaatttggcacgacggtgaatcagactgacatgtttggcaaccggttcaagtgccagtgcccaatcaattgcagaatcaccaccaccagccacggccacttcctgatcccgaaaagtttccaaatcctgcacgaagtagaacagttttttgccttccaatgccggatcatagtcaacagctaacttgcgcggcgtaaaagcaccaccaccggttgccacgatcacagttttactgcggaaatcgccttggcttgtatgcaatgtgaaaaagccatctggatcttgatcgatcgtctgtacttccgtagcggtcttgacttcaggatgaaaatggacgagctgagttttgagctgcgtgacaaggtctttgccactaacatgcgggaatccgccaatatcatagagaattttggcagggtataagttgcctgtttggccgccaagctcgtcaagactctccaataacaaaacgtctgcctggcgcaaacccgcataaaaagcggcgaacatcccaaccgggccgccgccgattaccgtgatttcatatacatgctgcactgacatttgcaatgctccgtttctatatagtatgacgtccatacactaccatattttcacgataagtaccaaaataggccgaacaccggtctgtcaagtgtgattagcccgtaagcagcctttttaatagacgatcgttgcatcagcaagcctgtgtagtttgcgctcaggggctgggctggtatactacgcctagtacaagaacgttaacttgtaaaggagattgatcatggattacccacaattagaactcaaagactttaagggaccaaaagcgatttttgaaacaagcgaaggtcgctttgaaatcgcacttttccctgaacaggcgccaaagacagttgaaaactttgtaggccttgccaaaaaacattattacgacggtttgatctttcaccggattattgatgatttcatgattcaaggcggcgaccccaccggtaccggcatgggcggtgaaagtctctgggggaagccctttaatgatgagttttcaaatcagctattcaatttgaaaggtgcactttcaatggccaatgctggtccaaatacgaatggcagccaattcttcattgtgactaatgcgcatttagacccgagcatgcaggcgcaactaagtgaggctggattcccagaacccatcattgaagcgtataaacaaggcggtacaccgtggctcgatcatcgccacacagtctttggccaagtcctaagtggcctgtccgtggttgagaagattagtaaagtcaaaacaggtgctaatgataagccggttgaaccggtcacgattgatcaggttacgattgaagactaatattggtcggcaatgatttttagggtatactcaaagagaaatccaatgaaatgaagtgtcagaatggaatatcgcataggagatatcttgactggcaaagtgacaggcgttcaaccttatggcgcgtttgtcatgcttgatgagcacacgcaaggtttagtgcacatctcagaatgccagcatggttatgtcaaggacaccagcgatatttttaccgtcggccagcgagttgaagttgtgattttggacatcgacgaatatacccaaaaaatcagtttatccttacgtgccttacaagcgtcgcctagaatgagtaaaaagcgtcgccgcaagcattattggaccagtcgtaaatttcacacaggctttgcaccgattgccgctcggttagacgggtgggtcgctgaagcacttgatcatttagacgaagaaccggctcacaaatgagtcggttctttttttctgaacttttgtcacgatgaatagaataatgttcgcagaaatgctgaatttttatgcaattttggagaaaacgttcgcgatctttcggtattttaaaatgtttcaatttgcatgaattttttattgactacatcgttaaagtgctggtatgatacttgttgttgtcaaaacaaaaggcgctgatctttagcggatatacttaattagatcaagttgatggcttgcacaatgtgcgacgtcgagaacagatgaataaatattcaatgtttaaaaaaacgttgacatgtaacgctggtcatgataatctatcaaagttgtcttttgacaaggtcgtcctttgaaaactgaacaaagtttcgtttaaatgtgcagggtccttggtacttcggtaccgaggcagaaagtaacatttgcgaagtcaattcgctagaacaacaaatcgagctattcgaacagctcatatttatatgagagtttgatcctggctcaggatgaacgctggcggcgtgcctaatacatgcaagtcgaacgagttctcgttgatgatcggtgcttgcaccgagattcaacatggaacgag

SEQ ID NO: 52 - DNA, 3201 bp, Lactobacillus paracasei
ttcaaagcattcgaaccgctagtgcaacgttgagcggtgtggaaattgttcacgcaatacgcaaaagaacccgacgagagttaagtctcatcgggttctcagtcgtggacgaattagaagcattgttagctgcataaccttcaacataggatcaatagctggttagatggtcatctctcacactgtttgcaccagatccgcccaaacgtttgattggctaaatcgatacgcttttgcatactaatccccctgtttgataagaaggtacttaaagagttgctttcaattgatctaatcgccattggcaccatgaaataaaggctaattcgtcaatctttggaatgccataggttctagcatacgttaacttttgagtggtaagtagttgatcatagggcttactaataataccaaccacaaggatatcgacatttttgtcaatcccgttgacaggttttgctcctagaatagttgctaactgttgtgcctgcaaacgacgaaaagatcgcaaacgtccggtaaagagaattcgtttcccccttaaatctatcatgatgtttacctcttactagggggaacgttagctaaatcttctgcctgatacttttcgatgcgatataaggttactggtgcaatgcctaacatgcgagcaatttgtcgcttggtcagagtttcatctccgtctttcttcctatttaaaaggcgacaggcttctttataaatatagcgtttttgacgattaggtgaatgaggcccatactcgcgaattttacccttatatttgccctggcgtttggcaatttcgatgccttgttgttgccgtatcttaatggtttcccgctcttcttgagcaatatatttatataattcgacaatgattgtcgtaatcaagttacgaaggttaggatcttcaatacttgcaaagctaggtaggtttagcacattcaattgagcgccacgacgtcgaatggtttcgatgatgtcagttaaatcatgagaattgcggccaagccgatcaagactcagtaccactacttcatcatcatcacgaatatagtctaacattgctttcagttgaggacgatcggcatttttacctgaaagcttctcttgaaagattttattaacaccggcatcatgtagctgttcaatttgacgtgccagattttgatcacgcgtactaacacgcgcataaccaattttagccaattctagatcacctccgggtcacttatatgtaactaataatactcccttctctctttagttacaatagggtacaccctattgttttaattgctgcacttaaaaacctcgcctaaacataaggagaggtaaagtgtaaacctatatgacctagttcatcgactcaattggaattggattatcaacaattgccatttgagtttctttatcaaagaaatgagccttgttaatatcaaatccaactctaattcgatcacctgggctgtggaagtcacgggcgttgacattggcaatgtactcttcattatcagttttcagatacaattgctcagttgcacctaacaactcagaaacagatacttccgcttctacaatggcatccggccaagtatcgataaaggcctgctcagaatgaatatcttctggacgaacaccaaaaacgatttccttaccgttatacccttgctcatttaaggtcttagcgcggccttctggcacctccatcctgatcttgttcccatctgacactataccgtttctgtaggcaacatggaaaaagttcatagcagggcttcccatgaatccagcaacaaagatattgcgtgggttcttgtaaacttcttcaggtgtaccaatttgttgtattttcccaactgacatgacgaccacacgatctgctaatgtcattgcttcggtctgatcatgtgtcacgtaaatagttgtggtattgaggcgcctatgtagctttgcaatttccgcacgcatagaaactcgtaatttagcatctagattagataatggttcatccatcaaaaaaatgggtgcatcacgtacaattgcgcgacccaaggcaactctctggcgttgtcctcccgacaagtctgcaggtttgcgctgcaaaaattcattcagtccaagaatatctgcagcattatcaattcgtttttggatgttatccttactgtaatgtcttagtttcagaccaaatgccatattatcggcaacagtcatatgtggatacaatgcataattttgaaagaccattgcgatgtcacggtcctttggggcaatatcgttcattaaatgaccatcaatgactagctcgcctttggttatatcttcaagcccagcgatcatacgcaacgtagttgatttaccacaaccggatggaccgacaaaaacaataaattcacgatccttaatgtgtaaaacaaaatcttcaacggcataatcattaccatcatcataactcttgtataagtgctttaaatcaatttcggccattttaatccttctttcacggttctgaaatctatacaaagatataaatatcgttatcattgtttttgtagggaagctcatgcctagattgcataattaaagttaccacccagaaaatgtgaaaaaagacctgtctgttcttgctgaaatggtgtttgcataacataccatctagagagaaggacaggtcccatggccattataaccttaattggacgatctcagatagaactgatgcaacaccacacgattcaatacatcgctgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaggctaaccctaggttggtcccctgaaatggtcggttatgccgttcactgtgcgccacacacgatttaccactggatttatcaaagacaagtcgattttcagccaagtcaactctttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgacc

SEQ ID NO: 53 - DNA, 58222 bp, Lactobacillus paracasei
actcgttccatgttgaatctcggtgcaagcaccgatcatcaacgagaactcgttcgacttgcatgtattaggcacgccgccagcgttcatcctgagccaggatcaaactctcatataaatatgagctgttcgaatagctcgatttgttgttctagcgaattgacttcgcaaatgttacttcttgcctcggtaccgaagtaccaaggaccctgcacatttaaacgaaactttgttcagttttcaaaggaccactttgtcgccaagcgacaacttactaagaatatcaaattggcaactcgttgtcaacatctttttttaaatcgctgtgcggtttaaactgtttttatgactgacaactcgtactatactacgcagtttgctcactcaagtcaaccacttttttaaaaaagtttttcaagaaaggaaaagcacgcactatgacagaggatcaagctttttggaacgcatttgcgcctgattatgccgcggcagagcaggcgtcgcgtttgcctatcgcacacgatgtcatcgcatggctgcgttcaacgcaattgctgcctgcgcattcggcggtcgacttagctgccggaactggccactacgctgttcaaatgatgccatgggttcaggaactgacgctcattgattggtcgtctgccatgctcgcctttgcaaaagagcgcatgcatcaacaagccgatactaaagctcaatttatcgtggctgactggcgcaaattacacaagccgcttaatgccgatatgttgtttgtcagccagttgccgacacttaaacctcaagacctaaaactgctgatgaactgggctagccaaaccgtggtgcttaactttcaaactgcacagtctgacgctttgcttgaacaagcggcctcgcttttaggattgcagctaccaccagtttatcaggcggaccccgcccggatgacaagcttcaaagtttggctgacagcccaacggataccttttcaaagtcattctttgacgtacgagattgaagagcaaacaactttaagcgacttgttaccggatctggcgacaccaattggtcttaaaactgctgccagccttgccaagaccatcaccggccatgagaatacgcacgttcaggtgactgatcagttgacttatacttatacccaactggtctggcatgtttaatcaccacccattcagtatgttcgaaacacaaaccgaattatccaaatttcgactaaaaaaaacttgctgctgtatgaacgttcatacagcagcaagtctttttatagataacagcataaacatcattgatggtcatgcccgtcgattttttcgaaacgttaggctttaacttgcaactgttcaacgttcacaactgtgtcaacccaggaactatcatagaagccagcttcatgggaaactagtaaaactgcgccaggatattgttgcaagccttcacgcaaagcgtttttggtgtcgtcgtccaaatgattcgtcggctcgtccatcactagaatattagtcgtttggagcattaggtcagccaacttgaccttagcctgttcgccccctgacaacatcgtcagaggattgttcgcctcttcactggtcagtgcagtgcgtgataagacctgtcgaacggttttctgcgtgagcgctgggaaccgttgctccaaatactgcactgggctttgtttaggttgatcccagtgcaactcttgttcatagtagccaaaaacaacattgtcagctatttcaacgttgccactgatcgccggtaaaaggccgagcaatgtttttaacaacgtcgattttccgacaccattgaagccttcgaaagcaatgatctgatcttttgcaaccgaaaagttcattggttgtaataatggcttgtcatagccaacaaccaaatcgttaacatccaccaagatttgtcgattaacaggcgcatacggaaacgccaaatgcgccttggatcgcgtcccaggaggcgtcaatttgtccattcgcgccagctgcttttcacggcttttagccatcgtggcgcgcgtgcctgccttaaacttccgaataaacgcctcagttttcttaatcgtctcttgctgcttggcaaaggccttcaaataagtctcatgatcggcctctttttggcgcatggcttgttttaacgttccggtgtattttgtgatttgcccgaactcaatatctaagacagcattggttacattttctagaaaatcaaaatcatgtgagatcacgataaacgcgccctcaaaattttggagccagtccgttagccaggcaatatgcgacacatcaagatagtttgtcggttcgtcaaggagcaacatatccggcttttcaagtaacaattttgccaagattaacttcgatcgctggccgccagacaatgcttcaacaggatgatccatccccattgctgtaatcccaaggccttcagcaacagtttgaatcgttgtttccagatcataaaaatcgcccgcttcaagctcttgttgcagctcgcctgctttggccagtaaatcgtcatcgggatgattagcataatcggcataaatctgattcatttttgcttctttacggtagagatcactaaacgcggtccgcaaaaattcaataactgtttggccgggtacaagattcgcatactgatccaaatagccaacatgtaagtgcttctgccagacgattttacctgcatcaggcgtcagtgcccctgtcagaatcttaatgagggtactcttgccgaccccattttgcccgatcacgccaaggtggtcttcgatatttacttgaaaactggcatcttggtacaacactttgtctaaaaagcgctgtgacaggccggttacggtaagaacactcatgattcctcctatactaaaacgtataaaaaacgacagctgattggttgcttagagcgtttgctgaaaccacttcgcaagctgtgacagtttgcatgcgagtggcctcaatgccaattgacacaatgatgacactggctctagctcccttattcacgctctttctgaaaatagtcactgcttgctaggctatcacagcatggttatttttacaacggagcaaattttttgcaattttatgcgttctagcgaaataatagctccatagtaatatcaaagaatttatatgtggtctgccctttgacaaggttaagtgtgcctcggatgacctgagaaaatgtcaaaatcacgacacgacatatatatagagggggaacctaaatgggtatcatggaatcacgcttgattcacggcaccgttggttttgcgatcggtgatgcgttgggattgccagttaagggacaaaatgcggctgaattaaccgctgcaccggtgacaaccatgaagggttatggcacctttaaccaacctgctggcacctactctgacgaaactggactcgcgttagccggattagatgccttgcagcacggttttgatgaacaagccttaatcaaggcttaccaagcttggttcaccgcgggtaagtatgctccttatggcaaacgcagtccggatatctggccaagcattgaaacagcacttaaaactggccaatcagttgccgcccccaaagaacccggggcactcattcgaatcttgccattcgcctttttcgcctatcaaacgtttgacacgagtctttttcaaaaagctgaaggtgttaaggtacttgaaacttttgttcatattactaaccaagacgctgaaaacttggttgctgctggcatttacatgcaaattgccgttgaattacttggcgcgacgccagatttaccgagtgccattgccactggtatcgacaaagcaggtagttattttggaaccacgcagccttaccagccaatttttgaagcttttcaagcagccttggcagatgataagtggcctgatgggagtgctaccgatccgatcagtttgttagcacgcacacttaaggcactgcaaagtaaaccggactatcacgatgccgtcttacaaaccgtgaaccaaggtggcgctaccgatacaactggcgcgcttgttagcggtttagctggacttgcatacgggtatacaagtttgccgcatcgttggtgcctgatgttagccgaatatgcgcaaattgtcgatttatgccggcaagccgaaaatagcggctttttcccaaaatacgattaaattgaccggtgatcttcctagtcgcgagcgttcggcttgtggtagactgaagttattctgttccggaaggtgtcattgtgaaaaataacagtcattccaccttaaaaacggtgctcgaattccttgtcctttttgccgttatcttctttgccagtcaactactgatgcgctatgtgttgagcaaagatgtggtgcaaggaacttcgatgcaaccgactttggaaaacggtgatcgtttgtattctatccgcgtcaaaaagcctaagcgaaacgatatcgtggttattaatgcccctgatcggcctggttctctctatattaaacgtgtcattggcatgcctggtgacaccgttagttcaaaagataatcaattgtcagtgaacggcaagaagattgccgaaccatacttgaacaaaaagtttgccaccgacgagattaataaatgggccagtcagcagggacttgatgcttcaacgattaaattcaccaatgacttcaacatcaaaaccctttcctcaacgaaatctgctaaggtaccagccggcaaatacttcgtgatgggtgataatcggctagtatcccatgacagccgcgattttggatttgttgataagtcaaaaattcaatcagttgttgtttggcgctattggccattgaatcagatgaaactttactagtctgacaaagcactcaaaagcaccgccagtcgttaaccttttaatggttagcgactggcggtgcttttgggtgaaacgttgtttggttgtcactaccggagctcatatataagtgactcgagcctaaacgagcttgattgatctgcggtcgttttcgcttttaggcttgctttttgatgcttggcttgctgtctataacgcgctcgccatcgcagaaacctacacataagaacctcgaacctaaccggccatttaggctcctgtttctaaaagcgctggctcgcgctcactgcgactttaaaacctgccgatcgatcaacctgcgtagtttggtttgaatggccatcatcgtcatgcgatcactgtctttaaatgcttcgacgtaacttggcgcatcggtgctgatgctggcggctgggtggccatctaaaccggtaatgttgatagtatcaccgtcaatcttagccgtgaagtaactgccctcgaaaccttcatcaagcaaccactgagcccagttttgaatattttcagcaatagcctgatctagcggtactttatcttttaaggcggcttgccgagctttcacttcggcaagtgtcatataggcttcagtttccatcgtcttttgcctcaccttcaaaatgctaataccgatatacaattcattttgttgagatcgcggtcagtataccccgtctcgcagctggcgacaacgattcagctttagtcatgattgagccgcttgagccgcgatcttgtaggcgcgccgattttcataatagttagcgtgaaccaattgcaagtatggattgatcacccagtcaaataaatggaacgtgatgttttccagaagataccaaccgatcatggaaacatacaggccgagcaaatcgcctttgaagccgcgcatcagtcgccaggaaccgatcaacgccgatatcgaggaaaagcgctgattggtttcatgaccatctttaaagacccaaaaggcctgacgccagcccaatgcaagtagtattccaggaatcaagaaaaatgacagccccatcaacgtcaagaaatacataaagatccataatgagatggcaccccagaaccactgaccgttaaataggcctagcagcgcatgcagtggttgaactcgctctttacggcgtacaagatctagcacgccaaaattgaccccttgaatcagcatcgtattgaccaagctttgaatcgtattcatacttccggtacgattgccactttgcagataattctggaatccatctggatcagtcaaagctttgtcaatgccgaatttttgaattaaggcgaagaccatcaagtacgtgatgatagcgacagctgcctgaattaaactcggtaacaaataagccagcatcaaatcgcgccgattcgtgccttcttttaattgcccttttgctttttgcttaagctggcgataagtcattaaatgttctgtcaacgcccgcgcctccaattatcaatgttcaatcttaattgcctctttcttagtgaccttttctgttcgtcgtgcgactcgtaaaacttgatgaatccgccaaagcgcatatagctgctgcggaaccgcaccgatgatccccaacgattgggtcgctgagtctcgacgaacaacatgatgataagctggatgcccggtgtaaagaaaccggtgagtggccatcacgtaagtcgccgtgaacagttcatcttccataattgtcatgctttcatcaaaacgtagcctgacttgctcgatgacatcacgtcgaaaaactttattccataaataaccgcgaatataaccaattggatgaagcatttgtcgaattaggccttcccgcgtgagttgcttaggcttgcgtaaagcctcatgcaccggtcgcgggtcaggatcatcccgataaaacggcatcgcaatgagatcccaaccacgcgccatcatgtcaacggcgtgagcaataaagtccggctcgtaccagtcatcgccatccatgaaagcaactaaatctcctttggctagggccaagccgctgttgcgtgcagccgaaaccccatgattcacctgcttcagaatcggttgaatacgcgaatccagttctgcgaaatgcgcaatgatctgcggagaatgatcttttgaggcatcatcgatcacaatgatttgcaaatgagaataagtttgttcaattaagcttttcaagccgtgagccacataggcttcaagattataaaccggcacaatgatggtgacgagtggctttaccatgaacgcacctcctcactcgtgcgaatccccggatcatttattagctgttgaataggtatcaatccctttttagtcaagcagttgttagtcgccaagcagaaactgtgtctgtggggcaaaccattgcttgtgcgttcgcgataattttttatccgtaataagtgtggtaatctggccgagttccagcccgcgataaggcgcttcaatctgaaacttttcggtttcagaaaccacgaccacccggcgtgctgataacgccgctgcctgcttcacctgagcatcttccatataggaaaagtaaaccccatcttcggcaatagccgttgcaccgataaatgccgcatcaaaggcgattcggcgaagcgtttcaagcatcgttggttcaaagaagaaccgggcgtgatgatccagtttgccaccaaaaagatgtaaattaacacgttcttcaactgagagtgcgatcgcattgtctaaactgtgcgtgtaaactgtcaccggttgtcgaatggactgcgacaattttaataaggttgtcgaatcatcaatgaaataaacgccgccaggtttgattaacgacaatgctgacttagccatctttgttttctgagttgaaaatcgtttcagccgcgcggagtagctgggaatcgtgtgaccaaagctaagagacaccaacccgccacgagttcgtctcgcaacgccttgcgcatcaagcgcaacaatatctcggcgtgcggtatctcgtgaaacaccaaccgccttcataatatcctcgatactcaactcgctgcgtgctgccaacagtttttttatctcttcaaaacgtttttcccgatacattgccacgaattcggcctccttgacagttcagcttcattatacctgattctcaaaagcaccgtttaggccagtcattgaattgtatcatgaacgatcagagttaaagtttaggctcccataaatttccaaaaaattcacaaattgtggtagaaaattggccaatatcacagtaacttcaaggtctcaacccactttttcgagaaaagttcactgattgttacgaaaaattttaacattccgtttgttacacgaacgtaacaatattactgaattgagtatatttgtaatgatgttggtattttactgacataccacccctatatacttcgtcttgtgttctcgggggaacaaaacgacgactattcaaaatattaggagtgaatatttatctttactaagcaaattaaattatctatcatcgcgttactcagtgtcgcaccattattagggatggcaagtaaccattcacaaaaggtcgaagcgattgccgatcacgccgatgcagataacgatagtagtcacgtaaacgcaaagtcaattgtgttaagcaatgaggctaaagttgaacaggcgaatgcacattcactgatcaatcctaaaaaagaaatcacgttcacagtcggcacgaatgatattgccgaagcagcacatcagattgctgatcaaaaagctgccgctgctaaagctgccgaagaacaagcagctgctgaacaggctgcagcagaacaagcggctgctgaacaggcggctgctgaaaaagcacaacaggaagcacaacaagcagctcaaaatgctgcggcagcatctgctgcttcagccgcttctgcttcatcaagcgctgctacaacagcttcgacagaaacaaccaccaacaaaggtactttcaagttaagtttctatgatccgtccgtgcttgggtctggtttgggttacggcggcgttgctgctaacctctccgtattcccgaaaggtacccgtctgaagattacattatctgatggcactgtttggtatcggactgttaatgatactggtagttttgcagctggcaaccctaatcaattggatgttgcaatgccgaattcacagattccttcagctggagttttgactgcgacggttgaagtcgtaggttaatagattgctttaacccttcgcatcagtgcggagggtttttgtttgcgcaaattttgcttagaaccgtgttgactactaagggactacttgatctcggaggtttcaaaacgcgcaaacaggcgcagaaacctgctcataaggaccccaagcctaaatgccaaagcccggccatttaggcttgaggcagcttatgctctactttcgaaacgcgcaaacaggcgcagaaacctgctcataaggaccccaagcctaaatggccaaggcccggccatttaggcttggggcagcttatgctccggtttctaaacgcgcctgtttgcgctctgaactttttagttgacatctgtcgtttttttcgtaaaataaacaacaattcaacaaacgactaaaaacgatgagtagaagagtacctgagttgtcggtgtcagcgagtctcggttggtgggaagagacctctggtagctttgggaaagtagtctacgagttgccgaggtgactttggaagcttcggttgggattgcgcccattatagcaatcgtgtatcgccaggcaactggccgtacacggtaaggccgcttacggtgacgtagcggtaaattaaggtggtacagcgtgattcgcgcccttaacagtctcgactgttaagggcttttcttttggttaattagccaactcctttgaaaaccttcttacagtcaagacgctgtcggcaatcgttttgattaaatggagggatatcaatgtcaccacaacccacactcacaaagcgccagtatttgacactagggtcacttttgttcggtatgttttttggcgctggcaatctgatttttccgatccacatgggtcaactggccggttcagcttggctaccagcggcaattggctttttgctgtctgctgtgttgttgccgctgctgtcaatcatggcgatcagtctaacccgtgcgagtagtatgtacgatcttgctcggccggcgggacatagcttcgcattgttctttctgctggccactcatgcgagtctaggtctgctgatcgcgtccccgcgtaccgctactgtcacatactcaattggcattgcgccgttcttaggaaaaggtcaacaacaaatcggccttttgattttctcgtttattttctttttaacaaccttcttgcttgctcgcaacgaaagtaaaattacgacttatattggcaagctgctgaatccgctgttgttgattttgctagcagtgatcttcttttgggcactggtcatcaaaggtgatattcgtgcgataagttttaccagcagccctaagctcatgagcagcaacttgattaacggctttttgcaagggtacaacacaatggacgcactggccgggttaggctttggtgtgacgatcatcacagccttgaaactcatgggcttgcaccaggcatccactcgcgccaaggctgttgcgaaagtaggctccttggcaatgggcttggaagctttgatctacatgctcctgatcttgctaggagcaatcagtcttggcttctctaagctcacagcaaacggtgggacggcgtttaaccagatcatgacacattataccggtttgattggcacggccttgttaggcgcgatgacgctgcttgcctgcttaaccaccgcaatcggtcttgtgacatccttctcgcaagatctcggtcatcgttttccaaaacttggttatcactttttcctgccaatgacgacaattggtgctttcctgattgccaatttcgggttggatcagatcattgcttattcaacgccaattttaatgctgctctatccgctggcaattgccttaatcatgctcggcctcatgcatccttggattgggaaaaatacccgaatctataaaactacggttgccttcacgatgatccctgcgcttttagatgccatccatgccttaccagctgggctagcacaactaccgattttcagtagcattcaacaattcgctacaacctatattccttggttcggcatcgggatggattttgtgccatttctgctcatcggctttcttaccgggttcatcgccgctaaacttagcggtcacaaattggcaccggatctgcctgatccagattaaaaacgtcttgatttctcatcaggcaaaaaatattcagtatagcgcttcaccatgacgcgcccccagtcgcagcagcctgagcgcttctactcgcgctcacaaaaaaacagcagccttggcaatgaagccagagtgctgctgtttttttgatcacggtccggttgtcgcaccatcgagcgacacagtgtagaccggattgttcgctgtccaatcaaatccattcgcattgttaatttcattttgctgagtattaaaattacttagcgtcttgctttcaagccctaactgcccacgcagctcattggacatcttttgaagcgtttcggttgtcatcacctgataagcagcctcatcaatataaacgccaatccctttaagctgttgacgatcaatggtagttgctgaagcgcgataattttgcgcaattgccatcatatcatcaaatgttaggttggtccgcatgctagatgataaggaatccatgaccttttggtaatttgtcaacgatttgaccgataaaaggtgtttaacgatttgattgataacttcctgctgacgtttttgtcgaccatagtcgccttcaggatcttcgtcacgcattcgggcgtatgccaatgccatcccgccatcgagatgcgcctttccttttttaaaggtttggcctccggtattccagtctgtccaactaaacggaacattgacatccacaccgccgacagcatcaacgatttttgataagcctgccatattgaccgtgacgtaataattaatcggtacatctaataacttctcaactgttttaatagctgcatcggattggccatacgcatacgccgcattaatcttctcgtatgtcggcgagtcgcttccagtaccgaccatctctgccagcgtgtcacgaggaatgctggtcatcgttgttttcttctctttaggattgattgtgaccagcatcatagtgtcagatcgaccggtatctttccgaccaaaggctccggtatcggttcctaatagaagaatactgatcggttttttgccatcgagatctgagctgactgccttagtactaactggatcatacgtttttgcaactgcttttttggcttgagaataaaatcgagcggcatatccaccggcgagaaaaagggcaacgagagctatgatagccaatgcacgaagaatcggatgacgtcgttttggtttgcgttttaatgttcgttgatctaaatctggttgcttgtccattcgagcttcactccacttttagtttccagagtagtttagcagataattatgaagaaaaaagggatttacctcaaatgccgcctcaatatggtaacattaaagaaatattagaaattggagctgattagatgcaacatttaccggcacgcgcagaagtccctaccgaattgacatgggatctcacgactatttatccagatgacaaggcttggcaagttgactttgaagccgttcgtcagcaagcaaaggaagcggcagcacttaagggtacattgggcaagtcacctgaagcacttgtcgcaggtatcaaagccgttctcgcggtgttcagacgctttgaaaaggtttatgtctattccagcttgaaaagtgatcaagacactggcaatgcagcgtatcaagccatgaatgccaaagcagaaagtctggcagctgatcttgccagccaattagccttcatggatccggaaattctggcgattccagccgatcagctgaccgcttggcgcgataccgaaagcctcaaaccctatggccactttatcgatgccatcactgtgaatcgccaacacgtcctgaccacagcggctgagtcattaattgccagtgctggggatgcgctgaatgccagtcatgcaacctttaatgtgttgaacaactccgacctgcaatttggctttgttgaaaatgaagacggtgagaccgtgcaactcagcaatggtttgtatggtcaactcattcggtcaacaaatcgcaagctgcgtaaagacgcgtttgaggctttgctgcgggcatatgaaagtcttaagaatacctttgctcaaacattgagtggccagatcaaagctcataacttcaatgctttagcgcatcattatcccgatgctcgcgctgctgcaatggcaagtaaccacatccccgaaagtgtctacacaacactgcttgatcaagtcaacgctcacttgccattactacatcgctatattgccttacgtaaaaagattctgaatgtcgatcaactgcatatgtatgatatctacacaccgctgaccggacgtccgccattgagtttcaccctcgatcaggcaaaagacgaagccttaaaggcattggctccgctgggaaatgattatttagatcatatgcgggaaatctttaataatcgttacattgatgtcgtcgaaaataagggcaaacggtccggcgcttattccggtggcgcgtatgacaccaatccgttcattttactgaactggcacgatgccgttgatgaattgtacactttggttcacgaaactggtcacagtgtgcacagctggtacactcgtcatcaccagccttacgtttatggcgactacccaatcttcgtcgcagaaattgcctcaacaaccaatgaaaatttattgacggactacttcctaaaaaacaccaatgatcctaaagttcgggcgtacattttgaattactatctagacggcttcaaaggaacggtcttccgtcaggctcaatttgccgactttgaacattggattcatcaacaagaccagcatggtgaaccattgacggctaccagcatgtcctcctattatgcggatctcaatgcccgttattacggaccagatgttgcacgtgatcctgaaatcgcctttgaatgggctcgtattccacatttctattacaattattatgtttaccagtacgcaactggttttgccgctgcctcgactctggccgccggcatcagcggtggcgaaccagaggcggtttcccgctatatcggctacttgaaatctggcagttccaagtatgcgattgatacaatgaaagcggccggcgttgatatgaccaagccagattatttagaagccgccttctcactatttgaacaacgactcgctgaattagaagaaattttgcagaaaggatgagcagtgtgaaacttgggtttattggcaccggtgtgatgggcaccggtattatcaagaactttttaaagaatggccaagaagtggtcgtctttaaccgaacgcaggcccatgcccagccagtcattgaggctggagctacttgggccgaatcgccgcacgctgttgctgcgcagtgcgacattgttctctcaatggtcggatttccgcaagacgtcgaaaccatttattttggtagcgatggcattttagctggggcaagaaaaggcgcactgctcattgacatgacaaccagtacccccactctggcgaagaaaattgctgctaaggctgccgagaaaggcctgcaagccgttgatgcgccggtttctggtggtgatatcggcgccaaaaatggcacgctaaccatcatggtcggtggtgacaagactttgttatcgcgattgcagcaacttttcacgcccatcgccgcctcagtcaattattttggcccggccggctcagggcaacatgccaaaatggccaatcaaatcatgatcgctggcaccatgaccggtcttaccgaaatgcttgtctatgctaaggctgctggcctggatcttgacgaaacgcttaaagtggttggcggtggcgcaggtgccaactggagtctcagcaactacggaccacgtatcctgcaaggcgactatacgccgggattctttgcaaaacattttctaaaagatctgcgcattgctctggatgaagccgataacatgcacttacaactgccagccacgcaattggccaaacagctgtatgaacaaatggttaatactggtaagggcaacctcggaacgcaagggttgattacgatgaacgacaggtgggatcaagcatgacgacaatcgccattttatcggatattcacggcaatatgacggccttttcagcggtcattcaggatgcgaaggcgcatcaggcggatgaatactggtttctaggcgatttgtttttacccggtccaggttctgataagttatgggcgacgctgcacggactcaaacccacacatattgttaaaggcaactgggatgacgatttattctgggtgctggatggaccagttgatctgtcacagccaacagatgtttactttagtcgactggttgcctatctgtggccgcacctcacggctgaaaatctggcaacaattcgaagttggccgctgcatgaagttttcgagcaagatggtttgatcgtcagtctagcacacaaccttcctgacaaaaatcatggacatgccttatatcctgatcaaccacaactcaactttgaccaaattgcccccgattcgcaaattgatctagctgtttatgggcatacccaccaacagctactgcgctacaccagtaacggtcaagtcatcctcaatccaggttctattggccaagcctattcaccccggccacacctgcaaacaaccacttacgccgactatgcattgctgcaactcaatgatggtgccatcaccgatcttgatctgcggcaggtgccttacgacgtgtccgcagagttatcactagccaagcaacagcagttaccttatcctgaggtttacacgaagttacgccacactggcgccaccagcactcacaatgctgcttacctcaaacaattcgaacagcgccacgattaccaacaggaggttgctgaatttctgcacaaatatcgccatcaacactaactacgtcaaaaaggactcacaacacaaccgctactcaatacggtttgtgttgcgagtcctttttcaattgcttagtttgttcggtgatggtaccacaatgccaagaaataaaaaagaaattcaatggcagcgatgaaaaacgtcaccggccagttcgtcaaaaagcctaaatacaagccgctccaaaccccgattaaagcggtaatgacggaaatcacaatcatctgcggtaaagttcgccccagatacttagcgacattgggcggtaaggtcagtaagataaagaccaacaaacttccgacaatttgtgctccaatcgaaaccgaaacagcaaggataagcagaaagtaaatggaaatatatttacttttcaatccctgtgccgccgaaccaaccggatcgaacgaatcaaacgcgagtcgccgatagccaaaatacaacgtcaccagcacgccagccgccaatgctaccagttgccagacatcggcgcgggagattccgatgatgctcccaaacaaaatggtggttgcataactagcattagcgcttgaaagtgacagaaacaaaatgcctaaaccaataaacaaactggaaaccgcactgatcgaggcctctcgccgcgatgcttgaacggacatgcggccaacactgatactactgatcgctgtgaacaacaacatcccgtctaacggtctgatgccagcaaacaccgcaaacgcagcgcctgcaaacccaacttcggaaagtgtgtgggctaagaacgacatgttccgcgcaacgacgaacacaccgacaatgcctgtggtaatggcaataaacgtacttgccatgaatgcattttgcatgaatgcataagcaaataaattcatgcgatcaccccacgattctcggcatcattgcgtaattcttctggcattgctttcaaatccatttgcgctgttggcttcatctcataacttgacccggtcagtagtaagtattgttgggtgtactttttggctaagctcagatcatgcgtcacaaatagcaccgttaattgccgcgtttgattcaactcctgcaccagatccatcaactcctgcttcgtgttgacatctaagctggccgttgattcatccagaatcagaaagttaggatcatctaaaagagcttgtgccagataagccttttgtttttcgccgccactcgccattccaagccgcgtgtcagcaattttaccaaggtgagtcgctttaatcacggcatccaaggcagccttctccttacccgtatgccagaaaaagagatgatccaactgccggagttgaatgaaactgcggatcgacaacggaaattccgtatcaacattccggaactggggcacataacccaatcgaaccggtggctgttgccgaaagcgaatggttccggcctgcggttttagttgcgccattagtaaccgaattaaggttgttttgccgaccccgttcggaccaacaagacttgtcattgagcccacattcaactgaaaactcagatcctgataaagctgttgatcccgaaaaccaaagctgagatgatccacggtcaaaatcggttcgctcatagctgcctcccaatagtaaacggtaacgattacggtttactattgtatcgaacttttcatgaaaaggccagttttatttggattcttctgccttaaacggattagccgtactgaaatccagccgaattgttttcggcttatctttgaccacaaggatatacccatgacccaaaaatggcttttcgccagcataggtaagcggaaactcttgtgctggtgcaagattgccttgaatgatcatggcatacatttcatcatcggtataatcatccgaaaatgcaatggcgactggtgctgtcacaatttgcttagccttattcatcacagcgatcacatcaaaaatctgattggtgacttctttagggaaaaccttggccacgtcttcggcaacgcggcgttttttagttggttcgtacatgtgtaaacgatctccatttctgtattagcgaatggcgtaagtttatcatattgtggtcagtcgggcgaatcgagatcattttaaccttcgtgaatgctggccggtttgacaggaaaacggtgaccgcggtctactaagttgggtcggatagtgccaaaccatcagtatctctaagaacttatccatcctcatttcatcttgaaacagataaaaaaaaccggcattgccagctttttttatttcttcacttaaaccaccaaactcaacaacagcaccccgccaagtccaacaactgaaataatggtttctaacaatgtccacgtcaacaaggtctgtttaatggtcaaatcaaaatactcccgaaacatccagaaaccggcgtcattaacgtgactggcagctaatgaacccgcaccaattgccagtaccatcaaagctggctggatgccagcactttgcatgagtggcagaaccagtccagaggccgtcatggccgcaacagtcgcggatcccagtgcaattcgtaagacaaccgcaatcagccaacccaagataagtggtgaaatgcctgagccaacgaacaaattttttactgagtcgccgacgccaccatcaatcaggacttgtttgaaggcaccgccgccaccaatgacgagtagtaacatcgcaattgatttcacagcgtcctcgagggttgtcataatggctttggctggcagcttgcgcgcatagcccattgcccacatagcgaacaacaatgaaatcagcatggcgatacttggtgaaccaatgaatgcgataacgttatcaagaccatttggtgtctttggaagtttgccaccatgaaataccaattcataaaccgtggcaatcgccatcaaaatcactgggaaaagtgatgtgagaacggagatgccaaaacttggtgtttcctccaatttaaaggttttttgcggccccaatgctttcaaattaccgcgcctttcaaaagcatctggcacaaagcgatgcgcaagtttggaaaacaacggtccggcaatataaacagtcggaatggcgatgatcacgccataagccaaaaccagaccagcagaagcgcctaatgcagtcgagatcgccgttggagctggatgtggcggcaagaacccatgggtcaccgacaaagccgctgccatcgggataccaagtgtcagaattggaacgcctgcttcagccgcaatggcgaaaacaattggaactagcaagacaatcccaacttcaaagaacaaagcaataccgataatgaaagatgccaaaacaacggcaagttgcaatccgcggcgaccgaaggcattgatgagggtatgcgcaatgcggtaggctccaccagcatcagcaaccaatcgaccaagcatggcaccgaagccgaagaccaaggccagctcacctagttgcgcgccaatcccattttgaatactggtcgcaatcttggctggcgccattcccaaaccaagggcaacgacgacagctgtgatgatcaaggaaacatacgtgttgaacttaaacttgatgataagcaccagcaagagcaggatacctaagaccaggacgagtatatccatttctattccccctaaattttacagattaagaaatcgcttacaattttatttatgaaaaacgttcattgacgtttttctcgagacatgtcgtttgatctgtgtacccagttgcttcattctcgttattttcccatcgaaccagcatattccgtcttagcacggacaacaggcgcagtgctggcgactaatcctcagcagctatatgggcattcggatctggatgcgcccgctgatagtcggcaattgcttgatactcgctgccaagtttacgcgtcaatcgaatccagattggcaacaactcacgataagcttgaaaattgtcagcattgggttcatgggtattggtgacaccaatcatatctttaaccacgttcaaatcgtcaatcagtcccagtgacttcattcccaaaacaactgctcccaaggctgaactttcaaagctttccggaatattgacttcctgttcaaaaacgtcagccaacatctggctccacagtgcactgcgcgcaaatccgccagtagcctggatggcttttggtttgccagtaataccttcgatcatcagcatcaccatatataggttgtaaacgataccttccagtgctgctcgcaccatatgcgcacgtgtatgctgccgggttaagccaaagaaactgccacgagcattggcatcccaaatcggtgcccgttctccgcctaaatatggatggaaaagtaagccatcagcaccagcgggtatcttgctggcaatttctgtcagaatttcataggaatcaacttgcagttgctcggccgttaatttctctggtgcaaaaagttgatcacgaacccagcggaagacaataccaccgttgttaactggaccgccaacaacccagtgattcggtgacaggtagtaagtgaacaggcgcccttgcggatcaactaccggcttgtcagtcacaacccgtactgcacctgacgtaccaatggtcaccgccaagacaccaggatcaatcgcgccaacgccaaggttgctcaatgtcccatcactggcaccgagaatgaaaggcgttttagcatcaataccggtcaccgccgcatagttggcatttaatcctgtcaactgataactggtgtcgaccagttctggcaattgatcgcgccgaacattggcaacatcaagtgcacggtcatcccaatccatggtgtgaatattaaagagcccggttgcgttagccagcgagtaatcctgcacatatcggccaaagaagcggaacaaaataaagtctttaatgccaataaagtgggaagtctgagcgaccaattctggatgttcggcactcaaccaaagcaatttaaccaatggggacatcgggtgcgtcggcacacctgtatttttaaacagtgtcatccctaaatcgctttgcttcagcttcgttgcataggctgctgcccggttatcagcccacgtgatgacgcgcgtcagcggcttatcattttcgtccatcaaaatcagactgtgcatcgctgcggaaaaggaaaccccgccaagttcatcgggttggacattaccgcgatgcatcacttcagttaaaccgccaactgtcgctgcaaaaatctcttccggatcttcctcagccatgtcgggcgtatcttgatataacgggtagggattattggcggttgcaattgcgtgacccttgagatcaaacaaaacgacctttgtgctagtagtgcccagatcaacgccaatcatatatttgattgccatgcttatctcctttacttaatcaattttgacttagttattaaaatggcgatatcacgatggttttgcaagttattttgacttaattggatcaaccgcatggccgccaaactgattacgcaaggcagcgaccactttacccgtcatcgtatctgcttcttcagagcgatagcgcatcatcaacgaactggcaatcaccggcgttgcaacatgtagacgtaaggcttcttcaacggtccaagcaccttcacccgagctgtgcatgataccctgaatcttttcaaggttcgcatcctcggtaaaggcattggcggccaaatccatcagccagctacgaatcaccgagccattgttccacatgttggcaaccgccgcattgtcgtagtcatacggactgtgggctaacacatcgaagccttcaccaatcgcctgcatcatcccatattcaataccgttgtgaaccattttcaaatagtgaccagatccagctgggccagtatacagatagccaccttttgcagcgatcgccttgaacagcggctcaatcttgttaaagatcgccttgtcgccaccaatcatgaaattgccatcggcgcgtgcaccggccatgccgcctgaagtgccgacatcaaagaaatgaattccctcagcagctagcagctttccgtgtgcgattgaatcctgataataggagttgccgccatcaatcacaatatcatctggccgcaacggtttagctagctgactaatcgtggcttctgtcggtttgccagcaggcaccatgctccagatgatccgcggagatgccaagctcataactaaggcatccaggcttgccactgccttggccccatattgccctacctcttctcgcgctttgtcgttcaaatcaaatgctgtcacttcaatatcatgatcgcgcatatttgcgaccagattcatacccatttttcctaaaccaaccatgccaatatgcatgtttgctgcctcctcgttatttgaccctgtgaccatccgttttcaaaaaaacaaaccgcttctgtgatggttatcttatatcctgatgccattgtatgtaaatcgtttacaaaaatcaagtaatttgaccgtaaattattttcacactgctatcattcatgctatactgaattcgaaaagtggtgtttggcttggtgcaattaaccatcagccttagacaataaacgcactctgacaatgcggcttaaaattctgacattctcgtttctgctctggtgaatgtatttttaggagggatcaagatgcatgactttctggtacaactgcaaatttataaaccgaatctaagtggccaggagaaaaagctagctgcctatcttcaagcccacccggaccatgccagtcaggccaacatctcggaactcagccaattgaccggcgtcagtacagcgacgatttcccgctttgctaaagccttaggttacacaaactttcaggccttacgcatggcgttggcgcagacttcaccagaggatgatcatgcgctttttgctgagttgagtcccaaagattccgttgatacgctagcgcaaaaaattttcacctccaacattgatgcactgagaacaaccttagcaaacctagatactgatgctttgaccaaggctgttaaatggattacccatgccgagcatctcggactttttggactaggtgccagtaatcttgttgcactagacggttaccataaatttttgcgcacggcgattcccgtggcctatgcggctgactaccacatgcagctaatggccgccacacatcttggcccgcgcgatgcgatgatcctgacatcgcattcaggagaggacaaagatgccattgcattagctgaactagctaagaaacaacaagtgcctttaatcgtcattaccggttctccaacttcgcgcttagtcaaaatggcagatgctgcctttgttgcagttgctgaagaatcacgctaccgcactgaggcgcttcatgcactgattgccgaaatcagcattatggacacgctctttatgatcagtgccatcaaaaccgatagtcagacagcaccgcttttccgccaagtaagagcaacaattgatgcaacgcggcactaagcgcttgagctcaccgccttgcccttgcccaatctttcaaagtatataaaaaagcatctgccgcaacctcatggcagatgcttttctcatggaaaaaactaaaaacctaatatcgctgattttgccttagaaatccgttgtatctgggtcagttgctaagccggcttcaccgtgcaaagcatcaatcaaggtcatatcatgatggctcagttcaaagtcgaacaactcggtgttttccttaatccgatcgtcatgaacggattttggcaatggtaagaaaccatgttgcaatgaccagcggaggacgatctgagcaacactcttgtgatagcgtgcggcaattttctttaaggcatcaacttggaaaattttgcctgtgccaagtgggctgtacgcttcacttaaaatatcatgggcgtcattatacgccacaacttctggctgcaaatcacttggattcaagaaaatctggttaaccattggcttgacagtagctgtttttagcaaagcgtcaatgtgcttggcgcggaagtttgaaaccccaattgctcgaactttgccggctttgtacgcttcttccatggccttccatgaccctgcattagtttcttcccaattatcacggaacttaattgggtttggccaatgaattaaatatagatccacataatcaacgcccagtttcttgagtgatttatctagcgctgctttagtcgcctcgtaaccgtgatcaccattccaaagcttagtggttaagaagatctgatcgcgaggtacgccggatgcacgcaaacctgcaccaacgctttcttcgttaccgtaagcagctgccgtgtcaatatggcgatagcctgcagccaatgccgcttcgacactatgcttggcaacgtcgccatcaggggtctgccaagtgccgaacccgacgatcggaatcttaacaccattacttaatgtatatgtgtcggtcaatttggttaaatgtgccaaaatgagcatctcctttactgggtactactataagcttaccacaagtaagtagttgattgaatgtgttagcagcccagcgtcacacttgcatcagtcaaaaatagcgatatcctgatcaatcgtctttcttagcattcaaaaaatgcttggttgctaagacatctagcaaaaccaagcaccttcttttaacacgctattaacgcgccatcatttgattcaacaatgccttcccagctgcttcactttgacggaaagctttgcctaacgcaattgttttatcaacaataatactttgcgcatcaatcacatgatacggatgatcaccggctttttcctgtgcaaacgatagctcagtacagccgaggacaatgacgttgacattaaaatcgtcatgcatccgttgaagaatacgatgatacagggccgcgttgacttcgcccttttccttgacgtatttataaatcaactcagtgaccatgtcttgcagcgcctgatcgccaagaacgacttcacgctcgctagtttcgatttcatgactgtaaatgccgtcttggatcgttccttgggtcgcaatcagtcccacccgtttttcatctggaaaacgttcacacatatcgctgatggctaaatgtggcatgtgtagcaatggaattggtgtcgctgcggctaattggtcatagaaataatgagccgtgttgcagacaatgaccatgaactctggattgagtaaactttgatcttgaatgtcttccaacaaatccggataaaagctaggcttgctatgatccaaaatgtaatccgtacggtcaggaacagtcgcatcgttaaccagaatgtaattcagatattcctgatcgctgtgcgcgtgggtacgctggtttaacaaacggacataactctcggttgccggcgtgcccatgccgccaataacggtgaaaaattgacgcattcgtatcagccttcctgtagcgatttagcgacttgctttacaacagccatgtctgttggccacggtgtgttgacgccgcgtaccttttgataggggtcggcccctttgccagccaccaccacgatatcatttggtccgctgtcgctaatagcttcagcaatggccttttgccgatcaagcactttgtgtactttaactttgctatgatcgattttactatcgatttcctcaatgatgtttgctggatcttcgtacccaggatcgtcggtagtcaagaatgcctcagttgcaaactcagtgagaaccttagcaaatccgggacgacgagaaacacctttatcaccgggggatccaaccacaaccagtaatcgaggatccttgtaagcgtgtttcaaaaacgacaataacgccttcatactagcgtagttgtgcgcataatcaacatagacagcaccatgtccggcaactttcgtatgctccatgcggccggggattttaacttttgcaatacccggaacagcggcagatgcatccacgccagccaatccagcaccaataatagcagccgtcgcgttactttcgttaaaatcaccaatcaaagcaagcgagtagtgaccgccgatgttcaatgctgctgctttttccgtgactggtactaaagtgaaacgactctcagcaacgtcagcttcctgactatcaaagcgaaaatcaatatcgatgtcatcgcgtttaggtctgaagccagcactggcaaacaggtagatgctttctggataagtggtggtcgttgcggcagcataaacctggtcaaaatgctcggtttcggcattaatgaccactttgcgcgcattgaccaacaattgcagcttgttgtgtaagtaattagcaaaggttggatgttcattcggtccgatgtgatctggcgtaatgttcaggaagaagccgacgtcatacgtcaatccaaaaacgcgattgcgcaaatatgcctgactcgacacttccatcacgagatgggtcataccgttttcgacagcctcgcgcatatcgcggaaaagatcgaggctctctggcgttgtcagattagacttgaaacgctgatcgggctcagggccaacaaccgtatcaattgtagaaaaaagcgcgatgtgtcgtggacgagcctcatttaaaatagcttctgtaaaataggaagccgtggttttccccttggtccccgtataagcgatcacaaacaaatcatcttgcggataatcaaagaaagcagcgctcaaaatcgccattgctttagtaatattccgcacgatcaaggcgtttaagccgttgccttcaacgtaaggtttctcggcaacataagttcgcgcaccgttgtccttggccatggaaagataaattggtcggaacttgtcgcctttgcagaaaaacagcgttggtccagagaccttgcgtgaatcataggcgatgccggtcatatcgacatcttcagtattctgaattgctgcactctttagcagatgatgttcctttaataataagatacatgctctaagtgatagtgccattgggctgctactcctttttatatgccgtgaattcaagcttcattatagcataagcgcggtactggcattaaaccagtcggactgtcacaactatctgtgtgccgtcttggttcatgctcaaagttcattgattatcttttttatgcagatgcaatgttcattaacgtcacctgatacgaaccgcttggcgctgtcaccgtgacggtatcacctgcgtggtgatgccgaatagcggcgcccaagggagaattgatggcaagcttgtcttggcccatcccagcttcggcagggccgacaagttcataagtcgcttggtcctcgtcatcatcgaacttaagtgtgatcctattgccaatatcggcaatatcactagcggccgggtgcgtgactttagcataacgaatgagtttatccagatatcgcaatcggccttctagctggcgcaactcacgcttagcagcgctatattccgcattttccgagcgatcccccaacgctgccgcatcggccaagttcttgatctttgcaggccgaatagttttaaggtcttcaacttcctgcttcaagttagccaaacctgttggcgtgatctcgtgataggtgaccatttcaatgccttcttttttatctgaaaactaactctctacttgttgcaaaaaaggtgaacgtgatgatctccattcggagttcaggacattcaccactttttcgtttttggatcaatgaggtaactgctggactagaaaatattgctgaagaaatcgccaatgccacggaagatcaggacaaagaagtttgctttgttatcggtcttggtggtctttaaggtaatgccttcgcttgctgaactgccgacaaagccaaggttgtcacctttggcgctaacttccagctgcgcaatcgtggtaccttttttgactggtgcttcgacagtattcttcttcacgccttttgctggcgtgtaagtatattgaagtgattgtttgctgctgttagatggcacaacagcaaccgccttggttgacggcgcaatcggcgttgtccgtgattgaccacgattgaccttgacgctgtcgtaccctttaatcccctgaccagcttcagctaacgtcatcgttttccaattttccaaaacattggtcatcaattttttggtttgatcaaaacggcgagttttagcatcaccatttgcatgcaagataaccgtaataattcgcatgccatttttctcaaccgtccctgtaaaacaatccccagcggcatcagaagtacctgtcttcaagccatcaactgggaggttcttatcataagacaccaggcccttgagcatccagttccaattttccatatcgatcgcatcactggttcccttacggaatgtctgtttagcaatactcgtggtcttaaggacttctggatgatctttcagtaaatgttgtgccacctgggccatatcttttgcggacatttcgttctccgcgttatcatctgtaccgggtaccttagcatctttcaattggctgttattcaaaccggtcacgttgacaatttttgcatcggtgataccccagctattgagttttgcagtcatctgactgacaaatttctcctgactacccgctactttttcagctaataacatcatcgctgcattcgccgaataaattaaagaagcatcgtacagttcgcggactgaataagagccatcgcgccgcaacggtacattactaaggtcacgattctgactgagttcccagattgcgttattcagtgtcactttgtcatcccaattgatcttaccggacttaattgcatcaagcaccaactcaatgctcaacattttggtcatagatgcaattggtaaaacactgctggcattcttagcatataatatcttgccagtagtcggttcaatggctactgctgccttggcgtcaactagattggtatcgctgctctctgccgcagataccgacattgctggcgcagcacccccaatcatcaataccgccaccactgcggcaatcaacccgcgcatcaacttcttcattttgactttcctgcttcctcattagatttatttttattgtctgtcagcgaagcgccaacttttaatggtaaatgaatcacaaagcttgttatctccgggctagaatcggcataaatatacccgccatgcaaagcgatgatactttgggcaatcgctaacccaagaccagtcccgccagtttcctgcgatcggctttcctcaacgcgataaaaacgatcaaacaactgactcaaagcatcattcggaatttgtgcaccatcatttgagaccttaacaacgacttcactaccgatacgttgtgcatcaagaaaaatatgacgcccgccttggccgtacttaagcgcattaacaattaaattgttgaacacccggcctaatttttcggtatcagcttccatcatcaacgggtcaggttcaccgctgaccagaatccgcatatgcttcttatgcgcctccagctcaaaactagctgccagttgctctagcatcgcaatcatgttaaaacgtacgggattcagcttggtcgtggtcgatttaaccttggtgtactcaaaaaggtcctcaaccagtactttcatctgcttagccttcaaataagccgtgtgcgtgtacttgagtagctcttcttcactgcgatattgatgatcttcaatcaggccaagataaccgataatggacgttagcggcgttcgaatatcatggctgacattagtaatcagctcatctttactctgttcgatccgccgttcctcggccattgaattgacggttgaatcaacaagcgcgttaatgctgctgacaaccttttgcaactccgtattgacctcaaacttaatccgatgatcaagatgaccatcggcaataaaatgtagctccgcaatgacgtgacgcatttgcatttgccgatatcgccgagcaagtcgccaatacaccacaatgacatcagcaatcgccatcagtgctaggaaaagattggaccagctccacaaatgaaatccacggctgccaaacgtcagattcgtttttacaccccagatagcattttccaaaccaggattgtgcgcgatcatctgattaatcaacactagcaaggcaaaattaagcattaacagcagaatcaccgtcacgatgccttcaatccaaagttcggatttttccttaccagttagtttgactttttcactcatgatcgttaggcctcaaccttatagccgacgccccaaactgtttcgatcaccttctcgccatcggtcgcttcttcaatcttgtcacgcagatgcgagacatgcaccataacggttttcgctgagacgattgattcctgttgccaaacgcgttcaaaaatctcatcagccgagaaaacacgattcggatggctagccagcaagtacagaatgccgaattccagcgcggttagctgaatttgcttgccggtaagggtggtgacttcatgactatcctttttgatcgttagcggaccgacttcaagcacatccggttccgtattggtcacctcattttgacttcggcgcaacaaactcttgacgcgcgccatgacctctagcggattgaatggcttggtgacataatcgtctgctccagtaataaggccttgaatcttgtccatatctgctgttttagccgagacgataatgattggaatctgtgaatctttgcggacttctttgacaacatccatcccagacatattaggcatcataatatcgaggatcatcaaagcaatatcaggattggtcacaagcttagtaatggcttccttaccggaatacgcctgaatcggttcgtaaccttcgtttttaacgtaaatacttagtaattcgacgatttctttatcgtcgtcaacaattaaaattttcattgtattggctccgtttatgagaagaactgtagggtctgttacatcaaagtccattgtaccaaagttgaccggggaattctttacgaaaagcctaagaaaacagggctagaataggtacaaaagtgttgatttaatcgcgaaagaaggcggctaattgaaagatttgacaaaaatcgtcacagcaagtttaccctcaaccatgcacatcgctggcattaacattgcccgctcaagcggaagtacttactggctattaaggcaatcctcccaatggctcaccttacgccttgccacacatccccattggttacgaggtgttcgtcagctacaggttgttttgccagcatcatcagcccgccacgactcgataaccatgttgacaaaagccttagcgagtcctgccgcggccaaaaacacatatacctttacagcaattgacacggctcttgccaacatgctgctgtggacagcgtcgcgtaaactggtcttcatgctgcgcctgacccccgagatggccacgactcataaaatgacccctttttgtttacaacaagattttgcgccgctaccgcttttcttgggtgatcgtaacaatagtaatgacttattgctacctgtccatgatgccaagttgcaacaaagtctgattgatttttatagtgctaatttgctattcacgcaattctccagtcatcagttagtgaaacttttgccaactgcacaatggctgcaaaccattctgacaactgtacccactaatcccgcttggccattgacattggccacaactttcggcacggaactacttgacgtgattcatcgggcacgaatgtagcctcttaatcatagcgcgttctccaaaaaaggcccgcactgcaatcaatggcagtacgagcctttttgtgataccaatcttttattgaacggaatagttaggtgcttcccgcgtgatctgcacgtcatgcggatggctctcgcgtaaaccagcaccggtaatttgaatgaactgcgcattatcttggagttcttgaagattcggtgcaccgacataacccatgccggattcaataccaccgagcatttggaaaatcacatcgccgagactgcccttgtaagccacgcggccttcgatgccttcaggaaccagtttgtttgcttcgttaaccccgctctggaaataacgatcactagaaccgtgggcctgcgccatcgcgccaagtgagcccatgccgcgataagtcttgaagcggcggccttgataaatttcgaactggccaggtgcctcatcagtgccggccaaaagggaaccgagcataacggcattgccgccagctgccaaagcctttacgatatcaccggaatacttgatcccaccgtcagcgataattgtcttgccgcgcttacgagcaacactggcggcatcatagatggcagtcagttgtggcacaccgacaccggcaacgatccgggttgtgcagattgaaccggggccaatgccaactttgacaacatcgacaccagcatcatacaacgcttccgttgcttcagccgtggccacattaccggcaatcagagttgctaatgggaactgttcccgaatctctttgattttccgaatcacgccagcactatgcccatgggccgtgtcgatcacaatcgcatcggcaccggcatcaagcaaagcttgcgcccgatcaaaggtgtcagaggtaacgccaaccgctgctgcaaccaacaaacggccatgcgcatctttagcagcatgcgggaattcaaccactttttcaatatccttgatcgtaatcagcccactaaggcggccttccttatcgatcaacggtaatttttcaattttacgagactgtaaaatagcttcggcatcttcgattgaagtgccagccggcgcggtcacaagcccttccttggtcataaccgtgtcaatcagcacacttttatcatcaacataacgcagatcacggttggtgatgatgccggtcaacttgcgatctgtggtgttattaacaatcgggacgccgctaatccgatattttttcattaaatcttcagcatcactaaccggtttatcggccgtcaggaagaatggatcgacaatgacaccattttcactgcgcttcaccttcagcacttcatctgcttgtgcttcgatgctcatgttcttatgaatcacgcccaacccgccttggcgtgccattgcaattgccatagcactctcggtaacggtatccatccccgccgagatgattgggatattcagcttcaagttgtccgccagttgtacagacagatcgacatcgtgaggtaaaacatgactttctgcaggtatcaacaacacatcatcaaacgtaaaaccgcgccgggcaaactttgtatcccaaagactcatagcgtaatccctctttcaatttttagttgttgactaatgtactaccggaatttaggcacgtcaaacaagtctaaccatttttttcgaaacgccggtatcataggcttaaaaatgaaagaaagtctcataatcgttcatatggaaccgaacaaaattttatcagctatagctttctcaaaataatgttcggcttttgtcgtgtgttgtgacgtgtcatttaatatcattcgttttttacccgctaaaaccttcgcatgtaaaatgacaagaacatttgccgttttccctcactggcaatacaaaaaaaagccgccattttcggcgactgttggattttttaaaaagtagatacccgatgttgaaatcggactatcagcttatctctggaaaaagcttttgaggtgataccggtgctgtaagacccagtgaatcccataggcaatggcgccaataatgatattgacgaaccacggcattgggcgcgtgaacggcgtgtcaagcatcgccaaggcactgccaatgaacgtgattgacacgactaagacaacaccgccgcccaagacaagccaagcactgcggcgcttctttttatcttgctgcatccagtcagcataataaacgaagaagagaccagccattagactcaacatcactaagtaaacaaaactgctgctggcggcattttgcgacttggtatcgaagtaggcaagtgccccatacataaccgctaaaatcgacatgaagaacagactttggtcaatgaccatcaaccacatcggctttttaggctcaggttttggcgtatgcagaatttcgtctgcctttaccgtaaccggtccgtagagctgattggctggcttgccttgtcgttgcgctgtgatgatctcgggcaacatcgttttgagtagttcttcttcgtccgccgcgttcataccgccgtcttttaactcacggcgtagtttgaaaatatattcatcatttttattagtgagccgtgcaatcagctctggcacagtggtcgcaggcttttcctgtttcacatgtgcatttttagccgccgttgcttgatctgctgacgactcatcagtggctgccgactgtacttttgatgctgtttgttcagtcgtagcagtatttttaccagttactgcagcatcggttgccgtctgtttcgtctctgcttcatgtttctctgccattggaaactcctatctcctaagtcgttatgcgttagacattgaaccggaattcaatgatgtccccatcctgcacttcatattctttgccttcggatcgataacggcctgcttctttaaccgcctgaacagatccgtacttgtctaaatcggtgaaggacattgtctcggcgcgaataaaaccgcgttcgaagtcggaatgaataatcccagcaacttctggagccttcattccctgtctaaatgtccacgcacgggtttctttgccaccggctgtgaagaaggttgccaatcccagcaaatgatagctagccttgatcagcttatccaacccagactcgtcgacaccttctgctgccaaaaagtctgccttttcatcatcatccagttcagcaatttcttcctcagttttggcagaaatcgcaatcacttcggcaccttctttggcagcctcggccttgatttgcttgacgtaatcaaccgaatccggatcagccatcgcttcttcagcaatgttagcgacatacaaaactggcttgctggtcagcaagaacaagcctttgacaatcttcagctcatctttatcaaagtcgatgctgcgaaccatcccgccatcttccagtacgggcttaatctttttgagcaccttgaattcagcctgcgcttctttgtcattggtttgtgttcgcgccactttttcaactttagcatagcgtttattgacagcatcaagatcagcgatggccaattccatattaatcgtcgccatatcctctaacgggtcgactttgccagttacactggtgatgttgtcatcatcgaacgctcggacaacatgaacaatcgcatccacctgacgaatgttttcaaggaacttgttgccgagtccttcacccttagaagcacctttaacaatgccggcaatatctgtgaattcaaaagttgtatgaataattttcttggccggaatcaattcatcgattcgtgccagacgtttatctggcacttcgaccatcccgacattcgggtcgattgtagcgaatggatagttcgccatctcggcgcctgctttagtgattgcgttaaaaagcgtggacttaccgacgtttggaagtcctacgatacctgctgttaaagccatttggttacttcacactttctatttagtctgtctactctacatgacccaacacttttttgagtcgtttttcaaaatcgcgccgggacatcatcacaatatgaccgcatccggtacattttatcttgatatcagcacctaagcggataatttcccatttgttggtaccgcaagcatgcggtttcttcatctgaacgagatcatgtaaatcatacatttgtccacctccagcgttgttgtgcttgtcggaccggattaaacgcgttcgcaagtttctaaacgggcctgctcacgctctgcttttaaacgcgttcgctggcccagaaacctgcgtgtaaggaccttggacgcaatggccaaaaacccggccatcacgtccaaggccgcttacactccggtttctaaacaggccgctcacgctctgctggttagtcaatattgacgtcgagcatggccaagatccgattcaaatctttttcggaagtgaagtcaatctcgatcttgcctttgcctttgttgccttcattaatattcaccttggtgccaaagcgttcgccaagttggttctcagttgcccgcacgtatggcgactttggcttttctttggttgccgggcgcgtgttgccagcattcatctgattaatgagccgttctagctggcgcacagtcaggttttcattgattgtcttcttggccacactcaccattttggacttatctttgagacttaacagcgtccgtgcctgtcccattgacagctgattggcacttaacatttgtttgacttgctgcggcagtgtcaaaaggcgtaagtagttcgcaatataaggtcggcttttgccaagtcgtgccgatacttctgcttgcgtcagattcagacgcttgatcaaggtgtcataagcctgggcttcgtctagcggcgtcagatcttcccgctgcaagttttccagcacagcgatttccatcatttcgggatcattgaagtcccgaacaatggatggaatagtctccttgccagccaatttagacgcacggaagcgacgttcaccggtaataatctcatagcctgaaacactcttgcggacaatgatcggttggaacacgccggtttgtttgatcgaaccagccagttccttcaagccttcctcatcaaacgttttacgcggttggtagggatttggtcggatgtcaatcagcggtaattcttcaactgtattattggcactcagatctgggctctcaaaatctttgaaaatcgcatcgataccacggcctaagcctttgttattcttattcgccatgagcagccagcacctccttggctaaagcctcgtaaacctctgatccccgggactttggatcaaaatccacaattggcagaccatagcttggcgcctccgccaatcgcgtaatccgcggaatcaccgttgcatatactttatcgccaaaatacttgcggacctcgtcaatgacttgtgcgccgagattggtccgcgcatcatacattgtcaacaacaccccttcgatcgctaagctcggattaaagtgtttctgaaccaaccgcaccgtgtttagtaactggcttaagccctccaaagcgtaatattcgctttggaccgggattaaaatcgagtcgcttgctgtaaatgcattgatcgacaattggccaagcgatggcgggcaatcaatcaaaatataatcgtattgatcctccacaggatgcaatcccagcttcaatcgcatttcacgcgccatttggctggttaactcgatctcagcgccagccagttgaatggtggctggcacaatcgacatgttcttatgtttcgttggcagaatggcttcggtaatcggctcttcattgactagcacatcataaatatccttttcaacttgggccttttgaacgccgacgccactagtcgcattgccttgtgcatcagcgtccacaatcaaaatcttcttgccaaggttggccaaacaggcgcccagattgaccgtggtggtggttttgccaacgccgcctttttggttagcgactgcgatgatatgtgccatgagctcctcctatctcttttctttcggaatctcgatgatcattcggtaagcgtcgtcagtatcttcttcttttgctgtgaccgtcataccggtttcccggatcattttaaccgaacgttttaatgtgttccaagcaatgcgcgtatcatggctcaccgcggatcgtcgaactttaggtttcggttttggggttggcttcttaggccgcaacatctcattgataagggcactggtttctttaacggtcagatcgtctgcaaaaatctggtgtaaggcggcaacctgttgcttctcgtctaacttcagtagttcacgaccatgccgttcactgatacgcgacttcattaaagcttcttgaactggctcgcttagtttcaataagcggattttgttggcgacaaatgcctgacttttaccgagttgctcggccaaagcagcctgtgtcagatgattgagtttcataagtgccacataagcttggccttcttcaatcgcactcaagccttcgcgctgcaaattttcaactagtgccatggatgcactttcgtcgtcgtccattttctgcacaatggctggcgctttttcccagcccagggtttgcatcgcgcgatatcggcgctcacccgcgatgatttcgtacttctccggtttatattcacggacaataatcggctgcaacaggccatgatccttgatcgtcgttgctagctcccgaatcgattccggcgtaaagactttgcgcggctggaattggttaggcacgattgcggtcattggcagttgttgaacaaccgtttcgtcgtcaggctttttatggccaaaaatggatgataatggcacgcgttatgcacctcccaaaggttgcttattcggtatccccggcttgcgcggatatttgtttggtgttggtttaactttgtcgatgaccagcagatgacgtggatcgccggtttccggcaacgtcaacgcagcatcttgggccaatttgccgccaagtaagccaatcgctgacttggcagcaattaattctgcgggtgtcgccgcggctttcatggccacaaagcgaccttgcggctttactagtggcaaacagagctcagccaagacatccaatgccgcaaccgcacgagccgtgaccaaatcaaaactggcacggtgtggcgattttttggcaccaaaagtttcggcgcggtcatgaaagagctgaacatctgtcagctccaaacgcgccgttaatcgttcgagaaagccaattcgcttttgtaaagaatccacgatggtgattttgagttgcgggaacgcaatttttaacggaattgatgggaaacctgccccagcacccacgtcacaaactgacattacttgtgtctgaagctcaggtagcaccaacgcaagcgttagtgaatcgtagaagtgtttgaggtagacgtccccttcagctgtaatgccagtcagattcattttttcattctcactgatcagatactgatagtatgccgcaaactgatcctgttggtgatcgtttaaaacgatcccgtgatcagccaaggcttggacaaaagctgctggatccatgcctgcctccattttcgtaaacttgattttgtggaacaaacagggtttcacgtacccgtcaagtgtaacgtaaaagcggcctctgctcaaccgtctttatatggaaagaacaggcgttaagcgcaagttttttgacacacctgttatgccttactgctcaaatcaagattcgctatctgggctggctgcggtcgcgctactcacctaattacccaaccacaagatttgtctgaatggtcccttgtcatcttgcaaaaacgcgttcacagttcgataatgagatggtaactaaactcagaggcgagaaaaatggaattagacggtaaagaaatcaaagaaaatgaacaactgaccgatgcccagctggccgatttgcacaaacagtatgaggctttgtgggataagttaaaaaaagacaactaccgaactgaacatcaattcatggaagttttgtacgaggaacctgacaatagtcaaaactatgaagctgcctttttcacttatcaaattcgtaaagatactggcgataatcaatttgaccagttgaccatcacgttaaacaacaaaccaaccttccacgatcaaccagatgaatttgtcttcgaaattagtgactacgcggatatggatgctcttcacaaggcaattgaggaaaaagcccaaccgtggattaaggctcacaaacgttaataaccagactaactcgaaacacttatcctgtttcgagtttttttaattaaaaccgcactatgcactttctttcctctcagccaacacttgtggtaagctgttgccagtcaaacaaacggagggacccggctaatggcggataaaattaaaatcgcttatctttatgaagacctcatgaacacatatggcgacagtggcgatgtcaaaattctacgttatttattaaatcaacaaggttaccaagtcgatgtcgataatgtcagtcttggcgatcattttaatgcggacgactatgattttatcttcttcggcggtggtcaggactatgaacaaaccgtggtagccaaagacttgttgcgccatgcccaaacacttggccagtatatcgaaaatggtaaaccgatgctggcaatctgtggcggttaccagctgcttggcgattattacaaaactagcgaaggctcagtcatcaaaggcctcggcattttgccgctgcacacagttttcaagccagacagtcgcatgatcggtgataccaagtacgaaaccgagttcgggacagttaccgcatttgagaatcacagtggccggacttattttgacgacaagcaaaagctcaaaccgttgggcaaaatgattgaaggttacggaaataaccctgaagacggtgtcgaaggtatgcgttataaaaataccattggcagctactcccatggtcccattttgaaaaatcaaaatattgctaaggcgatcgccaatatgattgtgaaaaatcacaaggcacggatgggtcagcctgcataattaaaagagcattgccgcagtatacgggcaatgctctttttatacgaatttcatatagctttggcgcccagttaaccctttagtgttgcacttgagcacgaacctgatcagcatcgccagcaaataagaacaacggtccatccgcctgtgctggatagctatctgatagactgccgagatcgacaacatcaaacccaattcgtttgatcaatgtcgtgaccgtctgcttagcggcattatcatccccggcaatcggaatggcaattcttcctgctggctgacttggcttggcaagactacgaatcttggtcatcgcaattgtattgaatgccttaaccacttttttcgtgccaaaatgtttagcaacgagttctgatgacgtgacttgatgtgctgccagtgctggctggtcgccatcgcggctaggataatagttagtcgcatcaataataatcgtcttcggatccacgcttgtcggcaattccggcaacgcattaaatggcacggccagcacgacaatgtcttgtttagccgcgtcagcaacggtcccagcttcgaccgtcgagcgcatctctgcaatgaccggtgccaatgatgccacaccatgccgatgtgaaataatcacctgctcaccaacatgactaaacagttggcctaatgcccggccgacattacctgatccaataataccgatagtcatctaatcaccctctctattgagatcacaccttcattataccgccttgcttctttaaataccggccagcaagcattctagcccactcaaaaagccgcacacccgtcatgcggtctgcggcagttcaaataaaaaatgatccacaactatctagtgattcttgccttcaatcgtttcgatatcgcctttgccgtcacgggcgacgatggccttgatagcggcagtgatgcctaaaacatcatcatccaatgacaacgctggtgtttccggacgagtgacaacctgttccggcaaaaatggaatatgcatgaagccggccttaatatcgggaaacatcttatcccgcatatactgtacctgataaaaaatgtggttgcagacgtaagtgcctgctgtgttggagactgctgccggaacaccagcttcccgaatggctttggccatggccttaatcggtaactgggtaaagtaggcattctcgccatcgccatgaatcgtgtgattaagtggctgatacccggcattatcttgaatccgaccgtcatccaagttaatcgcaactcgctccggcgtgagttcaaaccggccaccagcctgaccaatgctcaacacatagtcaggcttttctttggcaatagcatctttaacgacatcggctgaaacattaaactttgtcggaatttccaatttaacgatttgtgccccagcaatttcatccggcaaacatttcacggcttcaatcgcaggattaattttatcgtcgccaaagggatcaaatccggtaacaagaattttcatgagaagatttcctttctaaaatgccaagaagtacatgaggccgatttgaatgatcaacaatagtatcgcaattggcgcctgctgtttgataacaccaagtggatccttcatttcgagcaacgcgactggcaaactattgaagttcgccgccattggcgtgagcaaggtcccacagtagccagaggtcatgccaatagccgccacaatcgctggattagcgccttgcgcaatgacaaaaggaatgccaacggctgctgtaatcacggcaaacgcagcaaaggcattccccataataatcgtaaagagcgccatcgccacacagtatagaatcacgccgccaagatgacttccagttgggaataagccggcaatcaatttcgccgtgagtgatccgaccccagcagcagtaaaaactgcccctaaggttgctagtaattgcggcaaaatgccagcagcaccaactgaccgaaccatccgctgggtatcattataaaccattttgcctggcgccttcgtcatgatgatagccacaattaacgaaaccgccgcaccaatgccaatgccgacctgaccaccgagtttggtaaactgggcgacaccgatggaaacgactgcaagtaccacgcttgggacgaatacccaaccgccaagccgtttggccgctgttgccgcgtgtgcgccgtcaacgggcttaattttgcctatctgaatctgcttgaacaacgccaaaataccgataataacaactagaacaccaacgaccatcgcgggcatcaaggtcccaaaggcaaaaatcactgccatgatctcccaaaacaaaccggttccgatacgtgccggattatcttttgcacgaaacgcctcaataccagcaatcgccatcacgacgccaatcagagcataaaggatcaataaaagggtattgaccatgatcatttgcctcccttatgcgactgctgttcaaattggcgatcaaaccagcgattgtagatagccacaatgaccaacgtgatcaatgccactggaatggatgctaaaacgacctgcatcggctcaactggatgattgaggctcttcatcgtgctcgcgatcaacaagacacccgctgttgcaacaaacaggttctgcgcaaagaaattgccaaagttgtcagtcgccgcagaacgcgccttaataaggtcgatatctttatctgttagcttacgtttggtttcagccgccgccgttaccatcggcgtgatcaacggtcgtacgaactgcacttgaccagataacgagataccaaagacaccacctaactcgcgaatcacaagataaatattcaaaatacgactgggtgtcaatttctttagcttctgaatgccattgacggcaacttccttgagaccgtggctttccactaacccaatcatcggcagggtcagaaaaaataacgacaccatgcgattatcgacaaagctctgcccaagtgtggtcagcaaagccgggatgctcatgcccgaaaaaactgctgtcacaactgctgccaaaaccactaccgctgtcgtgtcccacttcaatgcaaacccgacaacgataatgacaatgccaagtaattttaagtattccatgtaggatccccctttgttctatgaaagcagtttacgtgttgttgttgacagcgtcaattcgttaagggggattatcaatcgtgcaaactataaaaataacttgtgcgtcactagtttcctaaccgagctggctcgcgctcattttaacgcgctcgccaccccagaaacctgcatgtaagaaccttggttgcaatggtcaaaacccgaccatcacacccaaggtcacttacactccggtttctaaccgggctgcctcgcgctcacaaaaaaagccagttcaacgactgaactggcaatttatatcacgattatgctggctgaagatccttttctttgtcagcatctttgttcttagcctcgttacgagcaatttcgtctttggtgagcatatccttaacggtcatcttcacctcagtgacattaagtccggtcatttggcggacattcttgacgattgccatcgtaactttgttgaaaatttccggtgcattttcaccatatcgaacggtggcatcaagtgacacagaaacattctgatcatcgctcaggtctacatccacacctttagtcggatcttcatctttgcggaaaagatcggtcatatttgccatcatgccgccttcaagcgagtatacgccttcgacttcattgcaagtgatgcccacaatttttgcaatgacagcgtcatcgaatttcaattccttattgatgccagcgtttttcgtgttgtccatgtttatctctcctttgtcttatgaaggttcaacatcattttttttgccactcgcgtttagtcagtacatctttgacatgtagattgagttcaactagctgtaggcccgtcatccgggtaatctgagcactgattttttcgcagagttgtttaaaaatagcttgcgcatcactgtcaaatgccagaaacacatccatatcaatcgctacttgtttctcgccaacttcagctgagatgcctttggtgatattctcgccgctagaaaaggtttcggtcagattgtccatcatcgttccgtccattcctagcaagccatcaatctctcgagcacaaagcgcagcgattttttcaatcactttatcttcaaacgtcaatcgactattggccatcaatgtttctcgtgtaacagctggtgatgctgctactggcggtgttgcaactgcgtccatccgttcacctactttcctttactgaaagcatctttgccggcggtcaaccaactggtaaatgcatgccaattgggtactaggtaacgctcaatcagccagcctgctgcgccgaagatcaagaccagcagcatacccataaacccgaatcgcatccaggcgaaggcaagcacgatcccgatcacagcaccgatcattcctcgctgcattgtcatctctccttctagctgagcacgttgtcaaaggcatcgacatctttggaaagtgtccgctttgaatgccatttgcttgttgtcccagtgttgtcatcgttaaatcacacgggccgttttcgctttgacctttgtggctggcaagagatgcacccgcacatgcttcacaggaataccgagacaggcctgcaacttctgacgagcagtttcttcgatttgcttggcctctgccttcagatccttgctattaccggaaaaagcttcaatccgcattcgtgcgacttgcttcttgcgaatgctaacagctaccgccaccgatttggcaaaatgttgcgcaacaaccgctttggccacggtgttttcgatcgcacttttatcaagcgtcagatcaccatcttcaccagctagaatcagcgactgagcggttgaccgcctgaaaatggcgaccaatagcatgatgaggaaaaccaaagcgacaagcccagtcaggcctatcatggttggccgcagccaaacgacttgttgcagataaaatcgcgtaaactcacggcttggccaaagcaataacccgaaaccaacactttgcaataaaccgccaacggcaatgatgccaagcatgatttttgtgatgggtctcatggtcatcggcctcctatgccttgcgccgtgtggttcccagcaacagggaaacaaggaagacgacaatgatggcccctataatggctgggatcaaggccattccggccaatgaaggcccccagtcaccaaggagtgccgtgccgagccatgcaccgactaagccgccgataatgttaccaagccagccgagtggcatatcgcgcccaacgatcagctgtccaatacaaccaatcaccgcaccgatgatcagcgtccaaataaaatgcatcatggttctcaccctttcttttggttgactttcttctgactatcctaagcttaacgaaacgaggttattcgaagcaataaatatgctaatgataacaattagtattttactaggtatacaaaaaatgcctataaccatgcatatttgcaaagttataggcatataaattgtttaattaaaaatcatggcatcatgagttgctcgttttccgcgttaaagtccgggaatcagcccatcaaccttcaatcaaatcgccagcattaggaccggcatccagtttatagatacgatcaacattaatcaaaacggcactgatggctgctggcagatgatgtgccttcgcgaatgcctgagcatcttcaaagatcttgtcatcatgatggaattcaacggtcccttcaaaacgaaaacccttgagtgccttgtaatcaaccgtcgcaaccgcagccttcttagaatactgcaaattatgccatgcctgcttacctgtctcttcgttgtaaatcaggtgatgatcatcgaagacacgcatcgtgcctttgggacccacttgtggattaccattttcatcggcagtagccaaatagttcaattgtgcgccgatcatgtctttcatatcttgtgtcaaagttgccataaatgatcaatccccttttacttactttttgttaacagaaagagtgtaacacaatcagccacgattcgtcatatttttatatcagagcgttcgcaggcgcgcttagaaacctgagtgtaagcggcctcgggcgtgatggccgggtttgggtcattgcgtccgaggtccttacactccggtttctgcgcctgcgaacgcgtttcagtcaagagcgtgatggccggtttttggccattgcgatcaagatccttacacgtatgtttctgggctggtgaacgggagcgtgtatatctagaaatatggttttaggcaacggtttaaccatgattggatttctaagaagacaaaacttccgatgtgatttctttctttttgtctaacctgtactacacttaagttaggctcttaaaagtatcagttcgggaacttgtaacgcaatctgccatgatgatgctaaccgcacacccatagtgattgtgcagacgttaagactgatcaacaaggttaagggggaaaatgatccatggcaaaagtttatatttctgcagcattgccgaaatcggcgaatgctgccttgcaaaaagctggcgtggattttgaagcatataccggcagtggtttaatcaccgaaagcgacttacaaacacacttggctcatactgaggtgttgatcaccgccttgtccacaccagtaacggcggcaaccttggcaaaggccccacatctgaagctgatcgctaattatggtgccggtttcaacaacattgatgtcactgcagccaaggcccaaggtgtgcttgtaaccaatacgccaaaagtatcgaccacttcgactgccgaagtcacggtggccttaattctggcggtcttacaccgggtcacggaaggcgatcggctaatgcgcggcgctggttttgccggctgggcacccacctttttccttggtcacgaactggctggcaaaaccgttgggattatcgggatgggccaaatcggtcaggccgttgccaaacgcgtgcatgcttttgacgcaaaaattctgtatacccagcgccaccaactgacatcggccacagagcaaacactaggcgcaaccttcaccgatcaggccaccttgttacgtgaaagcgacatcgtgaccttacatttgccgctagtaccagctacgcatcatttgctggacgcgcaggcaatggccactatgaagccgactgcctacctgatcaatgcagctcgcggcccgttaattgatgaaaccgccttgcttcagcaattgcaggctcacaagttagcaggcgccgcgttagatgtctatgaggctgaaccgcatgtcagttcaggtctcaaggcgcttgataatgtggtcctgacgccgcacatcggaaacgccaccgtcgaagcgcgggatgccatggccaaaatcgtgactgacaatacactagccattctagctggtaagcagcctgagtacatcgtcaatgcctaatcagtgctggagttgactaaccataaaaaaggcgcctgtcgtcacacaatgcgtgtggtaacaggcgtctttttggatgaaataccatttcatttaatcaaggcttacgcgagttccgcggttgccaaatgcttgcgactaacaaagctaacacaatgccaagtgttaaaccaagaccgccaaccaaaaaaggattggcgatctgattttgagtcatgacaagatcaagaacgccaattaagcccacggcaatgagcaccaagacaatacggtaccacgccgttttcgtcatagatgagccagaatcgtatatttgccaactgctttatagtcacccttagcctttgaatcaggcgttccggcagcttcgtaaaaaacggaatacttgccgtctttatctttagcgacaaccaagccttcatcgacaacatgttcggctttgtaaatttgggcactgcgtcgagccgcggcgaaatcaaaatcattggcgactgcatcgccggggttgaagaaaacaatttcttcgctcatgaagatcccctcgctttctggcttcattataccacgtcaacatcgtctcacttatcagcttgaagcgcctcagccttggctatcaggcttttggtaaatgctgcaaactggggcatctcctcttgcttgacatttaaggcgattttcacagggtcagctccttgaaccgccccacttgccgccaacacggcttcaaacaactctggcgcggtattgtaatctttaccataatacggatcacctgtgccaagcacgccaaataccaacggcttagcggaaaaatcgagcttgctgagatcctcgtaaaagtcttcggtttcttccggaataacgccgccagtccatgtataagtggccaaaaccaatacatcgtaatccttgatagttgttgggtcggtttgaatcatttcaccaagggtcacgtcccaaccataatgttcaaagaactgctgctcgatccgtgccattcctttggcattgcctgtaatcgatgcatataaaatgattgccttcatcgtcctcacctcattaccttcagtatactgataacatcagggttgtaaaagctttcaaaaaaagcatgcacacgaaaagttgtttttcatgcacatgcttaaaaaattcagctttcacagcgggcaagttccatgaatactcacgacgttgccactacaaaaacgttcaactggcagtttcaacagtaccttcaccttgcaagatgaaatgaacggcatctgccaactcattttccttaaaaaaccgaatttcctgatgacccgaaaaatcatcaatttcgataatcggttcaaaaccattaaatcgtcgtaactcttgacgcagccaagcatcccagacttgtgtggctaagccttgctgctgacccaaattacgccgaatgatgatattcttattgtcccaaattcgaactcgcaattgccgatcattttgatcagctgccaagtcctgtagataagcatagtgttccataagctcaccttacctttcaacaaaagacagcaagctaacagtgtctttgcgtcaagcaaacgacgaagcatcatcgcctaggtgtctatgctaaactagaggcaatgatcctacaaccaatgcgctaatggcgctagggggcaatatgacgaattccgaaactaaacaatattcatggcctaaattccggcgctcactgcgctttgggcgaccatctgccatcattcattttatctacttgctagcaattgccccatatgtgttttgggccatttacttcatcgggttaactgcactgctgctggtatcaaaaccaagtatgttgctcgctttgctaagttatattggcaagctattattacttgatcccatcttgcaaacctggcagttactgacatctttgaacttcgccgaaaccggttggatgctactgattgttatcagttattggtgtgtcatcgcaggcattgtcatgcatattgtccaccgcattcgcaaacggcagcttttccatcaactcatatcaggacaggcacagattatcacaaaagcagatcagaccttcgtcatggacaagcaccagcatcattacccactgcttaagcatcccgtgcgatggtggcaggccagtccggatcggcggtggtactaatggttgatctggttaatacaggatcaagaacaacatggtgttaacctttggtacaacctcattatacaaacatacgttcgtaaatgcaatagctttgtttactgtcgctttgaaattggccattagaagtttgttttaccgctttaatcaagcaactcagtctgacaacgttacgattgaatgtcatacgtgcgcagactggtaaaaatcgttatactgttagtaaaggctcacgaggaggaatcgttttggctgaaaaagatcaaatcagtgcattttcacgggagattattgacttccagcgcaaaaatcatctaacagacacagagatggcgctaaacagccacgtatcagttgaacatatccacaatattaaatccatgcgtgagatgccggattcttccgtcgtcgccacactgaaggattacatggaacataagccaagcggcaaataatgatgccactgaaaagcgccgatgcaaactcattaaagtttgcatcggcgcttttcgtttgccggctcagaatagctaactcatgagctaccgattacccaagtagccaatcgtcatcgcacccagcaagataatcaaaacaatcgtcgtaatccatacatataaccgatcgtgttcaactgcaaaagcgtaaatcgaaacgaccactcgcaacaccggggtcaggatcagcaagaagatgcccgtcatcaaaaccgcatacggcttcagtgccagcgtcccagataaaatatcaccaacacgtgttggatgaacgccggtcgcgtatcccgttgagccagtgactaacaataaaagcaggccaagaataatcaccaaggccgacaaaacgaccccaatctgcatgaccttaccgatcatgatttcaacgtcatcaatttcagttttaagttttttgtccatcagatgttcaccccgaatcctttaagtgccatctgaatacccatgtagccaataacaggaataaaaatcagacgtaagacttttgttggcagcatcggcatgatgcgtgagccaacggttgccccaatcaaaataccgatagcgagcggtgccgcgatttgcggctgcaattgtccgccaaaatagtacactgtcgcacttgctgctgccgtaacccccatcatcagattactcgtggcacttgatggctttagcggcatatgcatgatcgtatccatggcaatcactttaaaagcaccgctgccaatgcctaacaacccagaggcaatgccagccccgaacatcatagcaaatccgcctggcacatttgtcacagtataattgatttctttaccagtcgccttgtcaaaatacgcgccattcaatcgcagtttagtcgcaatctcatctggttttgactggcgttcttcaggctccttcatccgcattttacgaatcatgttgaatgcagaaaaaatcagcaaggcgccgaacaagacgtataagactttgccgtccacaagaccagtgacaacggcaccaataactgcgccaacggtggtcgcaatttctagaaacatcgcaacgcgcaagtttagcatctcatcttttaagtaagcaatggtggcacctgagctggtagcgataaccgatacaatactagcaccgatggcatattgaattggcaaccccatcaacatcgtcaaaatcggtgtaataatcatcccaccgccgatgccaagcacggcaccgagaataccgccaagtaaaccggtgaccattaacattatcatttgttccatttatctagcctcgttttccagcattttaggatggcaacgaaaacatcgccatcaatttgttttattttctaaggttagcccacgtggtaacaaggtttcaagccctcaatatcattcccgttgcttaccaactgccgccaaatccaccaccgccactgctgccaccgccaaatccactaccgaaattgtcagaaccgccgctgctaccgctgctggcactcgacccaaagtcggatacaacccaaagtggcaagtcgtattgacttaaatcctgatttttttctggatgccgaatatggaacaagataacgccaaacgtggcagccaacatttcagctgaaaaacgatccgtttctttaacgttttcaaggaatttcgaccaagttgtcaccgcagcttgaccagcaacattcttttgttggcctaaccactgggcataactggcttcataaggtctgccttttgcaaaacgatcagctaatgcgggggttaataacgctgctaatgctgaaacagatggggccgccaccacatcttgatcggctaattgccgcagtggtttgcttgtttggtagtagtaccaataaggatatggtgcggtcaaccgcagcacgcgcgtccacgactcgaaaccacgacgagccaaattggccagaccgatttcgcgtagcttggcatgtgaccaagcgaatttgaatagtggtaaggaagctgtctgtcggcgtaccggaatgcctgctgccatcacagccgcatacaacggcatcgcctccaacgcaacggtatcacgcatagcatcacgcaatcgggcagccatcgccatgtggactacgaagaagagtaccagcaaggccatcaaaatcaaagcagcaatcaagattgcctgctgaatagcagcatcacgtgcccgtttagcggttatttgggcaggcgtcgcgatggcactttggtttgctgtcacgcgttgaccaatatgatcgagaaacagtgcgattgcctcatcgtagttctgcgccttcagctgtgttttcacgttcgaagtaacaatctcgtctgcgctcccgtctggcacgacgtcttctaacccatagccgacctctagccaatacttacggtcttcgcgggaaagcacaagaagcaagccattgtcccagcctttttttccaatacccaatttagcaaactgatcattggcatagtcttcgatttcgtcatcatcaagcgacttgaccgtgatgactgcaatttgaggatgaccctttaccttggcaaatgtctcattattcaaacgattgaccgccgcctggctcttagctcccatcatgtcaccgtcatcgcgataccatgttcccgaagccgcttgaaccgactgttgcgttgctgccccaataccaagtagcaagacaagcgggatgagccaccaaagatatttgtgcatgtgaacctcctttgacgcgttttgacgcatgcatcgaatcgagtcgcgctgtcaaaatttgcaattgttgctctcatgataccatgagccttcgaacagcttacacgccatctggcaaaaataaccatgcagcaaaaacgaccttctcactttcgagaaggtcgtttggctaactttgactgaatttaatccttgacgggatcaatttccacaaacgtatcatttggtacccgtaaaatcgagaaacggtcagcaatgttgccaacatgcatacctaaaccgtttaaaaagcctggcttgtaacgagcagtgaccgttgccacgtaggcttgatcggccgtctgatccaattttttcaggtcttttttcgaccatggatagcctgccgcccgcggggtcaacggttgtgtaccggcactaacttcagcattgtgacttgtattttcgtatttagcgccgttagtccagtaagtgtagtacaaggttggattcttaccattccctgtttggacacgaacataaaaggaatgatcctcgccagtttgtaaaatgagatgttctgcgctgtggctaatagctaccgcacgactatcacgataatcaataggccgtaaccagctcacccaaaccatgccaatcgcggcaatcgcaaaaacaagcacttctgcaatgtcaattaacaccaccgagccacgaacttgctttccggatttaacaattgctttaatgtgccgttgccgaatgtgccagacgatgaaaatcaaataggcgatgagtatcacccatgccaacagtccgataagattccacgaattcataattttccccctacgccgtcgtattatctgcttgcgtcacagccaattgccccaacagattcaaataatgccacggtttatcataattcggattgaacagcatgtcgacataagccagctgatcaatcgtgttacgattttggatcatcacagaaatgagattagctgcatttacaatatcatattgactataaaactgggcacccagaattcggcgatcatcagtatcatagacgagcaccatcgtaattttgacggtgtccggcatgaatggcggtcgaaaatcatccgtcatcgtgacactggcagccgacaggtggttgcgcttggcgtgagcaagcgtcaaacccgtcacacctaagttatgatcgtacaacttcagcgcgctggtggcttgcgtccccatatatttaatcgttggtttaaacaagttagcgccaaccatcatcccttggcgcacagcattggtggccaaaggcgcataagcgtccttaccagtgggattgaaatggacggcgaccgcatcaccagcggcgaaaatatccgaattgctggtctgcatataatcattcacgtgaatggacccatcaggattcatatcaacttggccgatcagcaactcggtcatcggccggaacccgacacaaaccaccgccaaatctgcctgtatttcgcctttatctgtttgaataaaaacatgctgctcgtcactatcaaaatgcttggcaactgtgttgggtttcaactcaaccccacgtgttgtcagggcctcactgatttcatgactaagtggtaagtcaacataatgactaagtaaaggcgaaacaccattaattaacgttacctgtttatggttgcggctataggcttccgccagttcgacaccaatatacccgccaccaacaatcgcaatatgctcagcatccttggcactttctttgattcgccgagcatcatcgtagtttttacacatcagcacccgcggaatactgacacctgaaatcggcggaacaacaggataactacctgtcgccatgactaatttatcatattgataatgttgttggttgcccgttttaagattttcggccaaaatccgatgatcagaggcatcaatgcttaaaacatcatgtttgagatgaacgtgaacatgcggccccagcgcctctaaagaagctggcgtagcataaaacatatcttccaatcggccaacggtaccttcaaggtataacgcgatgccgcaagaaagaaaggagatgtcttcccgccgttcaaagacatccacttctgtctctgggtgcttcatcaacagttcgcgcactgccgcagttcctgcatgcgtacagcccacaacgacaactttcatcagcatctgccttcctttcaagattgtcaataatgacattatgacacgaaaatggctaaacctaaagcatgtcgctaaccgctttctggcgcttacaagtataatgaaatcgttgcttcacaaatattcaactcataaaggagcgctgcacatgcatatcaccctcatcggcgccggccctcgcggcttattaattttagaacggctactcagctggcagcaaaatcgctttccaaaacgccaactcaccatcgttctgaccgatccttatccaattggcggacgcgtttggaaaatcgatcaagatccgaaccttatcatgaatacagcagcgtcacagatcaccttattcactgatcaaacggtcaccaatgttggtccattcttgaccggacctgatctgagcacatgggcactcacaactgcatctggttaccttgatgctcaccctgagttcaataaccgcgcgatcctactgcggcaggcagcagcactgggacccaacaactacgcttcacgggcactttatggtgtctaccagcattggttctttgacatgcttgtagcccgcgctggtaacaatagcatcacgtttaagcagcaaacggttgtcagtttagctaaaaacgtcgctaacttcacaattaccaccgatcaagaaagctggcacacagaccaagttgtcatggcgctaggcaacctcaagaattccttgacgcgcgatcaaaaagcattggacgattacgcccacgctcacgatttgttttatcttgccccaggtttccctgaagaaggtgaccttagcaccatcgaaccgcaggcacctgtgatcattcgcggactgggcttaagcttctttgatttaatgagcaggttaactgaaggccgcggcggccgcttccagaaaacagcagacggcttgctggcctatcatcctagtggtcgtgaaccgcatattttcactggctctcgacgtggttttccttaccgggcaaaaggtcgcaaccaaaaaggacccggtgaagaatgggagccacagtttttgacgactgaacagatcaatacttggcaagcacatggcgaagtgagcggtcaaaccttctgggaagcattgcaacacgaagttgaactagtttattatcggctcctgctagtgcaacgctaccccgatctagacgtaactgcctttgaacatgacttcgtcgccgatcctgttacgacgctaggcacattgccaattgccgccaaagatcgacttgattgggatgccttggctgatccaaccaagtggcatccaagcggtcagccttatcaggactttatgcggcattatctgcgtcgagatgcacgcgaggccatgcgtggcaccaaaactggaccattaactagcgcactagaagttttgcgtgatatgcgcgacccgattcgccagctcgtcgaacgcggtttgttgagtcaagatcagtacctcgatttcttcttgcgctggttcaactcgctgaatgactttctctccattgggccgcctgccttgcgaattgatcaattgcaagccctgctaggcgctgggatcgtcactattttgccaccggggatgcaaattaaaggcatcgatggtcaatttttattgaaaacgccaagtgatcccagcttttcggttcaggccaagagcttactcgaagcgcgtgtgccggctgtcaatgcgccaactgcgcaaaacgcattaattcagcaactcttgcatgacggctatgcgcacacatatgagctgcagttgaacgctgacaagcgattccagtccggcgccatcgccgttgatcgccaaacccaacaactgcttgacaccaacgaacaccctcaacctggtctcttcttctggggcgtcccgactgaaggcgtacattggctcaccactgccagcccccggccactggtcaatgacactagtttgaaaacggcagaacagattgtgcagacaatttggactatgccaaaaccgtagccttatcttactcacatggatcaatcccaaaaagacgcactgatactaaccgcaaaaaacgggtctacactttctggtgttgagaaataatcaacactgaacgtgtaggccctttttggataacgcaaaaagacacctactcagtgtccatgctatgcttgttagcgtcgaaaccaaaagcaagcgaggttatgagtaaatgtcccaatacgatcctacactgtccgtccttggaat

SEQ ID NO: 54 - DNA, 36519 bp, Lactobacillus paracasei
ggtttacttttgccacgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaacccccagttcaagcagtgagcaagcctctttctaggtggtaactttattattgcaatctaggcgtgctagagatgaatagggtgaagatatgaataacttttttaacatgattgattttgagtttcttcaaaaactattaactcatatatatatatcatttaccgctattattcttggcgttatcgtggcagtgcctctaggaatcttactgagctcctttaaaaaaagaagcaatttcatcatggcggttgtcggaatgttgcagacaataccggccttagcattattgacgttaatgattccaatttttggtatcggtagaacaccaacgattattgctttatttctttattctctattacctatactgagaaatacttacgctggactcgagactgttggcgaaaactatatagattcggctaaggggatgggaatgtcatgggggcagagacttatatttatccgtttgcctatgtcaatgagcgccattatagcaggaattcggacttcctcagtttatgtcatatcatgggctactttagctgcttatatcggtgcggggggtctcggcgattatgtgtttagtggattaaatctttataggatggatttggtaatgttggggacaattccgataaccatactagcgctgaccgtggattctttgcttagaattgttgagaatcatttttccttacaaaaggggtgatactgtgaagagaatagttgccgttatattaatgttgcttattcttattatatcttttgtaagcaacattcaaagtgcaggtaacactattacagtttctggcggtgtcacctcggaatctcaaattcttgggagcttagtttcagagatgattgaacattatacagataataaagtagagtttctgaacaacttaggaacagctacgatagatcagcaggcaatgcaaagaggagacttagatatatcagccacaaggtatacgggaactgatttagtaaccacactcggagaaaagacagaaaaagatccaacgaagacgttgagaacagttcagactcagttcgaaagaagatttggatattattggtcagacggatacggcttttcaaaccaattcacatttttagtaacaaaagaaactgcaaaaaaataccatctaaaaacagtcagcgatctaaggagagttgctagtagactatctttggggactgatcaggcatggtacaaacgagcaggcgacggatatctggctttcagcaaatattatggcatgaagtttcgagatgtttatccaatgcaggtgggaattttgtacgatgctctcgttaataaggaacttgatgtcattttgggatattcaactgatggtagaatcggaagctatgatctagttatgctgaaggacgataaaaagttcttcccgccatacgccgcgagctttgttctttcaaaagacacactgcaaagatatcctaaattaaagggtatcttaaataaattatcaggaactattgatacaaaaactatgcaaaaattaaattttcaggctgatgatgaaatgcttgagccgcaaaaggtagctaaagagtttttagaaaagcataagtactttgaagagggggagaaaaaatgatacaggaatctctggattatttatctaccaatttctcatatatcttgaatcaaattggcatccatctctacatttcaacgcttggggttgtgataactttctttatcgggtttccccttggaatatttctttcaaatcatcagaaaagtgaattctttgttacgaatttgatcaatatttttcaaacagttccttcaatcgcgcttctaacaattcttttgatgtttatgggattaggccaacggacagtgttagccgctgttgtcgtttattcattgctaccgattgtgaaaaatacaacagttggcttaaaaaatgttgatccaatttacattgaaaatgctcgaagtattggtatgagcaagtttcaaactttgtggatagttatgataccgctggccgctccaataattttggcaggtgtccgaactgcccttgtgatggctgtgggtgttaccgccattggatcttttgtcggtgcaggtggattgggggatataattctcagaggagttaatattacaaatggctctccagttatcataattggatctggactttgtgtgcttattgcaatcggggtagatgtactctttaagtggattattgggactagtgaagaatgagcgctgagttgtgcgacaccttgaagtcaaaaacctaaactttaagcaggtctattaatctgctctggaaaaagaaagttagattaccttattgactagatttctgcaaaggcttacaataaccgtgtaaattaaatatacagaaaacggtatattcagctaggagtgccacaaatgcaggcttatcaatatcaaaaaaagggattagcactcatcttcttagcaaagaaattctttgttctgaaggttggcgatcgtgtgcccacagttactgaaatgatcaacgagtccgaattgtcgcgtggcactattcaagcgggacttgaattgatgaaggctgatggcgctatttcaacgatttctaagggtcatctcgggtcctttttagtagctcaggaccaagataagcttctgtcctatttggattatcggaatgttgtgtgtgcgatgccacttccgtataccaaacattatgaaggtttagggacaggcctctataaggcgttcaagaatcagaagctaggtctaaatgttgcgtacgtcaatggatctgtgaatcgtttagaagggttgcagcgcaatcgttacgatttcattatcgtgtcagcacttactgctgattacttggctgaacaccatgacgttgatgtcgttgggattatgcctgaaggttcctacgtatctcaacacgtcattgtttataagggggatcaggatttcaaaatgcgcgatggcctgcgtatcgggattgattcgcattcactcgattataagttgatgacgaacaaaatcttagagaagcacaaagttgagttggtcgagtctccctataatcaaattgtccagcgaatagttgcaggtgaaattgacgcagctatttggaatcttgacgaggtgaagtcaaaaaattatccactgagttatcagatgatcaaagacccaatggttaagcgtgcatctcgagctgccattctttgtgccaagggaaatggatttgttaaaagagtaattggtgattacgtggactttaaggaagtgacagccattcaaaaacaagtgatttcaggagaagttttaccagaatactaattgagagatataccccattttaggaggtgagacaatgtgagcgatgaaaccgctaaaaaattgcagatcttatatgatgtgggcaagttgagtgatgaggatcttgcattcattcgtttagttgatcaatatttggttcgaacagtgggcgagcgagactccgagatgttcttgattcatttatcagttgcattagaacgcagtcataagcaagaacctgtggatgcgttgccagataatctttgggcagaagtgacagccgatccagcataccagaaagctttaagtatctggcaacatgtcgcggcatctcggccagttgaattttcggattttgaaacacgctacattatcatgcatttggttaatattttgaggaggggttaatatgacaagaatcgtcattggtggtcagatgggtaaggatgagttgaggcagtcacttgagaaactgaccgcggggaaagatgttgagattagtgtcaagagcgatcttgatgcagccatggcagtcaaagataacaaggcagacttttatattggtgcttgcgagaccggtgctggcggcgccttagcaatggcgaccgcgttattaggctcaagtaagacactgacagttgcatcaccctcgaaagttttatctgaagcggacatcaaagagggcatcgacaatgggaagattgcatttggctttacgattaacacgaaggacacgattttaccaattcttgcaaaatatctgacgaagtaaacttttatgtcataagtcaatatacggtattttgtatattgagaaaaggaaggtgtcaaaatgaacatttcggtcttagtagactacgtgttaatcgcgttagtcggaggcgtgggttcgattttagccaatcgcggcattgcggtctttaatgatggcttgcgaccaattatgccagagtatctggaaggcaagattgatcgcaaagaattggctgctaccagttttgccgttagttttggcttaattatcggctttggaattccggtatctattggctcaacaatcttggtagcgcatagtattctacttgctgctgatattatcggcacatggaccccagccaacaaatggggcactgcactggctggtgttgttggtgccgtgtatggtgttgggcttctgttcggcctttcatttattgtttcagcgttcaaaatgcttcccgttaacttcctaggagcgttgtcactgctaggcgggccgattttgttagctttctgtgcattcccagcacttgcagttgccagtcagcatggggcaaagaaaggcatgatcacatttggggcgacatttgttgcttaccttcttgccacaaaatttggggttttctcagttggcaatgggataaaaatcacgttaaacccaattggaatgtcactcttagtcgcaatgttattcatgctttactttgccgctcaaattaaaggcgaaggcacatcaaatgcaagtctggtaaacgtcttttcggcccgagtttctcggattaaaaagaattggatttggttgtccatcatgggtggcttaattactgccgcatcaagtgtcttgattattgcggttgatgttttgccgcaacagttattggttaaaggccaagtcatggaagccgccattgcaacattggctcgtgcgattggatttattccgcttgtcttctctactgccattgtaactggtgtctatggcatggccggcaccacgatcatctttgcaattggccttttattgaaaggcaatccgattgttgcgtttattgccggatttgtttggatgtggattgaagtccaagcacttgctggtactgctaaaggtttggataaattccctgggttgcgtgatatgggtgaacatattcgaacttctctaacggatacgattgcgatcgccttgctgattggtgctgcgttggcctgcaataagatggcgccaaaccttggttacttctgggtgatcggagtctggctgctgaacaagaagctgaaaaagcctcttgttgatatggcagtgggaccaattgctgctatcgcgcttggaattttgctgaatctgttacgaatcgtacatctgttttagtcgatggcgagcgcattaaggggaggaaacatgttattaccaggtaaggtttatgctcatgaacacattccaattgatttatctgaagtcaagcaaaacgaggattgtcatcttgatgccattgatcaagtgattgcagaattcaaggatctttatcaaaaaggtgttcgtaatgttattagcatgacgaacaaaggtatgggtcgaaatattccatatgctaataaagtagcaaaagaatctggcatcaacattgtgcaatgtactgggttctatcaagacgcctttttaccaattgaagtctttcggttgtctgttagtcagttagcggaacagatgattaaagatattcaagtcggtattaaaggaacagatattaaggctggtgtaattggcgaaattgcaacatcgaaaggtcagtggacggcagctgaagaaaaagttttccaggcagcggtcattgcccagcaggaaactggttgtccgataagcacgcatacctcaattggaacgctgggtcgtgaacaggttgatttctttaaacgacagcatgcggatcttaaacacattgttatcggacatgttgatctgacaggcagtgccgactacgtcttagatatgttgaaaactggtattaatgtggagtttgacacaattggcaaaaataattatatgcctgatgcaacgcgcgttgagatgttaaaagcgattgaagccgccggttttacggatcaagtcgttttgtccatggatattacgcgtaaatcacatctgaaggctaatggggggaatggttatgcttatttacttgattcatttattcctcagctgcaggatgcgggcatttctgagactttcatcaacaaaatgatagaagcaaatcctcaaagaatctacggtgatatcaatgcctagttttaaaacttatccattagaaagcatcggatatgacgaagcgctgcggaagcaatttcttttagttgatgagattacccggcattttaaggggtctgaatttctcagtcgtggtgatttaggcgttgtgccggggcttaatcaaccgcgctataccaaaagagtagaggaaattcttgccgcatattttcacgctgaagctgccatgttagttcgaggtgcaggaacagtggcaattcggatggctttgcacagttatctgagggctggtcagactttactcgttcacgatgcacccatttatccgaccacacaaacatcaattgagatgatgtcattacgaacgattcgagctgactttaatgatctgaatcatcaacaactgcctgagtcgccggacggtattcttgttcaatatacgcgacaaaagccagatgactcgtatgatatggcaaaggtcctggcattctttaagcaacgatatccgtcagttccgattgtgaccgatgataattatgctgtcatgaaagttcacaagattggcgttgaacttggcgctaatctaagttgcttttcaacatttaaattgctagggccggaaggtattggttgtattgttggtgccaaatctgccatccaaaaattgcgatccgagaattattcaggcggctcacaagtacaaggacacgaagcaattgatgttttacgtggactgacttatgcaccggttgcattggctgctcaagcgaatgttgtcactgaattagttgagcgattgaatgggaacgagattcctggcatttccgaggcgtatgtggcaaatgctcagtcaaaagttttgttggttgaatttaaccaaccgattgcggaaaaagttttgaaatatacaaatgaccttggtgcagcaccaaatcctgtgggtgccgagtcgaagtatgagattgtgccaatgttctaccgtgtatcgggtacctttaaaaagtttgatccaaatctattaaaaacaacgattcgaatcaatccatatcgttgcggtgctgacaccatcatgaggatcttagcggaaagtgtcgagaaggtgatggcgtaatgttcttaaaacaattggaaaaactaaatccagaattaattcaatatgcctttgaattgcatcattcggggaaaattttaccggatacgtatgtgattgatttggatatgattcatcaaaacacaactcatatggttgctgaagctaaaaaaaaccatgttgagttactttatatgacgaaacaagttggtcgtaatcctgtgattgcgcaggaagttgtcaacgctggcatcccagaggctgtggtggttgattttcgtgaggctgaaacttttatggaaaacggactggccttaggcaatgtcgggcatttggtccaaccgccaaagcattttctcactcgtcttctgaagtatggaacaaaatacgtcacgatgtattcactcgaaaacacccaagcgttgaatgaagcagcaaaggaagtcggtatcaagcaaaaggtgctacttaaagttatgggcaatggtgatgatatttatccaggccaaactggaggttttaccttagcggaactagacaagcagcttgagcagcttaaaacactgtcgaatatcgcgcttgttggcataacgacatttccggcgattctatataacgagtcacaagaagattttgcagcgacagcaaatgtcaaaacaattgacgaagctaaaagtatttttagcaaacatggtctaaaggcacaggtcgtgagcttgccgtcagcgacctcaactacctcattgccattgattaagcaacttggcggtaacgaaggcgaacctgggcatgcgctgacagggacgacaccgctgcatgcggttaaggaacaacctgagaagcctgcctactgttacgtgagcgaagtttctcatacatttggccctcacagttacattttcggaggcggctggtaccggcgtggtcacttaaagaatgccttaattcaagatggtgatcaatacacacatgcacatgtgttaccacttgaaaattcgaatatcgactattacttggaactagatcagcagtttaagtcaggcttgccagtgatcatggcttttcgtacgcaaatttttgtcacccgaagcacagtcgctttggttcgaggattacacaccgctggcaaaacacctgaattagttggtttatatgatagtcaagggaaaaaattaccagaagggatgcaatagcatgggcaaatacggtgtcattgttttagatagttttggtgttggtgccatggatgatgttcctaaagttcgcccagatgacatcggggcaaacacagctttaaatatcattaaggcagtaccacagattaaaattcctaatttggaaaagctaggtttgatgaacgctattggccaagaacgaggtgatcacaagttttcgccgacagcaaattgggggacctccttactgatgcaccatggcgctgattcttatcttgcgcatcaagaaatcatgggtacaaagcctaagatgccactgcttcagccgttcaatgaagtgatcgatacagttgaggcacaggttaagaaagatggattcaatgtcgaacgttacggtgatcccggctaccaattattactcgttaatcattgtgcgacaattggtgacaatctcgaagcagatcctgggcaggtctataacgtaactgcagcacttgatgaaatgccatttgatgaaattacgcgtttaggagaatcagttcgcagcgtggtcaaagtctcgcgggtcattgcttttggtggacgaggcgttgatttgaagaacattttggcagctcggaaaattgaacacgagaagtatgtcggtgtttcagcgccggaatcaggcgtctataatacagattatcatgtcattcatttaggttatggtattaatcctaaggtgcagctgccgtcaattttgcacgcaaatggtattgatgttgctttggttggtaagacggcagatatcatgaatgttgatacaccacggaagttcccaggtgttgatacggactatctttttgataagtttgttgaacagtcgaaggatatgaaagatggcctgctgtttatgaacattcaagaaactgatttagcaggtcacgccgaagatcctgttcgatacgctgaagtacttgaaacagcagacaagcggttagccgatgtcttaccactttatacaggcgacgatattttaattgtcatggctgaccatggcgatgatccaacgatcggatttagtctgcacacgcgggaacggacacctttgttgatttacaaggaaggtactcacaataagtatgtgggcgaacgttcgacactttctgatgtcggtgcgacgggttcggatttctttaaggtaccattccccgagaatggtaagagtttcttgcatcgaattatcgatgggacagacttagacgcatgatgtcgcgatgaatggtagtggcggatgatgacagtgaagggtcgtcatccgtcactatttttgtacaatcatactcatcgcttaagctgaattcatcgataaaatcggtttgtcagcgggctgagtgactattgttagttttcaggctgatcaaacatgttcatataaatctcaatcaaaatatctgcttgcaccatcaaagaagcccttgaagtgatgtcataattttcaaagtggttggtggggacggaggaactaaggttagcgtccatcatcttagcaagcgaactatcgccattgtttgtgattgaaaataataagttgtgatcaacatacctgaattttttgacggcttgaataattgactgggtttcaccgctcatagagaggaagaggatgacatcttgtgggcgtgtgagtttggggatcaagtcaatgatgtgtgattcatagctgtagatggtgggtttattcagttggatgaagcgcttggcaacatattccgcgattggtttggtcagaccaacgcctgcaatgtaaagggttttagcttcatgaattttagttgccatgtagcgtaaacgttcaaagttaacgttgtcgagcaggcttgtgaacagatggcggtattggccgattaaatccttttgatcaggtagggtattctctttaactgcggccatcgcgcgatatttgaactccgaatagccagctagatctaattttttagccatacgaataatcgttgtgttcgaggtggcgaggcgttcagcaagttgcgttaaggtgagttgtcgaatgatatacgggtgcgcatcaataaagtaaaacgcatacttttcggtttcagataagttgctgagatgttcagcgaattctttttcaattaatcccatattgacctccagttgcgtataattatacgctttgagaacggtttcgtcagtttacctatgctataaccaaagtggagtggaaaaggtgttagaaacttttgatgaggtgaactatgtttgcagataagatcgagacacatttgcggcagatttatcaagatgataggcaatatcgacaggcaactcaaattttttctgatctgttgaagtcggagcagctggcggacttcagacccgttatgccattgtctcagaaaagtgcttatttgatcacttatggcgatgcatttacggaacagcatgagcgtggcctgtcagttttgaagcaagtcgttgacctgtatttatccgagacaattacggatgtccatctgttgccaatgttcccatatacatcagatgatgggttttccgtcacagattacatggccattaatccggatcttggtgattggcaggacgtctatgcgctgcgacagtcaaagcggctgatgttcgattttgttgctaatcacatgtctgcaaacagtctttggtttaagcgttttctgaaccatgatgctggttttgaaaaggcgtatatcgaatttgatccaacttttgatacatcaaaggtgattcggccgagagtttcgccactttttcatacttatcaaaatgatcgtggtgaaactaagacggtttggacaaccttcagtgaagatcaagttgatattaattttggcgatccactcatgttagctcgtcagacaaaggtgttgcttgaatatgcaaagcggggcgcggcctcgattcgcttggacgccattggttttatttggaaagaaagcggcactacttgcatgcatcgcccggagacccatgaaattgtccgactgtggcgaacactgcttgaccattttgcgccgaatactcagatcattactgaaacaaatgtgccaaataaggaaaacatcgtctattttggccagggtgatgacgaagcgcaccaagtctatcaatttccgctaccgccattggttctttatagttttatttccggggatgctgatcatcttcaagagtgggctaaaactgtgcaggcaccatctagtaaagccactttcttcaactttcttgcttcacatgatggtattgggttgcgaccagttgaaggcattttaagtgcggacgaaaggcaacgcatcattgaccgggttttaaccaaccatgggcaagtgtcatacaaagataacccagacggcaccaagtctgtttatgagttgaatatcaactatggcgatgctttaagaataagcactgatacggatgcagaagcggccaataagatgatcgcggcacacaatatcctagtctcaatggtcggcgtaccagcgatctactaccactcaatgtttggctctaaaggtgaccttaaggcggttaaagaaactggtatgaatcgccgcattaatcgcgaaagaattgactatgatcggttgaagaatgagctacggacagatcagtatcgtcaaaaagtttacgcaggaatcagtcatttactcaaagttcgtcaaaagaacatcgcctttaatccgtttggcaaacaagaagtattagatcttggaaagcagatttttgccgtgaagcggtttagtgatgatggctcagcgattatttcatttacaaatgtttcaagtcagccagcaattattcacaacattgagggtcgagagctgctatcagagaagcttgtcaggaatgatttgcgactgaagccatacggtattgcgtggttgaagatggaggcatcaaagtgaaggttgttgtcggaatagatagctttaaaggaagtgctagctcagctgaattgaatcaagctgtagcaagctcaattaaagaggttgctggtgtaaccgcggtatggccagtgagtgtttcagacggcggagaaggcgctgttgcttcacttcaacagcgccttgatggtcaaatgaagacggtcacgacaattgatttacttggtcggagaattcaagccccgtactttacttttgcttttgagaatgaaaactatgccgctatcgaatcagctagtgttgttggactggataaggttgtacccagcccagaaaccattcgtcaagccagttcatatggtttaggaattgcattgaggaaacttgatcaacaacattttgaccatattcttatcttccttggcggcactggggtttcggatggtggcttgggcgttctgcgcgcctttgatggcgccattaaagacaacaaagggcaacttcttgaagaaggcaatctgctattacaagcagcgtcaatcaatttatcgaagctgagccgattacacagtgatttgatgatcgccaccgacgtgacaaatccgtattcaggtgagagcggcgcagcgaaggtttatgcacgacaaaaaggtgccactgtcgagcaagtcaaccaactggatacaaatgcacatcagatcgccagtcatgtccatgagtcaggtggtcctgatttagacaagtctgcaggagcaggagcagccggcggtcttggcggagctttacaactaattggtggtcaaatatgtcagggatttccaacaatggcaaagtttctgcggttggatgatctgtttgaaaaaactgatcttgtgattactggagaaggcaaacttgatcggcagtcaacgtttggcaaggtgcctttcggtatggcgaaattggccgaaaagtatgcggtgccaaccgttgtcctatgtggttctaaacaaattgccacttgtccaaaaatctttgctggcatcttctccattcaacctggtcctatcagtctcactgatgcgatgaacaaagaaaatacattggctaatatcgggaatacggcttacaacattttgtcgactattcagcacgtattcgcacaaagaactcaggaggggtaattattatggacatgacgctcattacggatccgtcgttaatctttttacatcaagattggcagagtaaagaagaggtattagatcacctgattaatgcattcgcatcagaaggtgttgttaatgacaaagcggtttacaagcaggctgttttagatcgtgaaaagatttctgaaaccggattcgagaacgggttcgccattcctcacggcaaatccgtggcggttacgaagcccgcagttgctatcgtcacgttgaagaagccgctggcatctgctgcgtgggcatcaactgatccaacgaatcaagttgagttgattttcttactagcgattcctgaatcgcaaaaaggcgatgcttatctcaagattctttctgatttagccgttcgcttaatggatgagaagcttgtcgatcaacttaaacatgccaataccgctgatcaagttattcagttacttggcaaaaagaatcaagaagccacaacaacgattaaagaaaccaagaagcgacctaaacaaattttagcgattactgcatgcgcaacgggcatcgcccatacctatatggccgcagaggctttacaaaaagcggccgcggctaagggcgttcagattcacgttgaaaagcaaggcgctaacggtattgaagatggcatcacaccagaaatgctgaaggatgcggacggtgttatcttcgcaactgatattgcagcaaaaggcaaggagcgttttaagggcattccatttgttcaaacaaaggtagctgagccattaaaacatggtgaagccatgattgaccaagtcttaaatcatcctgatggcgtggtgcaaggagaagcggctgcatcagaagttgcgacaaccggtaagaagcagtcttggcaaagtacgttgatgcaatctgttatgaccgggatttcttatatgattccgattttggttgctgccggggtgatgatcgggctttcgcaaataggtgcgagtttcttcggcctgaataaggtgattggtgatcctaagatggccaccaatgcgaaccagatgattgtcttactttattacatgggtcaatgtggcaacatggcaatgaagttcatgtatccaatcttcacagctttcatggcttattcaattgctgatcgaccagcgattgcgcccggatttgtcggtggtgcctttgctgctggcttccagttcattttactgggaaatgcgaaagggattccatcaggtttcttcggtgctctgttccttggcgcattagtgggcttccttgtgaaatatatgaatgaacatattcatttaaataagaacttctcggcaatgaagccgatgctaattttacctggtgtttcaatcttggttgtcttcctggctaacttctttattgttgatcctgtgttcggcggattgaacgcttggttgcaacaaatggttttaacttataaggactctagtgaagttttactctcttcgattattgcttgtttaactgcttttgacttaggcggcccggttaacaaggcggcaggtgccgttgcaattgggatggcagctgataaagtctttccattaacgccgcgggttttgtctatcgtgattcccccaatcgggattgggcttgcaacgctgattgacaaatatgttgttgggcgccatgtctttgatgaagatctgcgggtttcaggcaaaacatcattgttattaggcttcctagccattggtgaaggggcgattccatttgccttagccaatccgctcatcacgatcccaattaacatgcttggggcaacactagggtctgtcaccgctgttttgctcggcgcagttcagtggtatccactgccggccgtatggggatggccattggttcaaaacttcccggcatacgctgttggtattcttgttggggtcttgtttattgctttgactaatatctttattcgctttcatataattcgtaagaaagaaaagacaaccactgctgtgaaatgattggagcttttataaatgactaaatctgtttttgctgttgcccattcacattgggaccatgaatggtattttactcaagaagatgctgacatgatcctgattgaaaatttggattacttgattgagacattagaagagaatcctgaatttccttcctatactttcgatgggcaatcctctgttattgataagtatttgaaaatccgacctgaaaacaaaaagaggattgaaaagttaatcgctgatcgacgtttattcgtgggaccttggtatacacaaaccgatgctctgttgggcaagactgagtcagtcattcgtaatttgctctacggtgtgaagcaaacgcaagcgcttggacacaccatggcaattggctatgcaccggatattttcggtatgcacgcctactttccgtcaatttataaacgcttcggcctgaaatgggcaattttccaacgaggggtttataacgaccaagtgtcttctaatttgaattttaactggcaggcaccaaacggcgaagtgattcctgctaataatatcttttttggctatggtcctggtaaatttttaagtgctgatgacgcctatattaagacacgtttgaaaccgatcttagatgaactgagtcgtcgtaatcaacatacggacaatctgttattgccagcgggtggcgatcaagtgctgattaatcgccactttccaaagacaatcgctgaattgaatcgtctgttgccggactacgatattaaactcaccgactatgagacctttatgcaggccacatggcagcatcaccattttccaaaaacgattgaaggggaattagttgctgggcaaaaatcgcgtattcacaatacgtgtcgctcaacgcggtatgacatcaagaacctgaattttcaggtagaagatttgttgttaaacgagctggagccgttatgcactattggcagtcaatttggcatcaagtttccgcaaaactggttggatcaaatctggcgcaaagtctttgagagccaggctcataatggcatcggtgcctcgaactcagatgacgctaatcatgacattgtggttcgtttaacgagtgcactgcggcaaattaaagatttaatcaacatggttaagcggcagctgacagcggcaattagcaaacaaacacagttggaagatattgtggtgttgttcaacactaacattcgagaagaacactatcagcgcagcatcgttttatttacccatcacaaagacttcacactaaagacgatgaatgatgagccactggcatacagcattttgcatcaagatgagctcgacggtggcaaggtgattgttgtgacagcaggtggtgaacaggaaaaatccgtgcccccgtattatcgaacagaaattttagttgaggacatcaagctaccagcgatggggttcacaactcttcaggttcaggatggtgtggcaggacagtgcgaccatcagagcgcaataaaggcccaggtcattgagaatgagttttataaagtgagcttcgacgatgaccagcaccttcgtctgcaaaacaagcaaactcgacaagccattgacgatcccttttacttcgatgatcaggctgacggcggtgattcgtttgactattcaccaatttcaggagatcaagcaaaactcatcaatgaaccggttctgattgatgtgacgaagagtgctcgtcgacaagtgatgcgactcgaattcaaagcgcaactgccggcttcgttaaatcaaacggctgatgctcgctcagaggctgttaaggattttgtgattaagacgaccctagtgcttgatcaaggagagcgtcatttaaaagttgaacacgatgttgacaatcacattaaagatcatcgtgtacgcgttcactggcacacaggtgttaagaacatgagcgaaaactatgcggatcagggattcagtttgctaacccgcaagagtaccaattctcatgaggcgacctggcaaactgagggatttgtcgaaaaacctaaatcgattttcgtttttgaatctatgattgctttgtccgatgatgagtctcactttagtttgcatagtggcatgcttaaggaataccaaccatatcctgatacacacacgttggcgttgaccttgttccggagtaatggactcttaggtcgagatgatctggcttggcggcctggcagagcctcaggaatcaacaacatggtcgtgccaacaccagatggacaaatgcttcagcaaatgcattttgcctatacggttgagtttggcttgaaatcaatcgattctcagcaagcctttaagcagtcggatgcaatttatacaaagaccgacttttatcaaaatcagtcgttgaactcttatcttaatcgaattgatcgctttcaaatcccgaaattgaaagccgacgtaccagctcacttttcactattacatagtcaaaatgaaaatctgttcttcgctgctttgaagcaaggatggaatggcggggtagttttacgtctcttcaatccaacgaacgatgcccaaccgattaacttgaaaacctcagaggcgattcaaagaactcgagtcgttgacctgaaggaagatccggttggtgaattcaaagaagggcaattgttagctgcaaaagactatatcaccttgaaattcaattaacttgttgatgaaaggagttcagcatgacgtatgaattacggccaaagattgaggctaaagactatcagatagcggctcagaacgatgaaattggcaactttattcggcaacaattgagtcaagctgatcctgaaactcaaaccgttttagtctttgaagcctacccgggggttgatcaggataaactgttagctttggcaaagtcgttacagccgaagctcatcataaatgcgctcgatcagacactgccgcaatcggaagttaatgcaaagttaaaaacgaccttaacggatgatcgtgtccttgggttgatgacgcatgccaacatggcagacttctttgactcagagaagatgaaccgagtccgagatcgaattgcgcatgccgaagggttagttattgtgtacggtgtgggagcgtctttagttgcaggagagtgggatcatttagcttacttcgatttaacgcgctgggagattcaactgcgttttcgaaaggggatgaacaattggttagctgcccctgagccagatatactcaagcaattcaaacgtgggtatttctttgaatggcggattgcagatcgtcgtaaggaggcgttgtcctccatgatggattttgtcgttgataccacgacaaacgatcattggacgatgataaccggcgatacttttcagcatatccaacaattggctgtccggcgtcccttccgactggtgccttactttgatgcaagtgtttggggtgggcagtggatgaaagaaacatttcagctcgatccgggaaaagaaaactatggctgggcatttgatggtgttcccgaagaaaatagcgttttgtttcaactcggtaatggtgagttcgaaatgccagccattaatttggtccataactttccgcttcagttacttggagagcgggtaacagccttatttggaccacagtttccgattcgatttgattatttagatacgatgggtggaggaaacctcagtcttcaagttcaccctaaggttgagtatatccagcaacaattcggcatgaattacacgcaaaacgagagctattacattctgcaagcaacttcacgatccacgatctatttaggcgtgaaaaatggtacgaataaaaaagagctcttcgatgccttgaaagaggcgcagactggtcaggctaactttgatgatgacaagttcattaacgtttttccggtaaataagcatgatcactattctataccggctggaaccattcactgcggagggccggacacagttgttctggaaattagtgcgaccccctatatctttacttttaagctctgggattggggacggataggattagatggcaaaccaagaccaattcatcttgatcatggtgaacctagtgccgacatgcgtttcgacactgattatgtaaaggacaatctgttcagcaaaaataaggtcattcaacagacggagcaagaattgattgaagagactggcttgtgcgatctggagtttattgcgacttaccgctatacctttacagataccattgaagttcaggatcacgatagcgtgaatatgttgaacttagtggaaggagatgcaattgagctaagcagccagaccgatgcattcccgccagtgaccattcattatggtgagacttttatcattcctgaaagttgtcatcatgtgcaggtgactaatttgacgccatctaagccagtgaagcttcttcaggcgtttatcaaagattaacaaaagtgtgttgaaaccattactacgttgcaaggtttttttgatggttaagacaaaagtgagtagcatgaattagtctcattagaagaagtcattctgattttcgagtaggtatcgaaaacggaatggcttttttaaatgatgaaaaaacgtgatccataatggtatggaatagtttagatttcatgccttatagtagtctaaaattgaaagaagaaaagcggttaaacttcttcagcagctatagtaaccagcacctttacctttacacccgaacatttctcggctaaactcagaatacattcagttatttcgaatcttggtggttatgttcacaacaagcacatcgtcaatgatgcaattggaatactgaagaaaataggatcgcgttcgacaaaccgattgggcgccaatgggactgtcgacgcaagggggacagaaaatggcaaagttagtcttacaaacagattttgggttggttgatggtgcggttgctgcgatgtatggcgtggcttatggcgttgatggtgagttgtcgattcatgatttgacgcacgagattccgccgtatgatatttttgcagcgtcttatcggttgtatcaaacgacgaagtattggcctgaggggacggtttttgtttcggtggttgatcctggtgtcggtagcgatcggcgtagcattattgcggagacggtagatcatcatttcatcattacgccggataatgggactttgacgcatttagcaaaatttgtcggattgaagcgggtgagtgtgattgatgaggcatcgcatgccttgcctggcagccaagagagtcatacgttccatggtcgtgacatttacgcttacaatggcgctaaattagcaagtggccagatcacctttgaggatcttggcaaagaaatcgaacctgagcaagtggtgatgttgccattgggtgaggttaaagaaggcgttgatcaaattgccggtacgatcgacattttggatattcgatttggctcgttgtggacaaatataccgttggctacctttaagaaacttggtgttgcagctggcgagtttgttcaggtatcgatttattatcacgatcaattgcgttatcaaaaccagatgccgtttacccggacatttgccgcggtgcgggttggtgagccgctggtttacgtgaattcattactgaatcttggcgttgcgatcaatcaggactcattttcaaagctgtatcatattggcactggggttgattggcatatcacggtgaagcggctttcggtataattgaatgcatgaacagtctgctggcggcgatggctttggcggctgctcaacacgggtaagtaacggtacgtttgacaaggagggcaatcatatgcgtgatcaaaaggctttgagcgtacgtacagtggtggcaatcggtattggtacggctattttatttatcttgaaacgatttgcggtgattccaacagggattgcaaatacgaacattgacatttcttatggctttctaggctttatcgcaacgcttttcggcccgattgccggctttttcatcgggtttttagggcatgctttgaatgattttacgcaatacgggacaccatggtggacatgggtgttcacgactggtttagtcggcatggtgatcgggttgttctggcgtcgcttcaatgtcgaagcgggcaattttggcatgaagaaaattgtaagcttcaatctgttgcagattattacgaatgtggtgagctggagtctgatcgcaccaacactggatatttggatttacagtgagccggcaaataaagtttatgtccaagggatcgtgtcagctatctcaaatagtattgcgaccggtgttattggcaccattttattggtcacttatgcagccacacgcacgcggtctggcagtttgaagaaagagtcttaatatggcagcaccagcaattcagcttgatcatgtcacgtttcagtatgacagtcaggcggaaccgactttgcatgatattaatctaaccattcaaccaggagagaaagtactgattgttggcccgtctggatcaggcaagtcaacgttaggtaacttgatcaatgggttaattccgcacgcttttccgggcaaattgagcggcaccgtgaccgtcaacgggacggtggttcaggatgccagcttggcgacactttcactgcaagtcggaacggttttgcaggatccggatgctcagtttgttgctttgacagcgggcgaggatattgcctttgctttggagaacagcgctgtcgcacctagtgagatgcatacacgcgtcaaaaaatgggccgatcgtttgaaaattggcgatttactggcgcaagcaccgcaatcactttcaggcggccaaaagcaacgggtggcgatggccggtgttttgattgatgaaggggatattttactgtttgatgaaccgttggccagtcttgatccggccactggtgaagcatcggtagacttgattgatgagttgcatcagacttatcacgtcaccgaagtcatcattgaacatcgtttggaagatgtgttgcggcggccagtggatcgattagtcgtgatgaaggacggtcgaattattgccgatgatgccccggaaactttattgcatggacagttgctgcaacaaatcggcttgcgagaaccgctgtacttggaagcggctgagtttgcgggggttgatttggatcaggcggatcatttggctgacctttcgcgttttgaggccccacaactcagacctaagttggctgctttcacagcggaggctgcgactgttaagccggagcagcttcaggcaccgttattgtcgattgacgggttgcagtttggctatcctaatggccgtcaaatttttaccgacctcagtttcaccttgcatcatggtgagatggtggccttggttggacgcaatggggttggtaagtcaaccttgagtcatttgatcgctgggtttttgaagccgggtgctggcaggatgacgcttgatggtgaggatttggctgattggtcggtgaaggaacgcgccgataaaattgggtatattttacaagatccaaatcagatgatcagtaaacacctgatttttgatgaagtcgctcttgggccgcgtttacgtggttgggacgagacgcgtgtcaaaacagcggtcattgaggcgctgaaggtttgcggcttgtatccatttcgatcgtggccgatcaacgccttgagttatgggcaaaaaaagcgtgtcacgatcgccgcaattttggtgctagaaccggcattaatgatcttagatgaacccacggctggccaagattggcgtcattttaccgacatgatgcgtttcttgacgaccttgaatgaacgtgggattacgatgatgctgatcacgcacgacatgcatttgatgttggagtatgcgcagcgggctattgtgttaggtgatggtggtatcttgatggacgactcgccagcagcagtgctgaccaatccggccatcattgagcatgcttccttagcacaaccaagtttgtatcgcctcgctaagcgtgaaggccttgacccattagccttcacgcaggctgtgattgaccaagaacggagggtgcgccaatgaactcactttttggttatgatccgcaagacacatggctgcatcgattaacgggtgcgacgaaaatgctcgcgttcattggtatctcggtcattgtgatggcgagttatgacacacgctttgtctgtgcagtgatgctcgcatcgatcattctgtttgcccaagctaaaattcattggcggcaaattagtttagtggtcaaaattattacgatttttgcagtggtcaatttattgctcgtgtttgttttttcgccacagtatggcgttggcttgtatggcagcaagcacgttttgctcaatgctggttacttcacgatcacacaagagcaattattctatgaaatgaatctagcgctgaagtatattgtgaccgtgccactggcgctgattttcttaatcacgaccaaccccagcgagtttgcagcgagtcttaataagctgcatgtctcataccgaatcagttattcggttgcgttagcgttgcggtatatccctgacgttcaaacgaatttccgccaaatcagtctggcccagcaagcccgtggttatgagttgtcacgtaaggcaaagctgtttcagcgactgaaaggtatggggcaaattttgctgccgctgatctttaccagtctcgatcgtattgatcagatcagtcaagcaatggaactgcgacgttttggtacaggcaagcggcagacgtggtacatggatcagccgttgcgcacgcctgactggatcgtgctggccggtgttgccgtgattatcgtcattgggctgtttctgtttcatgttaatggcggacggttttataatccgttccgaggatgatgtaaaaaaatatgaatattgcttcatcaaaaaagttcgatggtcgtttaacggatcaccgaacttttttatgtgctgatgttgccttgaccaactgaagacagatgaagtagctgctaacgaacaatccctcattgccttcgatggcgctgattcagtgttgaaggtgtatctcaatggcgatttcatcgggcatagcaagggtgcccgttaaccaagccattgaattgctacgaaacactaatgatgccatcggtgatattgccatcaaagtcggtttttcaaactacgtgcagtttgccaaagctttccaaaaagcccgtcaaatgtcaccttctgtctttagaaaggcaatttcaaatggtgatctgagtccccgaaagattgattaaaactagatgatcctactgagcaagcacgaaaacacccctcgttatggtttctcaatagcgaggggtgtttgttttgtcatgtgatcacgccacaaaaataaagtccttgagcagttgataaagcaaagcaatttcgtagtcctgcaccttgatattgaatttttgctcaactggctgaaaaatgccgctggaaagggagaagaattcttgctcaggtggggttaaggttgcgcgatcaatcgaagtagtgctgcgtttgctggtcatcatgcgttcaatcattaaggacaagtgcatgaagagattgagctttagtctggatccgaatttgacgttgtagaaatcttcgtagtgggagacaatgcgttgactttcttgaatgacaatatcgggattcaggatttgcaagcggccgcggataccttcaatcgacaagaagcgaaccaatcgatcaatgagttcattaatggactgggggctttcaccacaattgcgtaggacagtttgcattttttgtgaggaagccttatcgaaaacattatagacattcacgatatcaatgccgatatcggccccgatatcgccagcaacatcggtggtggttaagattaactgggtattcgagaaaaattttcgatcatgattggtgagcagggtatggagttctttgtagtcaacggcaatgacttcaagtgctggcgaaagggtcgcatcaattagctttttgacttcttcagacagaccgacgccagacatgcaagagacgataatgttcttcttgtttgataagccttcgtaatattgggcttcagttgttgcaccatattgctcgctggcttcagcgatggactggaaggcatcattacgctgaacgcgcaggccaatatcgagcgccatagcagtagttacgttgttgaccacaatcagttcttgatcagatacctttttaatttctctgaacatctggcgcaaagaacccatatcgaataagacaatattacccttagcagatggactttgatcggttaggtattcctgaacgtaaccgttgatttgatcaagtgtcacatcaatgggcatatcaaatgcctcaaaaaagtaattaccgcaaagcgaattcaccacttgctggatgctcgatgcggtgtgttcgccgtgagcaagcaggatggcattgtactgcactgattcgattttactttcgcaatgaatcatcatcatgaagaatggcagataatagtaagggctttgaacatactgcgcttttaacctagtcaaaaagtgcttgaaaaggtagtaacttcgaggataacggtgcttgattgctttctgaattttcagtgctgattgtgtgtctggcaagttgtcgcgacaaagacccgcgaatgcgaaggcaagtgccacattttgccagaaaatattgtcgcttggaaacgttacaccatatacatgcgtgatatacgttttggcgtctttttgaatggcttgagcaaatacagacagaagtttttcactagcaatggtatcgacttgattgagcactttcgccagaagaaaattctgttcagtgatggactcgccattgtttagcgagtcagaaagtttcttaaaaagcgcatcagttgttgggccaagctgcaacgcgctggtgatcaaagatgtgattcttgcttgcaaggtctgttgtttaggcgttaccagaatcgcacttgtatcggtttgaccaagccgtagctgcgtgtggtcaggcgctttggcataggcgccagcgcaaagcaactgaacacggttattcaatgccgtgatgttattgacgtgatcaaaatttgccagtttgatcaactcgtttggtgcgatcaagatctctttattgatttgatcagcctgttgttgaaggtacatcgccgcaaacgtaatgcgctcgtttaaaggtcgatcgctaaaagcgcttagtttaatctgaaccgctgcacttttgaaccagacacgcgctgctttaaaaatttcagttgttcctgaatagatgtaacgaaaagcagtggtttgttgctggttggtgtgcgtgaaaagatagtgttgatctgatgagcctagcatctgcacatttttaatatacaagtagccactttcggcggtgccatctgccgtcgtggcattgttctcactttgcaacttctttttgagtgtccctggatgatccttatagttggcacaatcaatgattttaaacacagctgttttcttaagcacttcacgacgaatggcttcgtgataaattgcctgagcaaatggcaacttgccactaccggctggaccagtgatgaagatcggcaatccatgtgttggatagacgattgcttcgattgccagctgaatgttagtgcttaaactaccgtggacaccgattaagtcgtcaaaagcggaatggtcccgcttgacttgccagtaaactggtctactgccggtcttgagcagtttgccttgcttttcgagcttagataaataactactggtcacgccgcgtgttagccccactgcatcggcagcctgattagttgtgattcgttcagttggaaagtgttgcacaattgtcgcataaagtttttctactgcgttcaaagaaaccaccccttaagcactattcccgcaaattaagcacaacgtcttcgtgacttttattagtaatgtgcttaacataatcattgtaagcgttaaccttgttgacgtccagatatagagagaaaacgacttacataacgattgcagaagggagggcgttcctcgcggggacaaccgcaatactgtccgaacaataatggatcactttcagttgtacttcggttgattgtcgccttttgcggtaaatccatattttcatagtcttgataaagggatggtttagatgaaatatttgcttcttgtcagtcacggtgatttctccagtggcttaaagcaaaccttgggtatgtttgcgggcgatgatgcgattggttctgtcattgcggttggtttaaaacccgatgaagcagcttcaacatttggaacacggtttgaggcattgctaaagaccctgccagagaatgcaagctttgttgttctggcagatattgtcggcggtagtccactcacaacggtttgcaacattttgaacgaccatggcaagctgcaagatacgcttgttcttggcgggatgaacttcccaatggcgttaaccacattgatgtcgaaagacagtttagataactcagcgttaaaagaaaaagcattttcagaagcaaccgcggccatcaaagaatttcagacgacctcatcagaagcttctgacgatgacgatatttaaggagtgagcaaaatggcaatttcgtttgtacgtattgatgatcgcatgattcatggcttgatcacggttcgttggggcaaggaatacccgatggatgggattattgcggtaaacgacaaagcggcaaacaatccgattttgaaggaagcctatatggcagcgtctgacaagaagaccttcgtttggacgttagatcattttgacaaggttaaggataaggtgttgaactcagcaaccaagtattttctcatcaccaagagtcctcaagatatgaaaaagatcttggtcgatatgaacttcaagccgggcgacattaaaacagttgttgtcggtccaggtaatgatcgcgacaacgcggtcaaactcggagacaatcagtcctttacccaagaggaaggcgatgcctttgaagcgattgagaaggctggttataaagttgagtttgcgctgttgccagatcagcggattggtagttgggacaaattcaagtcacgctttgggtattaatggttgaacaataacgcgctcgcagttgcagaaacctgcacataaggatcttggtcgcaatgaccaaagagcagtcatcacgtccaaggctgcttatgttccggtttctaaacgctactgctcgcgctcacaataacgcgctcgccagcgctgaagcctacgtgtaaggaccttggtcgcaatgaccaaagaacggtcatcacgcccaaggccgcttacactccggtttcacccgcgctggctcgcgctcacgataacgcgctcgcagtcgcagaaacctgcacataaggaccttggccgcaatggtcaaagtgcgaccatcacgtccaaggccacttatgctccggtttctaagcgctcctgctcacgctcacaaaaaaggaaggtaagaaaaatgacaattagttggtttcaagcagctattttaggtgtattcgcttgcttatgttccaactcatgtatggctggtcaagcggttggtaattataccattggccgtccattggttgggggtcttgtttgtggcattattctaggtaatcttcagttagggattgcctgcggggttgcgatgcagttggtttatatcgcattggttaccccaggtggtactgtttctgccgatgttcgtgctatttcttatattgggatccctctagcaatggttgcgatttcttcgcaaggattgaatccgctgggtggcggtgctgctaacttggctaagtcagttgggacattagtcggaactgtcgggacggttttgtactacgctgttgcaacaatgaacctggtttggcagtcctttggttggaaagacgttcataatggcaagcttgataaattaacagctgttaactttggctggccttggatctcacatgcattgttctcatttttaccaacaatgttactcacatactacggtgctacggcggttacagctttgcgtagtgccttaccaatggacggcattgccatgaagacactgttcacggtcggcggcatgctgccatgtgtcgggattgcgattctgcttcggcaaattgttggtaaagcagctgatttcattccgttcttagttgggttcacacttgctgcttcactacacttgaacttagtctcagtcacagttgtatcgttactgtttgcggttattatttatgaaattgagatgtctggttctaacaacacaccttcaaagggtagtgcagcaccagcagatggaccaagtgacgatgatgatgaggaggatatttgatcatggaaacgacaaatgacatgaaaaagcttgatcacaaaacactgacaaaatcttttcatcgttggttctggggtgcgttgacctgcttctcacaagaacatatgcagacttttgggtatatggcttcaatgctgccaattctcagaaaactgtatccaaaacatgatgaccaggtcaaagccattcacgcatacaccgcgttcttcaacaccaacccaatgctcgggacggtgattgtcgggatcacggccagcatggaacaggcgcgtgcgaacggtaaagaaattgacggcgagaccattaacgatatgcgtgctggcctgatgggcccaatcgctggtattggtgattcattgattgatgggacattaattcccattctcttagggatttcccttggtatgtcgactggcggttcaccagtcggggcgattttctacattgttgcttgggtactgatggcatactttggccaacgtttcctttacttccgtggttatcgcttcggtgatcaagcggttagcttcttggttggtaaacaaggcgcagctgttcgtcacgctatcgggattgtcggcagtatggttgttggtggggttctggcatcatgggttaacgtcacaacctcactcaagttgcgcggtgctgatggcaaagtcttcctgaatctgcaagacaagctgaacagcatctatcctggtttgctgacagtacttgtaacattattctgctggtggttgatggcgaagaagcatgtttcagctatctggaccatgctgctactcgttgttgtttcgctcgtcggtgttctagttggtttcttcaaccctggcctgtcttactaaactacgaacgtgtatggaagaaggaaaatcaaaatgacaattgacgaaatgactaagggatacgaaaaagaagttgcgtatcagaagcatatgttgaaaaacctaggctactggtttcaactttgcaccattctcagtggcgttggcattgttctgatctacttcttccatggcaagaccttgtggttaaacatcgttggcattgtgctcttagtcctgggtgcactggggatgttgatgttcgggtattccggttggaaagggcagcaaaatgttcgcgcggtggttgacgactatgacaagaaaatcaaatattttcaaaagaaggttcgtcagcagacgggcattacgcccaaagccaaatagctcctgttgtaggtgactttaattgtagatacttcatttatcagtgataagtgcaactatggcaggactgagaagtcggtgagattcagttctcatcgactttttttgtcgtaaggctacttagcaaaatgtggtaaatggacagcggcaaccagaagatttcatgtatatgaaatgcgtcaaacaaataggaggatgaataaagttggaaatggatgaaaagaaacattacaagatgtataaaagcaagagtgtatgggtatttgcctgcttatcaacatgtcttatcgtttcattttttaatgacgggcaaaatgtaagcgctgcgacaagtgcttcgtctacccaaattagtcaaacaaacactggtagtcagcctaataatgaaacgacaggtgagacggctcagtcttcagtcaatagtacggcaactgcatcatcatcaagtgtggctgatttgcctagttcgagcgacagcaagtcatcaattggtagtacaatcagtcaaccagctgttgataaaaaagagacttccaaaagcgatactgccgacaatgatttgacaaaatctgtaacaacgagtgattcagacaaagcgctccccacttcgaaaaccacgttgccgacaagtaatgaacaagtacaaagtagtgtgggacaatctcaaactgaccaaccagcatcgtccgcaacaattgcaaccaatgcagtcacctctgacgtcagtcaaaacgatcagtataatgaaccataccgaaaccagtatcactactcaagtagccagaattggatcaatgatcctaatggtcttttttatgatagcaagacggggctttacaatctgtattatcagtacaatccggaaggtaatcagtggggcaatatgtcttggggccacgccgtcagcaaggacttaattaattggacacaagaggacgttgccattccaatgctacagaatcaggggtgggaagactttacgtataccaacacaactggttcgctaaaagataaaggcgaagttagatatgttggtgtaccaacaacaaattggggtgacgctgacggcaaaaaggctattttcagtggctcgattgttgttgacactaacaatgtcagtggcttaggaaaagacgccattctggctttctacactgctgattatcagatcgcaactagaaaaaatgatggtgctgaagacggatgggggacatggattggtttaacagaaattcaggagcaacatttggcttacagcctcgatggtggcaaaacgtttattcaatattcgaaggatggtaatgcagctaatccccaggcaatcattccaaccagtatgaaccaaggaggagatgccgccaacttccgcgatccaagcgtggtctacgatgcggttaacaaacaatactatttgacagttgtgtctggtcagcaagccctcatttataaatctagcaatctgttggactggacatatgcttctaagattgaacgtgaaaatgatgttggtaatggcgtatgggaatgcccatcactggtaccgatgaaggtagctggaacaaatgaaacaaagtgggtcttttgcatcagtgtccaacaaggcgcacatgccacaggatctgggatgcaatattatgttggtaatatgacagccgacggaacttgggtacctgagagttcaaaaacgttgcaaaatccaatgacgatggattcaggagaggatttttatgcgggtattcctttctccaacatgcctgatggtcgaacggttatgttggcttggcagtcgaattggagttatgtggacgaggccaaaacttcaccttggtctggcaatatgacacttcctcgtgagctgagcctcaaaaagaatgctgatacaacggacgggtacttgctgacgaatactgtggtcaaagaaattgctaataacgaagaggccaatgttattaacaaggctgaaagtaactttacggtttcgcgttccgatgagcaagtccagtacgaaggcaaacaatataagataagtgcaactttttcttgggacgaagctgacaaaccgaaatcagttggctttaagttgcgagtatctgatgatcaaaaatatgacatgatcgttgggtatgatttaactacgggattattgtacgttcagagactcaataccggtgaacccaacatgggagcaccacgagacaaaatgaacgcaacagtgaatgcggatggatcaattacaattacggtttatgttgacgaaacaagtatcgaagcctttgcgaatgatgggcaaaaatcaattacccaaaatttctttatgcggccagaaaatattggggaccaagccacaacaggcgtctatgtgtactcgaacgatggcacgacaaagatcagcgacttaactatcaatccaattacttcaatttggaacagtactggtcaactaactgaaaaatttgtagatgaaaatggaaacactatagccagtgataaaattcagaccggtcgtgtaggacaaagctacacttctgagtcagcaacgattccgggctatgtttttgtaaaagaaaatactgaccatattaatagcaaccagttgtatacgacccagaatcaaacgattacttatacctatcgtgcgtctcaagcgtctgttgtaaccaaggatacaacgttagtagcaggcccatcagccgcttggaacgcggccgataatttagtaggcgctacagacgcagacggcaatgctttggctgtgtctaatttaactgtcaccggtgcagtagatccaaagacaccgggaacttatacggtaacgtatagttacaccgatgtagcaggcaacagaattagtaaggaagccaccgtgacagtcatcgcgtccaaggctgatattgtgactaaagatacaacaatggttgcaggcccatcagcaacatggaacgcggctgataatttagttatcgctacagatgcaaagggcaatgttttggccctttctgatttaaccgtcaacggtgcagtagatccaaagacgccgggaacttatacggtaacgtatagttacaccaatgcagcaggcaacaaaattagtaaggaagccaccgtgacagtcatcgcgtccaaggctgatattgtgactaaagatacaacaatggttgcaggtccatcagccgcttggaacgcggccaataatttagttagcgcaacagacgcagatggcaatgctttggccatgtctaatttaactgttaccggtacagtagatctaaagacgcagggaacttataccgttacgtacacttatacggatgttgctggtaacaagatcagcaaagaagccacagtgacggttttaacagaaaaagagacaaacattgaagacaataccggatccagcatttctaacgatcgtgagaatccccctgcttcgattactggcaaaggcggagacgacatacatcaaaacgcaaagacaacaatgaccaaaaagaaaaccgagacattgccacaagctgggaatcacgtcaatgagttagcgattgttcttggacaaatgatcttagcaatttgcgtaggaggtattttatggttaaagaggcgggtgaagcgagtctaaaataatcaagtgattatctgatacggtcagatcgcttgtagatctaaaaactcaaggatttatctggcactgacgggataaactaagagacatagctggccattttgcaaaagcgaatgctatactaaagacagcaaaaagccgttgtgcgctaacacaacggctggacaaatgtccttgcagagccagctaataaacagtggcaaacaggattaggtaactaaaagccgcgagaccctggtgaaggaagcgcggcttttagtttacctacttttctcgaaatgcttcgtgcttgcataagttcgtgaactgctagaagcagcttgatagctgcaagtaactcagagatttatccgccctaagtcgggttaaaaattaacagacacaactagccattttccagaagagcatgctatactaaagacagcaaaagccgttgtgctcgaacacaacggccggacaaatgtccttgcagagccatcaaacaaacggtggcacacagaattaggcaaccaaaagtcgcgacattccggtgaaggttggcgcggcttttagtttgcctatttttctcgaaatgcttcgagcgcctgcataagttcgtgaactgctagaagcagcatggtcgttgctttgatcaatcgtgtgaacacgatgatcagcactaccaatgaacctacacaggctgtgatcgttgtgatgatagcgatcaccagcaaaacatgacacctttcttttaaaagtgtgggttataggaactagtcccataggcaccacctactttccgaatcaggcaccaccgctcattatccttctctgctggcttcagtttatcagagtcacttccagcgtgacgaccttgcgtagaacaacgaatgttatatcgtgctttttaaatttattgagaaacgctcagtcactgagcatatacgtcttaatattgataactttttgatggattatttttctctatgaaatttgatgaacgttaataacaagcagccaaaacaaatttggctctgcgtcaactggtgttgaagaataaatttatcatttgaggcggttctccatttggggagccgtctttgtcatgttatgccgtgatttggtagattcgtttgaagaagttcagctgattcttgaagccaaaacaggatcgtttgagtgacttgatgaggcggttaaccccttcgatcggaccgttagaataagggctggtgacagcggcgagaacagcgactttgtgtcgcttaagcgtcgcgatcgtcatgtccattgccgtaccgtttggctcgtaagtagctaacaggtttgccagttccgcgggatgtttcttcaccatcaaggcctcatgaagcgctaagtaggtctcgtaggtttgcttgagcttgggctcagtatcaagtgcgatatcgatggcctcctgttgcgtgacatattca

SEQ ID NO: 55 - DNA, 5638 bp, Lactobacillus paracasei
atttttggggaattcttcgctactattcatagtgatcctcctaaagtcctcagcgactaacaataataccctcatgaaggtaacactactttgccatattttgcagaccgtgtcaacatttttatcattcacagtgatacattatcattataatggcgtcttttaaattaattatttattaaaacgaacagaaaagtatttaaatgattttgattttataatataaattgtataaatgtataacttaaagttttttagcggccaataaatatctttactgataaaagtaaatagccattatataagtggagctaaagtctttagaaacacagaggctcatgaaaaccgataattcaagcgggattaatttggaattcttatgttgtaattgaagtgagaccgctaatctcgtaagtttccggcaaatggtgacttttcaaacatagcgattgcctccgttttttctgactttccatactttcatgatagctgattgcaagtggtacacaaccaagtatgccaaccaagttttgttaaggatagttaccaagctcgagaagaacaacaaaggtcagttttctaccatgtttgcttattaaaaagactttgcagccaataattgtcagcgtcaggctgatcacaggactgagtaacgctattttttaacgccttggaatattagctgacaataagcattgatgatcttcgctatttgaatagactgacagtgtcgtcaagaccacacagcgagctggcaaagatgctattcaagagaatcaactttacacgctgacaatcaacgggaaaaggatgttatttttcaaatccgtaaatatctttttgcacgaattattcatgcaagatgtgaatcgcacacatgaacgggttttaaaaacataaaaagtaatacaacttataaatgctgttatgcacatgaacaaatgcgccgtataagtgttttgataatcagctccctgaatagcttgaaacagcctcactgacaattggaacagaccaattgtctttttgtttgtgatatcacatatcattgcacgattaatcgtgcaaacaatgcctgttgtttcgtcttagaaagcgctttacagtagaattagaaattgagtgtgaagggggtgatgtgagatgtcattaagtaaccgacagcggcagattgttttgcagctgattaatgctgaaggggcggtgacggctaagcagttggctgagtcagcggcggtcagcgttcggacagtgaagtacgacttaacggatattcgagattggctggcggcgaaggactcagttttgaaaagtgcgccgcgcaaagggatctggattgaggccagtgaagcggctcgaacggctttgcgggagaaaatcgatgatcagttagctgataactatttagcgccgaatgaacgaatcctccgcatgatcttgattctttcgcaaaccggcgattataccacccaacagcagttgcaggcgcgggtgaatgtgagtcagacaacggtgaacaatgatctgaagaaactcgcggtttacttggagcaattcaacgtcaagctgatcagcaaaaattattatggctacaagctgaatggtaccgagttggctatccgccgcttgctggaacaactcatcacgcagcagttgaatcgtaaaacactcatggccgagctggttgacagcttgaacactaaaaccgaaccgaaaagagctttggttttgaccggtgaagcaacttttgatcacgcgttcaatgccatcttgaaagaggccattcgtataggtaaacaggaaggcgacatgcctgatcctagtgcactgattgccacgatcattcggttgaccatcggcgtgatccgtcaagggtttaatcaattagtcaacagctatcatcgggttgaacagtcccaaacggatcagcagtattcggacaaactgatcatgaagacgttggctttttacaacttgccagcgctcacggacgattacgactattatctcggtcaaagcgttaacgaaaaagtggccccgcaagatcataacttggtcgcgatgacacatcgcatcatcttggcggttggggcattggttgatcatgattttagtcacgacagtcagctgcaggaaaatctgtacttgcatcttagtcagtccttgggtaagaaaagtcagttgcttgagtacagcccatttacgcaagatattaagcaagagtatccggccttgtttgaagcaattgaaaaaaccgtcaataaagagttggcaggtgatcaggcagttttaagtgaggcgtttgtttccttcattgcgttgcatttcatggtgtcgctcaatcgcgatagccagatgcgcacggtgcgggtcgcgtatgtttgtgcaactggcattggaatcaccaatctgattcagcagcgcattgcttcagcgattccaaacattgaactggtcggctttgcttccattgatgatgcgcgggcgttgattgcgcgcgaacatcctgaattggtcatcagcgtgtttccgctcaagaatttggaggttcaggtgattgaagtgcgaccgttgcctaacgatgctgacatcgccgccattcgccgtgcagttgcgaaaaagctgcaagtgccgcttgctcagatcaagtcgcagcacccagtggttccgattagaccgaagccaaaccttgagcagcaaacgcagcagacgattttgactatgttcagtatctactcggaactcaagcagcaattgccaaccaaaattgatccgtattacagtgatgcattcatgatgcacgttttcctcgcggttcaacgcattatgtttgataagcagtatcaaggaaaaccgaatcaggatgatccgaagctggtgggcacggtcgagcacgtcttttcagatcacggcttggccattaatcgcgctgaagtgcacgcgatcctagaatatttgagtttaagtcatgaagtatcagaggaaggggatgacaccactggaagcgaacgttgaattacccacagaagtcaaagcgatgattgaacaaagcagtgatgcccaagcggcaacagcacttgtcaattatgtgattaagctagccgctgaagcggagattcattttactgatcttcagctgcaagttctcacgaatcatcttattgaaatgctaggccgatcgaagtcaggcgagcaattgccagcggttgatccgacaatgttcgccgaagtttcgcaaaagtcgttggatttggcagatcaagttgtgcagcatatcggacatttggaagtcgcagagaagtatgttttatcgattcattttgaagcagcgcaggataagatttaaagaattgttgttgtcgtcaggatccattttggaaaaagtcacacgtctcataaaaaacgcgttcgcagtcgcagaaacctacgtgtaaggaccttgaacatcaatggccaaagtacagtcattgatgttcaaggacacttacactccggtttctaagcgctcctgctcacgctctaataggaggatttcaccatggttaaagtagttattgcagatcggatgggtaaaggtcagaacgttgctaaaggtgttgaagctgctggtggtacggcggttgttgtgccggggatgggtgcggatatgcgcttgggccaagtgatggataaagaaaaagccgatatggggattagcttctgtggttcaggcggtgccggtgcgatcacggctcacacccagtttggctggccagaacgtcatggtatgcgttcggttcaagaaggcatcaccgcgattgaagatggcaataaagtgcttggtttcggtttcatggatcaagaagctttaggcaaagcccttgttgaggcatggaacaagaagtatccagaagcttaaggagtgattcagatgacggtcgtgaatgaaaccaaacgtcaggttctcacagtatctggtaaaggcgagaccaagcaacaagctttcgccgctgctttcagcgatattcaaaagcagctgatcgacaatggcgatgaagccattttacgaatcgttccagaaaaggttgagccgctgaagttgatcaaatccagttacacagaaaagtttcttttcttctttttcaaacggactaggcccacttatgcagttactttggtagtgacggttgccattaccgcgattgatcttggcgctttgacctttgaagatgtcacgactccgtcaccggatgcactctcactgccgaacttgaaaaatatgttgaaggatgtgaaatgagttgccaatactaacgatcttattccagtcgatcatcattggtggactggtcggttttgcggccggagttggggccgcgcggatgtttaccgcgccgaaaacccaagccttgggcgccttccgaacattaggcgaaatgaacgcggcagaaggagacccagcttcgcattttagcttcggtctagggttcttcttcaatgcttgggcatcaacggttggtgccggtgccttcacgcaggatatcacccaccgtgtgattcctaactgggcagcagcaggcttgttgatgaaaaatcgtaatgttgagcagactgtgcacaaccctaagaaaatggggattgccggtgccattattggggttgtcgtggttgctttcttgaatgtcacctccagttccattcctgaatctttacaggtgacggcagttaaggtgttagtcccagctgccaatcagctgatcaatctggtaatgccgattctgttctggctggcggcaattgatgccggtcgtcgctcagggttgttcggaaccgtcttcggcgggctttcggcgatgatcatgggtaacgcggtgccaggtgttgtgttgggcattttgattggtaaaggggtcgacgaactcggttggacgcggattacgaaatctattttggcagcagccattctgttgttcgtactatccggattcttccgcggattcgatcttagcttgttgaagtcctttaacctgaatgcaccagattggttgtcgaacgtccatcaaatgttaggcggaaagtagaggtgttaacgaatggctgataaacaaaccacagcaaatgatgtgtctgcggatgaagaattgaaggcagttgcaaatgatcatgacttttggcacgcagactggggcttcgttgtcatcgtcgccttgatgtcggctggcgtctttgccggcacgtcaatgtattacaattatggtgtcggtgctttcaacgaagtcgcgattgttgcgatgttgaaggcggggatgactggcggttcatacggtgcagccgcggcctttggtgccagcttcctgttcgcccgtattttggaaggctcactggtcggaattctcgatcttgggggttcgattttaactggtgtcggcattgggattccagcgattttactctcggttggtgccaaatccttagtttccaactttggacttgcccttttgaccggcggggtattaggactcattatcggggtcatcatttacctcgtgcggaaatttacgattaatcaaagtaatgccacattcggtgcggatgtcatgatgggtgccgggaaccaaactgggcgtttccttggcccgctgatcattctgagtgcggt

SEQ ID NO: 56 - DNA, 113933 bp, Lactobacillus paracasei
  misc_feature (16363)..(16372): n is a, c, g, or t
caacggtccgatcgaaggggttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttggcgtagagccaaaaaacccgcaagcaagcttgcgggttcatgcgtatattcagaaattagtcaaggatttcggaaacaacgccggcaccaacagtacggccgccttcacggacggtgaacttggtacctttttcgatagcaaccggagcaatcaggtcaacttcgaaagtaacgttatcgccaggcataaccatttcaacgccatctggcaattcaatcacaccggtaacatcagtggtgtggaagtagaactgcggacgatagtttgagaagaatggcgtatgacggccaccttcttcttttgtcaagatataaacttcacccttgaacttgttgtgcaattggattgaacctggctttgccaaaacttggccacgttcaacttgttcgcggttaacaccacgaagcaagacaccaacgttatcgccggcttcaccaagatccaaggtcttacggaacatttcaagaccagtaacggtagacttgataacatctggcttcaagccgatgatttcaacttcgtcaccaatcttaaccgtcccacgatcgatacggccagaagcaactgtaccacgaccagtgatggtgaagacatcttcaacaggcatcaagaaaggcttgtctgtttcacgaacaggtgttgggatatattcatcgatggtatccatcaattccatgataaccttttcctgttctggatcgccttcaagggccttcagagcagaaccacggataacaggaatatcatcaccaggataatcgtattcgctgagcagttcccggacttccatttcaaccaagtcgatcaattctggatcgtcaaccaagtctgtcttgttcaggaaaacaacgatgtaatcaacgccgacctgacgagccaacaagatatgctcacgggtctgtggcattgggccatcagttgccgcaacaaccaagatcgcaccatccatctgtgcagcaccggtgatcatgttcttaacgtagtcagcatgccctggcgcatcaatatgtgcgtagtggcgcttttcggtttcatactcaacgtgggcggtgttgattgtgatgccacgttccttttcttctggagcagcatcgatagaagcgtagtcttgcgctttggcaaggcccttttctgacaataccttagtgatagccgcggtcaaagtagtcttaccgtggtcaacgtgcccgatcgtaccaatgtttacgtggggctttgtgcgttcatagtgttctttttcagccatgaaaaaacgaacctcctgtatttttcgtaagaatacaggataccttgtgtaccctgataatcctttacgtttaagtgtactacatttgagcgtaaataccaaaacaaatatctacgctggaaatgaattccagcaatgagtatacatggtcaatttcactttgtaaacagatagcgtcaagtttctttcatttacagtgaaaacgtatcgttacgcctgttccgacaattttgccgtttcggcggtctgccatgcaaaaagttgatcaaataccgtgcttttaccttggtgatgatccaaataagcttggacgaatgcagctggatctggaatcagacggtcaatatcgggatagagaaaggcaatttgcacccgcgccatctgaaccaatgccgtccctagttcctgatcatcatcgcccaaggcagcttgcaactgagtcaaaatagccggtccgcttttttcctccgccattccaggcaactcatttggcacaagggtttcaatgcggtcatatgcctgatatctgacaggttggttataactgatacttgtcaacaaatctagcaaagacacgcgcatcgcaacaggaaccgtttgatcggccaaattaggcacagctgcttcaactaacgccgcttttggcaaaatgccaatttggctgaacaaatcttgctgctcctgccgcgaaaagccgccgagatggctgatttttcgcaccaatgaagcaatctgttcaccatggctacttaaagcaagtgcctcggcagcgtcaatttgtcggtcaaaagtagcgcgccgcaccgcatcaaaatggcgcaacatgccacgtgccatgacaaaattgagtgtccctaaccaagcatccaacattaactgaacgtctgcgtctgtctgcatgaaagcttgatagtgtggcaacatcacatttaagctttcgtgaaactgcttcaagccattcaaacttgcggccaacggttgcgcaattgcatacgattgatctgcttcataggctttttcaaaatgagccgctgccgaagcataattgcccttctgcaaagcttgctcgccgatgtcaaaatgacgtttttcattatccggtaatgaaaccatttttgccataagaaccctcctgtcgtgctgtagaaagcgtgtcatcactgcaaaaataaaaaatccggaaatggtgatccgaattttctttttgattattggcgcttggcgctattttgattaacttccataatgaccggcaggataactgggcggcgtttcgtctgttcaaacagaaaacgactaagtttatcgcggacatcctgcttcaaatgtgtccagtcgaattctttgttgtccaagttcttttggaccgtatcagtcactagtgtgccgctttcggcaagcagatcacgactggtcttcagataaacgaatccgcgactcgtaactttcggctttgatacgacgcgttttttcttgcgatcaatcgtcacaactgcaatgaaaatgccgtcttccgcaagcattttacgatctcgtaaaacgatattgccaatatcaccgacaccgatcccgtcaatcatggtgttacctgcattgacatgacccgatgcagtcattttacctttttcataacgtaaaatgtcgcccattccaacaataaagatattggcagttgggataccggcttcatgcgcaatctccgcgtgagcagccatcagacggtattcgccttgcactggcacaagatattgaggttttaacaagtcgatcatgagctgaagatcgtttttgtaggcgtggccagatgaatgaatatcatccccaagcactttcacatctccgccagcacgataaatcatgtctttcgtacgtgctgccatggtttccatggcatgggcgatggtggtcgtaataaagactaaatcaccttcatgaatgtgaatcaaacgatgccgagaagtcgccatgcgttgcaaggacttcatcggttcacccatacgaccagtttccaaaataaccgttttttctggggcaagcgctttgagttccttggttttagcaagaacgtcctcattcggcagcttgatgtagtccatgcgaatcgcagtcttgactactttttcaacatctcggccggtcaaaacgacgcgtcgtccgagcgaagcggccgcattaataacctgctgaatgcgctgaatgttgctggcaacaccggcaacaatgatccggccatcctgatactcgaatgtttctttaatgtgatcataaatttcatgttcattagcatttggataaggagattccgcattggccgaatccgaaagcaaggccaatacctttttattcccaatctgtgccaagcgcgcccaatcagtttgatacatcggtgtggcactgggatcaaatttgaaatcaccggtataaacaatctgaccttcgctggtttcaatatcgatccccaacgatccgggaatactatgtgttgtcctaaagaaggagacagacacatcgccaaaatcaatgaccgacttctcatcaatcacatgaaagtctttgaactttttagcctgagcatcatgttgcatgaataccttggccatcgcgatcgtcaattccgagccaaaaactggcacaggatgttccaccaaaaaatatggtaaggcaccaaccgcatccgcatgtccgtggctcaggaaaatcccggcaatccgatcagcattttcagttaaataactaaaatcagggataacaacatcaatgccaagtaactcattatcagggtattttaacccaaaatcgcatacaaaaatttggtcgtcaacttcgacggcgtacatgttttttccgttttcacgtaccccaccaagagcgaccagattgatcttcgtcatggtttcacctcgtggttaatttatggaagcgcggcaatgatgatcactcaaacccgcttccgccgaataaattcttatacaagtgtaccacatgacggaaggaaaacctatagagcgcaattggatgcatttcaaagacttcatgccaaatgagcctaagtacagatgtttctttctaaacgtgattctcaaagaaacgttgcacaacgtggtgattttgtttggccgctgcaacggctgtctgatagccagcatcactcgtctgtgccgcgtcaagatgataggcggctacttcatgatccgccattaaaacgactgcaagttctgatgagcaaccagctgcaagatgtttgccacggtcgttggctaagatagccaacgctgcttgcccggttactgggccgaagcccatgccatgagcttgtggtaggatattttgcacccacgctttcaaatctatcggttgcaagcgatcatccggtacagttaaaaacgcggcatcaccagcaagccaaaagtccaccgttgtaccagccacttgaggcatgatcgtcagtcctgtcggtgttgctgtcattagcagttcacgattttgtaaaatagtggttaccgttttttgcaactctgacggcaacaacgataaggttggtgttttaccaattaagccaatcgcaatcgcctgcactaattgctgaagaggcagcgcaatgccctctgcggcggtctgcactgctccttttttagtgatccccgcagcggcccactgatcagcagccattgctgcaaagacaaccgttatctgatgtgtcgctgctaaaaccgtgattctcaacaaatgatcctcataacgttgacgatattccgctcccatgatgcttactcctttgtctggcattccggttttcataacgcgctcgtagtcgcaaatagtctacacctaaaaggcttgaacacaaggacgtttcccagactacatttaaaagcccttcacacgccgctttctaatcagactagtttgtaaccatcaaaaaaaggccgccaaggcgacctttcaaagttaaattaacgacgcagacccaatgctttaatcagatcacggtaacgcgtaatatccttgttacgtagatatgcaagcaagttacgacgatgaccgatcttcttcatcaaaccaacgtaactatgatgatccttcttatgaacggacaaatggtcattcaaggccaaaatttctgcagttaaaactgcgatttggacttcgggtgaacccgtatccccatcatgccgtgcatactgcttgatgatttcatctttttgtgtttgttcaattgccattgtgtgtaccacctttctgagtattgcctgaaactgagtaaagcgtcggtgattcgctaaactaagtatcaggttcaaaagtacttacttactttaccggagctgcccaatgattgcaagtctttttgcctatcaagcattttccctttacaactttttattgcattgcccccaagccttctgtataatagcgactgttgaaacttatgcagttttatcataatccactgttggaggtgaacatctcatgccacaaatcaaatctgcaatcaagcgcgttaagacgcaagaagctgctcgtgtacgtaacattgcgcaaatgaacgcaatgcgtaccgctgttaagaagttcaagaccgcaaccgaacaaaatgctgacaacagtcaggatctttacaaggctgctgcccgtgctatcgatatggcaaacagcaaaggcctgatcaagaagaacaaggccggccgcgacaagagtcgtctttctgcactacttaacaagtaattaaggcgtcatgccaaataaaatcccctcgggtttctatccgaggggatttttgcgtctaacgatcatttgcaatccgcacgatgttgcttaaccgcgcacatgcttgccagactgctgtcctgtgtactttagcataaatagttcaaaagccaacgccttatcgatagttcccgttttcattgctgtttcagtatcaaccaagccactgtaggcagtcgcgagctgctgataaggtaagcgatccacttgccgcatggctaatttaacccgatatggatgggccttgagggtgccagcaatatcgccttgactataccctttttttgctaataatttcacctgcagcaatagtcgaaactggcctagcatcaatgcgttcaaacgaatgggttcttcacgctgagccaataaatcacgatacagcgccaaagcggccgcagcatttttgcgcaaaacatcagtcaccaagtcaaacacccgatcattgagctgcttaggtactagggcttcgaccgctgcaacggtcagcgggctgccatcactggcataggtcagcagtttgcgaacctcacccatcatgatcgaatactggccgttggtgcgctgcacaagggtatccaatgccggtgcatcaatggtcacttggtgcttcttaaatgtttgggctaaagcagcacgcgcctcccgttcatcaagcggtgctgcattcacaatgagcgccgcctttttcaatgccttggtcaaccttttccgttcatcaagtttcttataaggcgcgatgatgaccatcatcgttgacggtactgggttctcaaaataagcctgcaaaccagcaagatcatgatcgattttgtcggcatttttttcgcctgtcaaaaaatacggatcgtcaataacgacttcccgataatccccaaaaaagggcatcgaggtcgcatcattcaaggctgcaccaacaggcgtttgctgcatatcatagcggccaaagttcatggcctgttgatcttccggaatcatgctggctatcgcgtgttgtgcctgctgacgcaatgcggattcttcaccgagaatcaatgtcagcggcggtcgttcgccattcttaagatgtttgataaaatcacggacctgcattgctgctttgctcctttgttggtaaccagccaaaaagctgatcttcctgtttgttttgccccggctcaacccacagcattcctcgctcgctagtgctagcccatggaacgttggctgcagccaacgttgcaagagtttctggatggggatgaccataccgattatcgacaccggcggaaataagtgctgcttttaaatgcaagctattgatcaatgccggggtacttgatgttttcgaaccatgatggccgacttttaaataatcggccgttagctgacgcggcatgatattcttttcttccgcttctttttcggcgtcgccagttaacaaccaactgctgttgcctattttaccatagagcacaattgaatcggcgtttgtcttggtaggatcgccggatgtctgcgctttcggtgatacgacctgaaatttagcgggtccaatgcgcaaccagtcatcagccgccacgagctgcacatgttgcacttgcttggcaactttttgaatcatttgatgctgaacgcttgtcgctgtggtgatcagtcgaccgactggcattagctgagatagcaacggggcatcgccaacatggtccatatccggatgcgtcagtaataaggtatccagccgagcatagccgcgagcatgcaaatatggcacaatggctcgtcggacaggtggattggtcgtcttcccgaaaattcgcccaccagtatcaatcaacaaagcaccttgatgaaaaggggtttcaatcaaaattgcgtccccttgtccaacgtcaaacatgaccacccgataatttggctgataccaacaccagccaaagacagtcacgaaccagcaagccgccgccaaccagcgtttagcaacaatcaccgtcagcatcacgacaacaccgataagcgctaaccaacttggaaaagcgccagtgactatttggctaggtacacggcttaaactaactaagccattttccaacaattgcaaaccatcgtcaaaagtggctgtcaaggtggcgtgtggcaaaagcaacgcgatcgcaagccctggcatgaccccaagttcaaagatcggcattaacagccagttaaaaagaaccgtcaatatattgaagctgaacgtgtgccaagcaatcactggcatactggcaagtaccagtcgccagttgagctgccacgaacgcatggcaggaagcgccactaataaaccggttaacaggtaagttagttgaccacccatggttaacaaaacccgcggttgccaaaataaattaaacattaaaacgaagctaaataagtcaagcccgctgaagccaagttgcaaatgatcattcacaataccggccaatcgcatccaaactgcgcgccacaatccagcaccaagtggcaataggagtaacaacaacggcagcaggacgattagactcagatcaactaacccttgaggcactcgcaagcgcgccgcaaaccagtataaaccggcaataattgcaaaaagatgcatccctgaaacagagaaaacgtgaaagatccctaagtcaacgaaagcttgccgctgagtcaaaaagtcttcatcaagttggcctagaaataggccttttgcatattgacgaacttttgttggtaattgctcaaaatagtcaaataaatgaacccgccaaccatcaactagctctgctatattttgtggcgaccttgactcgaaattcaattgcggtttcactaactcgtaggctaactgctgtgtttgccaaacataagtcgcgtaatcaaactcaaactgatttcttgccggccctagacgttttatttgatgctgaccgtgcagcacgagtggttgattatttgattttagtcgggcagcgacggcctgattgacgctgccgcgaccactaacaatcaccccattagctgctcgaccagtaaaacttgcgtaaccttctttaagtttgagtgctgtcgcagggatcacaattgatccttggggaacaggcggttgccgccactgctgggcatcaatcaagccacgtcctaacccaacgagaatggccaaacttacgactatgaccagattgcgagtcgttttaacgagtagccaaagcaacaataaacaagctggcaaccatcccccaatgccaatcaagataccagcaagcaaacctgctgccattaaaataaaccgaccgctcatgggccaaccgttagctgaggtgctaaagtctcaaacgttttatcgccaatgccgtgaacctcttttaattcggccacatccttaaatccaccatgactatcgcgataactgataatgtcagcggcttttttcggaccgatgccgctgattgtctggagttggctaacatcagctgtgtttagattcacaactgcacgactaacagccgcctcatttgtttggccagcagtgccgccagtgctggcagtccctgaagctggcgcggtggcaacagcgccacctttctctggaatctgaagactttcttgatccaccgctagcttggctaaattcacctgactgatatcagctttgtctgtgagcccaccagcggctttaaccaccgcatcccaacgcgtatcagcacgaaccggatatagcccaggcttttggactgctcctttgatatgcacaaatccgcgggttggtcggctggtactgcttcttgtttgcctactggacgctatagtggtcgactgaccatgaacattagatgcatgactgcgagtggtgtgaacactaacggccagctgggattgtgctggtgctgccttagtttgctgccagaaaaagaacccgccgacaagcaacaccagcggtacataccaataagttttcaaccaaaacataagtgtcgtcatctctctcacctcaccaacacattacgcaggccaagaaaaaaagaactgccttggttggcagttcttcatcatcaccatctcttcatgccaatgttcgatcaactggcaagcgcttatgatgctgattttgcataagtttccatgtaacgaatgacatcttgcaatgttttgaccgggacaatcttcatcttggtcttaatctgcttcgctgtttcgacggcttcagcgtagttgttgacgtaattgggatcataatgttttagcttttttgtagctggctgattgggggcaaaaaagagttttgcgcctttggcatcggcagcaaccaccttcttatcaatcccgccaatttgccccacattaccatcgctatcgatcgtcccggtaccggcaatcactgctccccgccgcagattctggtgtgtaatttgcgtgtaaatctgtaaggcaaacatcgtaccggcactcggtccgccgatgttaccggcatcaatagtcactttcggttcacttgtgaccgccgtgttctccgtcagtgtgataccaatacccgcccgttttgtttgcggtagccgcatcagcttgccagttgcttgtttggtctttcccttgtgctggtatgtcagtgtcagacttgatccgacctttttagatttgatcgcattgacataggcatcagcggttgtatagtgctggccattcaattcggtaatcgtgtctcctaacgccagcttacctttgaatggcgactgcggcagcacggacatgacataaatacccaaatgttccgttttcactggcattttggccgctttgaatgctgccgcaaccgcgttatttgcggcacttttcatatagtaggcttgcagctgatcatactcagcgctactatcattgcccatcagatcctgtttcgacacaatatcggtgtgcgcttgcaccttactgagcaaaagtaatgccggagatgctggccctacgacacccactgtcgtcaacatataggcacccttggcatcatctttattgccactgactttaacgtacggcttcaaagattccgctgaaccgggcacttctagataataattggttgggatcaaaaagaagacagccaacaaaacgactgctattaacagtccgataagccaacgccagcgccgacgtttctgattacttggtttgatgagcgtcacctagtttcgcatacaaagctgcttcgacaggcgcaggcacaaaacgatgaacgtcaccgccaaaggccgcgacctctttgatgatggtactggataaggcatcatattgcttgtctgccagcaagaaaactgtttcgatttcaggatcgagatcatgattcaccgtcgcaatatcagcctcgtaaccaaagtccgcgacattgcggataccacgaatcataaactgggcaccgattgaccgggcaaattcaactgttaatcgtttaggcgctgccatggctttaacatttggtagcccagcggtgctttcactgatcagcgccaatttctcttcactggaaaaaagcggctttttgctcgtgttggtcatggctgctacaaccacttcatcaaacaaccgactagctcttttgacggtatcaagatgaccgttcgtgaaaggatcaaaactaccgggaaacactgcaatttttttagtcattgttttcctcgcttcgctctaaaattaagacctgcgccaccccataggtttggcgccgtagcttgatgtagccggggatctcatcaggataagtcacatccataccggtttcaactaaaacacgtgcgcctggccgcaacaaattagtactgataaacgccgcaagttgtgccaatacttgctgttgcgcatagggtggatccatcatgattaagtcaaactgttggccagcttccgcaaactggcggatagccttattgaccggctgcttcaaaacggtgaagtgctcaggctgtttggttagtgcaagattggttttgatcgttttgattgcggcgtactgccgatcaaccaacgtcgcgtgagccataccacgcgagactgcttcaatgcccaacgcaccggtgccagcatacaagtcgagtgcctgtccgccgtcaaagtacggtcccagcatgttaaacatggattccttgactttatctgcagttggccgggtttggttacctgccactgccgtcagccgcaatccccgaaatgctccactaatgacgcgcatcgtgatcacctactgatgtctcatcgccagccgaacttgggcgcaagcgacgttttggcttggctttcacctcaagatcctcttcagtcggcttaaattggccgatgttgctaccgaattcagtcgccaattctggccgatgggagggttcaacacgtttaacaaatcgtaatttactgagtttggcacttgtctgagccaactcgtcttgatccaaataaagataaacatacttcatgcggcgcgagacatacataatcgtgccatatcgacgcagcgtttttaattgtttgagggaatacacccaaacgacaagtccttgccgctgtttgatagcaaacattttttcaccttccaaactcactgcttggtcacaccgggttgaagcttggccagcagttcctgactcttaattaaggcgcctgcctccacgtaaagatgagtgacggtacctgcaaatggcgcatgaaccgtcgtctccatcttcatggcttcaatgacaaacaaggcatccccttgtgccacttcttgaccggacttaacggcaactgaaacaattttccctgccatcggtgcaccaatttgattacgatcagtcggttccgccaactgatgccgcaaccccgcgctcttctgatgcgcatcgcggatttgaacttcctgcttttgaccatcaacagtaaagtacagcgtcttcataccacttgcatccgcctcgccgatcgcgttgagctggataatcattgtcttacctgctttaatcggcacagacacggtttcgcctatccgcattccttggaaatacgatggcgaatccaacttcgtcaccggtccaatctgccgttgcttgcgggcgtatgcattaaagacatccggatacagaattgcactcaaaacgtcttctgtgctgggttcattcatcccggcttgtactaacgccgcgcgaacagccttcaggtcagccggcttcgccaattgccctggacgtaccgtcaacggtttttgccctttcagaatttttgcttggagcgctttcggaaaaccaccaaccggctgcccgagatcgcccttaaagaatgccacgaccgaggccggaaaatcatattgctcaccatgcgccaacacttcatcgggtgtcaagtgattttgcagcatgaacaacgccatatcacccaccacctttgaggatggcgttactttgatgatatcgccaaataaggtatttacctgggcatacatcgttttaacggcctcaaaatccgttatccccatgctacgtgcttgttgctgcaagttactatactggccacctggcatttgaactgtataaatatccgttagcggacccgtcacaccattactaaaatcggcatagtaaggcctgattgcctgaaaatagcgattcaacttctgcgccttttcaatggcaacatctggctgtcgctgattgccacttaatgcatagtaaagactttctagactaggctgactggtcgttccggaaaaactgctttgcgccacatcaacgatatcgaccccagcattagcagcggctacataagtcgcgataccgttaccagtggtgtcatgtgtgtgcaaatgaatcggcacactgaccgcatctttgagcgccgttactaactctgtcgccgcttgcggtttcaacaagccggccatgtctttaatcgcaagcatgtcggcgccagctgccactaattgtttggccagatcaacataataagctagctgatacttagggtgggcatgacttagaatgtcgcctgtgtaacacatcgtcgcctcagcaagcttgcctgtttgtttgacggtatcaatactgagcgtcatctgtggcaaccagttcaaactgtcaaaaattcgaaaaacatcaacgccatcatcagctgctttttgaatgaaagctttaatcacattgtccggatagttttgatagccgaccgcgttactgccacggaataacatctgtaacaaggtatgcggcaaggctgcccgcaattttttcaaacgggtccacggatcttcgttcaaaaaccgataagcgacatcgaacgtcgccccgccccatacttccatggaaaaaagatttggcaagccattgcccatatcctgtgcaaccgtcaacatatctcgagtgcgcatccgggtagcaaaaagactttgatgggcatcacggaaagtcgtgtccgttaacagcaactggttttgtgccttaatccaatcagtaaccccttgcgcaccgtcagcatgcagcaaggcaactaaatctttttgcggcttggcagcaggaaaatgaacatcatagtgcaattcagggtaatatttttgtgcctgtcgttcaacacctttgaacccattaaccgtcacatcactgatgtaccacagtaaccgcgaagccgtgtcgggctttgcctgaacttgcaagagttctggatgggcatcaataaacgcggtttctgcttcacctgtccggaaagtttctgtcgctaataagtgctcaaggaaagcaacattggttttgacgccggtgatttgaaattcatgtaaagcgcgttgcattttggctacggcagcggtgaaattcggtgcgtgaacactggcctttactaataaggagtcgaaataaggactgacaactgccccagcataggcattcccgacatcaaggcggatcccgaagccgcctggtgaccgataagtattaatggtgcctgtgtctggcatgaaattgttttcaggatcctcagtcgtaatccggcactggattgccgcgccattttcatgcaaatctgcctgctttggcaaatgcaagtctgcaaaaagatcggcgcctgctgcaatctttaactgtgactgcacaatatccacatcggtaatcagttcggtgatcgtgtgttccacttgtacccgcggattaacttcaatgaaatagtactggtcgccatcaaccaaaaattcaacggtaccggcattttcatagtgcaagccttgcattaaatcaacagcgctttggcaaattcgcgcccgcaaggctgttggcaatgccacagctggggcaatttcaaccactttttgttggcggcgctgtactgaacaatcacgttcgaagaggtgcaacaaatggccatactcatcgccaagaacttgcacttcgatatgtttggcggaggcaatgtacttttcaacgtacatccgatcatcgccaaaactagctttcgcttcattcaccgcattttgatacacggcctcaagttcagcttcagagtgaacgattcgcatgcctttcccgccgccgcctgatgctgctttaagcatcaccggaaaaccgtgtgtggctgtgaaatcctgaatttcgctaaaatcgcgtgtcggttccggcgtgccgggaatagtcgccaagcctgccttgtgagcagcttccttggccgcaactttatcgccaaaaatatcgagtaattccgaacgcgggccaacaaaaatgagcccggctgtccgaactttccgggcaaactcagcattctctgaaagcaggccatagcccgggtgaatcgcgtccgcgccactttgcttggcaattcggataatatcgtccatatccaaataggcagcgataggcgcttttcctgctccgacctgataactttcctgcgctttgaatcgatgaattgacaaagcgtcctctttagcaaaaataccgactgttttaagaccaagctcttcacaggcacgaaaaatccgaatggcgatttcgccacgattagcgactaaaactttatgcatgcgtcttctctacctttcgttgcgtacgttcactatgataactgatatttaacataatgccgatcgccattgacaggacgatcatactcgaaccgccgtaactgataaacggcagcgtcaccccggtaactggcaaaaccccagtcacagcaccaacgttgaaaacggtttnnnnnnnnnnagcatcatcgtggcaatgccgtacgcgatcaacgtgtgataggtgttcttggagcgaattccgatcagataaaaacgcatgatcaggaaaaacagcaaactcaatacgacaaatgtcccaaccaagccaagttcctcggcaatcacggccaaaataaagtcagtataaggctcaggcagatagcctaacttttggctgcccatgcctagtccaacaccaaacagcccaccgtgattgatcgcatacaaggagttaacaacctgattgccaaccgtattcgctttagcaaacggatgaatggcggccactaatcgttgatagccgtaattcttctccaatccgggaaaatgataatgcgacacgatgtagtagcccagtgctgtgatcgcgatcaacatcaagacccacaaaaaaccgtaacgcatcggtatcccgctggacataaccacgaccaatgtaatcaagaaaagaatggcaaatccaccggtatccggttcgacaaaaaccagaagcatgatcataccagcgacaaacaatggctgccacatctgccttagccgaaagtcctcttgttgaaagcgatcctcgcgcgatgtcagcatgtgcgccagataaaaaatcaaaatcattttagcaaattctgatggctgtaagcgaaacccgccaatcgtgatccatgcagcggccccgttaacggcgcggccgtgcacaatgagatagatcagcatcacaactagtccggccattaaagtcaacagaacccaacgattgtggaccaccttcaaggacatattataaaagaaaaacacagtcgcgataccgagcaggacaaacagtgcctgttgaatcaagtatttcgtttcggcaacgccatattgccgttgaacccaataagcgctggcagagtacaccatgacaataccgatcgcacataaaacgaggtacggaactaatatgaagtaatccacgtgccgtaatttattcatcaatgaaaacgcggcctttcaagcaattaatggactaattatagcatatcgccttcacgctccaagccgtgttctgcggtaatcactaaaaactgttttttcaggcggtcatttacaccaatacatgctgatttaacaaccgctcagtcgacaagttaagccttgtctaacaatcacaattattgtgatcaagacatcaaaaaagccgccttttacagacgactttttgaccaacttatttacttggatgcggcaattttcttgcgcttagccgctttttgacgttcgcctgtgttaaggatcttcttacgcaagcgaatgttcttaggggtaacttcgcagtattcgtcatcattcaagaattcaatggattcttcaagcgtcatatcttttggcgtcttgatggctgctgcgtggtctttcccggctgcacgggtgttggtcaaattcttgcctttggtgacattgactgcaatgtcattttcacgcgagttttgaccaacaatcatgccttcataaacctcggtgccagcattgatgaacaactggccacggtcttcaacggattgcagactgtacgtcgttgctgaaccagcgttgatggaaaccaaagcaccttgtgtacggcctggttcccaattcttgataaccggagcgtatttttcgaaggtatggttcatgatgccgtaaccaccagtagcagagagaaattcggttgagtacccgatcagaccacgagaaggcgccaagaatgtcaaacgggtttgaccgttgccttcgttctccatgttctgcatttcgcctttacgttggctcatcgcatcaatgactgtcccagtatattgttcaggagtgtcaatttggacgctttcgaacggttccatcatgacaccatcaatgtcacgatagataacttcaggacgacctaattgcaattcaaagccttcgcgccgcatctcttcaaccaaaattgaaagatgcaattcgccacgaccggaaaccatccaggcacctgcctgatcagtgtcgtcaacgcgcagggacacatctgtctgcaattgcgacttcagacgctcctcaagtttacgagcagtcacatttttaccttcacgacctgcaaatggactgtcattcgcaacaaacatcatctgcaaagttggttcatcaatccgcaaaatcggcaaagcttccggcgtatcagctgccgtcaccgtttcaccaacgaagatgtcatccatcccagaaaccgcgatcaaatcgccggctttagcagagttgatttcggttcgggtcaagccaaagaaaccaaagagttttgtcacgcggaagttcttttgagaaccatccagcttcataacggtaacattgtcgccgattttaatcttgccgcggaaaatccgaccaatcccaattcgaccaacgtaatcgttgtaatcaagcatcgcaacttggaactgcaaaggttcgtcactgttgtcgatgggtgccggaatggttttgacaatggtctcaaacaacggagtcatggtgtgcttttgcgttgacaaatcggaatccatgctggaagtgccattgacagcggaagcataaacaactgggaattccagttgtgcatcatcagcgcccaattcaatgaacaattcgagaacttcatcaacgacttcttcagggcgcgcacctggacgatcgaccttgttgatgacaacgatcggtgtcaaatgctgttcaagcgcctttttcaagacaaaccgcgtttgcggcattgggccttcaaaagcgtcaacgacaagcaaaacgccgtcaaccatcttcataacccgttccacttcaccaccaaagtcagcatgccccggggtatcgaggatgttgatggtcgtatcgccgaacttaactgccgtgtttttactcaggatggtgatcccacgttctttttcaatggcgttggtatccattgcccgatcctgtaattgaatgtgttgatcaagtgtatctgattgtttaagcatttcgttaaccaatgtggtcttaccatggtcaacgtgggcaatgatcgcaatgttgcgaatatcgtcacgtgttttcacgatttatacttcctttctgctggcactactggccgcctaccgcattaaaaaagtgccagcaactgacacagttatacgatttgaaattataacacacaatgacaagtctgtctggattttctgaaaagtgaagtgcttcacgcaatcacagaccttgcattttcttataaagcgggctatcacgcgacccttttattaagaaaaaaactggcgccacttagtttgcgccagaaatcatgatttgtctattggtttagcttaagcctctttgccgccatccgccatcatcgtcaaaatcgtttgatgtgcctttggtgtagcagcaaccacaacgcctggttgctgcaagttgattggtgcgccatcttcacggctgaaaacaacgccaagacccttagtaatcgccattccagccgctacgtcccacggctgtaagtaagacacatacccgatctgtcgacccagtgcaatttcgatgaattccattcctgcactgccgctcattctagcgccagaactggtcaacgcgatatcgcctagatgcaaccgattcttaatcgtcatcgggccattgacacctaacaagccatctttaagcggcaagtctggcaaaaccttcacttgttgtccagcatgggtgacgggaatcattgggcccccgctaagcacttcatttcgcatgacgtccataatcgcgccgacaacaggttcaccgtcctgataaacaccaatcataatggcaaaatgggcttgttgtttgacgaaattcatggtgccgtctattggatcgacaaagaagacgagaccagctaaatcagtgtcatcgtgctcatgtccttcttcgccaatgataccggcttcaggatacgcctctctgattttgccaatcaaaaattgttgattcgccttgtcgacattggtgaccaaatcgttgcgattacttttggtggcaacatctaatggggcggccattgcggttagaatttgtttgcgactagcagcaaaccagctaataatcgtttgccgcaacatttctggatcttgtgtcatggttaactcacccttaccctaatcttttggctcacgcctttgcgggccatctgtataacagtatacatggaataaccggacagtgcttcaaactcccgatccaatttgcgctcggttcctttatctggcacaacttccttaaatccacggtacgctgcaagcagattatcacgatcaacaccgtgttcatatgcatcttcgactaaggtataaaaggtcgtgacttttactttttctgcagttgtccagtcaatgtcgagtggataggcataattaggtttcatgtttactagctccttgttctatcgccttaatttgatcctgtacagtttgtttcgtttgactcaacgcagcttcctcatcatccgaaccagcaactgtggcgagcgtcacaacgccgctatcattcaagaggactggcgaactataaacctgacctgtgtcatcctctacatccatcagatgcgtcagcgtgccaatcaaactatcgccactatacgccgcaataatcggaatcaccaacctgccaagcaagacagtcaagggactcctcaaaaagcttcgaaccgcatccaagccatcagtaaaaatcgtctgatcatttaataagcgcaaaaccggcgttgcaccaacgtaagctcggctccaaatcaacactggggcttgtcgcgtacctaccacataagccgtcacatgtttcgccggtactgccaacctagcagccagaaattgttcaaatcgccacgttgcaccaaacgtaccaagtccaacaacctgacttttattcactccggaaaaacgttgcgcaaaatacgtaaaaagttcatcacgtgtcatcgcaacaatgattctacctgtgaagcccgccgccatcgctgaattgagaactttgcgaattgccgcaatattcgtctcaataaaatcatcggcatcaggtgaccccgtatcggtcaagattaaaatatccgctgcttttaaaactttcggcgtgacttttgcaaatgtgttttgacatatttgacttaaagctgtcaacccaaccatatcaatcaatgattcatctggttcataacaacccaccgtcaacagcaactgtgatgcaatcaatgtttctaaaagcccttgggtcccgatactggcaccgctcaccacgactctttgcatgaaaacccttcccctccactccattagttacattttaacggaagcagaatcttaagacaaaattaaaaaggggtttagacgcaattgttaactaactgaaatattagccgtttctcatcttcttgtaaaaattagctgttgccatgctcacagcattcgccattagcgataaccaaatgacacaaaaacagcctgatcaagaagatcagactgcttcatgacatctctatcagatactaaatattgattgggagtcccaatgcaacttcagcatcatccatgataacttcactcagtgttgggtgcggatgaatggtcaaggccagatcctcaacgttcaaaccgccttcaacagcaacggtcagttcggaaatcaaatcactagcaccggcgccagcaacttggccgccgataaccgtaccgttttcattagtgaccaagcggacaaacccttctgtctgggcaagactgagggcacgaccattggcagcaaatgggaacttgctggctttagccttgatccctttatccttcgcctcggcaactgtcatcccagttgttgcaagttcagggtccgtgaagcaaacggcaggcatcgctttgtagtcaaccgcactggctttgccgctgatggcctcagcagcgactttaccttcatagctagccttatgcgccaatgctgcacctggcacaatgtcgccaatcgcatagatattcggtttgttggtccggccttgagcatcgaccttgattaaaccgcgatcagttgtttcgaccccgacaatatcgagaccaagatcgtcagtatttggccgccgtccgaccgtcaccataacataatcagcggcaatcgtctgttccttaccatcggccgtgtacgtcactttgacacctttgccagtgtcttcagcttctttagccatcgcattggtaataactgttacgccacgttttttgaaggaattcagaactagctgaaccatatccttctcaaagtttggcagaatcgaacttgtgccttcaagaatcgtgacatgcgcgccaagattagcatacgcactcgccaactcggagccgatatagccgccgccaatgacgacaaattcttttggtacttcaggaagattcagaccccctgttgaatctaaaatgcgcttgccaaacttaaagcctttaatttcgattggccggctgccagtcgcgatgatcagattcttgaacgtataggtctgagctgaatctttttgcatcacgcgcaggctatggtcatcttttaagaacgccgtgcccataatcgtgtcaatcttgtgtttcttgaatagcatcgacacaccgcttgtcagcgtatgcacaaccttattttgcttccattcctgggttttcgtgaaatcaaggtcagcacctttggcattaatgccaaacgtacttgcttccaaggcgtcttgatagcgatgacctgcgttgatcaaagcttttgatgggatgcagccgacattcaaacaaacaccgccaatgaacgtgctctcaatcacggtcaccttttgacccatttcagctgcgcgaatcgcagcaacataaccgccggggccggaaccaatgacgacggtatccaaatcgattgcaaaatcgcctacaaccatgcttatccctccatcaacagcagatcaggatctgccaacaatttatccatcagattcaaggcggtttgtgctaacgcgccgtcaatcaaacgatggtcatagctcaaacttaatttcaacatgttgccaaccacaatttcgttgtcttcgttgacataaggttccttagcaattttgcccactccgagaatcgcaacttcaggttgattgatcactggggtgaaccagccgccgccaattgacccaacgttactgatggtcatggagccaccgcgcatttcatccggctttagtttgctgtcataagccttctgggcattttcactaatttccttagcaatttcaaacatactctttgcatcggcattcttgatcacaggcacatacaagccgtgatccgtattcgttgcaatcccaatgttgaagtaatgcttatagacaatttcatccgttgtatcatcaatggacgcattgaattctggatattcacgcaacaccgtcacaagtgctttgacgatatacggcaggaaggttaacttgatacctttatcagctgcgtattgcttgtacttcttgcgatgagccattaacttagaaacttcaacgtcatcaaaactcgtcacatgcgggctacgttgcttagaagcaagcatcgccttagcaatcgctttccgagttggggtcatcttttcacgggtttcaagttcagcttcattaccactcgaaacgtatggtgcaactgcttgcggctttggtgctgccggtgcagctggctttgctgtggctggttgcggttgtgcctgagcagcaggggctgctggctgtgcagatgcagctggtgcgcccgtcttgaatgcctcgacatcagccttggtaatccggccatgtttgccggttgctggcacttgtgagatgtcaattccctgttcgcgtgcatactgacgcacagatggcattgctaaaatttcccggttcggatcggtgatggccggcacgccacccgctgctggtgcagctggcgtcgcagccggtgttgcagcaaccggctgcggtgcagtaccagcctcagtagcaaccgatgtgtcattatgacccggtgcatcaatatcaaccagtgcttcaccgactgtcgcggtttcgccttctggtaccagaatcttaacaaccgttccggcaactggagaaggaatttcttcaacactcttgtcgctttgaacttctaacagcgtgtcgtcctctttgatttgatcgccaggcttgactgaccatttaacaatttcgccttctgccaaaccttcgcctaattcgggtaacttaaactgataaaccgattgcgcaggtgcaggttgcacagcaggcgttgctggagcgggtgtcgcaggggctgctgttgcagtcgcaggtgcagccggtgcagctgccggtccggagccatcatcgatttcaaccaatagatcaccaactgacgcggtttccccttctggaacaagaatttttaaaattttgccggagaccggggatggaatctcttcaacacttttatcactttgaacctcaagtaaggtatcgtcttccttgatgtcatcaccaggtttgacgtcccacttaacgatttcgccttctgccaaaccttcgccaagttctggcagtttgaattcaaaagccatgttggcacctcttctttctagaaattaacggtttcccggactttagcttcaatatccttagcatttggcagccaaatgttttcagcttggccaaatgggaacggggtatccggagcggcaacccgaccaatcggtgcctcaagcgacagaatcgcccgttcggaaatctcactgatcaccgttgatgcaacaccggccatgcgttgtgcttcttgcaccacaacaaccttatgtgtctttttgaccgaattgatgatcgtttcgacatcaagtggcgcaattgtccgcaagtcaacaatttcagcctgaatcccatctttggctaaattatcagcagctttcagcgcttcgcgaaccatcgcaccatacgtgatgatcgatacatctgaaccttcgcgggtcaccgccgctttgtccaacggtaccgtgtacgtgccctctggaacatcttgccggaaggaacgatatagtttcatatgctcaaggaacaagacaggatcattgctccggatcgaactaatcagcaaacctttggcatcatatggattgcttggaataacgacacgcataccaggaaattgcgcaattaacccttcaaagttgtcactgtgcatttccggggtgtgaacaccaccgccaaaaggcgcccgaatcgtgatcggcattgagcgagtgccgcccatccggtaacgcatccgtgacatctgaccaccaatgctgtccatcgtttcaaaaacgaatccgaaaaactgaatttcaggaattggccgccaaccggtcaatgccaacccaatcgacaaaccgccgatgccagattccgccagtggggtatcgaaaacccggtcctcaccgtattttgcttgcaaaccatcagttgcacggaaaacaccaccgtttttcccgacatcttcgccgaataccaaggtcttagggtcgttcgccaactcaacatcaagcgcatccgtgatggcttggatcattgttttttgtgccatggttacttcgactcctttccttgaaattctgccagctgttcagcaacattttgcggtgcggtctcgtacgtgtcctttaggaagcgggataccgtctgctgtggtgccttatcagctttgttaattgcgtccttaatttcatccttaacttgatcaattaaggcgtcttccttatctttgttccaaagtcccttatcagtcaggtagttccgcattcgaattaacggatcgcgcttttgccataactcatctgtctccttggaacgataacgcgtcggatcatcgccagataacgtatgtggcccataacgataggtcagcgtctcaatcaagacagggccattaccagcggcggtccatgcccgcgcttcttttgtcacttcatagacagctagggcatccataccgtcaacttgcacacctggaataccagcagcaactgctttttgcgctaaagtcttcgcagccgtctgactggctcgcggtacagaaatcgcaaagccgttatcttgcacaataaagattgctggggctttgaaatgaccagcaaagttgacaccttcgtagaaatcaccttgtgacgtgccaccatcaccggtatacgtgaaggccacttcatcactgccattcttctttaagccgagtgcaacgccggctgtttggacgtactgcgcaccaataataatctgaggcggtaacgcgtgaaaatcttctgggtattcattaccggcaacatgaccacgagaccataagaatgctttatccagtggcaaaccatgttgaatcaactgtggcaagtcacggtaagcaggtaacaaccagtccgttgttttcatggccgaatggctgccaatcatgctggcctcttcaccagcgcttggcgcataaaaacctaatcgtccttgccgattcaacgcggttgctcgttgatcaagaacccgctgccaaaccattttggacatcaagtcgaccaactgatcatcactcagatcgggcatgatatcaggattgacgacctttcccgcttcatccagaatttggatggtcggcttaaaatcggcatcttgattttccaacagtttcttgaaatcaactgcagcatgctgttttgccataatcagaacctctttccattcctgttgtcattaacgcaggaaaactgtactaatgaaaatctttacaaaccaagcgtaacattgcggttttatccttgcaagcgttttatttcagcactggcgggaatccttttccgagcttgttgtgcctcattttttaacgaatgggactataacagaaccttataaaaaataagacacaaaaagagcacgtcgcttcacaagcgcgtgcctcttttaatggattcattcatcgtgcttcacgagaccggatcttggttgtgccgaaaatcacttgttttactgtgatgtttcatggcgccaaccaaggtggcgtgttgggcaaggtcggcatgtaaccgaacctgctgtgcacgatttacttgtttacttcttaacaattcacttgccaggagtgatacagcaatgccggatacccgaaaaatctgttttagcgcaaggacaaaaccaactgccgcactcgttacaagtgaagctggcgcatgattttccgtctttccgttcaattgtgcaaaggcatggtcgacaagaccatcacgcaaaaccgccgtgacggttgcttgggcatcggtcgccatcacagcgccagcaatgcctacccccgctggtacctgccgaccaatcaaagccagcagcccggccaaatcacttggcaaggaaacgtgtgcatcgggagccagcgcaacgtcaacaggcagtttttctcctgtcgtcaacatcagcacgtcaccgacgacgaggtcatttgcgctcacttggcgaaccaagccctcgcgtacaaccaaaaccgtctgtttgggatcgccctgatgtcgggtagcagctgtgagcagataaacgatcacagccatcatcatactaagcaacacgccgataacaactgtaagaagccagttgcgagtgatcacactgatcaagccactgacaccggcagtcatgatcaacaacggtaagaagagacttgccttgttgatcgtattaggacgtggtgtaactgtttgttgggccttttgcgcttcgtagcgtgacaggccactcgaaaccatcatcaacatcgacaaactccttcccgtttcccgagaaggaccgcgatgctgccaaatccattaatttcacttaagagatcgtagcggcagcacaatgggccttccgggatcagctaaatcgctactactaccgctactctttgaagattgttccattatgctcaccaccttttcctcagcttttcattaggcaaaaaaattgcacgccgattgagagcgtgcagaaaaagcatcccaatcgtttagttttagcactatacgcctagaagcgagcttcagctgcattagcgtaagccttaatgggcagacgcagttgactcaattggcatctctcgatgtttctgagcagcagcattgttcgtataggagcctcacctaacggaaagcaccgtatttgtttaaccttctatatagtagggtaaaaaaaaccgaatgtcaaatgtttcaccgaatcgagcacagctgaacaatcatggcgattcaaaaaggttgttggttagaacataaaacttgcgaatcatcaattagacaaaaaacattttgtatttgtctttctaagtgatacagagctattattttttctgtagctttatgaatcgaaatagcgtgaatgccttgaaaatgagcaaagcttcaaaaatagtttttttcttgcttatcacccagacacagaaaaagtttctgctattgcagcatttaaggcaaacctcttgcacgcgaagcttttcagccttctggtcctgtgctaatctagtagaagaaatgaacggaggtacagattgtgtatttgatgaaggatatcacgcgcgatggggccaaggtcctgcgtgaaacggcaaagccagtcacgttcccactttctgacgaggacaagcaactggcgcatgatatgatggcttacttggtcatcagccaagatgaagaacaaaacgaaaagtatcatttgcgtcctggcgttggactagctgcgccacaagtcgggcaaagcaaggcgatggctgctgttttggttcccggtgacgataatgaaatcctctttaaggaagttttgattaatccgcggatcatcagcaacagcgttcaacatgctgctttggctgaaggcgaaggttgcctatccgttgataaagatgttcccgggtatgtcgtccgggctgatcggattaccatcagttatcaaaatgaagccggtgaacataaaaagattcgtctgaagaactatccggctatcgtttgccagcacgaaatcgatcacttaaatggcgtcctgttttacgatcatattaataaggaacatcctttcaccatcgacccggatgccgtcattatcaagtaaaatacgtttgtactaaaaagaaggcttaaagccttctttttttgacactatttttcacccaacttacgattctttatacacaaatcgttgtccctgcaaccatgccgttaagtcttcgtactgtcgtcgtgataagcgggtgtcccgccatgttgtcaaaagtgctttagctgccgaaaagccattttccttcacttcggttatcagttttgcttgatagctggccaagctgacttccgcatcgtggaaaacgacgactggatcatctgggcgtcgatctttcttactcatcgcagcgcctaatccttgggcaaaacttttgatctgacgcatcaataaatcctgatcatcgttcacttgaacccctccattcggcactttctaaaattaagcaacgcgattcacatcgcggacatattctatggtagcctcattagcaataaaagcgagatcaacatgttgctgcccctctagttcaaagtaatccgtgatcacaaaaggcggtaatgccggatcggaactggcaatatccaattcttcagccgctttttgcaaagcgtcggctaattgatgctgatcaatggtggaaaagctcttggggaaaatataggagaacgccatcacaccatgaccccaaatgtccgtaattggttttgaagtcaaaggttcttggacagggattttaagtgatgttaaagcagcatccatgacctgatcacttagtcgctggctatgatgaagcagaatttggattgctttattacgccgccagcgcttcctgagcacccacaaaacgatgagcacgatcagaactagaacaacgataagccagaccacaacgtccactcccttcaaaagccaatatgttattgattcttacctttattatacccagaacaaccacgctatcgccaatgtgattcttgcaatcgaaggttagtttaacaataatagctggtcataaactcgtgggcatcatctggtttgattcctaagagagtactaggatcagtgtgccagccgcattagcaccaaaggatagaccttacaattgccgcataaccgcggtcgccagttcagaaacctacgtataacaaccttgaacgcaatggcctcaatccggccatcacgttgaggagcactgacactccggtttttctaaccgggctggttcacgctctggtctgttcacaccgtttcaaatatgatagactgttgctagctgttgttttcacaacaaatcgatcggtcataaagtatttaggagttgtgacagaaatagaacgacgaaatagcgcaggtatgcctgttttcgggttcgaacgacgagaaatatcggccatcccaataagatagaccatgtctgttgtggttttccatcttgatggtatgtcctttttttcggaagccgttttgttgcacttcctttctttttgtaccacggaaggagtccatcatgatctacaaagtcttatatcagaaagacaagattcaaaatccacgacgggaaacaacccagacgctttacctcgaggcgccatctgcggttgaagcgcgtgcgcttgttgaaaagaacacgccttataatattgaattcattcaggaattatccggaaacttcctggaatacgaggaaaagtcagccaactttaagctgacaactttctaattatatgaaattaaatattaagaataacgaaaccgccgtctttgctgtcggcggtttaggtgaaattgggaagaacatgtacggggttcaattccaagatgaaatcatcgtgattgatgcagggatcaagttccctgaagatgatctgcttgggattgattatgtcatttccgattattcctacttggttcaaaacaaagacaagatcaaagcactggttattactcacggacatgaagatcatattggtggtattccctacttcttacagcaggtaccgaatgtgccaatctacgctggtccgttagcagcagctttgattcgtggcaaacttgaagaacacggtttgttacgcactaccaaattaactgaaattaacgaagacaccgtgttgaagttcaaaaaacttagtgttgagttcttccgcacgacccacagtattccggatacgctgggcatcgcggttcatacaccgcaaggcatcgtcattcaaaccggggacttcaagtttgatctcacgccggttggcgatcagccatcccctaacttccaaaaaatgtgccggttcgccgaagaaggcgtgctggtactgatgtcggattcgaccaacgcggaagtaccgacatttactaagtcagaacgatttgttggcaagtcaattcgccacatttttgatcgaattgatggtcgcatcatatttgccacctttgcgtcaaacatttcacggatcgcccaagcagctgatgcggcaatggcacacggtcgtaaaatcgctgtttttggccgttcaatggaaactgcgatggtcaatggccgcgaacttggctaccttaacatccctgatgacgtcttgattgatgcccatcaacttaattcgatgccagctgataaagtgatgatcctctgtaccggttcacaaggcgaaccaatggcagcgctgagccgaattgctaatggcacgcatcgacaaatcagtattcaacctggggataccgtcatcttctccagcaatccgattcccggcaatactgtcagtgttaatcacgtgatcaatcagctaagtgaagctggtgccgaggtcatccatggcaaggtcaacaacgtccacacttccggtcatggcggtcaagaagaccagaagcttatgttgcggctaatcaagccaaaattctttatggcctgccatggtgaataccggatgcaaaagattcattgcgaacttgcccaacaatgcggcgtccctgaaaagaattgctacattatggaaaatggcgatgtattagcccttacgcaagatagtgctcgaattgccggtcacttccctgctggcgatgtttacattgatggtaatggtgtcggcgacatcggtaatgctgtcattcgcgatcggcgcatgctgtctgaggaaggcttggttgtggtcgttgccacgatcaatatgcaaaaacaagcggtcttagctggtcctgatctgctttctcgcggcttcatctatatgcgtgaatccggcgagttaattaatcaagctcagcggcgcgtctatcgcaccattaagtcaaccttctcaagcagtgaaaaggtgatggaagctagcttaaaagatgcaatcaccagtaacttgcaagaatttttgttcgacaaaacagaacgacacccggttattttaccgatgctgattttgctctaaattccggtcagatagctggcaacgtcactcattaactgaaaatgattaacagtcacgcgacaaccacttaggtgcttgtcgcgtggcttttttattggcatctattgccaaaaatcatgattaaaatcctgttaccgccttgctaggtgctggaccaacactttgctggttcgtagtcatctgcctcttcaaaaaatgttcgtttgatgacaataaggtcgtcactgttccattgtttttcgccttattttcggtataattgagtgcgtgtctattaggaggaaagctgatgacggctgttttttattatattatctataatccggcggctggcggtggttcgtcgattccaatttataaacaagtgaaggccgttttggatcagcgtcatttggcttatgccatcaaaacttcccgctatcccggacataccaacgtgatcacaaagcaaattggtgatttcaatcgacgtgagcatccggttttgttagtcattggcggggatggcaccttgaatcaagcgatcaatgggttagctggcacacgccagtcggagattcctgttgcttacgtaccagccggatcgggtaatgatttcgcccgcggtatcggtatgtctgaagatccgatgcatgcgctggaacaagtattacaggctacagaagcggtcacgattgatatcgggcgatttcatgaacgcacccgcggcgaaagtggctatttcgtgaataatatcggtattggatttgacgctgccgttgttaacgctgctaaccgcagtgatagtaagcaattgctcaataggctgcatcttggtaaactcacctacttatttcatgttgtcggtatgctgatgactcgccgtcccttcccggttgccgtctatgaaaaaggcgttcgccatttttttcaccgcgcctatatctgcaccaccaccaacattccttattttggcggcggcattcgtctttacaaaccggctaacccaaccgacgggaaacttgatctcgtgattgttgaatggtttaatatcgtctcatgggcgttggcgatgattcaactcatgcgtggtaaaaaaccgacaagtcgggctactcaccttttccacgcagacaagttaacagttgagaccagttcgctcgagtttggtcagatggatggcgaggaaatggggacacggccgtttgaaatcgacttctcaatggccaaacaaaaattttggattgatcgcagtatttaaaccgatcaaaaagcgctgtaccgccagttttcttctggtaggtgcagcgctttttctgtgattgaacatgacgatcaaaaataatctgaaaaataaggttcttccattggaatggcattttccagcaacttaatcgcatgcttactagcaaaaagtcgttcaatctgggccaaatacgatggccgccgataactcatcaacatggttgttagggtttggatatctgtttttatctcttcacccaccggtcgatcagtaatttgaacttgatttttttcgtcccaataaaccccaaaggtcccattgttccacggcgccaaaggatcagttacgacaaaatgaaacgactcaggcgtttcagccgcaaacggatactgcttcagaaaagccttcacatccacaatccgggccataaagtatggtttgatcgtctgatagatatcaccatcatctaacaaaaagtgcaacggttcatttttgtaaatgttacctttaacgtgcgtcaccattgaaaaatgagcacttataaagttccataagccgactcgggcttcttggttggtgtaaatcatttccttgacgtggaaaacctcgtcggcaatccaataaagaacatagccttgtggttcatcgttggcgtcataataaacaccagccgtacgctcctcctcgttttcccaacgccagtattcgtcccaattcaactggttgcggatcatcgccccatgatttttcatggcgaagcgattatacgtttcaatcacatcaggatcatcgatttccagacgctcaacatgtccgggcacattcacctgtttaggtaattgtgtgtctttcacgtcaaaggtgagatgatcggacatgatttcccatcccttttttcggtaaaaagggatgctgtaaggatataaatacgaaatccactgcttgtggtcacgcatatgctgcaagccaagtcggacaagatcgtgcatcaaaccgtggccggcatactctggatacgtgccaacccctgtcaaaccagccattttgtataatgtgccgtgaatattcactgtgcaaggataaatggccagtgaactgacaagctcatctttgtgaaaccagcccaaaacatccgatttctctaaaactggacgcttagctcgttctaactccccttcctcataaccggattgttccaagtccttttgagtcacttgaaacacataagttaatagatcgttgaactgctcgagatcctgaggcgtcactggcttaatcaccagtgacttgcgtatgttgtcctccatagctagttaattctccttcgtcataaacatttgcggagtgataccatccatcccaatcataggatcgattcgttgagaagccaccaaggcaggcgttaattggtgcactgccggtggttgttgtttaacttcattatccaagtcaagtgcagttgtgtcaatttgcggctcactgggacttgctgaaatatccttggttgctgaagcatcagcaacctgaggggcaacggttttgccaaatacggtcatgagccgatcgaccagcccagtatgtcgattaacggctacttcactgactgcttcctgaaaggctgccagttcgccaaccaaaatcaaaaatgatttagcccgcgtaatggcggtgtacaacaagttacgtcgcaacatccggcggctttgcaaggttagcggcaaaatcaccatcggaaactcactgccttgggctttatgaatcgaagtggcataagcaagcgtaatcttattaaaatcactgcgtttgcaagtgatttcattgccgtcaaaatcaatcgttaattcgtccgttttgctttcggcttccttgcccaaagtaatgccgacaatctgaccgatttcaccgttaaaaacattttggttgggatcattgaccagttgcaacaccttatcaccaattcgatattccgttgctccaaactgaattgctttcgttcgggcactgcgttttggattcaaaatgttttgcagtaacggattcaaacgatcaatgccagcggttccgcggtacataggtgccaacacttgaatatccgcgatcgagaattgtttgactgcggctcgttgcaccacttgtccgacaacttcaggtacctgactaggcgcacacgccaaaaaactgcgatcaacttgcggcttggtaaaatcatccggcaacttgccagcattcactgcatgcgctagcggaataattgaactgtcggcatcctgacgatgaatatgcgtcagcgctgtttgcggcagcacgccgctgcgcaataaatcagcgaatacttgtccaggaccgacacttggtaattggtctttatcgccaaccaagacaattttcattccgggatgtaatgccgttaaaagcgtccggaacaagtaagtgtcaaccattgacatctcatcaataatcaacaggccatttggtaactcattaggtgcaaattcttgcgtgtcaacacctaaaccgagcaggcgatgaatcgtactggctggcagttgggtggtctcactaatccgtttcgctgcccgcccggttggcgctgccagcatgattggaaatggctcgtcagtcgtatactgatcaagatccaatgaaaggtcatgcaaccgtgcatacgtccgcacgataccatctgttactgtggttttcccagtacccggtcctccagtcaacagaaaaatgggcgactgtaacgccgtgacaatggcttttctttgtgtcacatcatacgcaataccggtatccgcctcgaccgccgctaacgttttttcaatctcagccaattcaggttcagtggccgttgcgtctgcctctgccagtccttttagttgccgaccaatctgccattcagcatcatataatcgtttcgggaaaatgcggtcgccttctgcaatcagggcgttgtctttagccagcgtcacaattgcctgtcctactgcgtctggcgaaacggcaacgtttctcgcgcgttccaataaatcaagtgtctgagtgaccaatgacttcagcgtcacataggtatcaccttcgccatcagtcaaccgctgcagggtatccatcactgcaccgccaagacgaagctgcgaagtcggtgcaatcgccaattttgccgcaatctgatcagcccgagtaaagccgataccatcaatatcgttaatcaattgatacggattgtgcttaatcacatctaaggcgtcattttgatattgttggtaaatacgacctgccatattgctagtaaagccgtaatcgttaagaccaataataacccgttccatgccttggttcgatttcagattcgtcgccaacatatcacgcttggcagctgtcatgcctaagcctgccaaaaccttcggatcatccagaatcttgtcaatagcatccatacccaaatgatcgataattttcgttgccgttttcggaccgatccccgggaacttatccgaactcaaataatcgaccagcccacttttattcgtcggctgatccgcatggtaattgtctgcttgaaactgctgcccatacttaggatgatccacgacatgcccagtgaacgtgtaggtcgcatcttccttaatatcaccaaacgttcctgtcaccacaatatctgactctgtccaggtgatagtcgtcgcagagatttcgatcagaagaattttaaaaaaatttgttggattctggaaaaagatacttttgacccgaccggtgacagtctcctcacgcgtgtccatcttgaccctcctgcaatcgcaagaatcggttgatatcagcgacaatgttagctttttgatcatacccttttggatcgagtgccttggccttgttcaaataatgactgccatctttaccagcggcgctcagtgccatgccgtacgtgaacagaacctgtggctgttcggttgccaacaatgttttcaacactcgggctgctgcatcaaatacatcgtttgccatcagcaaatcagctgctaaaagggcggcatcgagctgctttggcgccaagtcatgcgccgttaatgcaaacgccaatgccttcgttggctggccagcttgttggtagcttaaagccaacatgtaggtagcatcatttttcaaagtctggtcagttctaaccttggcaaaccatgaaactgcagccgcaaagtccgcttgagcatacgcaaacaagccagcggtgtattgcaattccagatcctctggaaaaagctggcgcgctttggccagcaattcaccggcctgatccagcgctttgatactaatcagcattgttgccaacatcgcatagcgtttcggatcatcaggggcagcatcaatggctttgactgccgcttgaatcgcctcctcatgcttgccttggttgaacatggttaaaatttttgaatccatttgaccctcttatctcgttgttgacagccgtagcaactcaaatcgtatccgttgcttttggcggttccggtaagaaactggtttcattccaatccagcaaggtaaacggcaaggtcggtccatctgcgtgcaaaatggtcacactgctattggtcaaacctccgtctttgcgaatatccgccagtggtgtgcccaacagactttgaatcaccgcagcgagtgcggccccgtggctgacgtacagcgaattagcctcaccagtgcgatccatggccacagtcgccacgatcgccggaatagcccgattaatcagttgtgaaaaagattccccatgtatttttcgtggatcataggctgcaggttcatgacgaaaggcatgcagctcctgaggaaaatgcttacctacatcagtaaacgtcatcccttccattttaccgagattgaactcccgcaaagctggcataatggtcaacggaattgactcatccaaatctttaatcaaggtttgggcagttgttcgtgcacgctttaatggactgacataagcatgcataaaaggaattccttgcaaataaccggccaacgccttaatttgcgcataactctccggcaataacggcgagtccccattagctccttgataacgtccttgattattccattctgttttgccatgacgtacaaaatacaacttcgtcacaagtcaatcccctttagtcacagccaatgattcaaaagtcccaatcaatgaccgtactatcctttcgcatcttaactctttcattatcgagattttgaaggaaaatttcaagcagagcgtgagcaggcgcggttagaaaccggagcataagcggccttgaccgtgatggcccgggtttggccattgcgatcaaggtccttatgtgcaggtttctgcgcctgcgaacgcgttttcagacaagagcgtgagcaggcgcggttagaaaccggagtgtaagtggccttgaacgtgatggcccgggtttggccattgcgatcaaggtccttatgtgcaggtttctgcgcctgcgaacgcgtttcagacaagagcgtgagcaagcgcggttagaaaccggagcataagcggccttgactgtgatggcccgggtttggccattgcggtcaaggtccttatgtgcaggtttctgcgcctgcgaacgcgtttcaagcagcaatcagccgccgctatgtaaaaaagccgacataatcgccgactttctttttgcactcagtttaattaaacgtactgtaactcattcgtgtgtgcgtatgcagcatctatggttccaccacccaagcactcgtcgtcgtcataaaagacaaccgcctgacccggtgtgattgcgcgaactggcacgtcaaagtcaacggtggcggtgccatcatcatgataatgaagcgtcacccctgtatcccgctgacgataacggaacttggccgtcatgtgggtgccttctgccggtgcctgaccagtcgtccagttaaggttagaagcgctcaagctggtggccatcaaggctgggttgtcaaacccttggccgacatacaagatgttcttgtctaaatctttgcctaccacaaaccatggctcagaattatctgagttaccgcctatgccgaggccttggcgttgaccgattgtgtaatacatcaagccatcatgggtacccatctcgacaccatccaccgtcatcattttgcccggctgagctggtagatacgtgctcaaaaactgcttgaaattgcgctcgccgataaagcaaataccagtcgagtccttcttctttgccgttgccagtcccgctgcctcggcgattttacgaacctcgggtttctgcaaatgaccaatcgggaaaagcgacttcttaagctgatcctgtgaaagctggctcaaaaagtacgtttgatccttattgccatcagcgccgcgaagcatgtgcacgatcccgttttcgtctgtcttaacctgcgcatagtgacccatcgcaatataatccgcgttgagctgatcagcgtagtccaagaaagccttaaatttgatctccttgttgcacatcacgtcagggtttggtgtgcggccagccttgtactcatcgaggaagtattgaaaaacccgatcccaatattccttctcaaagttaatcgagtaatatgggatgccaatttcactagcaaccttggcgacgtcctcatagtccgttgttgctgtacagacgccattttcgtctgtgtcgtcccagttcttcataaagaccccgacgacatcataaccttgttgtttcagcaacagcgccgtgacactcgagtccacgccgccggacatgccgacaacaacacggatgttggaattgtccaaaacaatcaccatcatttcatcagattctggagatatccgatttgaaggtcgaattccagtaaaaaccattataacagtgaatgatgagatagcaactgcaagagcgtgagcaggcgcggttagaaaccggagcataagtggcctcaagcctaaatggctggtctttggccatttaggcttgaggtccttatgtgcaggtttctgcgcctgcgaacgcgtttcagcaagagcgtgacccaccccggttagaaaccggagtgtaagtggccttgggtgtgatggcccgggtttggccattgcatccaaggtccttacacgcaggcttctggggtggcgaacgcgtttcagcaagagcgtgacccaccccggttagaaaccggagtgtaagtggccttaggtgtgatggcccgggtttggccattgcatccaaggtccttacacgcaggtttctggggttgcgaacgcgtttcagtcaaaaataacaagcttgccagcagcgatctagacataaacagccgccagtccaaatagctgagctttggctatttaggctgacggctgcttacgcggaactgcaaaccatcattttctggtctatgctaatttagtttttctctgatgatccaagcaaacaacaagtcaccagctcattcttgtttcagtgcaacgtgacgcagaacggtcaatacaaataaatcaagtttggcgtcaatgcctattattttgttgccgttccggcgcctgattgtattgcttcatggcttggcccgttcgtgattgtttgacagtcatgctattttcaggtgtccccgtatagcggacttgaccaccatagatgccagcgtctggacccatgtcaatgagccagtctgcctgactaatgacctctaagttgtgttcaacgatgatcaacgagttgccatctgcgacaagttcgtcaaatagctgaatcaactttttcacatcttgcaaatgtaggccagcggttggctcatcaagcaagtacaaggtaccggtgcggttcaattcgacagccaactttaaacgctgcttttcgccaccggaaagtgtggtcaatggttgcccaagtgttaaatagtcgaggccaacccgtgccatatttcgcaagggtgcggcaatagctggtacatccgcaaaaaagctttgtgcttttgtaatcggcatgcgcagcacgtcagagatatttttatcatgataagtgtagctcagcgcctgatcattgtaacgtcgtccatgacattgttcacaagtctgtacaaccggatccatgaacgccatattggtaatggtcacacctttacccttacaacgtgggcaagcgccgcgaccgttgtaactaaaccaactgctagccacatgattcgcgtcagcaaagactttgcgaattggatcgaggattgagagatatgtggcaggcgttgagcggatattagcaccgatatcggcttgtgccaaatcaatatatggtgcggttaactgatcacgtaaagcagataccaacgtactcttcccggaaccagcgaccccggaaatcacagtttcaatgcccagcggcactgcgacactaacatcttttaaattatgtcgatgaatatgctgtaatgaaatcgttgatgtggctggccgcggctggcgaaaagtcaatggctgtttcaacagtttccctgtcaaagtgtcactgtctaaaagggcttggtaggtacctgtaaaggtgatatgcccgcccgttgcccccgctccaggacccacttcgacaatattatcgccaatcgcaatcagtgccggattgtgttcaacgattaaaatagtgttgcctttctccttcaaacgcaaaatggcacgcttgattaattcaatatcatgcggatgcaagccaacactgggctcatccaaaatgtaaaccatatcgactaaggcactagtcaaaaacttggcaattttaatgcgctgggtttcgccacccgacaatgtctcagtcggtcgatcaagggataggtagcctaacccaatgtcaatcaaagaatcgatttttcgtaacagctcacggatcacgtcctgaacaagtggttcttgaatgccattcagaaaatggcgaaccttgacgagatccatttgcagcacttgagcaatattcgtttgattgatgagacaagtcaaaacctctggccgcaaacgtgttccatggcaggttggacatggcatacgggtgacaatttctgccaatgccgtcttatgatgttcagcctctttcttaccaataatggaccgcctgattcgcggcacaacgccttcgtacaaagctgttttaggccactttgttggcgcatgatctagtgtttgctgcggggcatacaataaggtgtccatttcctgctttgtatagtcgcccaatcgtttgtcattatcaaataaaccactgtaagcgtagcgtttccaccgccacgtgtctggtccaaaactgacaaacgtaatcgcgccctgattcagcgatttgttcgggtcaattaactttttaacatcaatgtcatccacatacccgagtccctgacatgtcttgcacattccctgtggcaggttaaaagaaaaagtgtccgaatagccaataaacggcttgccagctcgtgaaaacaacaaccgcaacaaggaataaatacccgtataggtggcaagcgttgaccgcgcatttttaccaatgcgcttctgctcgacaacaattgccactggtaaatggtcgatttggccgacatccggctgaccatatttaggtagatactgttgggtaaaactcggaaaagtctcattcagttcgcggcgggactcagccgcaatggtatcaaaaactaaagaagacttgcctgaacctgatcggccgacgaaaacactaatcgcatccttaggaatctttacgttgacgtgttgcaaattattttggttagcatcgtggacctcaatgaagccgtggtcaaacatattatccctccatttcttttcttcgttaatttcagcttatcactttagcgtttctgataatcataagaaccaatttacggcagattggcatttttactgtgaatacgattgcttcgtaaggtttgatctaatcaaaagaaagcaaaaaagctgctaagctgtcagcctccctgaggccgacatcgtggcagcttaatgttaaagcgcggcatacatcctattttgcttcaatcacaccgcgctcaatcaaattattgatccaatattgatattgctcgacattttcttttgtggcatcggttttgaaaatgttaatcgctttaagaccattgcccgttgtgacatcgagctggaacttatctaaattctttgccaccgtcattttcagcttgtttgccgttgtgtacggtgaatttggatcaagcgagcgttgcagttgaaaattgccgttcttagtttgaacaaagcctaaatctatcaaggtaaatcgtttcaacgctgacccgatttgataggttttcggatcgccttgtgcggatccggttgctgctagtgccatacaaaaacctcccctaaacagtttcaccagcaaaaggtggtgaaactgtttttatttcagcgcatgcgaggaacacgcttaactgtttataagtttagcatattggtcgcaacactggggaggttgataaggattattaggtggtgaaagacaattttgagctttttaaccgttgaaacgcatggtaacgggtcactcgcaaaccagacttatcgcgccgattgttttgcctgaagccgttgcacgattggtaacagggcatcaataaaggcctgaatatctgctttggttgtctgcgcgccaaatgacaaacgaatcgactcgccaagccgcgggctatcagcgccaaacatggcagttaaaacgtgtgaaggctcaagtgaaccagctgtgcaggcagaaccaccagaaactgcaatgccagccaaatcaaggttggtttgcaaagcgtatgttgagatccccttcaaccagatattgaaaacgtgattgacattatctggccgaatatcaccattaactgcatagggaatctccgcatcatccaatgcacccataatctgctgtttaaaaccaagatactttgactgccgcttagccttctcatcagacgtgatcagactaaccgccgttgcaaacccggcaatgccagcaatgttttctgtaccagcacgacgtttcagctcctgctcaccacctttcaacaaagatgggaactgaaccttaggatcgcggtaaagaaaaccgatgcccttgggtccgttaattttgtgcgccgaaacacttaacatatcaatgtgttgcgcttgaacatcgatgtctagtaagccaaaagcctgggttgcatctgtatgaaaccaagcttgatgatcgactagtcgcgcaccaatttcactgattggcatccgactgccaacctcattattgcccatcatgatggtcactaagatagtgtcatcgtccaaagccgcgtcaaaatcagctaaactgattcggccattttcgtcgactggcagatacgtcacccgaaagccttccttttccaaggcttttagcggctgcaaaacggagggatgttcaatagccgttgtaatgatgtgcttccccaaactagcgcgtgtatgcgccgtttgagtgatcgccgtattgttactttctgttgcgccgctggtgatcaccatattcccgggctgcgcatggattgcatcagccaaaactttgcgactcttgtccatgacagtatgagctgttcggccaaaccaatgagtcgaactggcattaccaaaatcgtgctccatttggtccatcatggtctgaatcacttctggggccatgggtgtggtcgccgcgttatcaagataaacatgttgcatattaacaatcaactcctaagactgaggtgatgcctgtaggtgagcaaaaaagctaagaagcatcgcggcactttgttcgcccgccttgatcacaaatttgtcaaaatccactccggactgctcgtcagcgacatcgctcattgcccggatgacaacaaacggggtatggaactctttggccacctgaccgatagccgccccttccatttcgcttgctaacgcctgcggatagattttcagaattgccgcaatcgcatcctgaccgttaacaaacttgtcacctgtcacaatgagaccaacttttgatgttaaaccggttgtgctggctgccgcctgaattttagccacatagtctagaccggcttcaaaaatttgcggctgttgtggcaactgccctggtaagtaaccaaaagccgttgcatccacatcatgatacgcaaccccgctcgaaataacaacatcaccgatcgccagaccttgaccaataccaccggcacttccggtgttaatcacaacatccggtttaaaagttcccaacaacaaagccgccgtcatggccgcttgaaccttgccaataccagactgaaccaaaatcacatcaatcccgtcaatttggccctcaaaataatgttgactggcaatcaccgtttcatgttgctgagtctgtttggccagtaaggtcctgatttcttcttccatggcacaaataacgccgacttttatcaaaatatcgctccgttctttcttctataatatgagtgaatcaactttcttccactgcgcttgcgctacagtaaccatttctggtaagtgccaagaatagctagcttacccaaaatagagtaccagaaaaacaatcaccaacaagccaaagacaatcccgatggcccaattcaatctttttttgagactgttaaccttcctgaaggtcacttcgtcaaaacgggcattcttgatttcgggtttgcctttggatttgcgagcatagtctttttcaacttcaactcgtttggcctcgcgggcgcgcgccgcgtgttgttctttttcctgtgcctcacgatatgctttgcgcgtgttaacttccgccatgttgccctcctttaacgcgtttgccaagccagaagcctgcggataaggatcatcattgcactcgtcaaaaaatgaccatcacacttacgacctcttatataccaagccggttcacgctcctattccttgctgctgccaataaagtaaagccagcaaggttttgctatcgcagatgcgaccgtcatcgactgctcgccaagcttctggcagtgtcaaccattcgcctttgacgaactcatccggatcctgatgcaattgattggttgccaaatgcagctcgctggccagaaacaaagccatggttgcatcagaaaaacccagtgactgaaagtaactcgccaaaggttgccacttcatcgccgtcatgccggtttcttcatttaattcccggcgtgcagctgtgagtggtgcctctccttgattgattttacctgctggaatctctaatgtcatctgaccgattgttgatcgaaactggctgacaaacagcgccttgtcgtcttttaaggccaaaacaccagcagccggttgggcgcgtacaatttctcgctgtgcggttgtgttgtttggcaacttaactgtgagttcatccacagcaattaattgcccagtaaaaacgcgttgctgagcgatcggttcttcgtccacttgattttccctccttaactgcattcgcaggcgcagaaatcttcacataaggaccccggccatcatgaccaaaaaatggtcatcaccacctaaacccgtttaagtgctggtttttttctaaccgcgcgagtccatgctggcctctaaagcttcaaaatggccaaacaaaccctaattatcagcttacaccagccaacctacaaccgtgcatccttaataaaataattactaatatccaacttccggctgatagtcaagccgcggggttgtgctacactaaatgcaaacgaaagaggaagtgatctcgtggccacaagcaaacgtattcgcatatggcgaattatactctgggccgccatgggtgcggcaataggtgcactgtccggacgttgggtgatcgccttgtccattggtgtggtctttgccttcgcctgctatatcggtgaactaagccggcctaagccaaaatcaaccagtctcccgtcacttgatccgaagatggctgaacattatgctgcatccggtttaagtgatgaggaaatcaaactttttagaaaaacaatggccgatcttgccgaacaaattcggactatcgaggcactcacaaaagaagtaccaaagttgcgtgcgctcacattaaataccgatttggttgacctgctgcatgcctattttgaggcacttgttcaagcaccacaacgcttaaccgatgccggcacgttcgtttatcagcaggtacctaatttactggatctgatgcaaaaatatgcccagattacgcatcacgaggttaagacggcagatacgtacgaaaccttagacaaagcattttcgaccatgacttctatggcaggcaaaatcaagtcagactatcaagccttcattaaagatgatcttgatgatctcgatagcgatgttcgtcttgccaaaaaacaccttgatccagataaggtgcatgaaacggagtgaataatgtgaatgatgacaaacaaaccaatctgacagatgatttattggccgatcctttcagcacgtcagaagcttcaatgaccaacaacaattcggctgaggctgttcaagcagcggccacagcgaggccaaaactaagtgctgaacaagaagcaaaagcacaagaattagccagcaaaatcgatgtgacgaaaggcgaaactgttttgaattatggcgctgatgcccaaaaacaacttggcgtcttttcacaaaacatgttaactaaagttcaaagtcaggataccggcgcagtcggtgatgccttgacaagtctcatgacgagattgaacgaggctaacccagacgaattgaaagctgaaaataataatattttccgcaaattatttggccgtgtcaagcgatcaatctatgaaatcactgcgaagtatcaaaagatcggtgctcaaattgatacgattgccaatcgccttgaaacatcacaacgcgggttactcaatgataacaagctgttagacgaattatatgatcaaaacaaagcttattttgatgctctgaatatttatattgaagcggccaatcttaagttgcgtgaactcaatgacaaaaccattcctgaagcggtgaaagcagccgaagcagccaatgaccaaatggcaattcagcaagtcaatgatctgaaacaattcgcgtcacgtttggataaacgtgcttacgatctgcaattggctcgacaaattaccattcaacaagcaccccagattcgcctgattcaaaacacgaatcaggctttggccgaaaaaattcaagccagcatcaacacagcgatcccactgtggaaaaatcaagtggccatcgccctcaccttgttgcggcaaaaagatgctgtcacggcccagcgacaagtctcgcaaaccaccaatgacctgttaaagaagaacagtgacatgttgaagatcagttcgattgaaactgcgaaggaaaatgaacgcggtgttgtcgatattgagacgttaacgcaaacacaaaacgacttgattgacactttgaaacagaccttgcagattcaacaagacggtcgggttaaacgccaaaatgccgaaaagcaactggttcaaatggaaggcgaactgaaggaacaactgctaaattatacgcacggtgatatgagtcatcaaggccccaaagacgtcacaccagacaactgatcagtcagttatctgctataaaaacacttcgccaattaaaaaagcatccccgcaatgaaactaaaaagcagggatgcttttttttatgtctttcacttagacagctgtctcatgacgtacctgccacatgcgatagccggttaaagccaccgctagtatgcacaaccccgtcgcaacccaaaaagaaacatgcataccagaaatgaaaatgtccggttgcccagtcagataagtggttacttttttcccagcagtatgactcatggaagaaaacagcactgtggtggccgttgagatgccgacgaccattcctaaattacgcgccaacgcattcataccgccagcaattcctaaatcacgggtcggcacactcgacatcaccacagtattatttggtgcttgaaacagcccattgccaaatccaactaagccgatcatcaacgcaacaaacataaacgatgtctgcaaattgaagaaagcatacccaatctgactgacaacaatgatcaacaaccctaccattgtgatgcgataaggaccgatgcgatcagcaatgctacccgccaccggagccacaatcacttgcacaatcggaaaaatcatcaataagtacccagctttttctggtgataatccccgcgcattctgaagataaaacggcgaaatgacgttgaagaaaaagttcgtgacaaaaataaaaaacgcagacaacaaactcagggtaaacgcactgttttgaaaaatcttgaagctgaccaatggatcggttttatgattttcaatatgaacaaaggcagcgaacgccacgatagctaatgcaaacagcccaagaatgaagggatcggtaaagccgcgttcttgtcccaaaaagatccccataaaaagggacaaaatcaagactagaaacgtcacaaaaccagcccaatcaatcggcacgcgcctgctgggtagatcttttggcaaaacaatcgttccgaggatcaaagcgacaatcccaatcggaatattgatccaaaaaatatacccccaaggcaactggcctaaaatcaaaccaccaatcccaggaccagcaattgcgccaatcgacacaaaggaaccgatcagacccaaggcgcgaccgcgctcattcattggaaaaatctccgttacgatcccattattgttcgccatggtcatagatgcaccagtagcttgaacaattcgcgcagcaagcaacaaggcaaggctattgttgaaaccggcaaaaagcgaaccaattaagaatagcaccatcccaactcggaaaactttgattttgccaattgaatcacctagccggccaaaaaacagcaacaaaccacagatcatcatcagataaatcgaaaccacccactccgcttgattcattggaatatgtaaatcgcgactcatcactggtaaagcaatgttgacaattgacccatctagcgtcgacataattgtaaacattccgatggcagttaggatccaccaccgatttttctgaacatttttgtcctcaatgtaatttttcacgtgttccgctcctttaataaagcctatctgcgtcattatacgccgagtgttgtcggcatttcaaaggaaccgttacagcctttacaaaagtaaaacgtattctttacagcaacgtggcgaagtctttacacagcaaccttatgcttaggttattcaagtattggagggaaaagtaatgaagcattcgaaattgttcgtcggtttgaccgtggccttagccgccaccttagtattggcaggctgcgggtccaaatccgccagcagttcaagcaaatccagctctgccccaatcaagcagagcaagattttggcagttggttcaacagctttacagcctttggttgaacaggcagctaagcaatatcaaacagacaatcctaaggcagaaatcaccgtgcaaggtggtggttcaggcgccggtttgagtcaagttgcagccggttcagttacaatcggtaattcagacatttttgcccaagaaaaatctgatttgaaagctgatgatctggttgaccatcaggtagccgttgttgcgattgcaccagttgtcaacaaggacgccggcgtcaaaaacatctccacgcagcaattagttgatattttccaaggcaagatcactaactggaaagaagttggtggtaaagatcaggccatcgtattgataaaccgcgcacaaggttccgggacacgagcaacgttcgaacagttcgggatcaagacaaataaagttaaaaccagtcaggaacaagattctagcggtactgtttatcagatggtttcaacaacaccgggtgccatcagctatctcgccttctcagcaattaaagacggtgttcaaaagcttgcccttaatcatgtccaaccaacggacaagaatgtgaccaccaacacttggaagatttgggcctatgaacatatgtacaccaaaggcaaaccaaacgcctccacagcagctttcatcaattatattcagtcaaagaatgtccaaaagacattggtaccaaagctcggttacatccccgttactcagatgaccgttgcccgtacgcatgacggtaagatcgaagaaatcaacaagtaatttaagtctaaaaacttgcaccacaaaaactgaatgctgtatacaaaaacaccgcgatttgatctcgcggtgtttttttactgtctagagtttccgtaagcgccctgtcgccagccgacaacggggcatcaaaaagtctattgcggagcaccatcctcagatcgatgaaccgtcacattcgctgcttgtggaccccgaggcccttcaacaataacgaaatcaaccgtttcaccgggtgtcagacttttaaatcccggttcattaatcgccgaaaagtgaacgaatatatccggttgcccctcagcttcaataaagccatagcctttgtcaacgttaaagtttttaacgcgtccttgcatgtcttcacccgcctacttatcaaacccgttagtgacagcatctgggaaattcgcctctacgatagctgcacaccggctgcacaattgcggcaactttggatctgtaccaatatctgtacgcaccattcggcagcgtgggcaaacttcgccgtcagcatgttttacaacaatagccatgtcatcaaactgttcggcattggccggtgccttcgtagttgcagacgcaatttcgaagtgacttgtgatcaaaagctgcatcacattggcatcgacgtcatccagcatatcgcgaacaggttcagaaggataaactgtgactgcagcttcaagcgacttcccgataactttgttgtcacgagcaagttccaaagccttttgcacttcagaacggaagtccataaagcctgaccagatatctaacaattggctttcatcatcaaactgttctgcttctggcatatcagccaaagcagcataggcttctggctgcttgagatatggccaaacttcttctgctgtgtgcggcagaatcggcgtgatcaacttagtgagggccaataaggcggcaaacatcacggtttgcattccacgccgcttaggatcatctttcgcctcgatgtacacaacatctttagcgacgtccaaatagaaagcactcagatcattgacaaggaaactgctgatagtcttttcgacggtcgcaaaatcatacgcatcataagctgttttgacttgcttgatgatttggtttaagcgaaccatcatgtaacgatcaactgatccaagttcatcataagcaaccgtatctttttcaggatcgaagtcgcctgtgttagctaccataaaccgcatcgtatttcgaatctttcgataagcttcagaagtttgggcaaagttatctacagaaactcgcacatcagaggaagagtcaaccgttgcgacccacagccggatgatttcagccccaaattgcttttcaatcgtggccgggacaatcgtgttacctaggctcttactcatcttgcgtcctttgccgtccaaggtgaaaccttgcgacaaaataccgcgataaggtgcgacaccagtggcagcaacgctggtgatcagactggaattaaaccagccgcgatactgatcagacccttccaaatacaaatcagctgggaaactgagctctggacgagccgccaaaacagcctgatgagaggaaccggaatcgaaccacacatccatgatgtctttttctttggtgaattgaccattcgggctatgcggattcgtatagccttctggcaacaagtctttcgcctctcgctcaaaccacacatttgagccatattttccgaacaaatcagcaacatgattgattgtctcttcttcaataatcggttcgccatcttcagcatagaagatcggcaacggcacgccccatgcgcgctgacgggaaataacccaatcgccgcgatcacgaatcatattgtacagccgggtcttgccccagctcggcttaaagtcaaccgtatcaatagcctttagaatctgatcacggaaagcatcaattgacgcaaaccattgtgtcgttgcccggaaaataaccggcttctttgtccgccagtcatgcggatagctatgggtgaagaaatcaagcttcagcagggcgcctttatcagccagtgcttgggtgatctgcttgttggcatcatcataaaagacaccttcaaaaccaggcgcatattcattcatgtaacctttggcatcaactactgagacgacaggcaagccgtatttaaccccgactttgtagtcatcttccccatgaccaggcgctgtatggacaagtccagtcccagcatccaacgtgacatgatcagcattcatgacaagactcgtgcgatcatataaaggatgctgagcagtcattttatccatatccgtgcccttaaaggttttcaggatcttcggattttcccagccaatttcttcagcgacgcgatcaagtaattcggcagcaaccacgtactttttgtcaccaacttgaacctgaacgtaatcgaaccgcggattaaccgtaatcccatagttagccggaatggtccaaggtgtggtggtccagatgaccagataggtatcagtgtcaagtaggcccttgccatccaccactttaaaggcgacgtaaatggatggtgatttatcatcgtgatattcaatctcggcttccgccagagtcgattcagatgaccatgaccagtaaaccggcttcaagccatgatagatgtagccctttttcgccatggcaccaaaaacccgaatttcactggcttcataatgatgctgcagcgtaatgtaaggatgttcccagtcacccatcacgcctaggcgtttgaagtcagtgcgctgtttgtcgatttcctgcatggcaaactgccgacaaagttcacgataatcggtcatcgacatttccttgcgcttcacaccttgtttcgctagttgctgttcaatcggcaacccgtgagtatcccaaccaggaacgtaaggcgcccggaagccattcatggatttgtagcgaacaataatatctttactgatcttattcaaggcgtgacccatatgaatattgccattcgcaaatggcgggccatcatgtagcataaacgttggcttgccttcatttaatttttggcgttgctcatagacgtggtcctcatcccactttttctgccaaatcggttcattcttcggtaaaccagcgcgcattgggaaactggttttacccatgttcaaggtatctttaattttcacgtgacccgctcctttattaattgaaatcaaaaaagcccgccctaatattaggacgagcaaacgtggtaccacctaacttcagggaacaagtccccctcagtgattgactaacggtgatcaaccggtcccgcttaccaacttcggcaggacaactgtgaactgatatcgttcagcggtacttgtcaggctcacacctacttcctgactcgctgcaaagggaaccaccaaacgacgcgtgttcatacgttattgagcatcatgatcggttgcagactcagaatcattggtactgtcatttgtcgattctgactcagccgccgccgaactagccggtgtatctgctgctgcttgcgaggctggtgcgccactttgatcatctgggaaaatgatctcagtataggtaccatcagcgccggaaactgctccctctgagtttacgaaaccctcgtgggcattgtcaagcgaatcttgactcggatcggtcgtatcggcagcttcaggtgaactggaaagcaattccttccactctggactcttcacaacttcaagctgtgactccaacatcacttgcagacgttggcggaagacccggctttgtcgcttgaggtcttcagtttggacagaaatattctgacgtttcaatgcggcatcatgcaaggtttgttccgtttgagcttgagcttgatgcaacttctggtcagcatctgctttggccttgctcaaaatagcctgaccatcctgctgtgcctgctgcttaatcaaatcagcttcctgatgcgcgctatttttaaccttttcagcactttcctgagcgacaataatcgattgattcaaggcttccttcatatccgtgaagtactgaaccttttccttggcatctgccaattcttttttcaggccctcgttgtccttgatcaagctactataatctttaacgatctgggcaaggaagtcattgacctcgtccttatcatagccgcgcattttgctgctaaattctttattgtgaatgtctagtggactcaaagccattgatagtcctcctcatcaattcgttttctgggacaattgttgcactcggcggtgtgactacttatgaatcacagccgctgagacccttagtttaccttttttactctctccaagaatctcatcaagccgcaagcggccaaaccctcgaacagagataatatctgatgttgcaatttcagcatccggtgcatccgattcaccaaagttaagacgcaccttaccgccttgaattaaggttttggcacgttgacgcgagatgttaaagccgtgggccacaactgtatccaagcgtaaagcactgactgaaaaattgagcggctcccagtcattttccggtgtcacataatccaccagcggatgttcagtgaaatgaacacctacgcgcccgattttatcaacattgcttgtgacccaatcctgcatgtgtgcggccacaaagaactgccaaatgtcaccatccgtgataatgtcaccgaaaacatcacgatcaaggcctgcgttcagtagggtgccttgcactgtactatggtgcagttcggcgaatttctccggataaatgatctgtaacaaccgaatatcaaaatcagccgccgttgctgagaaatagctcggtgcaaagataattcgttgccgctcagcgtggggatacccgccaaaatgtacgagcttaatatcgtcatcggcgcttactaaactggtcgcaatcaaccgttgacgtggatctgtaaagtctgtcagcactggccggtactccgttcgtgcggtttcaattagttccgcaaaatggtcgatcagtgccgcttcatcttttcgaaaatgctgatagatggcatccataagttgtcacccgattacaagcttctggactaacatgataaataatttcgtccaagccattttaataagtgaaagtacaaagaatgctaggattggtgaaaaatcaatcccagccaatggtgggatgaatcgctgaaagatgctcagaaacggatcaacaaatctgcttaaaaagcgatccagtgctgagccttgagcattgggaaaccaagatatcaaaatgtaaatgaagaccatgatgatataaaggtaaattgcccaactgcccacctgatagattgcattgagtaaattgaacacttgacacctcgttaatgttgcgaagaaaggttcaaaccgtcagagtcaatggtgctagcgagtgacccatcaatttcaaagttagctggggtcacgaggaaaatcgactcgcccacccgtttaatctcaccattaatggcgaacacagtgcctgtcaaaaaatcgacaatgcgcgtcgcatcatcggagccgatgcgatcaaagttaatgacaaccgcccgattgttcaataaatgcgacccgatttctttggcatcagagtacactcgcggttcataaaccacgatcttcgctgtcttaccagcgggcgttgccattgaaaccaccttgttgctgcgataatgattgtccaccggttgttctggtgcgggttgttgcgcctgttcgtcttcttggtcttgataatcatcttcattgtccatggcaaagaagttgctaaatttttcgcctaacttttcaaacgccatgtatcatgacctcctgactattgacgccgacgcttgaagaatggtggctgatcatcgccgccagcatcgtctgcgttagtttgattttcaaaaatgtcgaaatcttttttcttagcgttgctcatatcatcgccgcttggtgcctgacgcttgcttggctcacgccgcaagtcccagttgccaaacggatcatcgctttttgcctgccgattctcgttggcgtcactatcagcataggctgggcgataaccgccgccttgattatcttgatccgttgtacggttcttagcaacgttgcgacgtgaaggttcctggcggggatcttcttcgatccctgtcgcaatcaccgtcacgacgacttcatcgccaagttcctcgttgatggatgtcccgaagatgatattaacatcatctttagccgagtcggccacaatctgggaagcatcttgagcttcgaacaagctcaaatctgggccgccagtgatgtttaacagtacctgtttggcaccgctaatatttacttcaagcagtggacttgagatggctttcttagtcgcttcaacggtacggttttcacccgtagcactcccaatccccatcaaagcagatccttggttagccatgactgttttcacatcggcaaagtccaagttaacgtaaccagggctggtgatcagatcggaaataccttgaacaccttggcgtaacacattatcagcagcatggaacgcttcaagcatcggcgtcttcttgtcgacaatctcaagtagacggttgttggcaataatcaccaaggtatccacatgctctttcagttgtgcaatgccctctgtcgcattctttgcgcgcttagggccttcaaaagtaaagggacgggtaaccacgccgacagtcaaggcaccttggtctttggcaattttggcaacaatcggcgctgctcctgtgccagaaccaccgcccataccagcggtaacaaaaatcatatctgcaccttgcagcgcagcaccgatggcttcttcgctttcttcagcagccttttgcccgatctccggattggaaccggcacctaggccgcgggtcaatttaggcccgagttggatcttggtttcagcgttgctggcattcaaagcctgcaaatcagtgttcgccgcaatgaactcaacacctttaacatcttcggcgatcatgcgattaatcgcattgccgcctgcaccgccgacaccgattactttaatgttggcgcctttttcattttgtgcgtccatttgaaaatccattcgtgttcctcctaggatcgagatttattcaaagaaattgccaaagaaccggcgtaatgctgaaggttccttggattttggtttatccggttgtttttcctgcttgcgcttaagtaatcgctgattgccttggtccacagcggcagccggttgctctggctgcttactttgtggttgtggacggacatcggcgccatcaaccatgaatggtgtcggcaagacgctggagaccagcatttcaatatctgtcatctgggcagcatacttgataagggcaagcccttcagtaaaggatgggtgacgcaaccccatatcatcgggaataaaccgtttgaccggtcggccgaaaatgtcctgagccaattccgtcacgcctggcaacgccgtagtgccgccagtaatcacaatgccgccgggtaaatcaagcgcattgacagcgtccaacgctttgttcagacgtttaaagatttgcgccactcgcgcctcgataatctcggaaaggtatttttcagagatcatcgctggctcgtgtttgccaacaaccgttacaggaaaagtctcttcctcactcgttgccagtgaatcagcattgccatactcacgcttgagtttctcagcgtccgtaaaactcgtgttgaggacaactgaaatatctttagtgatatactcgccgccttcttgatccaccgacgtaaacttaagcttacggtcatggatcacggcagcggtgctttgaccaccacccatgtcaatcaaaacagtgccaaaatcttgttcaccatcggttaaggccaaacgaccaatggccaaaggcgaaatcaccaaaccgccaactcgaagacccgccttttcaatggctttcttcgtgttatgaatcacggtcttaggaacagttaacatgatgccacgcatctcaagccgaacgcccaacataccacgcggatctttaatatcatcaaaaccatctacgataaactcggtcgggactaatgataatgtttcacgctctggtggtaagttgcggaccaatgctgccgctgccacgctgcgaacatcgttgtcggaaatttctttattctcttcaccgaccgcgatcatcccggaaacttgttcaatctgcagcatgttggcgggaatgccagcaacgacccgatcgatcttgatatttgccttgtcttcagcttgggcaacggccgcacgaatgacggcaactgccttatcgatatcaacgatcaccccgcggctcacgccttccgatcgctgacttcccacaccaataacattcatttgtccctttactgtttcggcaacaatgacttttattgaggtggttccgatatcaagtccaacgtaaataccttgattatccatgtatcgggaacctccttgtgtaacgtttaataggttaatttcataattgaatggtgccattattagtgtaacacactcgatttgccttgagaaaacaaaccttacaaaatcagtcgtttgacgacttttccgcacttgagtatgcccgccaaaatgccccaacttctaaatcgataacaccttttttcttaacctgtgaaacaattgccggataatacttgattttgttagcaattgttcgcgaatcggcaatcacgcgataaccgtcgttcatgttcatcgagatctggtaaggatttgcgtcaccacgactagcatcaatttcggaaatgtctcgctgaatggccttcggaaactgctgcagcaaggaaatcatctgcggcaattccttcgctgtgaagcctgaaaaaacagggtaagtgtcaactggcgtctgcgtcccgttcttcagcactttgccggttatcaaaatcttgtgataagtacgcttctgatagacgtaaccgatcgtctcatactcgctggttttgataacaatatgattcaagccggtaaacgtcagactcgcttgtttaatttctggtaaagaatcttgaacacgttgagcgatcgcttttttatgcaatataacgcttaacatcaaatcatcatccgacaattttgtggcattaatcacctgctgatcaggcacggtccgcacaccttgcacactcacaagcccaaccttggatagcggactagcaaaatagccaaaaacccccagcaatatcagcagggggagcaaaatcaacgtgaggtttctaaccagcttacgccgccgtaagttctgtactttcggcagatcgacattcaattttggcttctggcgccgatcatgtcgcggcgtctgctgctggcgcgcctggtattgctgccacggtgtcagcgggtcaggttgcggtttcttttttcggggccaagccaaagttatcacctacgtttcgaaagtagcgtcgtcatcactgcgatcaattgatcacttgcatctgggacacctaatttttttgatgccttagccattgcggcacgtttttcgtcatcttccatcaaggtcacaacccgacgtggaaaatgattgtctaattcatcttctgtaattgtgatcgctgccccttgtttcgttagactttgggcatttaaaaattgatgatgatgagtcacattgggactgggaatcagaactgccggaatcccaagcgccgtgatttctgccaaagtcgtcgcccctgcccgactgatcaataacccgatatcgggtaaaatggatggcatatcatcaatgtacgggaccactttgattgtcgctggcaaatcaggcaatttagccttaatttgatcgtaatgcgttcggccagtggcaaacagcacttgaaaatctgctttcgcccaaattggcaaggccgccacaaccgcatcattaatccgtggcgccccacgagaaccaccaaaggctaacaaagtacgaatatgcggatcaaggccgaaatcacggagccgatcgttcggcttcaaaccagcaacttgttgggcccgcggattccctgtcaccaccactttattggctggaaaagccttagcaacttcaggaaaaacgatggccacgcgatcaacgaaatgactcagaaacttgttcgtcaccccagccaccgaattggattcatgaatcacggttggaatatgcaatcgtgtcgcggcaaataagatggcaccggaaacatagccaccggtaccaaccacaatatcaggttgaaaatcctgtagcaatttttttgcttcacccaagctaccaagaaatttccggactgttgtgaaattacttaacgatagacttcgcttgaagccttgcaaatcgagcgtcgcaaacttaagtccggtcgctggtacaatccgactttccaagccccttttcgtgccaacgtaaagcacatcgtcaagttttccttccgcttttaaggcttcaatcaacgccagtgccggataaatgtggccaccagtgccgcctccagagatcaccagccgcatttacttatccccactttcgactgttgcttttaattgattgacagctttaatgaaatcatcgccgcgaacttcaaaattaggatattggtcccaacttgcggccgctggcgaaagtaagatgacatcaccagggcgactgacttcataggcaagtggcaccgcagtcatcacattctcagtcgtttgaactggtaccccggcgtctttggcaatcttggccatcaagggtgctgtttgaccaaaaacaaccatgcttttgacgtgtttcttaaccagtggtgtcagtgcatccattggcaatccgcgatccaaaccacctgccagccagacaatcggttggtcgaatgcattcaaggcaacggtggctgcctcaacgttagtcgcttttgaatcgttgtagacccggcgaccatcaatggtttctagatattgaatccgatgtttaaccccggagaatgttcgcagcacttcgcgaatagcatcgtcgccgaccccttcgagtttcacggcagcgatggcagctaacgcattttcgatattatgtaagccggggatctgcatctcgctggccttcataatccgatcgccatcaaacgtcagccaaccatcgattaactgagctcgagcgccttccgcgttctttcttgagaacgggacgatttgtgccttgctctgtttcgccaactcatgcatttctggcaaatcccagttcatgatgaaatagtcgtctggtgtttgattcatggtaattcgcattttggccgcaacataatttgcccggttgccatgccaatccagatgagcttcataaatattcgttagaacggcaatatgtggatgcaacgttttgatgccgcacagttgaaaactcgacaactcagccacaatcgtatcgtctttgccgactttttgagcgacttgactaacgggaatgccaatattgcccgcatcaaatgcatgatgtggccgctgctgattcaacatcaagccaatcagcgtggttgtggtcgttttaccgtttgtcccagtaatcccgatccattgagcttccgaaacctgataagccaactcgggttcagtgataattggcatatgtaacgcctcagcccgcttaaccatcggattactgtatggaatgccaggatttttgaccatcaactcgaaatgctcatctaagagctcaaccggatgcctgccggtaatgacccgcataccgtctgcaagcagttcctgagcgtctttgttgtcgtcaaattgttgtttgtcattgactgtcactaaagcgcccaacttatgtaataggcgtgccgcattcacgccacttttcgctaatcccaaaacaagcacttttttattgcgacaatccgaaatattcttcacgatttatccttctttgcttatgccttaattttaaagaaaaaatgctaaatagatgccactgccaattagcccgaccaaccagaacgtcagatcaatttgccactcagaccagcccttcatttcaaaatggtgatgaataggtgacatgagaaaaattcttttgccagttaacttaaaagaacccacctgcaaaatcacgctggctgtttcggtgacataaataatcccaatcaacaacaatgaccattcgcggtgcagcaagatagcaaccactgccaacatgccacccagcgctaatgatccaagatcacccataaaaatctgagcaggtttgtgattgaacatcaagaaaccaagcatggcaccgatcgtcaccaaacaaacgatcaaaacatcagtccgaccgtcatgtgccgcgataatcgcgtaagtgccaaatgaaattgttgtttgaccggcaaccaagccatccaagccgtccgtcaaattaacagcattactgaagcctaccaaccaaacaatgacaaaaagaacgtagaaccaagtggcactgacattgccaataattggcacccatagtgtgtgatcaaagccttcatggaaataagcgattaggaaaataatcgcacccagaatctgaccggctagcttttgccatgccttaagtccttcattgcgatgatgaaccagtttctcaaaatcgtcatagaagccaagcagtccatagagcaccaaaataaacaaggagacccagacactgagcgtcagttgatgctgccaaataccgacccaaatggccgacacaatgatagcagcaataaaaatcaaaccacccatagtcggtgttcctgactttttctcgtgccagcttggaccctcttcgcgaatcacctgaccttcttttttgtaacgcatgtagccgatgaacaatggcatgaacataatggtaattgcaaatgccgaaaccatcgggatgagcatctgagcaagttgcatgactatccccaattctattgttgtttaaatttaatggtcccgctagtatcgcctaacaatgtgcctgcagcgatactttgctgggttacaaaaccatcaccgacaagtttgaatttcttaccggtcagttgtacaaattttaacacatcagattttgaccaaccagttaagtcaggcatggtcatggccccgttcgtcaaaagcaaaactcgggaaccgtgcagtgccttggtaccgcttgttggtaattgttgcacaactttattacctgtacccacagctgccacgtcgaaattggcttgcttcaagctatcttgagccgttgtcaatgccgcgttagtgaccgctggaatggtggccgtgttggtatcatcagtaaccgcaccattagcagttgtatccagtgcccgctgcatcatcggtttaaaaatgctagccaaaatggattcggctggttccgtcattttttgcggttgtttcatggccagataaaggacgtactgtggatcagaagccggcgcaaccccggcaacactgaaggtatagtttgaatcacctgtcagatagccaccttgtggactggcaatttgccccgtcccggttttcacagccagatcaacaccgggcatcttgtatgcgacaccggtgccgtcttcatcgttaacaacatgccgcattgcatcaatgacttgggccgcagtttcctttgaaatgggttgcccaacaacttccggtttataaactttggttttgccgttctgagagatgactttagaaacgatctgcggtttcaacattttgccgccattggaaacggcactgatcgcctgcagcatctgcatcacattgacctcaatgccttgaccaaatgaggtgattgcttggtcgaggggccgttcaaaactaatgtgcccgctagtttcacccggcaaggtgatgccagttttctggccgaaacggaatttatccaaatactgcttccagatgccagcccccattgcctgttcaatcttaaccatccccacgttactcgacagagggaaggctttgcttaaaggaatggatccccagccgccggttcgccagtcattaacagtaccaccatccaatttgatagatccggattgataataatcatttgggtgatacttgccactttgaatcgcagccgccagcgtcacaattttcatgaccgagcctggttcataattatcttcaacaagcgagtcacgccacatgtcgcctaagccttcacccgttgaagcatcaaacgttggtcgttgagtcgctgccaaaatctgtccagttttagcactcatcaacactgccgtcatgccttttggttcgtatttattttgcacgtcggtcatcagcgtctctaaataggcctgcaaaccactatcgagcgttgtgtagacggtaccgccattaacaggcgttttcagattcgtctttgcgttaggcagcttatagccatatgcatcagtctggctgcgacgataaccattcgtaccggctaaaaccgtattgaattgcttttcaagccccatgacgcctgtcaagctggtacttttgccttgtgcctgagccagaccaatcacgtgactcgcaaagacgccatttggatacagtcgcgacggtgtttcacgaaaatggatgcccggcagtttttcagcatcaatttgtttcttgatcgccaaactcaatttggtgccaggtgtgccaaattcaacctgatacatatttttacctggcgttagtcgcgccaaaatttttgcttctgacatcgccaaataacggctcagaatcttcgccgtttttgctttatcaaccacataatcaggtttattgttgctgtctttgctttgcttgtccaaaatcgcaaaaatggtataagtattggaatcttctgcgatcacattgccagttttatcaagaatggcgccgcgcttagcctgcaagacagtatcagtttgatattgtttttgtcgctgcttcgccagattgttagaatcaacctcgccaacagtcgccacaaaagaaaaacgaagaacgaacccaccaaggatcaggagtgtgaccccgatcatccagatgccgaaaattttacggtttcgggcaggatgtgcattcgttgatcgttttgatttgaaaattttcatttattatcaacacgctttatgttgccgttgataaccttaaaaccgtgtgctttggcaaaggcatcaaggcgttctgaatttgaaagttcaccaatctcctgcttgagattcgcagtcgtctgggactgtttggcaatctgcgtctgcaaatcttcatactgacgctgtgtattgctcaaccgattttgcataaacaaacagactacacaaaccacggtcgctaaaacaccacatgcaaacatcaatgtcctttcaaacccgctaaatgcaatatgtgtgttgggcgcaggtgtggtgacaggtttatgtattggcggtgtttccggctgctgcactaatggtcttgctgtactctcaagcatagattgtaccccctaatcgtgaattttttcaatgactctcaatttggcactatgagcgcggtgattcaccgcaagctcctcttcacttggtaaaatcggttttcgatttactaggcgataattcggttgtgcagaggccggaatgaccggcaagccacgcggcacatcctgaaccgaagaaacttctttaaacatcgttttgacgagtcgatcttctaaagattggaacgtgataacgctgatgcgtcccccgacgttgatcaacttcaacgcttgttctaaggacgactcaagcgctgatagctcatcattaaccgcgatccgaattgcctgaaaaacttttttagctggatgaccgcctgttcgccgagcctttgctggaatgcctgctttaatcaactcaaccaattggaaggtcgttgtaatcggctggactgttcgtgcttgctcaatgcgtcgagcgatttgtttagaaaaatgttcctcgccatatcgggaaaagatgcgaaccaaatcggcataaggccattcattgacaattgtttttgcatcgagcgtttgacgctggtccatgcgcatatcgagtggcgcgtcaaagcgataggaaaagccgcgctttgaatcatcaaattgtggtgacgaaacgccgagatcgtataaaatgccatcaacttcagttattcccagcgtcgttaatgcatcggtcaaatctcgaaaatttctatgtaccaaagtgagttgttttggcaatgttccaaaatcggctgtgaccgttgcaatcgccgcctcatcttgatcaaacgcaattaatcgaccagttgtcagctgattgagaatctgtcgagtatggccaccgcggcctaacgttgcatcaacgtaagtaccagcaggtttaaccgccaatgccgccgtcgcttcttttaatagaactgtttcatgtttaaattctgtcatcgctataacccaaagtccgttagattttcagaaatatcatcaaagttttcttcagcggtttcagcaaactgttcccaccgttcggcatcccaaacttcgatacgcgtgttcacgccgactagtacgcaatctttttgcaaaccagcatgtttgaacaacggttttgggatgttgattcgtccctgcttgtcgatatcacattccgttgcggcagaaaaaagaaatcgggtaaaggttcgagcatctttttttgccaatggtaaagttgcaagtttggtctggagtttgtcccattcagcaatcggataaccgaaaaggcagccatccatcccacgggtgagcacaaaagaggcgcccagctgatcgcgaaacttagctggaataattaaacgcccttttgcatcaatactgcgttcaaattcacccatgagcatggttgacacctccctacttttttcagtctaccacaatgacccactcttctccacatgtaaccacttatgaatgaaaattgggttatttaataagccaatcattttgaagagcacaaaaaagcccgtgatcacaaggatcacgggcgataatgagttgtgggaaaaaagtggggaattaacccagaaaaaagattaaaacacccgccatccaccaacatgtggtggctaaggctaaaacacgggtcaacatgcgccaatatcgacgaacgattaggtcatattcacgtaccacctgccaaatgaccaaaatcaaggcaatcaccatcgtggtaaacaaaatgacccaaataaaatttggtgtcttggtaaaggttagtttaaaaatagcccaaaaattaacgattgcgagtaaacaaaaccacgaaccgccatgaaaatcgaattgaacgacagccgcaacgacgaccagccataccagaatgggcaaacccatcgcaagcaacaccatgatgattccctccaaaagcagcaaccgtcttcggtgccgcgtattgatacatctctcaattaaccctaaccaaagctccgtggagcgtcaagctttgcaaaataattgcgtggtaaagttgcctgcttttttgaaaaaatttaacaaaaattgaataacaccctgttagctcgtctattaggcttttaaagaatgaagcccccgatattgccgcagtacttgaccacaactaatgctgcctcgccgacctagtcgctagaaaagaccacaaaaagcagcgattatcttgccgataccggcaaaaaccagtacaatgatagccagcagaacaacaaaggtggtgttttcggtgcagaaaaagaaaaaaagcaagttccagaagatgaccatcatcagcgcctgggtcatgatcatcattaccgttttaggcgttgttctgggtgccctagcaagtttacaattgatctaaaccgatctcaccttatacttaaagccgctgtgtgccagcggctttttatctgccctttttcaactcagcttcatggcgcggcgattacagaattggtgctagtaagcgggagagttcttcactgagttgcttaggccgcgtttttgctttgatcactttttgcgtgtaaggcattgcccgttccatgtccgctaagaacagcttttggaaagtcttcccaatccgatggtcgtaaataaatgccgcaatttcaaagttcagtttaaacgaacggatatcgaagttggcagtgccagttgaaacgtatttgccgtcaaccacaatcgttttagcatgtaaaaaaccttcttcatataaaaatgcctgtccaccatttgccacaacctgattaagataaaacagcgaagccttggccatcaagatctgattggctttcttgggaatcatcactcgaacatccacgccggcattcgccgcaatggttagcgcatccagcaaactgtcatctgggacgaaatatggcgattcgatccaaatacttctttttgcctgattaatgaggccaagatagcctagtttgattgcttcaacctgctgctctggtccgccagagacaatttgcatcgtcgtgttcccagtgacaaccggctctctaaacaggacatcaacattttttactttttgttgcttgctcgttccgttccagtccatcaaaaagcgcgcctgggccacggcgaccgccttgccctgaattcgtaactgagtatcgcgcaacattggcaatccgtggtgttccttgccgaggttaaaaccgcccagataggcaagctgtccgtcaataatgatcagcttacgatgattacgaaagttgattcgcggattccaacgccccagtttcgtagcgacaaaccgctcaacctgaccgccagctgccgttaattttttccaaaaattgtttggtaggtcgtgggagccaaatgtatcgtaaagcacgcgtacggtgacaccggcgtgggctttttcaattaacaaatcgcgcaactggtggccaattgcatcaggccgaatagtataagcttcgatgtgaatatgttccgttgccacagcaatatcttcgaacaattgcttaaaaaaggcttcacgcaatgctaagacttgcacatcattgtgggtggttactagcgcgtcatcagcacgcaataaggtgcggaccagttcggagacaccgccactgccaggcgttccaatcaacggttggccagctgccaaggcttgctgctgctgatcaactaaatcgtcgatgcccagcaaacgctgcgtcatcagatcctgcatgcgattagcccgtaacttgcggccaaaaacaaaatagatcaagaagccgaccaccggcaacagtaaaagcaccaatagccatgcccaaactgcagaaatatcacgatgcgaacgaaagaccgtgatgatcgctgtcagtgcgttgatgatgtaaagaaacccaaggaccaaccagatccacataacatttcctccccgtaactgccagcaaattttgagcctacaagtggtttcattggcgaaggttacttaagtatcataacctaattagcccagctatgcctttaaaaaatacatttccatactcacccaagtggtcccgaagttccctttttaggtgcctcttgacgaaaaaaggtcatgccctgacaattgccagcggcacaacctcattttttcttcgcaaatacgctgattactcctcgactttgccaaaccattttttctgcaactttgctacggtgccgtcagctttaagtgctttcaaaccggcattaatcttgctgcgtaagacattgtctgacttgcgcatgccaaccgcaaagttttcaggtggaaagtcgtcgctggcaatgcgatagctggacgggtccggtttgtgggcaatgtaatagcgagcgtagacttcatccattaaaattccttgaatgcgtcctgcatcgagatcaatgaaagcatcgttaaaggtgtcatacagaattggtgttttgtttgcaatgaaattcttcagcaattttggctgggcatcgagatcaaaggcgccacttgacccagtttggacacccaaggttttcccagccatatctctgatcgttttgatattacttttggtcttggtgactaaaatttggtgattaatcaaataattatcagagaaagcaaccttctcttttcgttccggtgtcaccgaataaccattccagatcaaatcaattgtttgatttttcagttcagtttccttcattgaccaatcaatcgtttgaaaatcgacattaatcccatagcgtttgaataccgcttttgccagatcaatgtcatagccagccagttgaccgttcttttgacggaatcccattggaacaaaggtgtcatccaaaccgatgacgacttttttggttcgttcgatccgtggccaggaattgccgacggtttcgcgcgcacatccgctaatgacggtgcctagcaatgtgacgagtaacatgagtgccagtacaattcggcgtttcattgaccgtcaccgcctttgccaacgtgataagtcgtgtcagccacgctttcggcaaagtccatgtcatgcgtgacgacaacctgcgtcatgccagaagctttgaattggttaaccaaggcagccacattttcccgcaaaagcggatcaagcgcactggtgggttcatcgtaaagcaagatctgcggattcagtgccaacgcccgagcaatagctacccgctgcttttgaccgcctgacaatgaatacggataggcattttcctgagcgactaattcaagccgatctagcaacttcttggccgtttcatcagctttcttctgatcaacgccttgcaaggttggtgcaagcgtgatgttgcgcataacggataagttcggaaaaagttcgaagttttggaatacaacgccaatgacgccttctttgcgtaatgcttgcgctgtcgttggctgaccgttccagatcatcgtcccggaatctgcagtttctagtccactaatgattcgcaacaatgttgtcttcccagcaccgcttggtccaacaatggctaacgttttgccatcttcaatcgtcacattgatatccaccaggactggctggccattaaatgatttattaatttgtttgagttctaacataggttgcccctcctagcgataatatgaaaatgcactttcgatccgtttttgtaaaaatgtcaagatcagtgtcaacaacagataaatgatccccacaagtaccagtggcaccaaggtaacatcacgagcactggcgatattacctgctcgcagcaagtcgcccaagccaatgacgtacaccaggctggaatccttcaccaagttgatgacttcattaccaattgacggtaaaacaattttgaccacttgaggaatcacaacgtaccgcagcgcctgccaacgcgtcatgttcaagacggtgctggcttcgaattggccttcatcaattgccccgaagccgccacggaaaatttcggcaaaataggcggcataatttaaaatgaaggcgaccagtgcggcggagaatcgatcaaataccaatccaataatcgggagtccgtaaaagataaacattaactgcagcagtaatggcgtgccgcggaaaacccacacataaccttcaagcagccctttccctgctttacccagtatcgattttggctttggaatcaacccaaccgatagaatcaagcctaacggaatggacccaatcagtgtgatagcaaaaatacccaacgtcattttcacaccagataataatgccggtaaaatctgaaaaatatagctcatggtgtttcctcctctaaatgcgttcactggtgcaaaacccctgctgataaggaccttggtcgcttacgctccggtttctaatcgcaccagttcacgcccttttcgtattcaagcctaatgatattcgtttcagcgctgtgtcagtgtgactgatggcgttcgcatagctgggactgttcgcgccaactcgtcaaaaaagcgcccccttgcatgctgctgcaagaggacgcttttgcgtggtaccacctcagtttgctgattgttcacacaatcagcctcacgtggttgaaaaatcatgtccaagaaagatgtccggtaaacaaaaagccgtcctcctacagcaaattgctgtaagaggacggcttttaccgcggttccacctcagatttgttaactgttcacacagctaacctcatgtagttatctcaaccacggcgataacgagcccaaccgagacgacctacttcgttcaatcgtccactcgtggatgtgtgatcaatggatgtctatccggttcccatcatcccggactcgcttcaagacacgaccattcatcgattccactcaacgctttaatgaattgtcactaaattacaccgaatcttaatcaatgtcaactagtttctgaaaagtttcaccgatttgctgtcacgccagcacgtatttcagtcgtgacgatggaacagttttgaccaaaagccctgcttttttatccgaatatccatcaatggaacgctgtcgcctaacagccggcgagcaatgttacgataacccttgctggcaagatcgtctggattcatcacaatcgcctcacccttattcgagcttgcgatcacaccatcatcgtccacgataatcccgagcagatcgagtcccagatgactcgtaatttcatcaatatccatggagcgcccatcggctaacatgttttggcgaatgcgattaatgaccaagcgcggttttattggcatttcacgttgttcaagcaaaccaacaacacgatctgcatcactgacggcagaaatttctggtgtcgtcaccacaatcgcaccatcagcagctccagttgcatttctaaacccttgttcaataccggctggtgaatcaagaatgataaagtcaaaatcaggccgtaattgctcaacgatttcaacaacctgttctggctccaaagcatctttttccgcgttttgcgcagccggcagtaagtacaacaagtcatcaaaccgtttgtccttgatcaaagcctgatgtagtttagcacgaccggttgccacatcgacaatgtcatagatgattcggtttgacaaacccatcacgacgtccagatttcgcaaaccaatatcaaggtccaacaaaacgacccttttcccttgcagagccaaagctgtcccgatattagcagacgatgtcgttttgccgacgccgccttttcctgatgtgacaactaacgcagtacccatctacattgcctccatttgcttgaataatcgcggtcgaatgctggccagatccgctaatcccgcatgtgtcatcgtatgtaactcattcagataagccactggtcggtcaggatcgtaatgatctgccacaatctccacgacatcagcaattcgaatctgccccgcacctttcaaatcaccgacaacaacggcacgagcatctccttgactgccggcttgaaccacgccgccaacctgacccatcacaaagatattaccagaagcacacaaggtagcaccagaatgaaggtcgccgagaaaaagcacgtcgcccatcaaatcgatggtttgaccagaacgaataacgccaccgatgcgatgggttgttttggctgcaatcatttcgttaacaaccgttttgtcgatcaccgcactgacaaccccattaattgaaaaacgcggaaaatcagcaaaaatcttttgaatatcggctaactgctcctcggtcagcaaacggtttccggtttcaagtcggtaactgacatcaccagttggcgtttcttcgtaaagtttgcctagtaatgttttcagtgtgcgcatgatctgctcaaaatctgctgtatcttgaagctgcagcgccagaccatcgttacgaccttttaagacgacactgtccacatcatcaccccaactattcttcagctaaattatctaacaaacggtgcaacggcccatatacaatgacaaacaacgccaagttgactgtcagaccaggaccgaggtggtttgcaataagcatcacgacatttccagtaccgaaaccgatgaaccgattcatgatgtagttcgcaatgccatacagtaataacccaataatataaaccataccgacaaacaccggtgttcgcggaatatacggccgaatctgtcgaatggtataaatgactaatggaaagagcagtgcattgacccctaaaatgccagtataaaacgtatcaaacaagagtccaatgatcgcagcaatccaagtaatatacttttcctcagggacaaataacgtgatcatgatgagtccaagtaatgtcagctgcggcgtgcccataaaattcgggcgcatgatccattgggctaataccgatgccagactaccatcaatcaacatcagcaacaacaacaggagaacaacccaccaatgaccagtaaagtgtttttcattcagcatcttagtcacctgcaatcgtgcgcgaaatgacggtcaccacagtaacatcattcagactggcggcaggcgttaagtaaacactgttggccaaaccatagtcatcttttttgacgctggcaactttcccgatgagtaagcctttcggggtcataccgcctaacccgctggtgacaacatcgtcgccttttttaatatcagtatcagtattcagctcacccaaaatgagatcaccggacttctcgtcgtaaccagtaatgatcccgttcacttctttatcgcctttagtttcaacagcggcggcgatgcgatcactagacttgttagccgtcgacaacatctcaaccttggcgttcgtccgattgacttcaacaactcgaccaatcagtcccgaaccggccataaccggcatacctttcttgacaccagcagcgctgccttgattaatcacaaccatgttgcgccagtcacttggtgtccgtaaaatcaccgcggcactaatttgagaataatcggtcaaggtgccgtttaacttcaactgagttttcagctgcttgttttcccgcttaagtgtctgcacctgaaccttcgtctgagccaaattatccagctgactttttagccgttgattctcctgaaaggtatccaaaagattgttgatgtcatccaagccattccgagcaaaatccccaggaatggcaaccaagcgaccgccaatgcccacgacatcgttggcaatccgttgaataaatggcggggtgttgcgattattactcgcatacatcgaccctgcgatcaaaccaagactgaccagcaacgcgatcatgagggcgatcaattttttattggaaaagaatttctgcattggttcctccgtcatactcgcgaaaaaaggccaggatcaaatcatcccagcctcttgccacacacgaaccatcttcatttatgggctgttaacgcttctttaggacatcaatattcttcaatgactcgccagtaccgatggcaacacaatccaatggatcttgggcaatgaagaccggtaccttggtttcatccgaaatgacatccggcaagtgcttcaataaggcaccgccacctgttaaaacaatcccatgatcaatgacatcggcagcaatttctggagaagtttcttcaagcgtctctttaattgctgtaatgatatcaagaacattttcatgaatggcactggcaatgtcagtcgctgaaatttcgattgtcttcggtaaaccactcaacaaatcacgaccgcgaaccgtcatgccgtcaatatcttttgccttttcaacagatgctgagccaatctgaatcttcatggcttcagctgttcgctcaccgattaacaggttgaaattctgccgtaagtgattgatgatcgcttcatcaaacttgtcaccggccactcgaatagaacgactggacacgataccgccaagtgagatggtcgccacgtcagtcgtgccgccgccaatatcaacaaccatgctgccggtaggatccataactggcaagccagcaccgatcgcagcagcataaggttcctcaatgacgaatgcatcgcgtgcaccagcaactttagccgcatcaatcacggcgcgtttttcaacttcggtcacaccgctaggcacacaaatcatgacctgcggatggctaccgttgccgagcgccttttgcatgaagtatttcaacatggctgccgttgtatcgtagtcagcgatgaccccatctttcattgggcggatcgccacgatattggtcggggtacgaccgatcatgtcgcgagcttcttcaccaaccgcaatgacttcttccgtttgggtattcttcgcgacaacggaaggttcgtttaaaacgatgcctttaccgtcaacgtaaaccaaggtatttgcagtgccaagatcgatcccgatattttttgatccaaatccaaacaagacgttctccccttatgctgactcatttcgtataactccatgcattatagcatatttatttctgtgacaaaatgtgaaactacccgattttcatgccagatgggcaatttgagaaaagcttacaactttgttcccctgcctaattgaactccggatcatcgcgcgcgaatgaataatagcgttccccaccaacaatgagatggtcaatcaaatgcatgccaagcaacgcggcggccaactgaaaccgagtcgtggtgtcccgatctgcctgacttggcgagggatcaccactgggatgattgtgtaccataatcaggtttgtggcgctcaactttaacgcttctctaaaaacaatacgcggatctgccatagctgaatctactgtaccaattgcagcaatctgttcagtaataatctgattcttaacatctaaaaataaaatcaacatggattcctgattcacaccagcaaaccgagaaatcatcgttttgcctaactgttcgctatttttgatttgcccgtagcgaaccgtctgccgttgcatagcccgccgccccaactccaccccagctaaaatactagctcgtttggcagcgcccagtccccgaatatgctcaagcaagccttgatccccttctgccaagccctgaagtttcggataagtcgccaaaacttcactcacgatctgcttaaccggataatgttgattccctgctcgcaccaccagctgcaaaagctcagcatccgtcaaagcctgcggaccatgcgctaataaccgttcacgtggcaattctgctgcatctgccatgaaaattccccctgttggcattttttcacttcaccgatcagttatcggtgtcattagaaaattacgcaaacgcaggctgatttttcaaccaagctggcaattcgctgattgatgacagaatcgcggtcgcttttgaatcgagtttttgcgcaataccaggaatcatgaccactggcaggccagctccaacagccgcttcaacaccaacatgggtatcttcaacgacaacagctggcacatttcccagcttgactttcattgcttcgtacatctcaggatcaggcttatgcgcctgtacatcgctgccagtcaaaatcgggtgaaactgccgctgccagccggttgctgccaagacaacatccacataatgccgcggactactcgtcgccagcgccaatggataacctgccgttgtcaatgccgctaaagttggctgtacatttggcaaaacaaaatctgcgccgccttgaatttgatcaagaacatccgccgtcgaaaacttttgaaaccaagcagcatgttcggcgccaatcatgtcggcaatcactttggcctcgctggggccggctgcacccactaacggccgaaaatcagcctcagtgcgatgcaatcccagttgagcggcagctttgacattgcttttgagataaagtgcctcggtgttcaccaaggtgccatcaagatcaaaaataatggtagtcgtcatggtctcctccttaaagtcgctcgtgacacaaaaaaaatgctcacgcgctgttctaattgagctggtctcggctcttctgaaacgcgttcgcaggcgcagaaacctgcacataaggaccttgaagtctaaatggccaaggatcagccatttagacttcaaggccgcttatgctccggtttctaaccgcgcctactcacgctctaaacgcaatggccaaagccctgccatcacgttcaggtccgcttacactccggtttctacccgggttggctcacgctcttaaagtttgtcgaacatcagcggccagataaagcgagccggttaagatgattggctgatccggatcgtcagcaaggctcgcggccattgcttcttgccaggaatcctttaattggccttcatgcaaggctgcatacccagcctcaggcaaagcccgggcattgcctggtaccggtacgagatacacggtatgaaatgccttcgttagtgcatcagccatggtgtgataatccttatcagccaaaatgccagcaatcactgtcaccggttgcttaaagagctggtgcaatgcggcaattaatcccttgatgccatccggattatgggcgccgtcaatcacaatcagtggttcgtcacttaacttctctaatcgcgccggccatcgactggccgctagcccttggcgaatttcctgcggcttcaacagccaattcgttgcagaggcatagacttttgccgtctgaatcgcaattgccatatttcgctgttggtaatcaccaaccagcggtatatctatgtctgtcagctcaccatccttgtcggcataagtcaatcgctgaccccagccatgcaagcgcgctttaggaacggaaaagtcgcggtcaaatcgcaaccacgtgctagctgttgctgcaacccttgccgccacaacagcatcagcatctggtaccaaattgccagtcacaaccgggacgtgcggtttaatgatgcctgctttatgcgttgcaatcgcagtaatcgtatcgccaagcagtttttgatggtctaaagctacctcagtcagcacacttacaaccggcgtgatcacattggtggaatccgtgtcgccaccaatccccacctcaatcactgccaaatccacctgtttttgatcaaaataccaaaaggccagagccgtgataaattcgaattccgtgaccccgaaatctggtgtcgcttgccgcagctgggttaaggcctgttgtccgacagcgaccgctttaacaagctcagcatcaggaatgggctgatgatcaatcatcatgcgctcattaaaccgcataatgaacggtgatgtatacaaaccgacactcaaaccgcttgcttcaaggatatgggcaatggcattggcggctgagcccttaccatttgtcccagtgacatgaatataatggcctcgtttttgcgggtcacctaaggcatgcaacaaggtgagaatgcgctgatggtcgccagttttggccaagcgcggaaacgaatgaatatacgcgacactttcggtgtagtccatggttaacttctttcctcagggcatgaacgcgcccggtttctatgccagcgtgcaagtgctagcttcataagtttcatgataccagaaattctggagaagttatgatgtttacccagtgatttttgaatgataactagacgtaaccttgtgccaaaagcgtttaatcgtcagccgtctataggcaaacaaaaaggactggccatgttaccatggtcagtccccttttcaatcaatctattaacaaaaagcaaaccaacgtcaatctgatcgttaccttaaagcgaaacttgattaagcctgctgcaactgtgccaaccgctgctgtgtgctgttcagctgatcggcaaaattgctgcgcttggtccgttgttcttcaacaactgcctcaggtgccttggcgaggaagccttgattgttcagctttttatcgatgcgatcgatttctttctgaagcttcttagcgtcctttgtcaacttagcccgctcttcatcaagatccaccagttcatttaacggtacgaagattgttgctcccgtgatcacggtgctgccagccattttaggctcggcaacatcggttcctactgtgaaagctttgctgttaacaaaccgatcaataaagtcaaagttgtcctcaaaaattggcttcaaagccgggtcagttaatttgacaataatgtcaactttcgtcttgagtggcgcacctgcatccttacgaatgctacggacgccgcgaatcaaagcgatgattgaatccatggcatcaacagcggccgaattttcaaaagcatcattagcaactggataactggctgttacaattgactgtcctgcgtgtggcaaagcaagccataacttttcagtcacaaacggcatgactgggtgcaacaggcgcagaatctggtcaagcgcataagcaaggttaactcgcttagctgccttcgctttttcgtcatcgccataaagcacttctttactcatttcaacataccagtcagcaaaaacgttccaagtaaagttataaagagtccgacccatttcgccgaattcgaagcgttcagatagatcagtgacctgcttaatcgtttcgttcaattgggcaaataaccacttatcagataaatcgaaggtgcttggatctggttgttgcggcttctccaagtccccgagattcatcatcacgaatcgggagatgttccagattttgttaatgaagttccaagcggcttcaacttgtttgtaactaaagcgagtatcctgaccaggcttattccctgtaatcaagaaccagcgcaaagcatcggccccgtatttttcgatcacatccatcgggtcaatcccattgcccaaggatttactcatcttgcggccttgttcgtctcgcatcaggccatggatcaaggtgtacttgaacggacgctcgccagtgaaatgcagcccttggaaaatcattcgagccacccagaatggaataatatcgtagccggtaaccaatgtgtccgttggatagtagcgtttgtaatccggtgaatcggtatccggccagcccatcgttgaaaatggccacaaagcacttgagaaccaagtatccaaaacatctggatcttgctgccaattttcaatgtcttttggtgcttccatgcccacataggtctcgccagtctgcttgttgtaccaagccggaatttgatgaccccaccaaagttgccgagaaataacccaatcgtgaatattttccatccattgcaaataggtgtgctcaaaccgatctggcacgaaggtcacctttttatcagcttcctgttgtgctttgatggcagcgtccgctaacggcttcattttcacaaaccattgagttgacagccgagcttcgacctgaacaccggtgcgttcactatgaccaacactatgcacaattggctcaactttcagtagcagaccttccttatccagatccgccaccatggccttccgagcttcaaaacgatccatgccattgtacttgccagcattttcgttcatcgtgccatcttcattcatcgtgttgatccgcttcaagtcatggcgatttcctacctgaaagtcattagggtcatgtgccggcgtgattttaaccgcccctgtcccaaatgctgggtcaacatacgcatcctcgatgattggaatcttgcgattagccagcggcaaaatcagctctttgccaactaagtcctgatagcgtttgtcaccaggatggacagcaacggcggtatcgcccatcatcgtttcgggacgggttgtggcgatctcaatataaccgctcccgtctgcgaacggatatttcacatggtagaaggcgcctttatcatcttcatgaatgacttcgatatccgacaacgccgtacgggcctgcggatcccagttgacgatatattcgccccgataaatcaggccttgcttatacaactcaacgaagaccttacgaacagcctcgttaagtcccttatccaaggtgaaacgctcgcggctgtaatcaagtgacaaccccatcttcgcccactgactgtgaatcgtcttggcaaattcgtctttccattcccaaactttttgaacaaatttatcgcgccctaggtcatagcggctgatgccctctttacgcaacttagcttcaactttggcttgggtcgcgattccggcatgatccattccgggcagccacaacgtatcaaaaccttgcatccgcttttcgcgaatcacaatatcctgcagcgttgtgtcccaggcatggcccatgtgcaacttacccgtcacatttggcggcgggatgacaatcgagtatggcttggctttttgatcaccgctcggtttgaaaacatcctcatctagccattcttgataccggccagcttcaacggccttatgatcgtacttaggtgctaatgcttgctctttcattggctccacctcacaatttttttctgttcctgcagtaacgcggccgcaagctgacttacgagaataaaaaaaaccgccctaattaaaaaaattaggacgagtcagctcgcggtaccacctaaattgggaaacaatcccccacttggttcaggataacggctgtcaccggccgctccctactcacttcaggacggcagctcacaagctacaaccatagcctttttcaaggtttgcaccaaccaccttgtcgctggaaaaaaagaccatgaccctcttgatcattgcattagctgaattataacccgttgattttgacgggtcaatcgctagcgctatccttttcggaaacatagcctgctacggctcagttgtgctacccttgcgacactcgtttaacctgtttttgatgatcgacaaacaataaggcttgcagttcactggtgagatcaatgtagcgaatcgtggttgtcggtttggcaggaaccggtttgggagcaaaggtcaaaattgcagtgacgttttgcgcttctaattggcgcaccactgcagcttgggccgagcttgggacgcagacaatagcggtgtgcatactcggacgcaatttttcagataaagcggccaaatcataaatcggcacgccggcaatcgttgtcccgattaattgcggatcggtgtcaaagcccatcgtgatagaaagatcagggttgcggcgaaaattattcgtcagcaaggcacggcccagattaccacaacccaccaacgccatctgttcttctgagtggacttcaagcaactcgccaaaaacctgtgcaagcaagtcaaccgaatagccatagccacttcggcctaaatcgccaaaattagaaaaatcacgtcgaatcgttgctggggcaatgtgcaccaatttacttaatcgatcagaccgcacccgtttctcgccggtctgctgcaagtctttaaccgttcgataatacacgggaatccgtttaattgttgcctgtgataacgcctgcttgctgactaccactttgaacacctccgcacgcttttgttactcttttcacatattagcttaccagaattcggcttgcttggctatcttttttcaaaagtaatgactggcatgaatcgttaggattgtactgatgttatcatattatctgtcagcgaccgggcagtttggtctgagcttctgactttatcactacagataaccataagatgaaaaccgtcaaaagtctcagtttttgtgaaatgtttcctttattaaataaaaacgcccgttgtttgccatgaccactatcatcaataggcaaacaacaggcattcttcttaaagtaattcagcaataacatcttgatcttgattcataaattgatccgatgacttgatctcctgaatcttcacgccagccagtgcgcgatccatcaagccggcgacatcaattttgctttcatagtaacgcgcgcgatccgtctttggcttagttttcggtgaaggcggcgcaaaaatcgtgcagcaatcttcaaatggcatgatcgacaaatcataagtgtcaattttctcggcttcggcaatgatttcattcttatccatcgttgccactggtcgaataatcggcatcgttgtcacatcattgattgccgccatcgactccaacgtttgcgaggcaacttgaccgaccgattcgccattgaaaatcgcgagatcgccacgctgctgagcaatggcttccgttagccgcaacatcaatcgccgttgaacggtcatgagataaccttctggcactttcgccttgatttcctcttgaatttccgtaaatggcacttcgataaagtaaatccggccgacatatggcgtcaacttcgcggtcagttgcttagctttgttgagtgcctgctggctggtgtacggcggactgaaaaagtgaaccatctcaatgtccacaccccgctttaacgcataatagccagccactggcgaatcaatgccgccacttagcatcaaagctgctttgccggcagtcccgactggcaacccacctgccccttgaatggtcttcgtggacaaataaatcgcctcgcgccggacttcaacccgcaaaatcatgtcaggctgatgcattttaacaaccaaatcaggccgcttatctgtcagatagtcacccagatccaaattcatggcgtttgtatctaaggcaaaatcgtggtcactgcggcgcgtgttaaccttgtagctaatgccctttggcgcggtttcgttcattaattgcaaggcaactgcatgtaccttatccatatctttttcaaccgcaatacttggtgaaaaattttgaatgccaaaaacttgtgataaccgagccatcacctgatcactcggctccccattcaattcgatatgcatccgatcacgcttagggcgaatcgtgagtttggggaactcgtgcaaggcacgggtgacattgccgtttaaccggccgataaaggcttgacggttcttgccttttgtcgaaagttcgccataacgaaccataatttctgaatattgcatactataatcctttcagttaaacggtcgccttatcaagtttagcaaacttcgcataaatcgtatcaaatgccttgttaaaagcatctgcctcggccaaagtattcgcttcatctaagctaacacgaatcgctgacgttgcaatccgggaatcggtatgcattgccgcgagtgtactgctttccgtgccttttttactggagcaggcactagttgtcgaaatgtaaatagcttgcgcctcgaaagcgtggacgattgtttcgccacggacaccggcaatcgcgaaacacaacacatgcggggcaaaatcaggggtcaattggctgaacatcgtcacctttggcttttgactgacatgatcgtaaattcgtttccgaacagcttgctgacgagccacgttatccgcttcattggccaaaaggagccgtaatgacttcgccattgcggcaattgccggcacattttccgtacctgagcgccagtcattttcctggccaccgcctgtcagcaatggcgcgatcatccggccttccttggcatagatgaaccctgtgccacgcggagcatggaacttatgccccgaaaagctcataaaatcaatccgtggatcttgcaaggcagcatccagccccttgccgactgcctgcacagcatcaacatgaaaatgaatattgggataggcatccagcacgcgtgcagcttcaacaatcggctgcatactgccaatttcattgttgaccgccataatcgagaccaaaatcgtatctttgcgaatcgctgctttgagatcatcgatgttgataaacccgcgatgatcgaccggcagataggtcacgtcaaagcccaatttttctagttgcttcatcgtattaatgaccgcaggatgctcaatgctggttgtgatcaggtgccggccgaattcacgcttcgccatcgccgttcccttgatcacccaattatcgctttcggtaccaccactagtgaagtaaatttcgtttggtttcgcaccgatcagctgagcaatctgcgcccgtgaactttgcagaacctcatttgcccgtgtccccaaggcatgcaagctactcggattaccaaaaaaatccgtgctgactttattataagtagccaatgcttccggcgaaatcttcgtcgtcgcactattatcaaaataaatcatctgccggccccttccgttattgtgactgcgttgaattatagacaaaaagttagtaagtttcaagagcgcgagccagtccgggagaaaccggagtgtaagtggccttgggcgtgatggtcgcactttgaccattgcgaccaaggtccttacacgcaggtttctggggtggcgagcgcgtttatcggagcctagatcacatcagaaagttcgtacaacaggtcctacgaaaattacccacaaattcgcacaacaacaacctccaaacaaaaaaccagccaccaccggctggttttcccaaatccgaatcactaatataatgaagctttcttccgcgcaaggtacgcatcctcaaccttcttatagcttccggcttcggtttgctccaatgccgtcgctaaggtatccgcggcttgcttataatcaaattgcatatacgactcagtagcctgatgcactgcttcggcgactggtttcactgttgttttatagcggttggcatactgcatcaattcttctgtcaaacccgcagcgtcaatcaaagcgctggtagcttttttcaacgcatcaatatcgctggcaattttaatcagaaacttcgcaatcgcgtccatgttaattttcacttgatcaagatcatggtttaattgctcgatctcggcagtgacgtgcttgacctggctcacataatcttgtggcagaccaggtaggtgatgccgtaaaatttcgtgtttgatgttacgcatatccagttcaaaattctctgcctgcttgttggcgacaatctcgcctttctttaagcctgcgaccgcttgattaatttgaacctgctgcttctcaatcgctgtcaactcatctttggtggcatcaaaccgctcaatcacatcagaatacacggccttaccagcttcaatcgcatccgtatccttaatatagttggcatcgatcgaatcaagctgcgtctttaaatccttggcaattttgatttcattgtgattcaacgtgtagctctgattcaaatgatccagttctgtctgcaactcgcgattttgacgcaaggcgtgatcaataaattggcgcagatctggcgcagcagcatcgacgcgctttctagcctgcatttccttttccataatcgcgtacatcttatcaatctcagcttcaatttcgctgttagccgcttctatggcgtccacatcaagcgacttaagcgcggtgttagcgtcagccatcttttcgttaacatcctcgaccatgcccggaatatcatcagtgaaaacataatgagccgttgtcaactgccgatagccatgctcgatttcattaatctgcgcagggaattcgttcacctgttcattgacaagcggtggcaattctttaacttgacgccgcaatgccgccatctcatcacttaactgcttaatctcgctcttggcagcttgatgatcgccatcattattaatctggtcaattttttgaaaaagttcagccagttgttgcaactgctgctccaaagccggctgggcatccccgaagacaaaacttttggcgaggatcgttttacgcgacacttgataatcatcacgtagctgcaacatcttactgcgattatccgcctcatcatgccgaatgtcttgtaaggcttggctgatcaagtcatattgttggcgggctgtgtcaatttttgcttccagcaccttagcaattttctgggcatgatcaaagcgaaaacgcttggcctggtcctccagatcaagcagaatcttctgtaggtcagccaagtcgtcatcattcaactgatcaaaggcccgttcccacttgctgaacgttgccagactatcgccagttaactttaactgctcgatgctgcgaatctgactcgacagcgcaccaacgtcgatcgcttcgacttgcgcgtccaagttcttgattcgagtctgaaaataatgttgcagccaccagacaccgccggcagcgacaactatgatcactacgataacaaagaaccagatcatccctacaccctctgctttacctattatcatttcaattgcattttgacagcttcacggctaaaatgccgttaagcatcaaaatgtgagaatatcctaagtacaagtatcgcaaaaaaaggcttcagttaaaaggcctacacatcgcttttcataaattctctaaaaggactgattaaatgacgacccttgatcccatcattgttgaccaattagacggcttgctaaccggcgaaactaacccaattacggtacttgccaatgccagcgctttgctaaacgacttgatgactgacctcaactgggcaggtttctacctttataatgataaaactggccagcttgacctcgggccattccaaggtaaagtcgcctgcatgcacattcagccaggcaacggtgtcgttggcaccagctacgcccaaaacgctgtgctgcgtgtgccaaacgttcacgaatttgctggccacatcgcttgcgactctgccagcaacgctgagatcgttgttcccatcacagttgacaatcgggtggtcgccatcatggacatcgactcgccaacactggatcggtttagtgaaaatgacgaagccatcctcactaagtttggtgagacgttggcggcgcaccttgacactgctgcgctaaacacggtatactagcacgcgtgtaaaataatgcagcagtggccggcatggtcggctccagtcctgcctcggcgttaagccggtgacagtagtaaccgcggctgcaaaggtgaacctttgcaggactgcccgtgtgctaaagccgcaattcgttattttactccaaataaaatcttggaggaatatctatatgtctcgttatactggtcctcgctggaagcagagccgtcgtcttggcctctccctttccggcactggtaaagaattagctcgtcgtccttatgcacctggtgatcatggtgccaacaaccgtcgtaagatctctgaatacggccaacaattgcgtgaaaagcaaaagttacgttggatgtacggcttaaacgaacgccaattccagaacttgttcctgcgcgccggcaagatcaaagaaggtacccatggtgataacttcatgatcctgctcgaaacccgtttggacaatctggttttccgcttgggtctggcttccagccgtccgcaagcacgtcaacttgttaaccacggtcacatcaccgttgatggcaagcgcgtcgatatcccttcttatgaagtagagcctgggcaagtgatcgctcttcgcgaacgttcacaaaaccttgctatcgtcaatgaagccatcgagaacaccgtttcccgtccggcctacgttacctttgacgacactaagaagaccggttccctcgttcgtttaccagaacgtggcgaactcgaaccagaagttgacgaatcactggttgttgaatactataaccagaaactttaatacttcaaaaagaaacagccaactcgaatgggagttggctgttttttagtgtgttatcacaaatgcctatctactgtaaactttttgtgaaactttttgtgcgatcgacaagttcattgattggtccaataataagtcgggcacactacctatcaaatatttttcaggtaatcgactcagctcctacctgaaactctccggctaaaacagcatagctgaaatgccactctgcagtcggactaaagagaccagttcttttaaaggcaggtgaatcaatattttcatattggattcccgatttagctaaaaaagctctcgtctgtgtgctaggataagtcaaaacgatcaaaaaattacctttgcttaattctaagggtactctgatatccaaatcagctcgtccttgatgtacaacgaactcatcactgtacaaggcttttatttggtcagacgaaaaaaacaattttgcatcgttgaacaagttggtctttattgtgatccttgatgaagtcatcgtgacgctcattttaatgtaacgagccttttttgaaacaggtattttctgaccacttcgtatattgtttggattactataatagttactaattggtacatacccatcatggtataaaaatgattcatcagcaagcaggtcaaggcttggaaatgacttcttcattatgtcagctgtaagtactaagttgttccgatgttgcaacgcatttacccgatcacgtgcaaaccacaaccaaactctatcttcagctcgactataggcaaaccttcgagcatactctgtaatttctcctaccgtaaaaagaccatttaatgctatgtgagcaccatattttgaataaagaccttttcgattaatattggaatcaactatttcgctaatagattgaagacttcccttagctttttcgaaccttggaaattctcttgatcggtcatccgcaaacattttatcgggcgtatagtttctgtctgatagttctctcctaagttttgccttatactcaaaaggtatagcaatcgtcaaaaagctttcagtcgattcaataccggagatctctttaatccgtccatcctcaatgacatttgagcaaattgcgaatgttccactttgcgcacacattctcagattacctgcatcaacaatactgtgtctatcgacaaataccggtttggttgccagtgtcaaggcattgtgttcggagagtggttctgaaagttgctcgttaaacgacttaacaaaacttgaaaagtctgtcgagccccagaatgccagctttgttagcaaatcaatgtgtaaatcctcacgtcgtagtgacggtttgataaaaatgaatataacagaatcttcacggacagtcggactgactgcgaagaatagggccactaatggatccaccgtaaaatccagaaatcttgtcggtacaccttgatgctgtccatatgcaatattgtagaacctatcagtaccactgactaagttacttttttctaaacgtttaacttcatatagttttgaatattttccgtgcgcaattgacggtattacagtctgaaacgaagccaattgagctctgtagaaaagcttaccctgatttcggtaagcatcaaactgttgaagaaaatttaaataatcctcaacacaagtaatttgatgttcagcctcatcttcaatcattattttgacccccccttttcttttatagtatagtcaatctagcacgtaaggtcagttaatcacgtctttctgtatgctatatgtatatgataaacttaatcaaatagattgaaaatctttagacggctgcctacgaatacaagtacttcagttagatgaacaagctcttttaagctgtagcattcgattatacaaaggaaaaccatatgaaaattgtatattttgacgaaggttctgcaatggactatctaacaattattaatgatgggtatcggaaaagtgaaaaagaaacaacaactaaaaccacaactgccgctaacggcgatgtaacagtcaaagccaaattggggcaatggctttcaatcattccgggcatctctgttgatggtcaagttggggtgtatggaaaggcagcaagtgatcgtctagtcacctcctcaataactagtgcggtattatcagatttcttgcaaagcgcagagagtgctcaaaaagaggtaatgaagctttctgaatatcgactgtctcttcacaaaggatcaattgagtatattcaatctatctcaccatatcttatgatgactaatggcaagttcaatgtcggagatggtgtagccattgaagccagcaaaatctatgacgcactgaaactaggaaaggggtactacgaaatggtaggacagaagtttggggaaactaaacccagcgcaattttcaggtttaataatgctgcttttctacataattacagcatctctgacctacctgcgatgaaactaacttcgtatggaatgcattctggcaacaaaccattacactctcttgatttttcaaaatcaattcaagagtcgacttcagtagaagtcgttactgcgttaaatcattccttacgtactgactcaaaatggggctctgacacgaacgataagccaactacatttgacacaaagcttcccatgtatgatatcgttctgaccggtgtggataatgactgatatctctatcattcttggacctaattcatatttcaaaagcaaattaccgtcagaaagcttactctctttagaatcatacgtcctattttcagatcggtcttatcatatgtggtgacccctgcaacggaagaagagtttcaacaaaagctcaaaaacaagaccttatacgcatcaacagaatcattcgcaagactgacacaatcaggaatcgaaaacatttcagaagtcttacgctacccagtacaattttcgaaaaaaatatacttacaaaacccaccaaccagcgtgattcatcaactagacgctgcatactcaggaaaaactaatatacttgaatatcaataccctccagtatcaataacctaaattgcggacttttatcatgcttttacaaataatgtttattcgcaatctgatgcgggtattacaattttaaatgttctaactgagtatcagcatcgtaaggatcatcacgccccccttgttataatgttctatggcccgtcaggcatcggcaaaaccgagacagcaaaaatactaggagaagtcttaggcggttcgttgatgcgtcaacagttgtccatgtttcagaaccaggcatcctttgactatcttttcggagcaagtcattctcaacttaatttcgctcgtgatttatcaaatagagagtcaaatgtaatactgcttgatgaatttgacaaagtgaatccagcgctatacagtgccttctaccagttatttgatgaaggcatctttgaagataagaattaccaaatacgaactaataatttaattattatctgcacatcaaactttgccgatgttacccagattagagaaacgttaggtgatgccatgtattaccgctttagcgcactagttccattcaagcatttagacgtagacgcgtttctcaaaattatcaatgatgtcgtaaatgaactgtggagtgaattggacgaccaagaacgaacactattcgttgcgaaagctaatttaatcgaagcgtttacgagggatgttccttactttcaaaattttaggcaggcgaaatcgttaatgcgccaatttgtttacagaaaaattgtagatttatcgttaaaaaaaggctcatttcatccataaaataagcacccttttaaaaaattattaaccaaaaattaggagggatttcagaagttttctgccttttggaattccgccttgtgttgtttttttcctttcatgcttcgacagttctaaacattaattttcgccaactccatagcaaaaatctccccaaacttgcgatttttgctgaacaggatattgtgtcatttcatttaataaatgtcgtcgaatcaagatacttttctttgaccgtttgagccaccgttatcaaaattgcattggtctttgagtcttcctagcatatcattaagcaaggagttcttgccgtccataacgtaactttttattttgcatttggttgctttattactccattcgaaggtccgaaatataagatggcgtctaagtttgtcacctgatcttggccatttttgatggctttactaacttccgctcttcggcaaagcatgactgctattgcaccagcaccagaattgactgagaaatcgtttcatctcgcagtaaagcaaccttcaccgcgctttaggagccagtttgtgccacagattctcaagatggtccagcagttacagacgggggcatcttgaacagctccgcagtgttcgtacaacctacaagtaagacttaaaccggtgtttgcaactaactttacaacttctggaaatcaaagaaatatcgtctcagaaacgcaaaaaaactatcgaaaggctaacataactttgactaaaacaagaatagccggattcatcttaaagtttacagaaccaaattttcttcaatcaactaagtcaaacgtgttccacttcacgaatattaattatttccgaaaaatggaaagtgaagaaaagcgtggagtaaaagatccgcatgagataatgcaagtacacgccctcaatcctgaaacagataaagttagattgacctttaaaggtcatcctggctcgaccgaaatagaccaacctcacggaactttcaccttgaactatggaatgacaaaccatttatcaatatgctcttttgtttttctgaacattcagacagactttataaaaaattctaagaacgagtttcgaatcaaatcttctgtaataactgatctcattgatcagtttggtaaccgtcccgccattctttggggtggtggtgactttaaaaaactgacctctaatctcaatgtcaaggagaatacaatcttggaggtttatagtggattagtcaactattactcggggtcgaatttcagcctatttgacaaaaaaatcacaccaaaaaatatcttcaaaattgccttcaagaaggaagaatatttcaagtcccagagagagtttcgtctagttgcatacacagaaaaagagaactttgatttcgatctaaaatcaacagttacagccgaaaacgattcactgaaggtctcaaattctagagaacttgctgacttttatgctaagttgtaatccccagattgggaagcacttaatttcattcagaaagtgaattaaaaaacggttattttttaatcttgttgtcattttagtttttttacgaaccctcgtgaggattcgacgtaatccctttttcgattaacacctaaagagtgaaagcacaacaatgcctctcactgccattgtgttagagtgtgctcacaaaatcatattcaaattctatctaagccgcactgccgaagagttacgcatgactcttcggcagttttttcatgaattcactcatgatttgattaatgacgacccagacttcctgataagttgacgctgtaccaattaattgccttatgagccagttcaaggcctgcacaattctaatatcaggtaaggcttctccatagtaaaagaacaggtcacccagcattcgttcgtcagtatcttcacgttgacacaaagtgaagagatcataactcatcatgaccatcgccatatgggcacaaagaccgtcatatccacatacttgcgtctcagcgcagatattgtttagcgaccttgaagtaacctacaatttgccagcgtctgccgtacatctgaatgatgcgttcaggacgcaagtcattcttcgtagttactaaaactaaaaagcgattttttgcaccttttttggttacgaagacgagcttcattgccatcttcgtgccgtccatgtcgtattgcacaatcggactgtatagataatgctcatgttttggccacttgctttgcttcagcgtggcaaggaggtgcttaacatccatttctcgtccgcgataacgaaaataaactttttccgtctgcttgatcatgccgatatcattgattccgcacttaagcagttcatggaacatcttgcgataagcaaaccaactatcaaataaggtatactgcgtcttgacgcctgctttaatcgcttgatcaacgagctcaagcgcaaccaagttcattttacgatagacttaatgccgacatttggccgcaagggatcgaccatcacacagcttttgcgggtcaatttggttctctgccttgcttgagaccatcagtgcaaagttaagtggcaggaaggtgttgccgtcactccaactcaaagtcaaagcccgaaagccggtacagtaacgttcgtggtcatggtcgaagactttggaaagtagtttggtcttctttgagaactcacgcttaaataatgaatcgtcaatgacaagtgcttgatcacgacctgtcgcggcaaattgatgaagatatcgaatcagactaactgccaccagtaaaatcagcctctggcaattgatccgaccatcattcagacaaatgcatgccgttcgtcttgaaaagttgggattaacttcagcttgatgtagcgattaacgttgaaagatgatcaggatgatccactgaaacaagctggtcatcttgattcccttgtgcctttacgcgtttgcttgacgaagtgccctagaaagatgggccaatttagagaaatgctttgttttgagctgaatatcatgggttgattgttgtatagtggccatggacgtaaattctcctttttatgttggttttggtcgactcaattatacgacgcggagcggtttgcgtcttttttgatgccaaaaagccccgatttctcgggactctcagtcgatattcaactttcactctttagttaaacactatagaacaattccaagaggcgcccatatgcttctcagaatcaatctttatttagtttgtcttcccatactcctcatgaaatcttattttaaactccatcttccaattcgtcaccgcgccgccggatccaccatcgtcaactgaatccgctcgcgcgctaaatcaactgactcaatccaaacctcaacaatgtcaccaatagcaaccacggtctttggatcacgcacaaatttacgcgccatcttggagacatggacgagaccgtcgtgtttcacaccgatgtcaacgaatgcgccgaagtcaacgacattgcggacggtgccttctagcttcatccccacttttaagtcttccattgtcaagacgtcttgtcgcagaataggcgcggccatgttgtcacgcaggtctcggcccggattttgcaggctggtgatgatatctttcgcggtttcagcaccaaccccttcacttaccaatggcgcaatgggtacctcgcgaattttagcgactgctgctgcatcgcctaaatcagcggcggtcacacctgctgccgtcagaacttttttagcgactggataactttcaggatggatgtcggtgttgtctaacggatttttaccgccgataatgcgtaggaatccgactgattgctcaaatgctttcggtcctaaacgtggcacctttttcaactctgcacggctgttgtagcggccgttttcatcgcggtagtgcacgatattagttgcgatgctcttggataggccggaaatgtgcgtcaacagttggtaactggctgtgttcaagttcacgccgacctggttcacagcgcgttcgaccacgacatcgacttcattggacagatctttgcttggcaagtcgtgttgatactgaccaacaccgaccgactctggatcaattttgacgagttcggcgagcggatcttgtaggcggcgcgcaatgctgatggcgctgcgttgttccacatgcaagtcgggaaattcatcacgcgcttcttggctcgcagagtaaactgacgcccctgcttcattcacgatcacgtaaaaaacatcacgtttgatctgcttcaacgtttcggcgacaaattgctcggattcccgactcgccgtgccattaccgatcgcgatcatcgtcacttgatatctttcaagcagcgcaatgagttctggtgcggcttcctgacgctttttttctggtgctggtttatgcggataaatcacggccttagccaagaacttaccattttcatcaacgacggccaatttacagccagtgcggtatgcggggtcgaaacctaacacaaccttgcctttgattggtgcttgcatcagcaagttgtacagattttggccgaaaaccttgatggatttctcttcggcatcagttgttaatgcattccgtacttcccgctcaatcgctggcccaacaaatcgcttgtatgcatcttcgtaagcgtcctcaataaacgccgttgcttccgtactgggccgattgtcgataattttaaaatgaaagtaatgcaggacagcatcagtgtcgactttgactttaaccgtcagaattttctctttttccccacgattgatcgccaacgtacgcgttgaggacatcttcttgacggtttcctcgaagtcgtagtattgctgataaacgcctttttcgtctagttctttgcccttcgttttgactgtcgcgctaatggttcctgtgcgcatggtaaaattgcgcacccagttacgaatcggagccatttcgctaaaagtctccgccaaaatttcgtgggcgccatctaaaacatcctggacggtggcaatttctttggctggatcaacgtacttctgggcttcctgctcaagagatccgtttggaaaagcaagcaaccatttggcgaatggttcaaggccgcgcgacttagccaccatcgccttggtctggcgcttctgcttgtatggtagatagatatcttccacatcttgcagtttggtactggcttgaatctgctgttccagcttggcagtcagtgctccttgctcggcgatgcttttaatgacggccgctttacgatcttgcaaagcagtcgcacgtttataagcttcctcaattgcctgaatctgtacttcatcaaggctgcctgtcatttctttacgataacgcgcgataaacggtaccgtgttgccttcttgcatcaaatgcaaaacggtattgatctgtcgatcggtgatgccggttaaactttgttggactaattgaacagtttgttcttcaatcaagttgttgttcctcacgatttctagtcagtgtcattacttattcagcaaacactattatagcaaccacgcgtctgatataaaacctaaggccttgatgccagccaaacttgctcaccattttgacgaacacgcacaacctgtgaaagcagtcgccgtgtcacctcacattctctaagggttataaaaaaggatgattggtgacaccgtgtcacatttaattcaactttttttatttaaaacctgtcaaaattaagcaattccttttcaaaaaccttttccttttgtcgttaatcccctcgacatacaactaacatccaccattttcagtctaaacacgacggattaggtgataactcaccttgctttgcaactacgcggaatctagtttggcgatgcctgtcagcaatcatagtttccttgaaaattacccagagcaagaccgagtggattttttaaatgattgccgataatttcctacacagataactttttgaatttggtcatcacagggatcataaatggtaagttgtgagcttttccggacaaagcatttcacccctaagtatgtacagaccaagacaaaatacctactggccagttaagttaaatcagctcacggtattagatgctcaatcaaagtatctatcaatgctatgccgccataaatcaatgcggctttatgtgttgttagcaaatacgttgccaacgacgttcccccaaatatgagtatttccgttataacccggccaattgttggtaacctgtgaagcgacattggggccatgaaccgaccccaaaaaagaatgccgagcaccggcactatcacacccacagttagtttaaccacaagatcgctactattgaacccagcgatgatcaataacacaactgttgcaatttctaacagaaaacgaatcccatctgcagttgttttaatcattaagtgcccctatctttttaaataatgtcatcattgcatcatcccctgcctgcattttaatggcagtggtcgtatcaagcgctatgttgctaagggcaagatccagcttcgcccggcgtttaaagacttcgcgataactttgcaaaatggccaaggtatcttcgcgacaagcctttgtcactggcgcatcatacattcgcaatatcatgctgatttcatttaaagacaacccaaccgcttttaaatttcgcgtgatctgcaacttaaccacatcatctggggtataatcgcgataatgattttcaccccttgatggcacaatcaagccaatcttttcataaaacctcaacgtatctttgctaacaccggattgttgcgcacatgtcctaatattcataagaaaatctccttttttcgtgtcatcagaataacattggagtatacatcaaggccaaggactagaaaatgatcgacaagctattcctagatctaattatcatgatgtctgtcaacaacttttttaatcgttacaccgcatctgtaaaaacagtgatcgccatctgcttaagccgctatgcagcaaaggagaaccccatgattttctattttattctcagtctttttatgattgccgtcttagtagtgatcgcgttacaacatctcaacaccaaccgaatcgtggatattcagcttgagcagcacaagatgatgtttcctagccaagtccgcggtgcccgaattgtctatgtgcgcggtatctaccgatctcatcctagcaaacgcaactggcgactcgttgccattgttctggatatactcgcggcaattggcctcgtaacagcaattgtcatgcattaccaagacgcattttccgctgacctgatgacgtcaccattcggacttcgactagccgaaatgctcgcggcctcaaacaacgagattcaaaacatctttctttttggtggtatgaccttagcgttgatcagtcgcatgatctggttttacctgacgcagtggttatttcagctacttgaaaaagcggatcaagaccatgatagcgatgcaacggacctttattggacgccgaagcatttattgaaacgacaatatcaactccggatcagtctccagggcattttgatggtcggtgccatttttctggctttaactggtgcctttaactggttgccagtcgcgtcagagatggcttcacaaacgcgcctaccaaggacggtatctagcagcagtgcctccgccgcaagtgcctcgtccgaaatcaccaatgaatcggccacttcaagttcatggacgcaaaataccgacaccacctacccgattgatgctatgaaaacagcaccacttgcacctgccagtgagctagcgggtctgacagacgctgaccgggcggccttgttcttcacggcttactggaccctcaacggcttacaacaatccgaagtcgctgactacgcaaacagtactagtgaaacctacagttatcatctcgtcccgggatctagcagcaaactcatcgtgttctctgagtttatcccttcggtcaatcagacagactatatgttttatgccctgattgatggtgagcaggttgccttctacaatatgtatcagtccaaaacgcctattaccagtcttgctagtcaatacagcctcacggtttccggtaccactttgcggcctagcatgcctgaaatacgtgacagtgacatgaacatgcggcagctcattggggcctttaagtccgataaaagtttcgatcagactaagaaaggcttgcatcgaggggcggatataccgctatagtgcgctacaactaaagcgactacctgcgaagcctcactaagctttcagatagccgctttttattgatcatgcttggttaaattcaaagataggctctttttcatagggatcatgacatttgtcacatgccattcatgacattcgcgactactggccagcccactcaccgcgtagtatcaatggtggaggtggacgaaatgaccacagtaattcaagcagaacatttaaaatttagctacggtgataaagcagtcctaaaagacattaatttgacggttcagccaggtgaaattgtcggcttaattggtgttaacggcgcaggaaagaccacattacttaatatcttgctcggactactatcaggaacaggtaccgtcaaggtttttgatcaacaaccaggtacaactgctatcaaggggcgacttggttcaatgctgcaaggcgacatgatcattcctagcatcacggttggggatattctggctcttgctgctgccgagacgcctgatgcgcttgatccagctgcattactcgaagagctgcaactgcaacagcttaaatcgcaacggctcggcagtctttccggtggtcagttacgtcgagttacattcgccgttgccttaattggtcagcctgatttgctctttcttgatgaaccgactgtcggcatggacgccactgcacgcaaagaattctggaacaaaatcgagcaacttcggcaacaagggaaaacgattatcatcaccagtcattatcttgaagaaattcaacaggtcgctgatcgtttgttgattttacaagatggtcgcttcacttttgacggctcactccaacaacttcaaaaaaagcatttaggcgctaccattacttttgaaaccgatctgcaacccgccatctttaaaggactcgctgctgttgatcaggttcacagtatcggttccaaacttgcgatccatagcaacaatggcgatcaaacgcttaagtcactcgtcccaatgcttgatcgtttgcatcaaatcaacctcagtcgggaatcacttgaagatatcttcttacaattaactaaacaggaggcagaaaaatgaaaacactcttagcgcaactggcctttgatggcaagcggttagtcgtccgcaattcttcgtttattttcttctcactcttaatgcccgcaggattttatttgctctataccaaaatgatgatcagcggctctgcaactgaaattaaatattttaatatcagttatatggatcagatgattgtctatagcattttgattaatgctttcttcagcattgcatccatcttaaagcgtgaccgcgataaggggttcacaacctttctaagactatctccgcatggcactttgccctactatgtgtcaatcaccttttggatgctcatgatgagtttactctcagtcatcgtgttaggcagcattgctgttggtgtcaataatgtgagccttggtaccgaccaatggctaggactccttggtgtcgttttgattggacagctgccagtgctcatgattggcatcgcattgtcgtatattcatcgcgaagaaatgctcagtcttgctagtaacctgctcacctttccaatggcgattatcagcggcttgtggtggccaatcaccatgctgccaaactggttacaagttattggcaagcagatgccaacctactttgtaaacaagctcttaaatcaactcacttcacgtgctacagtagacttaactaatttagttggtattgtggtctggtttgtgcttggcagtttgctagttgttgcgatgaccaaacacgaacaacgaaagggcgtggctttgggtgaggcatagtctccgttcatggttaagaaatctcgaatggaccagctatatttggctggtctatttgccgtacatcatgtcagaatttgtgccagtaaaatcaatcaatgattggctttggataggtttaggtatcctgtttctaattgtctatatcttagtaaacgaggtcgatcattggctgccagttacgattccgcttgaactcgccattgcaggtattttctctatttttgccctcaacaattacatgattatttaccctggttggcaagttccttttatcttagcccgttttccacgaaaatatttccgttggtttgccgcggctttttatttaatcatttttgtaagtttatggcgcgttaatcagcttcatcccgggattatcaatatcaataatcctgatatgtttaatctgatttttccacttgtttcgcctatcatctcttatactgtttcccggtcagttatccatcaacggcaattacgtcaaaccaatcggcgacttcaagcaattgtccggcgaggtgaacgcgaacgaatcgcccgagacttgcacgatacgctcggtcagagcttttcgatgattacgcttaaaaccgaattagcaaaaaagttgctcgtgaaggcgcctgaccgcgtcgctcaagagttagacgatattgcacaaactagtcgagatgacttacagttagtccgttcgattgttaacgatctgcaccagcagtccctcagcgaaatgatgttgatgcaaggcaagaatcttgctgaggcaaatgtcgttctgctaaccagtggcgaaagtgaggccgctgaatggccgacaaaagtacaaattcgtctgagtgcggtcatttctgaggctatcaccaatgtcatccgccacgctcacgcgcatcaggtagagatgatatttgagcagaatccaaatggctatctggttgagattcaagatgatggccattccaaaagttataagcgcacaggatcaaacggtattagtggcatgcaacaacgtatgaaagaagttaatggaacgtttacgattaatcacaaccgccaaggcactcaagtttcactcactttaccaaaggagcagctatcacaatgattaccttatatctcgcggaagatcaaagtatgttaaactccgccctcacccagctactagacttggaagatgatctacacgtactaggcagtgctggtgatggtgcaaaagcatggcaggacattcagcaactcaaaccggacgttgccgttctagatattgagatgcccaagttaaccggattggacgttgccgataagattcatggcagccagttagcaacaaaaattattatcttaacgaccttcgcgcagaaagcttactttgaacgcgctattgctgcccaagtgaatggttatctgctcaaagacagccccagtgatgatttgattgatgttattcgaaaagtgatgacgggccaaacggtttatgccccggaattagtcacgaatatggtgaccgctgaaagcaatccccttactgatcgcgaactcgctgttttggcagaagtcgccagcggcttatcctcaaaacaaattgctgcatcgctgtttctctcggaaggaaccgtccgcaattatttgtctgctattttcagtaaactcggtgttcataatcgaattgaggccgtgcagatggctaagaagaataagtggttggagtaacagattctatcaagcaaaacaaacaatgcccgtttcccaacatattgagaaacgggcattgttaatttgatgtcagttcaggtcaagtctatgaagcatggctcattctcgtgacgcttaatacgactgaatcgttgcaccaatcagtcccggtcctgtatgaacccccaatgacggcgagatctcaccaataaaatcaaccggtcggccagtcacttcgcgcaatttttctgccaactttttaaccaaagctggattttgaccatgggcaactcctagacgataatgagcgctatttaagcaatccgttttgacttgttcaaccaatttccgaatcgctttatcttcggatcgcgccttaaaaagagggtagtagacgccttctggatcacatgagatcaccggtttaatgtgcaaaaccgaaccgacaaggcctgccactcggccgattcgaccgccggcactgaggtacttcaaagttggcacgtagaaataaatccgacttttgacgattgaggcacgaacttttgcaatcacgtcctgaaaggattcccctgcattgatcaatgatgcggcataggctgcttggatgccactgccaatgccgatgctttttgtgtcaagaatggttacggtgtcaacgggaaaatcttgcgcggccaattgaaagacgttgttcgtcacagacaacgcgctcgaaattgtgataccgaggatttgctgataaccagccgcgaacaaccgatccatcgcctctttggcagcttgcggtgacggacttgaagtctgcggcaatgtttctgccgttgctagcgccgaataaaattcatccggtgtgatatcaactgcatcaaggtaattatgcccattcatagtaatattcagcggtacgactgcaatatttttattttcatcaagaacactttgagggacatcagaacccgaatcaacgacaattgcaatttttttggtcatgttctgcctccttgcggctttaatatccatattatatggtttctaagactagatgtaaataggttcaccacatatatctttttccgttcatgtgaatattcagccagttttgccaacaaaagtcgcttccacagcaaaaagagagtcaaccagtcacggtcaactcccttttgtcctatttccgacgaagttttgtggttacatcgcaatatccccattcttagaaactttcatgaagattagcaaggaaatcactgtcaacgcggtcaaaatcgttgatagtgcagcggcaacgccgtaatttccacgaataacttcggtataaatggctactgtcattgtccgagtcttgacgttgtacaacagaatggatgtggataattctgagatcatcgtgacccatgaaagaatggccccatactaatccctcgttttgaatgcgcttacgcatatcaagtttacacgagccgatctgttctgtcaggcatggcgatttttattgattttgttctgggcgatttggccgcttattaaagcttcttgaccaacaccaaacaaggattccaagcatcccataatgtcggaaaaacttccaatcgctcaaatcccactgactcgtaaaaacggatggtttgatcatattcaggataatgaccttcatcaaccgtttttacctgcaggtagtgggcatgttgtttagcgtcggcttctaatgcctttaccagctgatggccaatcccttgatgatgaaagtgtttcttaatgcccatacaactgatttcgccgcttgccttgctggtttggcgataatcgataaacccaatcgcctgaccttcatagcaagcaacccataaagatagttttgcagcctcttcaacataagtgttagttgcatccggcaaaccaaaccattcgggcaaatcggccaaaacagcccgcacaatcgcttgctttagatctggatcttcttcgcgagcgactgtgatacctttatttgttggcatttattgtcctttctccaacagaaactaagtgtttgacgaaaaaaagctctgctgcgtcaatttccgggtaggtcagctggccaaattgctcaaaaccaagtgccttataaaacgccccccttgatacgacatggtatcgaggtgaacaatcggacagccaaaatcttttaaggcatttaataaagcatcaacgagagccgtgccaacacctgcatgtctgttcgtttcggctacccacaggctttcaatataaccgattttatacatggtactgtaaacgaaaatgccgccaatacattggccatcttcttccgctaaaaaagtaaaagtcacacccattttttgttgcagtagtggtttcattttcacattgtaggcatgaagtttattctcaatggcttccatcgctaggtcttcagccgcctcaattgaaaaagtcgctggtacggtaaagacgattggcagcgacaatggtttgacaagaaaatattcaatcaccctggcataatcataatcacgtttggcaaattcgtgatagccgttttcaagataaaatgctggtgcttgataatcaaaagtttctaatcgcacccttttgcaaccagcagcttgcaagccttgttcgacagttgctaacaaggcacgccctaacccctgtcgccgcatggtttcatctacccagagcaactcgatataaccaatcgcattgtcatccgaactcgccgcaacaccgccaaccacttggtcaccttttttgatgacgtacgcaaatgacacgtcggcacctgctccgttgaagggatgctgatgccgattaaattcgtccagtttttcttctaaagcccatccctgatcggccgtccctgctttaatttgcattccttcctccaaaatcccccaaatgccattccctgcagtaattttaccaagtcgccaaaaaaatcataagaagattcgtttacttatggttacgattatgattatacagaaaacaactggcgaattgaacaaataatataagtcatcattctcttctaagacatgggctttgtcagattccgaataataattacccataagaagcaggccaacattgccgctgtatatggcattgttggcctgtttgagggctgtggatgattgctcaatgttttcattgatcaatctctgaagaggtctgaacgtaaccggcaatagcctcatgataagcctgcaacaagctatggacgtattgcttgggtgcggttgattgcttgagctgttgccaaagaatcgcggcaacctttaggcgcggtcgaaattgcctagtcgccggatcagcaaaaaagtcatggacgaaacgattccattcatatgttttttcttcggcattttccgcgagaaattgttggcgagcttttgaattgcgagttgcctgataaacatctattaaatcagcgaccgttaatgctaattggggttgcgcgtccgcttgacgtttgagaacggccataggttttgtgaatgcgaacttgctgacatgaaagtacgcagcaaaaaattgtcgcgccgcagcattgaaggaaaatccagagttggcgaggggcgtagttaccgataattccttaacaggtttagccagtcgtttaaccttgctcgttggtgtgtcaagcggctgccctgccaccaatgcttgcaaacgctgatttaataccgcctttgtaccaccagcaggtaaccgatgctgtcggcaaattgccatcaactctgttttgtaatgataatgtttgaaaaagtcttcattcaaatccaacggttcactccttattgtgagcgcaaaataggttactatcagcaaaatcgatggctctgtctcactcattttgaatatcaatgatttgtaaaagtaccgataagtttacttgaagcatgagtctcgttcaaacagaccttgtcaatagtgtcgttcggacacaagcgtcactgcttcacccgcattaaccatcagtaacgctgtgcggcttcccttccacccgcagaacttcctgcacacttggccgttgtcgcattcgctcgtcaaaggcctttaattttggcaaatgatcaaatgaaaaatcaagccggtgcatccaatttgtcatgacaaacagataaggatccgtcattgaaaaatgctgccccattagccatggtccctgaaaccgtgcttcaacataagctagtcgcggggcaactcgctgccacaccaaccgtttgctatcatccgtattaggtagccaattacccttccgaaaaggcgaaataaagtttttgtggagttctgtggcaatatagttgagccacacccgctcctgccagtattcatctgtggcataattgctaccatcattttgtcgggcttgaaagtcaatgtactctaaaatcacagcacattctgttaagtattgttctggcgctatttgcaaggtcggcacataagacttggcgttgatttgatcgtaatcgccaccgcgccaagttttttgatctaagttcaccttttccaactcaaaattaagtcctgcgtcagtcagtagaatatgcggcgccattgcactggttcctgaagcataaaataatttaagcatgtggtacatctcctttattcgatgaatatcgaacaagcaagccaaaaattacagggtcgctaaaaaccccggtaaaaaccgatcaaaagctgtcgtattgatagacagatacttgatttgtgctacttggcgcgtattcgtcaagcccgctaaccgcatagctcgaaaatgatatgacactgtcgatttactcaaatttaactgggcactgacttctgagcacgtcaattctcgaccagcatgataaaggatacgcaaaatctcaattcgatgcggttcacctagaactttaaaaatattcgccattgtttgatctgcttgttcgatattcatagaacaagcgtaattcttttgatcctgaatgacaaccccagtgctctaatcagctagcatcaaggtagcatctcaaaaaaccaccgatcaattctaattcgcgaattgatcggtggttcagatgaatcatgcaactttaataaaacgatggtttgtcccactcagtccccggttcaacaacgccaatatttgcgtattggtataagctagggtgtctcacgatggcagtcactaacttcgccactgcttgacgtgttacctgagttccgcgcaatggctggccttctggcacgatttgatacttttcgttgccgttttcgtcgtataaccatgtcatgcgaagataagtggtattcaagccgctgtttaaaatcacctttgcggcctgtttgtatggtgtgtaatctcccatcatccgcgcattccagttgccaaacttgccggcaacttcatcgtcaatcccaaggccgcctgcgacaatcaaccgttggacaccggtatgcttcatcgctgtgacaacattttgattaccgacgagactggaacttgccagaaaaacgatgtcttgattcggcataacctgttcaatatcggcttcttgattccagtcgccgtcaaccaacgtcacacgtgactcacctgcatattgccccaaccgttgcggtgcttggcgggcaaatagcgttaggttcacagttttatctgccaacaaatctggaattaaaaagcgtgaaatctgactggcagcgccaagtatgaggacgtttatcattcaccatacacttctttcgccagattaaacgcagaccacgcctttggccagccggcgtaaaaagcgagatgagtgatttcagcaacgacttcctctttcgtcagtccgtgttcttttcctaattgtaaatgggctttgagttgtggaaaatcgccactggtcataaggcaagcaatcgtgatcatgctgcgatcatgggcagacagttcattctcttttgcccagacttcaccaaataaaacatcgtcattcaatgcggcaaactgtggggcaaatttgcccaactgtttgcgtcctgctgtttgttttgccatcttattttgcctccgttagctgcgcataagcttgatccgaaacaggttccaaccattcactagtccctttggtgatcgccacatgactaaaccagctgtctttggttgcgccgtgccagtgcttcacgccttcatgaatcgtgaccacatcaccgggatgcagcaattgtgctggcttaccggcttcctggtaccagccctcaccgcttgtgaccagtaaaatctgaaaaccattgtgatgaatatgccaattgttccggcaaccaggttcgaatgtcacgttggcaacagtcacatcgatctcatctgccgcggcgaccaaaccattcagataactgttgcccgtaaaatactgttggtaagcggtattagcttcacctaagccgaataatccggcgttttgattcttgtcattcatgacgaatgccttctttcaatgtttaagtttattatcggtccgatggcttaaaatgtataatgcttatatagcatatagtattatgatatttttttatgtatcggaggccttttcatggaattacgaacattgcgctatctcgtggcgattgccgatgctggcacgattacggcggctgccaatgcc

SEQ ID NO: 57 - DNA, 1623 bp, Lactobacillus paracasei
cttcagtatcgagtccctgcggcatggcctcaacaaaggtttttgcgtacgccatatcaagcacatgccataactcttcatctgtatagttgcgcgtcgccccatacgtcaagttataacgaatggtacctgccataattgttgcatcttgcccaaccagcccaaactgttcacgccaatcttcaacattcagatttgcgatgtcctgatccccgatcaaaatgtggccgctatcaggcgagtagaagcgttctaaaagactgataatcgttgacttgccaccaccagacggaccggcaaaggcaatgacctgattaggtgccgctgtcaccgtgacatcttttagcaccggcgtttcctgatcataactaaagctgacatgcgacattgtcaaagcttgaccactggcatcttttagcgggcgacctgtacgactttcctcaggttgttgcagtaactcatcaatccgcgccgttgacccgctcgcttttgctgtctccgcaaaaaactgtccaagcgttgaaaaaggcccaatcaactgggtgagatacattaagaaagcaaacaaggttcccatattcattgacccacttgcaacccgactggcaccatatgcgagcacgcccacaatcatacccatcattaatgtcgtcattactggctgggcaaccgcgtcataaactgcttccttcaagcccaagcgatacaaacgatcaatgcgggcatcaccggttttcttttcgactgcttcagcattggaacttttgaccaagcgcacagcgcccaacacatccccagcctcgccactaaaagctgccagattctcttgtcgtgaaaaagcaatcttacgcgactgagtggcaactggcaggaagatcagaataacaagcggcacaacggcaaacataatcgccgtcattttccaatctatcatcaacatcaaaatcagcgcaccgatcagttgcatcaaggctgtgaccatgcgcggtaccgagttggcgagtaaatccttgacttgagtagaatcattcaccagtcgcgatgtgatttcgccagacttggtggtgtcgaaataactgactggtaataccaaaagcttggcccacagcttattgcgtaatttggcaacgacatcttcgccaaaaaagcctaacacggcacctgaaccagcactgatcaacgctgaaccaataaacagcccgacaacgccaatcaccaaattcatgttgaccgcatgccccaacgcattaatcagcgacttggcaatggttggcacaattaattggccggccgtcgccactaatcccaaaagcagtccaagaccaagctgccaatgatgtgggtgaatggtactgattagtttcatgaaactacggaaatcgaacttttttggtgttgactgccttttttcggctgccatcatcgtggttgaacgttgcatatgcatgtgcctccagttatcagctatttaaaatagttagttgattatatgtctaactaacattattctagcctaatccttttgttagtctatgtcaacaaaaactaacaaaaagaactgaacaaattttgtccagttcttaaatcaccttgaagttccatgtcctcggctagtgtgcttgc

SEQ ID NO: 58 - DNA, 1043 bp, Lactobacillus paracasei
gcaccatcatctgttgctccacagcaataaggaggacacaagatggcagatttcattgtatcaatgattgcagaaatatttacgcttatcatttgtgcatttgcgctttatgcgtccatcatatctttctcattgtttgactacgccttcagatggtttgtcgcatttggcattgtgttttcgtccgcatgcattttaatatcaatcgccgctatgatcttttcctgctatgaattcttttctcaatgaaagagggaatcaaaacaatgaaactaaaaaataaactaatcaccttggtagtcgccttcttcgcggctatttcttttgccttgccatcgcaggtcaatgcagcaaagggtgatcagggacctgattggtcaaagtatcagggagcaagtggacgatacggcaccgatcaagataagttcgtcatcgctcagattggtgggacttacggtggtacttacatcgatcagtggacgtacgatagccaaattgccagtgcaaaggcagcaagaaaacgtgtgcatagctacatctggtatggcgttggtggaagtagccagttggggttagaagcacttgaccgttatatgcctcgtatcaaagcgcagacaccaaagggaagcatcgttgctttggactacgaagatggtgcttctggcaatatggcagctaatacggatgccattttagctggcatgcggcgcattcaagctgagggttacacaccgatgtattacagctacaaaccgtatacattggcacatgttgactatcagcgcattctgagagagtttcctgacagcctttggatcgctgcttaccgtgattatatgccaactaccaaaccagactatggttattttccaagtatggatggggtagctatttggcagtacacgagcgcatttgggctgtcgcaaggcctcgacggtaatattgatttgcttggtgtcaccgataatggctactcgaagcaaccagtaacacctatcaccccagcaccaagcaaaccagcgcaatcaaccgcagccactgat

SEQ ID NO: 59 - DNA, 35997 bp, Lactobacillus paracasei
aatggcggcgaagttgggcttcatatcctcaatcataaattttctaacttcctctcgaatgtcatgtctcacatcgttttcctccttggttacgatgtgattcatggtatcaaaaaatgtaggaaaaccgacaatttcaaatcgccattttcctacattttatgactgacatcgacatatgatatttagtaaccacagaaaacatcacaggaggcattccccatgaatgaacttaccacagaaattatcgctgcactagcccaaaaacaagatttggacgaagtttttcgtcaccacctaaaacttgaaagcccggaatgacgtctactgtgcgtcattccgggcttcttttgagcaaaattaaacacaagcaacgccttggcagtatacttgagtcgactaaaaccaagatacagaggagtgcttgtgcaatgtctattatagaacatcatcaagagaaattggacctttctcagacaattcatggattctctcagctggttggattctccaaactttcaactcatgttttcggccgccaccaaggtgaattctcactacttcaaatcatcgaatggcttttgacgacgaagtttctggggcggtctttgtaccgagctcagccgaaccctcgcttcacaacccgtacggtgcgtaattatctcaacgatggacgaacgaattggcaacgtttgacctgcttgatcgcccaagccctgatcaagtacctgcgtccttttattcatacgcacagacgccttgcatttatccttgacgataccttgcttactcgtgatacagctaagaagacggagctgttagctcgcatcttcgaccatgacgatcaggtctacaagaaaggttttcgcgccttaacgctggcgtggagcgatggcgatactttagtaccggtcgattacgcgttgatgtcgagtaaagacgccaagaaccgtatcggtggtgccagcacgaatcaggatttgcgtacgcttggcggcaggcgccgcgcacaagctgtccgcaagatgaccgatgtgagcgttgaactgatcaaacaagcattagccaatggtcttaaggtgggctatgtgttatttgatagctggttcagctcaccgcggatgtttttggctttgaagcgcctcggtttagacacgatcgcgatggtgaagaagagtagtaaggtccactatctttatcgcaagcggcactattcaattcctgcgctatataagcgtcttgcgtcttctaagtatcatacgaaggcaaactaccgctatgcctgtgtcgttcaagcagaagttgagcaaccggatggcagtgtcgaaatatttccagtgaagttagtcttcgtctctaatcgtggccaatccgaccgcttcttagtactcgccacgacgaaacaaagtcttcatccggaagaaattatccagatgtatgggcggcgctggcaaattgaaggctacttcaagatcgccaagcagtatcttcgcttggatcgatcacaggttcaaagctacgacggcctttgtgcgcacattgcggtcgccatgatggcttacgatatccttgcctggcgacagcgacaagaagcggacgtacgcacccttggcgacttgttctacaacatgaacgaagccatgccagaccttgcgctaacgcaagctttggcatggcttcttgaagaacttaacttgattcaagcgacgggaacaactgagatgagctcagcgttaaataacgtcatgggacaatttgaggcacatttaccgcaagcattggaaacacagctcggcattgcggcttaagttgtcccaaaactgaatattagtgactcagcgtaagtgataccaaggaatcagtctggattcaagcgttcatgttttagttacaaaaatatttcatcgtacagaaagcggttttatgaagttgagcatgccaatagatgagttatacttaaaactaagtctttttatgaaattatatcaattttcaattatttcacggtcgtctgtttacaaaatgacattctgtggctgataaccagccaaaaccgtgattagcatgaaattgagagatcacacaacccgggggagcgtaattcatgagtaaccagatcacaatcaacgatgtgcctgtcactgcattaccagcacacaagacaaatcctgattatcatacagataagcagcaagtcttcatcgtggggagtaaggggattccagccgcttatggtggattcgaaacttttgttgagatgttaacccgtttccagactgatgattcgattcgttatcatgtctcgcgattgggcaaggacacgcaacgttatatgcataatggtgccaaatgctttaatgtgaacgtgccagatattggaccagccaaagctatctattatgatattgcagctctgaaacgctgcattgattattgtaaagctcgcccacaaatcaagcatccgatcttctatgtgttagcatgtcgcatcgggccgtttattggtcatcttgccaaggaaattcatgcgcttggcgggaagctgtatgttaatcctgatggtcatgaatggaaacgggcaaagtggagtgcaccggttcgccgttattggaagtattcagaacaattgatggttaaacacgccgatttgttgatttgtgatagtaaaaacattgaagcatacatacgtactgattatcgtcagtacacccccaagactacgtttatcgcttacggtgccgacacaaagcggtcaaagcttaccgatgatgatccacagttgcttgattggtatgcagaaaagggtttaaaatctaaggagtattacttggttgtgggtcgatttgttcctgaaaataactttgagacaatgatcaaagagtttatgaaatcaaagtctaaaaagaattttgcaattattactacttctaatgatgagtttctcaagaaactcgaggggaaactgcatttcaaagatgattcacgcattaaatttgttggtactgtgtacgatacggaattgttaaagaaaatccgtgaacaggcatacggctactttcatggccatgaggttggtgggaccaatccaagcttgcttgaggcattgggtagtactgatttaaatcttctactgaatgttgggttcaatcgtgaggttgccgaggatgcagcgttgtattggactaaagaagatggttcattagctactttaatcgacaaaagcgatacgctttcaaagaccgaaataataacgattagtgtaaaggctaaggaaagaattcaagacttttacagctggtccaagattgtccgagattatgagacacagtttgttttggattagcttgtaatttgaatcgcgacattgcaatgctctgaatacaattttagtcaacgcagcgtgatgtgaaatgcccgaatgaggtaattatgaaaatactgcattataccattggttttcaacctgatagaacgggtgggttggttaaatatgccacagatttaattgaagccgagagccgtcaaggaaatgacgttgttgtgttgtttcctggaacgttagggattagccaaaagtttggcattcatcatgaacgaaagacgagcctgaggattggggttgagtgttttagcatcactgcctctctcccgttgccactagctagtggcattcggaatccagaaagatttatgcgcaaagtggacgagcaggtttatcatgagtttttaacccgcaaccatattcaaatcattcatgtacattccttaatgggcattcatcttgaactttttcgtgtggccaacaagttaggcattccaattgtatttacgacacatgattattttggtctctcaacggagcctaacttatacttacatggaaagtcgtatgatgatcaaaataatattgcattttgggaaaaggtggctgttcaagccccgagtgtacgtagagatttgatttatcagcttcctgggtatcacatcctgcgaaacatcataaaaaagatgcccaaaagtaaaactgaacaagatgctaaagttacgaacagtgatcaagacttgaataccagattatccgaagaactgaagaacctaaagcgatattatgagacaatgtttaagtacattgactattttatcttcaatagcgaagtaactagaaatgtttttgaaaaaaatctgccttttcctttaactggaaaagtagtacaagttacttccaaagacgcggtgaagcgtgagataaggattccagcaatctcaacaaaaacatccctgactattggctatattggtccaagtgcagactacaagggctttttcgactttgtaaaatttgctaacaattcgcagagtgttaaccgccaatttaagacatatggatatgcgccatcgcttaatttgaatggcattgaagaatgtggaagatttagtcgagacgaagttaaggcggtgtatagctctcttgacgttttagttgttcctagtcgatggaaggaaacattcggcctggttgttacagaagcattaacaaatggtgtacgtgtttttgcaagcgataatgttggagccggagaactcttaccagatttttatcgatttgaatctatagaggatcttcagaataagttcagatctgagacactaccgaaaattgaagtcgtagttccaactttctccgatcatgttcagaaaattgaaactctctatggaattatgattgatggcaaaattggaccaggcttctaattgctagagtaatgttatacagatttgttatctgagtcgctaggtgcgaaattgcgtgaacatttagaatgtttttaggatggagaaatcaacgagatgaagtcagtcagtcagcaagtatcccattacgctagaattcaaatttatgcacgaactgcaataaaaattattcgaggatttatcagaaagatctttttaagaaaatcaagtgggttactttttatcggtaagcatgtctcgattcaaaattctcagtatatttcagtaggacgaaacgtaaagttcgaggattatagtgagattcaaggtctttcaaccgaatatctgactttcggtgacaatgtgacgattggacgaggggttatgattcggccaagtagctattatggtgtcgggcacatcggagttggagtgtcaatcggggcaaacagttcgatcggacctggtggtttcgtgggctgtgctgggatggtgaaaatcggtacaaatgtcatgataggaccgaatgtgatgatcattgctgaaaatcatgtgttttctggtcaagctacatcaattaagagtcagggcgttgttcaaaaaggaatccatatcgaggacgatgtttggattggttcaaatgttacgattttggatggggtgacgattggcaaaggctctgtgattggggcagggaccttagtgtcgaagaatgttgcaccaggaacggtaaacatcgatcatcgagatcgaattgcacgtgatcggtctggaaaagaggggatgcagaaatgagtgaacacagcgttagcgtggtgattgtcacatacggaaacagaatgaactttgtaagtaaagttgcgactcaagtgctaagtatgagttcagtcagacacctcattattgtcaacaacggtaataaagaacgcgttcaatcggatgattctcggttggtttccatcaatttgccagagaatactggctcagcaaatggctttttcgcaggactcaaaagagcacgcgaaattcaagacgattttgtttggatactggatgacgataatttaccccaacggggtgcgctcgatgtattacttgaagattacgaccaatcggacggcaagcaaatctattgttcacttcgcctcgatcgaactgaacttgttaaacgcggcgagatgcattatttgaaaaattcattttttggatttagccttttaaacaagcttaagcgacatggtgcatcagtaattgacaaagaaaatcgttttttggtttgcgatactgttccatatggaggcttgatgttgcccctcgacgttttgaatagcatcggcttgccaaatcgagattattatctctacaatgacgataatgactttacatacaggattacaaaaaaaggcctcatgatcaattgtgatcctgaatcaaaaattcaagatttagaaagttcatggtatcgaagggaaaatgttccaatgtttcaaggctttttccgaaccaagatgattgcgagcggtttatacactattcgaaatcgtacctactttgagaagaacaatattgcgaccaacaaagcggagtatgtatttaatataattatttatatgatatatgtgtttattttttatatgccgaaaaatggtgacggtttgagaagatatcaccaaattgcttcaatgatcaatttgggttatcgtggtaagctcggacggatgaccgaaacgaagggaaaatagttttggaactgtacaatcgcataactaagcttaaatacattccagctttactcgctgggtttgttatagcattaccaagtaacgtgatgtctaagttgtttcattctaagagtaagttgtttctagtcggagaaaatggcggcgtcggatttcaagataatggaaaattcatctttgaagaacttctaaagcgcaatactggaaaaacctattggatgacatttgcactgaattgcaacacggatttaaaaaaccagtgtagaattggcactgttagaggatactatttatattttcggagtgctgctgtgttttatactcattctttgagcacagacattgcaccgcttgctaaccatattgtttttttcaatccgttgcacatagaaatcagtcacggtgtcgagggattcaagaagaagattcaaaccaatctggttacaaactatcccgcagatttatatacctgttcaaattcatttgagatgcaaattaagcacgactattggaaaattccaaacgataagttaagtataacgggtgtggcacggtatgatggacttccgatccagaaagcgtcacattttacaccacggcgtattctttatatgcctacatggcgcgagtgggattatcaggagtctagcgctgactttaaattaacgaacacttttaagcaaatcaacaatctatgcacagacagtaacttgagcaatcttttacaacaatataatatgcatttagttttgagattacatcctttttttcaaaaatattctgaatgctttgactctacaaaatttgcaaaaaacatatcagttactgatggtgatgtatcagcgttgattcgtgattctgacattttaattacggattactcaagtgtttcgtgggattttttgtattcgttgaaaccagtactgttctttcaatttgatagagatgaatatctaaatgtacggggtagctatcttcaaattccggaagatttatttggacccagcacaactgactggagaaaaattccagaaatcttgcaaaaccaaattttaaaatttgatagctcgaggttgataaagcaacgagacaaatattttgattattctgatcgaaaaaactccgctcgaattgtagaagcatgtacggacttacttgatgaagaataatcgtgaaatcaataaaggagaactcatacgtgtacaccaacgcgttggatacgtgaatatgaagaaaattctttccataattttcaccttattgctactcattaaagtttcaaaaaaaatgtggacaattgttgggctactttttcctcatctcggaatattgaaacagaacgcaaccatttcgattgcagtatttattctttgcttaattctcttgggttgttctcattggagaatgagaaagaatgactttttgctgtttattgtcctgatttttactcttctgatttcggcagttacgaactccacttccacacaaagtttcttttcacaattttacattctttttgatagttactcccttgttcttgtcgcgatattattaaataatcaatcaatgagaatgctaaactggcgatctgttgaagcaaccattctcgtatttgttacgctccaggcattgctaggaattagtcagtttatttccaagtcgccgattgttccaattatggatgcaagcggtgatcctgtagtaaattctatttactatgtgaatggcgcaagttccaataaggcatatttcatgtttcaagccggcgctaaattgcgtgctttcggcatgacggacagtggattcacatttggcttactaatgctacttggactggttgttattctaaaacgccgtgagatcaagccgtggcttcggggactattggctattttgtattcagtgggtatttattgctcgtatacccggataatcatgtttgctctgtttggctttctgattctgaaagttgtctcaaaaaagcatctcatttttataaaatttacatattttttcggggttgtaagtcaactgggaataatgctacttgcatacacactaacaagtatgcaggtcatgagttcctcaaccttctggggatcaatcgtttctcgtatacaaggaataatgttttacacagaacactattcactgaatttgattcattttctctttggattcaataatgttgtaaattcttcgaatattaataccatttatagcattgataatgataccctaaatatatactttgatatcggaattttaggtttacttgttatcgaagtcttttttgcttcaatgttactgaccacccttcgagaaagggtgactttttatcaaataagttcttttatggctgtcttggctcttattggcattgtaaatagtccatattattttattgcttttttgatgattctatttgaagttgagaggtactccgatggcacatcaatcattggttctgagattgacgccggaatctctatttactgagacttcgactgacatatagtaaatcgtatatattgatacttccaaagattttggtcacggacactttttagacacaattattgtagcttgcacagataacatggtggttgctgaagcgaggagatgcagaatgttaagcgtaatagttcccgtttataatgtgaagcactacttgactaaatgtattcaatcaattcaaaattcgtcatatacaagtcttgaattgttattgatagatgatggctctaacgatggttcaagtgagatttgcgattacttttccaatcaggacgcgagaattcgagtatttcataaaccaaatggaggacagtcttcggcaagaaaccttggtatgcaagaagcatctggtgacttgattgcgtttgttgatgctgatgatactgtgtctcctgattattttggtaagatgatttctgtactaaatcagactaatgcagatatcgtttcctcgccgtttgaaaaacatagtgatcgaattcgagagggcatcattccactcgaaagttttatttgtgacgtcatggctggggaacttggtactgtcgtgtggaacaaactctttactagtagattgttggcaggtgtaacgtttccatcaaattctattcatgaagagatagactttaatcgacaatatttaaagcgaattggtactgctgcggttgttagtgacagtggatatcgttatacgcaagatcgttcaggcaacacgaattcgtcatttgatccttccagagttgaaacatatcggcagattgataattttatcagtgaatatcgacgcttattttcacgaaaagtagtttgttcattagagatgttcggagctattcatttttattctatgatgaatttggtcgcgcatttttctgtaccgaaaacaattaacaccgagattaatgcgaaatttcgaagatattattggatgtcggtaaaggatggggcacttttcctgcaccccaaagccatgattaagatgcttgttcatcattagcagaggagaaattgattgaagaatgtcagaaattatttttacaatctgtcgtaccaactttttctattaatagttccgttaattacggttccatatatttccagaactattggtccatctggcgtgggtattaattctttaacgcttgcaagtacgcaatatttcatctactttgctactttgggcctcactacctatggacagcgtgaaattgcatatgttcgagatgataaaaataagcttacgaagacattttgggaaattgagttgctatcggttttcaccacgctatttgcgatgcttttctttgcagtattcatcggtattcaagctaaatatcagaaactgtattgcatcgaagcattattagttgtgtcgtgtgctcttgatgtgtcttgggtaattatggggactgagaattttaaagttactgtacttcgaaatttctttgtcaaaattacgtccattatacttatctttgtttttgtgcgtacatctgctgatttatggaaatatgttcttatcacttcattatcgactctcttgggaaatatttcactctggccctatttgttaaaagtgattaatcacgcatttccacgtaagattaacattttcaagcacttgaaaccgacctttgctttatttattccacagattgcgattaccgtttatgtgtatttcaacaagattatgcttggaaatatgagttctgtactacaggttggattttttgatagttctgacaaacttgttcggattgcgttaacagtggtcaccgcaataagcacagtcatgttgccaagcgcagctaagtatttttcagacggtaatgttaataaattgaatgattcaattaagacatcactgaatttcgctttgatgcttgcattaccgatggcagctggattaatgataatttcaccaagactcgttccaattttcttcgggctaaaatttgcgcctacaagtcaggtgatgattgttgaggctatttccataatccccatttcaatttctcagattattggggttcaatacttaatttcaaccaaaaagactcgaatttacaccgtctcaatcgtttgtggagccgtaatcaatttaatcgcaaattggttcttgattccaagtttaggcgcggttgggactgcatgggcgactgtaattgcagaatttctgatagcaggtatggaattggcattcttgtcaacaaagatttcgctcttttggatttttcaagatttgcctaagcttctccttgccacattgggtatgtcttttgtctgttactttgagtcgatgatcggaattgaaggtattgttggtgttcttttaccaactttggccggcatcttgtcttacttcggtttgttattacttctgagagttgatttttttgttaatgccgtaggtacgatcagtgataagtttagccactaacttatcactgattctaaaaacagttaagaggattcaatatggctgttcaatatcatcagtggttttgtttcactggaacttaattgcgatggttctggtgcaaagttgaaattaagcgtagatcaaagtgactgtgtttagtggttgtagcctatgccgctaacaattggtcgacttcttgatacgcttaaaagccgaagaggcctagcttctttcgactttctttgtgtatcgcatgcatggtttcaatgccgtataatgtcctagctgctgtccgagtgctctgataacttgcggaacgaacttgttgccgcttaataaaacggtgatcttgctcaatcagattattgcgatatttggagcactgatgcacacctttgtgcagatagccttccctagtaagctttttaattgcctttagggtcgctccgtactgatcagtcactaatcgatgtggaagaccataggtctttaaaaggcgtttgagaaaatgataggccgagttaaagtcacgcttcttgcgcagttaaaaatcaagcgtaagaccttgatcatcaatggcacggtagaggtaattccattgacctttgatcttgatataggtctcatccatacgccaacttttggaagtgcgccgatggcgcttacgccatagagcccgcataatcggtgagtaatgttgtacccaacgcatgagggttgtgtgatgcacgaaaataccacggtcgcgcatcatttcaactagatctcgataactgatgttgtaacgcaagtagtagcctacggcaaaagtaatcactgattgattgaattgccgtcctttaaaatgatcagtcatctgaaaacctccagtttcaattcatgatacaggatgaactctccctgagtaaactttgcaccagaacctgcagagagcattgcttgaagtaatgaaccatcaacgtacatactgttgaggagtccctgtttcaacaataccagtgccttaccgttgtgttgcaaaagtaggacggcaacaagacccggcacaacctgctgcgctagtttcagcgtgaggtcgtgccgggtcttcttttttagattccgtcagtgataatccagttgttgctttgcttggagagggtcagggtgtattgcgagacttggctcatatcgttgtcagtatcgagatacttcacagataaggtgacggtcaggccgcgcttagtctgcttgaagacaggatcgagcagttccacgaacttgaggttccgttcgataggccgcgtgccgtccttgacgtaatacttgagttcattgcgatcgctttgtgggtacaaggcgaagaacgtcttgaggaacttggttacgttgtctgcggtgctgctgtctaccgaattatcagattgcgtatctggcagcttgatccgtgctgtcgcaggttccgccgcgatggttgggttcttagtgaccaccatatcgccattgtcattttgcatgacgttaatggtgtaagtgctggtcacagccttcttgtctttgcccttggcgagttcttgcgtcaccgtgaatagtacgcggaacgtgtttttggccgtctcgctcacgtcccagaccttaacttcactaaccgtggctgtggttggaatatcactccgcacggtgtcagcgttcagtgattgtagttgctccacgaggtacggctgcaaggctttctggcgttgatcgagggcttcgtggctaggttgccacgagtagtagagcttggcgaagtcggtggcgaaggtcgccaaagcgtgcgtgtcgatcaccttagtcttgatcacttggacttcatgcaccgtgtgggtgtcgatggcggtcatgttcttgtagacgccgaagctggtgctaccgatcaagactgcccagcaaagcagtgtgaccggacggcgcaaaccagggtgcataattttaggtggctttggcgcggctggcttctttttgaaccagccgttcttttgggttttgtctttactcaaggttcgttcaccttgtcctttctaatttcgtagcagcggtaaaagtcatcgtaaatatcgagaaaatgcacgaacagacgttgtagggagattcgcttgcagctctcgtagtcggtttcgatatactgaccgagttcacggtcattgtcgaaatattcttcggccaagaaacgctcgcggtcgagaatatacttgcgatcctctggggcaaacaccttgccaactagccaatgctcaactgcgacttcgtgggccacggccagtcggtattcgcggcggtggccggactccatttctggcatacgatccacgaagcgatcgatcacattgcacaggtcatcagtgttgggttttctttgtttgaagaacttgattcgctcccatttgctggacgcaaagtcgagttctttgtttcgtagcgcgcggttgtcaccaaatttgagatcaacgtgtcgcatcatcgaaggtgttggtgaggagttccatccagtcagagtagccatatccggattcgtccatatcagcacctactttcggacacgtccggcgccgatcagatgggcttgccaataacttgagttcaagtcagcatagcccagcgggtcgccagcgttatacatcttcatgccgccgacgtagatcccaacgtgggtcacgtaatcggcggtattataggtcgagtggaagaatacgaggtcgccgggtttggcgtccttgatgttcaagtgtgccgtggcgtcatattgtgcttgtgcagtgcgaggaagcttgattccggccttgccgtagcaccaactggtcaggcccgaacagtcgaagccggttgccggcgttgagccaccgaagacatagcgtgtgccttgatatttgagcgcttcgtccatgatggcctgtactgttttgtcgtcaaacttcgcgccaccagtgacgaggtattgcgagatgacagaaacatagaacatgtttccgtatgcgtagcaccaactgtctttggcaaccgggtttgtgtaggtgactttttgacctccggacttttctttagcgaaagatactgccagttcaagcgtgtatttcttgccgtgcttggcaacgtagtcgataaagccgccaccgtagttgtagctctgaatcgcggtgttgagatccaccccggcagcctttttgcttttcagcagcgacgcgaaatacttcacgccttgcttgatggacgcttcggtatctagcgtattgactggcaaccccatcgattcactggcttgcatcacatcgccgcccttaccgccagattcaacctgcatgatggcaagtattaccatcacctggtctgaaatgccgaactccttgcaatacttttcgaccgtcagcttgtgcttatagacttcagcggataagttcatcgcgtcggctgtgatcgcagaggcaggctggtcttcgtcatcatcagaggcgatgactgcaaagaacagaccgccgatcaatagtattgggattgcggcgagagctaaccagcgccagagtttcatcgcttcttgtgtcctttagccggttgaatccgctgcggcttggggttgcgtggcttggctgttttttcggacactaggttaagtggctttttgagctttgtcgccggtggtgttgcgggttcttggtgcgtcttgattgcggggtctgcttgtggtttggttgccggacgtggcggccgagttgaagtcggttgcgtcgtggtgcgtttaggcttaccactagcggcagtctgttcggactttggcttggcaggcgtgacagtcggtggtttacgggtcgattcaacaggtggtttggtagccgttggtttgcgttttggttcaactggaggcttcgcggcagttggtttgggcttttcagaatcagacttcggcttgattgcgagcctgcgttcttgcatctgcttacgtcgctgttcaagctgtttgtcacgttcctgctgattggcttcacgtcgccccttgaagctatctttcgcggtttcggcggcctccttagtcagttgcttaccacgatgcaggccatacaaaacattagtcggtgcgtcctttacctgattgaggccgcgcttggtcttgtccttgaacctgttgccaacgtcagacacatcggcgagtttttcacccagacgttggctgcgtggcttcttcggctgttgcggtttggtagcatccgcggtttgttcgcgttgcgtcccagcggggagctgtggtgtttgcggcattccgcgtcctttaccatagccccgcgacaggaaacgtcctgccattgcgccgcccatagcactgccaacaaattgccgaaacattcggttcccacgacgcgagaagcgttgggcgccttgctgggcgtcagagctatggagctgcatcatgcccatcaaatcaccgagcttcatccagattccggcgaagatagtgacttgcaggaaggccacgaggaagaacggcgaggtagccgatagcccgtagaccattgccgatagcgagaacgccatcgtaatcaccagcgtcacgccaactcgggtcatgatcgtgttgaacagcttcatgatgttttgtttcatcaggccgttaaaagacggcaacatggcgagtaagaacgacaccggtaggaacgtcgcatagatgataaagagtatctgactgaacagcatcattgctgtcaggaagaagacgaacaaggtgatcgcaatgttgaacaggacaacgaaggtggtggtgcccagccgattgatggtcatagtcggtgagaggttctcgttgtcattatcttcaatttcagccttcaccacgtcggtacgggtcttgcctttgtcgccaaacgggtcggtcttcatcaacgtgttcacgcggtctttgccaacgttgtcagcatcgctgtcgccaaactgcaaaagcgtccacggctgcttcacttgaatctcaaaaagggtgtcacggatcgcatcgacgcctgacttatcggtggcggtatcagtccccatgatcatcttggagccagtgttaagcgcgctggtgctgatgtcggagctgaactcgttgatcttgctcacgtagtccggggcgtaggcgatgaagctggcagaggtaatgaagatcaccacgaaattgacgattgccgagatggctttcgaggtttcacgcttgatgatgccggtgtaggcgacgtagatgccgacaactagcgtaatcatcaggagcagtcccggatagaatccgtccgtggtgaagccatcttttgatacgccggccaagagttgcatgttcttcccaatcgcgtcagacgtatccttgatgaagtctagtgagtaggcttgctgaatcaggtagcccgcagcgtttgagagatagacagagagtgtccacaaaaagttggtgatggcatacaggccatagcttacggacttgccgatgccgtcgccccagttccacggtagccagtcccaacttgtatccacgaagtagtcaagctggtagtgcgagagtgggtacttggaatactcgttagaaccaccggattgatcgtctaccagcccagctgcgtgtaccggttgaccgccggcaagcactagtaccagcatgaatgccacgacaacaccgaggaacagcagtagccgccgacggttagctttcgtcatcagcaatcacctccacgggtttcggtggccgagtgtcaaaggcgtggtgtaggtgctcaaagatatagtcgaagtgcagcacaccaacatggccccagatgtcttggaacagacactccccattatctagcgaccggagccggttctgattgccttcgtcttcggcatcaaggccaaagaagttgagtgtgttcttgatttcagtgatgtcggtactgcggaacgcgaatttctgcgcgatgttgttcttcatcttttcatcgagcaagtcgtccgcattttgagtaacgagatagaccccggcgttcatggagcgaccttcacgaatcagcttcatcgacaaggctttgccttgcgcgacgtttaggaacgcccaggcttcgtccaagtccacaattttgaactgggcgcggtcttggtgaatgaagtcgatggcaaaggtactgataatcatgagcattgccaccgacaacatttcggcagtgatgtactcctcctgcgtcttgtcggcgtctggcagcaccaagtctgcgatctgcacgatgttgatcttgcggtcgagggcgattgtccgccgcgccgtcccgtcagagaacaacagcgccgcaaagtcgtagtccgtgaaggattcgatgtggtcagcaatgttgcgtgcaatcggggtgtcttcgcggcgaagttcatcaatgactttcaacagtcccggttcgggtgcttgggttaccgcccggattgcctttcgcagcgtcgggaagcggtcggcgtcccggcttgagatcccagttaagaaagtcagcgtatcaacggccaacgattctgaatccttcaagttggacaagatgatataaggatcaagcagcccgcggttttgttcttcactggtcaggttaacgatattgatttcgtcgcccataaagtcgaggttctccgcccagccggtacgttccgatttcgggtcaagaatcagcgcttgtgccccgtagagcactgcgtaatagacgagcaaattgttggagaaggacttcccaccacccagtgagccgaggaaagcagcggataaagcattggtgacggtgcctttgataccttgcgccgcaatgtctggttggaggtagacgttgcgcccggtgtccacgttgtagccaatgtagataccttctttttcgcccaaggactgagtcgcgccgaaaccaaggctggcgatgaaatcgctggtcacgtactggatatagtcgttgatgtagcgctttgaagccgggataaactcaccgtgcagccccagcatgtcgccaaacgggcgcaccaacttgatatttagtgaatcatagaagtcgagaatctgatcggcgcggcgtttcatttcgtcttcgctgcgaccggccacgcgaatgacgtagctgattttgtacatggcgtccttagtctggtcgaggttgctttcaagttcatcgacagaatccagtgcgtcgctgacgccgcgtgtcgtctcgttgccggactgataggcgtgttcgtccaagtcctttagttccttcttcttgttgcgtaccttggtcagcgccttcttgttcgtcacgatttcaacgtttaagctggtgtcgattggaaagtcgaattgactttgttgaaaatagaagatttcactgccgggaaactccaattcaccgacaatatcggaaagcgtcaggtacgtcacgtagctggcatccagcccgtgggtgattttgatcgagcgttggtgctgctcaatcagcgaccgagttggcttgatcaagtcatagcgtttgatgatcgtgtcccgcttggacttcttgcggggtaaatggtactcatagtcgtcgtagtcctgacccgtcatgccatagaggtgttcgagcagatagccgaagtcgttcttatcgagtggtcgcactttgaagcgccgaccgatcttctcggccaggaacttagcggacttggcgtagcgttccacctccgcattattcatggtgaaaaagtcaccagcgaacgttgtgttgaactcggcgaagaagtcccgaatgcccaaggacatatccttgaagatggacttggcagttacctctgcgtcgttcagcaatagcttgaaaccgatgaagaaccgatagtccacttggttgtcaccgacgttttcagtcaatgcttcggcctggccgtcgatgtgctggaaggcgatgtctttcagcgaccccttgaccaacttcttagagcggtcgagggtgtcccgaacactagcctcggtggcgagctgcaataaatggagcttgccgtcgcgattctgggagatcaactgccgaaagttctcatggacttgttgtttctgttcagggcttagaaacgagtagttgtacggaatcaattcaaaataggcaaagcactcgccgtcagcgttccagacgagattgtcttcgatatacttaattggaaatttcattgttgtacctccaaacgtagatcacagcagcggtttgtttctctttctgcgacttcacaggtttaccagcataggtgagcttcggggtaatggcatagttgatcaccgaccgcaggaatcccattggcttcttgttgtcgaacgtcttttggctcatgaaccacgttagcccggccggaatgccgacgtacttgagaaacgcgccgtcaatgaatgatagtggcggcaagtcgcccagcaacatgaccgcaaacagactgacgatgaaccacgtcatttgcgtaaatgtgattggaaacggcagttgcaggtcattgatggcgtacagcaccttttccactgaccagatgctggtgtaggaacggactttcttcatgtgatctcctttcgttgtgagataaaagggctgacgccttttgcagcgccagccccagtgactagttcagatattcgtaaatgccgtcgtaggtggtgatgtagtcaccatcggcttcaagatcgctggctaaccgttcgtagttgatatatgactgaatctgtttaggcacttcgccacaaaagtcgccatcttgaaccagtttgatagcgagatcttccattgtctcaacgtcatagtgtatgaaatcgtcgatgtgtgcggccagctcgatcacgtcatcaaagcgtttctccaccaattcttccactgcgtcagccaaatcggagttattgagcttttccagagccgcccacatttcattgaggtgtgcgatggtttcatgttcggagatgggaaacggcgcttcgtaatcgtgaatcgcatattcttcatactcttcgttcaggccgatttgttcggccacatcgtcccaagcaatcggcggttcaaaccacgcgccgacggattcgccttcattgtatttgcctagattggcaatccatactcgcatttctgttgccatattaagctcccatgacgcgattgaataagttcaacaacacgtctttaaccccagcggtgttgaacaccagccccacggcgatgatcgcaatgaccaagaagccgatcagcttggaaaactcacgcttgaagccgaggtagaccccgataatggcaatcgccatcagcaccaagctctgggcgttggaagtgaaccagttaaacaagttttgtccgaaattcataataataaccatcctttttgtttttaagttttgtgaccaatgctcctttcaagaatgccgctattttgtcgtggtcagcggcgacctatgactaataaagaaacaatgcttctaccggtgacctgaaaaccggccacccggattcatcggcagtttggtaaagcagtcgacgcagctcactgtaattgagggcgcgaccatcgcggccaatcagtgccgcaggatgttcttgttgttggtggcgccaagcgatgtagtcctgagctgtgaagccgaaactgttcatatcgcagatgcgacggtactgcttgtgttcgaccacgccgactagcgcggccgtgtagacgtaaacattcagcacacagtctttgaatgccttgccgcgcagttggtgggaagtaagcacatcattgaccaaacatgtcacctcccagttcctcgctaccgacagtctgttgctcaatcagcttgaggtgcttgtcgtttagttcggcgtccttgatcatgagctgcaagtcagtagtgccgaagtagttgtcgatttccttgatgactttgagggtaggcatgacttgcttttggagccacgccttggtcttgttcatatcaaagggctggggtgcggtagtcaggcgtatcggttgacgacctttgccgaggaagtatgcccagcggtcgttgagcggccacttcaagcggcttttgtccgggacttcatcaacgaatcgcatgtagcgcgtgatgataccgaacgcgactttttcggcgtcacgggtaatcagcatgctctcaattactttgattgcccgttcgttcttcaagcgaatctcaaagcggttgatgatcggtgtgtcggcaatggcgatgccgcgcttggcagcttgttcggcggccttttcgtagatgcagaagtacacatcgcttttcatcgtgccgacgtatagcgtgttgccccggccagcctcgtcgagatccacgagcttacctgattgcaatccttggaatgaccgcatgacggagatgcactcgttgttcagacacttatcgaccagttcggggatattcagtagaccaaccatgtcgttgattgcaatatcaacccgtttgaagattccgccagcttcatcgacacggaggaagtagtcgtaccaagtttcaccgtggcttagcagaatgccttcaaactcacggcagccttggcctttcatttcgaccagcgtgccgaggtttgagtcgatcggcgcgaccatgacttgaatgttggagaagatatacatggccgaatagccgtagaatccatgttcttcaaatatcaggtgttctggggtcagaccgagaatcttggtgatcacagccttggcgtcagttgtcgggaaccgcacgcgcatgtagtcaaacatcagcgtcagttcaggttcgtcgttccagttcttgagcagccggtcgatttcggcttgaagcgcgggactggggttcgtcttgccgttttccacttggacgtaatgcatccgtgtgacacctaggcgccgtgcgagttgaacttgggtcagcttgagttgcttgcgtttagttttaatcttttcatgccatgagcacatggcaacgctcctttcaaaaaatgatggatggggggtgccatccatcattttgactttttctattcaaacgccgttatagcaacctttctaccccgtgttcaggcacagacgttgtatttaatacccccctgttagagtactgggggtaagcggtcggctggcgccgaccgctgccactcacgcttgcggctttcgcgttgcacgccgcgcgtggcggcagcagggggcagccttgctgaacagattggatagtcatagtcttgctcctttcaaacgggtttgttttgatgacggcgtgaagctgattaataatggtgggcccagctatggtaagtgagctgcatgccagtttgcgtcatggtagccgtgaaccagaagtagatgggcttacctgagatggtgcggtcgccgacgagttcgagccagtgatcaccgtcttcgtaaggctcaatgtaatcacacatttccagtaaggcgtcttcggcgtcctctggtgttccagctatgattgtgtcagcgtaatcttcctgaaagcgactttggttgttgattatcggaattctcatgggatctcctttcgtattcgtgaattcacgtttcaaacgtcatcatgtggtataatgacgtttgaaacgtgaggtgagtttaatgtcagatttaatcgaatcatttatgaaacaaaataatggccaagtgacgaccgcagatgccaaaaagcttggggtcaatccacatctgctcattgatcttgctaaccgcgggaagctggagcgggtgggacgcggagtgtacattgatccggcaatatttgaagacgacatgtatatccttcaatatcggtttagtaagggtgtctattacaaagacactgcgttgtttttgcatcgtatgatcgaccggacgccggatcgctaccaaatgaattttccccgcggctactacccaagctcaatcggtgaatttccagttcgtatgtatcatcaaaaatccgaatggcacgagctaggggttgaggaagtgctctcaccggggcaacacaaggtacgggtctataacatcgaacgaaccctttgtgatatattgcgaacgcgcgattcatcggattcggaaactatccgtcaagcgatgatcagctattcgcagctaaagcaaaaagatattgggcgattggtacgctatgcagatttgttcaaagtgagagaaaaaatcaacaactacatggaggtgctactatgaaactcggtttttcaaatgggcaacagttcaaggccaaggtgcgtaaccttgccaaagaaaaacagattgatcctcaaatcttgatgcagaaggtagcgttagacgagattgtggatcgaatttctcgctcaccctatcgagataatttgattctcaaaggcgggtttctaattgtgtcaatgctaggcgttgatacgcgagcaacgcgtgacgtcgatacctcggtcaagggtttgccggtaacaaaagaggaaattctcaaagtgtttacggacatcgccaatatgaatgagccagatagcgacgtgacaatcaggattgctaagattgatgatattcgcgttgccgcagagtatgccgggtttcgcattcatatcgaagcaaaaatttataacagcgttgtagatacgaagattgacgtttcaaccggggacacaatcacgcctcgtgaaatttcatggcatcatcgcacgatttttaatgaccaagatattctggtcatggcctacaatatggaaaccattcttgccgagaaactcgaatccatggtcgtgcgtcaggagcttaattcacgaatgaaagacttctacgacttgtatctgtttgataaggtgcagcggcagaatattgatttcaaagtcttaaaggatgcattgcgggcgacagcagagctttgtggttcggaagctctattgccgcgatatgcagagatcatcacttcattgcgtgggtctgggcttttgaaacagcgctgggaaaaaagtaccgagtggcctacgtatacagtgagaacgtcacttatgaagctacctgcgatgctgcgttagatttggtgaacgagatcggattaccatagacctactcctcatcgccttcatctgcgacgttggtgtaagtcatgatcaagccaccgttgtcgccagtggtgacattgaaccaaaagcgcttcggaaaacgatcagcggtcagtccgccgggagcgcccatccagattcgtgaatctgggtattcgtgggcgtgcatcgccatccattgcagctggtcttccgcgtcttcgtcagactggaaaggcacgttctcgtgaaaatcgttgaggaattgcgtgcggtttttgattttgacatcagtgctcatttggcacctcctgttttgtgggtgttgcgggaacggtattggctgcggcgccgattttggtgagaaagtcatagtcacgtgggactagcggcgtgtaaaattcagagatgacgctgccgccagtgtccacatagccgcgtcccttgattggtttctggaaaaagtctttgttggtttcgccgaacatcatggaatagccaagctcactcatgcgcccaagcgcaacccggaacatgaactggtcgcgaatcccatcaccgagatacttggcatcaggccgttggcaagccaacacgagaaagaatccggcttgacggcctagcatgacgatctgcttgagtttggacatcacctgcatggcatcgcggccaagcatatccatgaaagcaacatattcatcaaaaatcagaaagtgggcgggcagtccaagataggcgtagttctcgccggtcttgtatccgtccatttgtttcatcttgtcgttgcgcaccatcatatcctgatagaaagtttcaagtgcgccaagcatggcctccttcttcgagtagacccccggcatcacgtcagccagatcagcaaggtcagcgtttttcgggtcaagaatggtgagctgggcaccgtctttcagtaacgcttcgatcagcgtcaaaatgaagtaggtcttcccaccaccagtcccaccggcaatcagcatgtgcggtagtgcgtcatagtgccaagccacggtttccatgagctgcatggcgccatgttcacaggtcacatcagcgatggtaatgcgcttgccaatggtgtcgtaaagcaaggtgtactcgacataagagtcgtgcaggatcttgtcgatcaactcacagtaaagaccagcctctagcttcttttctaagtgcaggagctggtcttgataggaagacatgacgatttcaacggaaacatggatcagcccgtccttgagccggtagtaaatcttggggaagtgcgagatcttctctttggtgcgcgttgaacctaagtccttgaagaaactctcgctgttggactggtcagtttggtaccaattgttctccatgatcatgcgggcgagcttttggcggtgttccatctgcttgtaggaatctgcaaaccaagttcggtgtacccacaagccagcaccaaatagtagtgctgtgcataaactgttgataatcagcggcaaccatgaccagggcagcgccgccacgtccgaccaactaaagaatttccagttaatttgttttagcagcggccaataggcgatagttacgccagttacccacaaggaaaccacaacggtcatagcggtgttgtagagcaggttgcgttgacgcggatagacccgtgtaccgcgataggttagcttcattcgtcaatatttacgccgtcgtagccaattacgaggcccagcggactacttgaaacgttgaaactaaagcgcgctccgtgaaggtaggcttcgggtttcgcacactgctcactggctaaaatcaaatcacaggcattcatgccagcttgaaccgcgtgattagctgcgtcgattaagttgatgatgacgtcaccagtgggtgatgcgccgttgtcaaagtcagaaatgtgttcgtagtgaagcataaagtcatccaagttgatgagggttgtttgatcattcatagaaattctcctttgggcgttacttgacgccaatatatttgatagcgggttgtcggtcttcagtgtcgatattgaagctgaactctttggattcgtggtcgcgggtacactcaccgtctacccagatggaaaacggttcgtcaggattggactgttcggcggccatcaataccatgtcgatcaaagcgtccgggctaggatcgtgaaagtcagggtcaactagtgcgggatagtcctccaaaaagccgtcaatgcttagtgcttgtgccatgtcatcagtcctttcattcatcgctgacgcccagatacgagagccgtaagccatcttcacgctcgtatgaagtgaacgagaacagcttattcatgccgtcgttggtctgctcactgtcgaaatgtaggtgttggtaggatttagggctttcttccatgagttccaccatgtcttgcaggatttcgtctgggtcaaggcggtagtcgttgtcaatttcttcgttatagtcgtcgatgaacacttcgcgaccaactacggtcaatgtggaagtcatcatctgtgatcaactcctttcgttagtgacaaggaaccgccgcagtgggcggcgcgcgcgaggagtggggcaataagctatttcttgtcattgttgtttggcttctcctgtgacttgaccggtgcggtggcaatcacgagatccttggccttcatgtaccacgaagtttcaactcggttgaagttcgcgtttgctaaggtgtcgatcactgggtcaaccaaagtaacaatctggttgtacttgaagtccttgaccccagcctcggctggaatggagacttgaatcatcattccttgcttcatggacttcaagtcatacgttcgttccttcacgttgtcggtgcggttgccatcttcgtcttgcacgaagcgttcgcggcgctggccggagaatttcaagacgccaaaggtttcttctaagtcgataacgatgccttctgctaatcgcatgtgagttcctcttttcttttatttgactgggacaatatcgtcggcattgcagatgtagcgcacaaaggcttgttcaccgatccggtagccgatagtcgcaatgcgcggtttgatgatgatgactggagcatcaacttcaatgctttcggccttgtcacctttcttcgctggaatggtgatctcgatgttgtcggtgcgctgcaagtcagagaataattcgtaggtgcgggagacgattttgcgttcgtcgcgggtgccttcggcttgctcacgcttcaaggagccaaagtagagatggccgaacgtcttttcaatgtttggtgcaacaaatttgagttccatgttgtagccttcctttcgtattcaaaaagccgagtaagtgaatcactcggctgtggcttggttgtagtattcagagagttgttggagtagatactggtaaaacgactttgagattgggtgaaccgtgcgaccatcggcatatcgcggaaactggatataccagcgatacgaaccttcgatgagcttcacgtttttcaagatgagcacatgatctagcacgatgtcaccttggagcaacacatcgccgccggggtcagggtacatattaatagaagaaatgcgcatgttacttaccgtctttcttcttggtgccaccaatcacaaccattgcagcgagtatgccgagaagcagtactacaccgatgaccatgagccaaccagccttggcgttaccagtttgtggtagaccaggcttcggcgtttgcttgtctttcatgatagccttcacgatttcaccgtccttcgtgatctcgaatggtacaagggcttcgctgatttcgtagccctttggtgcgtcgtattcttggaagctgtacttgccagcaggcaggttaccaaaggagaagaccccgttcttgtcggtgcgaccagatacgactgtcttgccgtcttcgtccagaatgcggatacccgtgtttggcagtcgcttgccggttgaaacgtcggtcttggtcagttcacccgtacccttgatcaagttgttgttcagttcaaaggcgatggttggttccttagcgtcagccttggcctcaccaatctgcttgtccttgccatcaaagaccgtcacgccgtccttggtggagacgagcttgagagtttctttggacagtacaaggtttgtagcagaaggcgtggattcacggagataaaaggttccaactggtaggtgcttgatagagccagtggaatccctgccgacggtgatggtctgaatgaccttcttgtcagcatcaagcagttcaaagaccgcaccggcagcattaccggtcatggcgtaggagtaacccttacccgaaaccagcgtggcaacttcgttgatcttcttgaatgacagttcgttttcgtggagcttgttctcaatctgcttaccgtcgttgatcttgatatgcttgatcttctcgttgtcagtggtgttgaagtggaagccgtacatcgtcgtgctcaaatcatggctatggccagcatcaagttctttgacgtagtagtagccaaccggtagctgaatcgcatcgaacgcagctttcccatccttgaccgtggttgttgcgagcaacgattgtgctggaacctcggtgtcaccgatcttagtggcggccatggagaacaggccaaagacctgtccattaccggcgacgttcttgatttctgggaggttgttcttccaccctgtgaggctctcctcctgcttgttgagcgtgatgtcgagctgctggaagtcgttcttagcttcaagtgaggtagaggtcaccgtcacttcttgtccagcatacttgagttcaaaggcaattggatcggtgttcagaatgaacccgtttggtgcagacacttcggttgcagtgtacttgccgaggtagagttctggggtttgaatctgtccttgagcatcagtggtgccagtggcaaccacgtcacccttgtgggcacgaacggtgccgtcagcagtcgtaatgtcttcggcagctttgaactcgaacttcgcaccagccagagcggtgtagtcgtacttgaacttgtactgatcgccatattcagtttcaaccttttcgacggcgactggggtagcccaggtcttggtcaaggtagcgacacccttttgggagaggtcagcaaacttgatgaccacgatgccgtccttgtgactaccgtcgatggtgaacttggccggttccttagctagtacatagccttctggggcttggacttcttcgagcaggtacttgccgtagccaagcgcttcggcggtgatcaacttgccggaattgtcagtcacaaacttatcagttgtgccggacttatcagcagttggctggacttcgtacttgttggtttgcaggttcttaacacggaagattgcgccagcgcgtagcacggtcttcccggtttcggtatcaaccttgaccacccgtagcttttcttcgataaccttgttttcaatgctataatgttgggacttctgggtgccgtcaacaacaactgtgaacggcttgatccctttgtagcctgttggggttttggtttcggtgacggtgtaggtgtcgtaaggtaaatccgcgaatttcacgtagccttgggcatcggtgaggccggtacggacaaccttaccggtagtcttgctggtcacagtgaactgggtgtccttgagcatgactggcttagtgcctttgccttgggttgtccagtcgtagttcccgtacttgagcagttcgagatcaccagtgatgacttgttccttaaccgtcgtggtagcagttgcagtcgtgacgttctgaccagcgtaagccagcttgaaggcgtgcttttgcggatcaagaacgtaaccggttggggccttcacttcttgccagtagtaatcgtccagctctaagccagaaacggatgcggtattgttggcgatcgtcactgacttcacgagcttgtcatcggttgcacggtggagttcgtagacagcaccgttaaggctggcagcaccttgtggctgcttaccagtagccgcatcttccttgatgatggtggcagtgccgcgttgttcttgatcagtcgtatcgacatgagcagttgtgaccgcgacggtctgaccagcgtacttcaattcaaatggcagcttggtcgtgttcagaacatagccagcaggggctttttcttcaagcgcgtagtagctaccgagcttgaggttctgcaaggtgcctttaccgttgccatcggtcgtgattgcaccaactcgcgtaccggtgctggtgtagatcccatacaccgcgccgttcagggagtagtaggcattgaacatatcgctaccgaactctttaccaatcttggcaagggtcacgttgccgagctgttccttgttgccgaggacaacttcgacggtcttgttgggttcaatggtggcttccttgagttcgcccttgttcacatacccgttaggagcagtgacttccgagacggtgaccttggtgccagccttcaaatcattcaaggcggcatacccgtcagcgccagtcgtgacttctttggaagtaccattgtatgcgaacttgagcttcgcccccggcaaggctttgttggtgtcggcatcgaccttcttggctttcaggttcccgttcaggttgaccttgattggtagactgaactcgccgttgctggataacttgaagttgaccagcttttgttgggaaccctttgtataaacgaatgaggtaccaacgtcagcagctttggcgattgcataggcgaccttaccggaagccttagactgggcggtagcagttaatgtgagcttgttgcctgacttcgtaatcttgaggtttgcggtgttcgctgtttgctgggcaaaagccgcaagccgcccgttggtgtccgtcaaggttattgaatcgccaactgcgagtgtgatctgtttgccgttgaacgatggcttgcgatcatgcgccgcgaccttatcgagaatcgctttcttctcggtttggtaggtcttgttcggcgtggtgagtaacgtgtctccgagagtctcccagatgaccatctgggtcacggcgtagttacggttggttgggttctggtagtagccgtagtaagcaatcttggctagttgatctttcttactgtcggcgtaagtgctggggttgtagccggagccgctcatatcgagatcgaccccgtgctccacacaaaacgccaccttgccgtccagcttcttcatccacatgccggtgtccgtccaatgtagaccattgaacagatgtaagtgccaagtgttgcgccaatctgcgaccttggtgttggtcatgctggcggcaattgccagtgaagcggggataaagagctggataaatataacaactaatgcggcgaatattgaggttcgccgagctgttttcattaatgatttttcctcctgagttttctgaaaatagagctgcaatttttacttgagcacacaaaaagcagaagatgtacgtcttctgctttacgttaatcgtagccttacgaaatgctcaaaatgtacgaaatgtgtcgctccatttccttttgtatgaaatttagtgaaacttggtgaaagagaaagtcagtaatatcaaggattttaaagccttgaaaactgtgtgaaagcgagatacttaaagtacggtctgaagaaggctcgtaaagcttcacaattctccaagcgttaatcattcgatcaacatttggcgtttcaacactttcctggttttcgggaaggtgttttttgttgcgctgaaaatagtcagctgattttgaaattaaaaaacgcatgtgatcatctagtctgaactagtctgttcacatgcgtttttatttaatgtgggattaaaattagttacctgttttttcaattcgatactgcctagcaaactgctgcttagagacgacgcggtgatttgtgacgtccaaatagtcacctagatagccaatggtcacgaccccaaactgaacgccttgaacgcgaaaaacactggctttctcatgctgtaagctttcgatcattggcgggaacaaaccggccattaaaatacgaagtcggtcatccaaccaaacaaggtagttcttttcaaaagcttctttgacccagtcagggaattcgttgtttttactaatttcccaaacttcggcggattgatctttataagtcgctttcatcagtatcctcacattcggattgtcggatttatttgtttaaatagttgtgcgattttgaggttccatttgtggaaggaagaatgactgtgctgtttgttaaatgaaaaagctcatactagtactcatcaaaaatgtatcacgagggcagcaactatggcaagcactgaagcatgctgatttctgaaagcaagatttatggacgcctataacattttaaaacttcacatggtagaattaataggagaatggtgcatagtgctgtagcctttttgcgccaccgtatttggggaatcgttaaactataaaactttggaggaaaaatagatagatcgccgtgtgtgatctacatattttgattgagtgatgaaaaggagaaaactggtcttaattagtttggccgtggtcgtcgtgattgcggcactcatttttggagttgcaaggcataacaaaacgcaagctgaacaagcgattcaagcgcgcaatgctaaggttgatcaaacattaaccgctataagagcacaacataaaaagaatgtggcgctgaaggatgatgccaaacgattgcaggcactggcgaatcttgagacgcgtagtgaggcgtattcgctgcgtgcagatagaaaacagccggtcatagcgctttataaggaactcatcaacaaggaaaaggcctattttactgacaagaatcaaaagagcctgaagaaaaataagctgactgatgaccaattgaaagacatcaagaagaaagaccttcaggcgaagctcgctgggttaaatgctttgaccgatgtgcttaatacacagagagatattgtctacaatgataagaattttaagactttaagtactgagattcagcatctgagtgaacgctatgctgaacgcttacggcagatgacgcaggatgaaggtcaagctagtcaaccagctgagagtagcaacacagcttctgagtcgcaaggtcagcaggatcagactgaccaatcagctagtgggcaatctgctgacaccagccagtcaggtaacgttgataatgggcagacagacacaggtacaagcactggcggatatgggtataacaacccttggaatagttggtatgcgccgaatactggcagcggtagctcggggtcagtgacagacaatagcggcgcaggaacaacaactacgccgaatgccgacaatagtggtgctggcactggagcgacagatcaaggggcgtcaaccggagctgacgatggcaatcaatcatctagtgcgacgggtaatactggtatagacgggcaggcaagttccggcgcggacgggacaaacccataacctaatcgagataacccatcttctgaaaatactttgtcaccagcggcaacagtgttggctgcatagacggtgccataaaatacaacgtcatcatcaggcgcttctacgacgagacgcgataataagctttgtttttatgcggatgctctgtataatcagtccagcgaataatgtcggtttcgttaaaaaaacggctgatgctgtcagttgcatggtttgaattttgactaacacgtaaaacgaccatggctaaccgctcttcctcatcgtctaggaagggctttttttgttgagctaagacattagcgacgacatccaacgcctgctgaagctgcgctgtggttatcttaggatgagcggctgccgctgcaagcaaatcactgccatgggcaatgccatgcgcccagcctttttatcgaaacataaccgcgccaatcggtttcgatttgcagatacttgagagcccaatctatccaagtttggatttgtttgtcagttagaaatggtttgctgctatcggtttctaataaaatcgcccctaataaggcggtgaaggttctggtgaagaccttgtcattgtctgaattgttgagaccagtaaaaagttgtgcttgttgcgtggtgcgggtggcaattgcttttcgttgagcagttgtgaaaccttcagttaaaaaaccgcgtgctaatagggaataaacaagattatcccgaatctcggcattgggatcgctgatatgatctagcagccattcgcactgatgctggttgaattgcaaaggatcgggcatcgaaagcagcttcttgagttcattttccattgacgggaaggacctttcttaatttatcttttataaagaatcggatattaaaattttgagttagaaaattacttattttaggctaatctgcaccaagcaggtcgctaacctcgtatggagtctattatctgttgaataagtcatattcaaaaaacttccatcatggtattttttggtctgatatactgaacgcaacacagaaaaggataatgaacggtggtaccagatcagagaggtggtggtgcgtattgggaaacctatcagccacacattgatgagaaaggtacattcacttgtctgtggtcgctgcattaacgacgatcacggcctgcgtggtttcgtgcatgatactggtggtcgccctaacacggttgatcagagccagtaccaaactgctactagcagtggacgaattccgcaaggcgctcggacaactccgagaaaaataggcaaactaaaagccgcgtttcctttgagcggatctcgcggcttttagttgcctgttccaacagccatcgttcattagatggttctgtgagggcatttctgcccgaccgccgcgctggtacgcggcggttttttctgcttcaagtatagcatggcttgcgaacgcttttccagtagttagtttttttactcgaaaatttggaagtaacatttaaaccaaatagcatttatcatcaaaaaattaaagcgagagttatagaatggaagagttctgatattaataatgcaattaatttatgtcaagaaatgttgtaggcataataagccgataatattcactttctatcgagtgattttgtttgacggcgcaaacaacgttctgtaatctactaaagtaaacatgtcaggagttattcttttaaagactaaggaggaagcacgatgaagctgagcaaaaacggacaaatgtctttattgacactaacattgaggtcacatggatttgaacgaaagaaggagcttcatggcgcttatcgaggtagaccatgttactaaacaatacgtcaaagtagcaaaaattggcgttgttaaaaagaaacgtacacttttcacggcggttgatgatgtcagctttgccgttgagccaggtgaaaaagttggcattgtcggcttaaatggttcgggcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttct

SEQ ID NO: 60 - DNA, 14602 bp, Lactobacillus paracasei
tgcgagggtaggaagctgccacgcttacatatggaggattagctcagttgggagagcgtctgccttacaagcagagggtcacaggttcgagccctgtatcctccattgagccgttagctcagttggtagagcaactgacttttaatcagtgggtcgacagttcgagcctgtcacggctcagagaattattggttttaaatggcggctcaagtcgatttttcgccgacttagctcagttggtagagcatctgtcttgtaaacagggggtcgaaggttcgaatcctttagtcggcatggtaccaataatttgatagcaccatgtttcatgcggaagtagttcagtggtagaacatcaccttgccatggtgggggtcgcgggttcgaatcccgtcttccgctttccaagcacagtgccgagggtgtgcttggtcaaacctatcctcggcattatcatgatttgcacccatagcgcaattggatagagtgtctgactacgaatcagaaggttgtaggttcgactcctactgggtgcattatcgggaaatagctcagcttggtagagcacctggtttgggaccagggggtcgcaggttcgaatcctgttttcccgattggacatttttgtcccttagtttttcgcggtgtagctcagctggctagagcgtccggttcatacccgggaggtcgagggttcgatcccccccgccgcgattgagcttggacctttagctcagttggttagagcagacggctcataaccgtccggtcgtaggttcgagccctacaaggtccatctttacagggtggtcgctgttcggtataatcgatatgttattgttatcgcgggatggagcagttcggtagctcgtcgggctcataacccgaaggtcgcaggttcaaatcctgctcccgcaatttatatggttccatggtctagttggttaggacgcctgcctgtcacgcaggagatcacgggttcgagtcccgttgggaccgtttgcggctcggtagctcagtcggtagagcaatgcattgaagctgcatgtgtcggcagttcgattctgtcccgcgccatattcataatcatttttatgcgggtgtagtttagtggtaaaaccacagccttccaagctgttgtcgcgagttcgattctcgtcacccgctgcggttatgatcatgggcctatagctcagttggttagagcgcacgcttgataagcgtgaggtcggtggttcaagtccacctaggcccattgttccatttatagtttcatatacacatggagaagtactcaagtggctgaagaggcgcccctgctaagggtgtagaccgggaaactggtgcgagggttcaaatccctccttctccgttgtggcccgttggtcaagtggttaagacaccgccctttcacggcggtaacatgggttcaaatcccgtacgggtcatgtttagatggagaattacccaagtctggctgaagggaacggtcttgaaaaccgtcaggtgggcgtaagtccacgcgagggttcgaatccctcattctcctttataattatcgcgggatggagcagttcggtagctcgtcgggctcataacccgaaggtcgcaggttcaaatcctgctcccgcaatttatatggttccatggtctagttggttaggacgcctgcctgtcacgcaggagatcacgggttcgagtcccgttggaaccgtctctctcaattgagagaaaaatacaatagtttagttccaaatggctcggtagctcagtcggtagagcaatgcattgaagctgcatgtgtcggcggttcgattccgtcccgcgccattatggaggagtagcgaagaggctaaacgcggcggactgtaaatccgctccttcgggttcataggttcgaatcctatctcctccattttatagggatatagtttaatggtagaactacggtctccaaaaccgtcagtgtgggttcaactcctactatccctgcttttataatggcggtattggtgaagcggttaacacaccggtttgtggcaccggcatacgtgggttcgatccccacataccgccctttttactggggtatagccaagtggtaaggcaacggactttgactccgtcatgcgctggttcgaatccagctaccccaatttctccaactgccataggggaaaggcacttaattgaaatatggcggtgtagccaagcggtaaggcatgggtctgcaaaaccttgatcgtcggttcgattccgatcaccgccttatcttgcggcaatcgccaagagagtgtattatcatttaatattatgccggtgtggcggaattggcagacgcgcgggattcaaaatcccgttccagcgatggagtatcggttcgaccccgatcaccggtatcacaaaccttcctaggaaggtttttttttgccttgaaaatctgtgccacaaacaaagatgttcccaatacatttttgatcacacccgatttaaaaaagtgtacagtttggcacaaatcatggggccgctgtttttgcatgaaaattgtatgatttctgacacacgaaaaaaagacccagcgcttcttcatcctacgtaaaagtaagatgctcctgagtcttttttcgttatctgatactgtcctttttgacgattgctgccagttgacttgctattcttcgcgagagaacttcaatatcttgatccgagaccgttccaatgcgcgacgatgacgctgcagcaaaggatcttcagaactgtctgtctgactgatgacagctgcctcgaaggcctcatattccaaaggtgacaaccgtgccagaaactgtgcaaactcgattcgcatgagtagaccatcttcatacgatctgagagccagacgttcttgaagagattcaagtgcgctgtcttcaactgggattgcggtcgcgtcgatgcggcgtttatgcgcaaagtgtttccgcaagactgaacgcaggtgtgactgcaataccattcgatagtagggaccaaattgggatccgctagagccatcatatcgagtaattgctttgagcatcgcagtcctggcctcttgtaaccagtcttcatgtgaaaaatccctgagatggtacggtcttaacaccgttaggactagcggtcgatattgcttaaacaattggctgaatgcagttgagtttgtgattgcttcactgattaatgttaactctgtggctttcatatctcctcctcccccgacttactagctttttcattctacaataaagcgtttccaattgaatagcgaacaatcgttcatgaatattttttaggggaacagaatgcttacaaccaaaggcatatgttggggcaatattgacaacattattttagtatttttttcacgatttttttaagagtcacgacatctttaaaggaatagaaaggggccagtagaatgacctattgttaattggtgattcggtggtcggagagcgtgttattacaagcatgatttgaaaattggtatgacaaaaaatgatgatattttaatggcgtgaaggcagctttagatatcttagaacggcaatttttaaaaaataatgttggcgccttcatatgcgataccatcgggaaaatagcgaatttataaagaataatcaattttacattgatcatgacacgcgttatattaaacaagtcacttttttagggaggtattcgataatttcttcaaacagagaaaataataaaattggtctatttcagttagttatgctagctttgggttccttgattggttcaggctggctctttggttcttgggaagcagcagcagtagctggtccggcggcgattctgtcttgggtgattggcggcttgattattggcatcattgcttataattacattgagcttgggaccatgtttcctgaatcaggcggaatgagcaaatatgctcagtactcgcacggttctttagttggctttattgcttcttgggccaactggatctcgctagtgacgttgctgccgattgaagcagtggctgccgtgcaatatatggcatcatggccgtggcagtgggctagctttacgcacggttttttggctaatgggcgcatcacatcgcaggggttgctggtggtgtttgctttcatcattatttttacgttacttaactattggtcagtctcattactgacacgattcacgagcttcatctcgatcttcaaaattggggtgcctttgctgacgatcacgctgttggcactttcaagcttccatcccggcaattatgggcattctttagcgaccttcatgccttatgggagcgcacctatctttgcggccacttcagtttctgggattattttttcctttaacgcgtttcaaaccgtcatcaacatgggaagcgatgttaagaaaccgcaaaaaaatattgggcgcggaattgcaatttcgttactgattagtgcggtcatttacattttattgcaaagcgtttttatcacgacaatttcgccgaagctattagcagcacatggttggcaagggttgaatctcaactccccatttgctgacttggcgattctgctgggcattcactggttatcagttttgttatatatggatgcctttgtttcaccgtttgggactggcgtttcatttgttgcttcatctgggcgggcgttgcaggcgatggtcagcaacaaccatattcccaaatttcttgggaaacttgatgaaaagtatggtacaccacgagtggcgatggtggtgaatgcgttgcttagcatggttatggtttcgatttttccttcttggggtacgttagctagcgtcatctccacggcaacgttgattgcttacctgacaggtcctattacggtcatctccttgcgtgacatggccccggattttaagcggccagtgaagtcaagcctcttgcgggtgatggcaccattgtcatttgtgctaacctcattagcggcttactgggcaaaatggccgacaacggttgaagtgatcggcgttattttcttgggtattcctttctatttgttctatgaatggcgatcaggctgggcaagcacgcttaagcaattgaaggcggcagcatggatgctggtatatttgctattcctgtcactcatctcacttattggcagcagtgagtttaatggtttgaattggattcactatcctttagattttgttgtcattatcattggtgctttgggcttttatgcttggggaattaatagtcacattttctctaaatatttccgacgcgctgcaagagtgaatgacaaagttaaaatgccgcggcagtagcaacttttattagaaaaaacacgtctctggtcagaaacatgatcatcgacgtgttttttggtatgatggaagacattctgattcttggccattgccgcagatgctttgagccgccggtggtgaaggctcgtttgataaaatgctagatggcataacttacgacttttgcctgatgatggtgtgatggcgacaaggtaagataattttaaaggtttgagggaaaattgcatttagctatgcctatctttatacttatactaaacaaatgacgtctggaggggattaggtgaatatcgggatttttacagatagctactttccacaagtcagtggcgtcgcgacgtccatcaagaccttgaaggacgatctggagcgtaagggccatcaggtttatatttttacaacgactgatccgcatgtgccggacgacgccgttgaacctaatttattccgatttaccagtgtaccgtttgtctcattcacggatcggcgaattgcggttcgtgggctttttcatgcttacgcagtggcgaaggaattgaacttggacattgttcatacacaaactgaattttcgatggggtatatcggcaaatttgtcgccaagcagttgaaaattccgacaatccatacttatcacactatgtatgaggattatctgcattatgtcctgaatggtcatttgctgaagccttatcatgtgaagcagtttacgcgggcgtttctttatcatgtcagtggcgttgttgcgccttctgaacgcgtttatgatacgctgcgacgatatggcgtcaaaactgagatcaaaattattccaactggggttgatttgactcagtttgcccagcaaaaagatccgcatttacgtgacaagctcgggttggcgcatgtcccggttttggtctcactcagtcgggtcgcgtatgaaaagcgaattgataaggtgatccgtgccatgcctaaaattctggaacaggtgccccaagcggtgctgttaattgttggcgatgggcctgcgcgtgaagacttagaggcgcaagtcgctgagctgggtctcaaggagcatgtccgattcaccggtgaaattgaccatgatgatgttggtgactattaccgggttggcgatgtgtttgtatcggcaagtgactccgagtcacagggattaacttatatcgaagcgatggcggcggatcggaaagtggttgccttgacaggggattatacggatcaacttttggatgatccggcgttagggacaacattttcaactgagactgaaatggtgcatcaggtcgtgaattacttgaaacatccaaatgcttacgatgatgctaagccgcgtcaagaaaagttagcggcaatttctgcagatcgatttggcgatcgggttttggatttctatcaagacattttgtcacactattcgcctaatgaggccgatgaagctgcaccatggaccgatgaagattccagtaaacggaccatgaaaggttaaatatgattgttattaatatgttttcctctgccaataaggttgcaggacaaggagttggcgcagtctacacagaactgatgggcttgctgaaacatgatttttcaaatgaatttgaagttaacgtcaatcgttatacgcgtagtgacatcagccattatcatacgattgatcctaaattttatttatctactttctccaaaaaacggggtcgcaagattggctttgtccactttgtgccgagtacactggatgcgagtctgaagttgccgcgagtggcgcggtggacgcttgataagtatacgttggctttttataagcgaatggatcagttagtggtggtgaacccgaattttattcctaagttagaagcttatgggatcagtcgcgacaaagtgacttatattcctaatttcgtatcgcaacgaacgtttcatccagtatccactgaaaagcggcaggctttgcgacatgccaatggctttaaacctaatgattttgtcatttttggcgcgggtcaggtgcaggatcgtaagggtgtcagcgattttatcaaattagcaaaacaaaatccggaatttcgttttgtttgggcaggtgggttctcttttggccgcattactgaaggctacgaccatttgaagaaggctgtagcagaagccccgacaaacttggatttcactgggattatgccacgagagacaatgattgactattacaatatggccgatgttttcttattgccttcttatgaagagctgttcccaatgtccgtccttgaggcttttgcaacgggaacgccagtgatggtgcgggatcttgagctgtatcaccaaatcatcacaccttatgccatcacggctgttgatgttgacgatatgcagtctcgattgcgggcacttgcggatgatcatgatcttttggcaacttatgcaactaagagtcgacaagctgctgaagtttacgatgaaagccgacttgaaaaagtctggcacgatttctatctgcatcaagctgcactggggaagcactagccgaggagttatatgacacggaagaacaaactggctgtcttaatcatgattttgattggcgccggtatttttatttatgaagctcgtgatctgaacggcgcacaattaatccacgaactattgacgcttgatctcaagtggctgctggtggcttttttgctcatgtttgggtcgtggatcattgaaacctttgtggttcagatctttattcgaagtgaagctgatgatttagactttaaaaccgctttgcgtgtgccgttggttgaacaattgtttaatgcaattacgccgatggcttctggtggtcagccagcccaattatttgctttgatgcaaagtggcgttgaagctggccgggcaagttccgtgttgttgatgaagtttgtcgtgtatcaattcatggtcctgattaactttgtcctgacactattcatcgggtttgatcaggtgtccaaacattttggggcgcttgctttgttcatcgtttttggttttgtgattcatgtggttgtcatcgtaggcttgctcatggtgatgtattactataagttcacaaaaaaattagtgaatttggtgatgataccgattggctggtttgtcaaacctgagaaaaaacttgccatgcaaagtaaccttgatcataaaattgacactttttacgcagagagtttgcacttgaaacgcgaaaagaagcgggtcatcaaggcttgcttgttgacacttgtgcaattgctgctttactatgcagtgccgtactttgtgcttctgtcgcttggcgtaagtcatgttagtatcgttgaggtcatcgtgttgcacgtgatgattgtgatgattgtcagcctgtttccgattccaggcggtgctgggggggccgagtatagctttaagaccttgtttgcgacttatgttgcgtcgccttcaaaattgattctagggatgctgttatggcggttcttgacctattacctggggatgatctgcggcatcattgccatggcattcccgccaaaaagcaaacgtacgtgagcgactaagaaaagtcaaagctcagggagggcgaaatgtcgtcagcaagcgaagaactgaaccagtattggcctgcctttagacaaagcaaacgttatgcgccattgttagggatcggagacgccgagattaagcatatcttgaccggcatcgttgaattggtgatggctcaaaatcagcatcacattaaggcgtggcaaatcaacgaaattgctgctgccctgagacctgctttggagactagctgggccaccccaaaacaggagcagcgaattttggcacgatatgcttcgtgggtgaatatttttttaacatggctggcagaagccggtaaggtcgcatttacatcggcagacgttgctgctgtgatggcgatactttatccgtaagctacatgtcgataaataaaaagcgcttggttatcagaccgattttgatctgataaccaagcgcttttatctattgtcttcaaaactaggcggctttatgcgcagctatgaatgcttgtaaacgtttgactgcctccttgaggtcagccatggaagccgcatagctgatgcgaatataaccttcgccaccagggccaaacgcagtacctgagatcagcgcaagtttctgctctgtggcaagcgattgcgtgaattgtcgcgaatcaagccccagttcgatcgggattttggcaaaaagatagaaggcgccatccggccgagcaacatcgaagcccatgtccagaagcgcctgatagacaaaatcgcggcgcttggcataggcggctttcatcacctgtgcatcatcttgtccgttcgtcaaagcttcgatgccagcgcgttgtgcaatggtggttgccgcggtgacgagatactggtgcacttttttcgcctctgcgatcaaaactcgcggacccatcaaaaaaccgattcgccagccggtcatggcatgtgattttgacagaccattcacgacaaaagttcggtcgtaagcataactgcccatggaaacatgtgagtcaccataagttagttcggaatagatctcatcgcaaataatataaagatcatgttcagcagcagttgcggcaatcgctttaacctcagacgcacgataagtgacgccagtcggattgcttggatagtttaaaatgatgccttttattttggcatcaggatgagcagcaatcgttgcttcgatcagcgctggggtcaagacaaagttggttttgctagtgtccatatagatcggtgtcacatgattcaacgtaagcaaagggatgtaccccggataaatcggtgacggcaccagcatggcatcacctggatcgctgatggttgtaatggcagttgccaaagcctcggtagcgcccacggtgacaagaatttcatcatcagcagcgtaatcagtatcatattttgttttgaaaaagtgttgcgcagcttcccgcagttctggatcacccaccattccggtataatgagaataattttcctgaatagcttcaatgccagcctgtttaacgtgctcaggcgtattgaaatcgggttcacctaacgttaacttcaaaataccgggaatcttgctgacgctttcgtcaaattgccggatttcactaacgtcgatatcggctaattgtttatttaatggttgcaacttcatgggcgatctccttagtatgtaggttgcaaatagcatagcccattttccctcatacttgcaatgcaataaaactgcaattcaaagagagatttctcccacagaggccgtggtttatgctaagctatttcttgaaataggaaaaataaacagcgcgtgatcccgcccagatgagattcgatgtgtcagtgccaatgattggcatgttggctcgcaaggtggtgatcgcgtttataggaggccattttatgaaacaatcacagctcgtggccatcatcaagcgcctagaagccatgcaggcaggcgatggcgagacccagtcgcgccgcttcgaaaaaaatggtgatgaaaagggcctcgtgacatacgatcccaagaccgaaacttatgaacttgaagaattaggcactcaccaaacctttcagtttgataatatcgatcttgcggccatggaaatctatgatttgatggattttgatgaagacgatggcacaagtgacagcaccagcgatcaagcaccagcttgatcaacgacaaaagcgaactgacaaggttcgctttttgtgtagcacatgatcagaagcgcttggaaatggtattcagtagccgtcaaaacctgatccgaatttaaaggcttctttaaaatcaccatggattggcccaaataggtccagaaagtttgtctttttcaaaacaagcggttatcctagcgaatgtgctatacttttgacattaaacaatgacttggaggctccacatgaaccagcttggcagtaaactcagggaattttttaatacccggctcgggttttttgtgcttgccatcgtccttttttgggcgaagacatactgggcatatcaatcaaaattcaatctgggcgtcaccggcagctttcaacatctgatcttggcgatcaacccgattccaaccacactgttcctttttggcatcgcactatacatgtcagggcgtaaatcgtacattacgatgctgattattgatgcactcacatcggtgtggctttttgccaatgtcctttactatcgagaattttcggactttctgacatttgcattgatcaaagggtcaggcgccgtgtccaataacctcaataaaggcatcatgggtattgtgcaaccaacagattttattgttttcgctgacgtcctcattttgattctgttgcttgtttttaaagttatccggatggacattcgaccgattaagaaacgctttgcactcggggtttcggttttagctgtcgcgatgttcgcagctaatctcagtatggcttatagtgaccgttcaggcttactgacgcgtacctttgacaataactatattgttaagtatttagggcttaatgcctatactgttgttgatggggttaaaacagcacaaaacagtgccacgaaagcaaacgctgattcaagcgatgtgaaatctgttttgaattatcttaataagaacagagtcacacctaatgcgcaatatactggtgttgccaaagggaagaacgtttttgtgatccatttggaaagccttcagcagtttatgattgacttcaaatgggatggtcaggaagtgacgcctaatctaaataagctctatcatgaatctgatacgttatcctttgacaatttctttaatcaagttggccaagggaaaactgccgatgctgagatgatgatggaaaactcactgtttggtttacctgaaggcgcagccatggttaccgatggcacaaccaatactttccaggcagcgccagcaattttggatcagcaaggttacacaacagcatcattccacggcgatgtgccgagtttttggaaccgagacaacacctataagtcttggggctatgactacttcttctcgaaaaattatttttcaagtgggaagaactacgatgtcggctatgggctaaaggataagattttcctcaaagactcagctcagtacattgagcaattaccacaaccgttctatgcaaaaatgatcacggtcacaaatcactatccgtatactttggataaagccaatcaaaccatcgagaagacggatactggcgacgacaccgttgatggctatgttcaaactgcccgttatcttgacgaagcactgggtgagtttttcaattggttgaaggaaactggtctgtatgacaaatcaatgattgttctttacggtgatcactatggtatttcgaataaccataaaaaagccatggcaaagcttacgaacatttctggtttcaatgattataacaacgccatgtaccagcgagtaccatttatgattcacatgtcaggcttaaaaggtggtattaatcatacgtacggtggtgagattgacgcactgccaacaatattgaacctgttaggtgtgaaagataacgatacagttcaatttgggtccgacttgttatccgcggatcatccgcaaaccgtggccttccgaaacggcgactttgtcacgccagactttacaaaggttggtagtcaatatttcaataccacgactggtaagaaaatcgacaagttatcagaaagccagaaggaaagtgttgatgcgtccactaatcgagtgaccaccgaactttctctgtctgatcgcgtcattaacggcgatttgttgcgattctatacaccggccggttttaagaaggttgatcgaagtgacttttcatataagctgacagatacaaagaaaaagttgaaagccgcgcaaaagaagggcacgagcctaaaagcggaaaacaagggtaagtcagttgccgatgagtataagaccgatgcacccgaacttaaagacgatagcgatagcagcagtagcgagtcaaagtagcaatcgaattcattgaaagcagcgttaagcggcgagcgctgctttttctgtgtccacaaaatgtgctgtagtgaatgggattactgacctgaagctgcttattctgaacttttgtaagtaaacagttgtgctagattagaaaagagcgtacaattttactagatgataatagttacaaataggaggctggctatgaatcaggcggtttacaacaaaacaattaacttgctcaaagcgaagcagattcgggtcaccccgcagcgtgaagcgattatttcgtacatgattgacagtacggcacatccgactgcggaaatgatttatgcgaagctgtcgccgcagtttccgcatatgagtgttgcaaccgtatataataatctacggcttttggttgatcttaatctagttgaagaaatgtcgtctaatgatgcggccactcattttgattttcccattgagccacattatcacgccatttgtacaaactgcggcagaatctttgacttcagttatccaggcgttacagatgttgaagcagtggcggctaagaaaaccggctttaaagtgagtggtcatcacctcgaagtttacggtatttgccctgattgccaagtgaaattaggtatgaagtaattgagtccaataaggcggtgcattacggcgattaagtcgtatgtaccgctttttgttgggtaggttaagcaacatcacgcaacaatcaattaggccgtatggacaggagcatcgcgtggttttgctggaaactcaaaaaaatacttgcacaccgtctgagttgctggtattatattattgctgtcaaaaagcaattccttttctaaaaagggtaaggtagaagcgcttgcatctcccatttaacaggatatttaataaaaatgttgacagttgtttgtcagcgtgataatctatcaaagttgtcttttgacaaggtcgtcctttgaaaactgaacaaagtttcgtttaaatgtgcagggtccttggtactttggtaccgaggcaaaaagtaacatttgcgaagtcaattcgctagaacaacaaatagagctattcgaacagctcatatttatatgagagtttgatcctggctcaggatgaacgctggcggcgtgcctaatacatgcaagtcgaacgagttctcgttgatgatcggtgcttgcaccgagattcaacatagaacgagtggcggacgggtgagtaacacgtgggtaacctgcccttaag

SEQ ID NO: 61 - DNA, 36193 bp, Lactobacillus paracasei
tctcgcaagtgctcgcagaagtcttgccgaaggaattaattcaaggtattgttgtgatttccggcccgagtcacgccgaagatgtcgccacccacgatattacaacgttaaccgccgcttccgatgatttgaagttggcagaaaaagtgcagaagctgttcatgaatgattattttcggttgtataccaacacagacgtcattggcgttgaaattggtgccgctctgaaaaacgtgattgccattggcgctggtgccttgcacggtctcggctatggcgacaacaccaaagcggccttgatgactcgcggtttagctgaaatcagtcgggtcggcgtgaagctaggtgccgaaccgttaactttcattggcttatctggtgtcggtgatctgattgtgacctgtacctcggtccacagtcgtaactggcgagccggcaacgcacttggacaaggtgaaaagttgccggatgtgttgaaaaacatggggatggtggttgaaggtgtctcaacgaccaaagttgcccatcaaatggcccgtgaacttgacgttgacatgccaatcacagacgcgatttatcaagtgctctacgaaaacgcgccgattcgtactgtcattactgacttgatgaagcgttctggtaagccggaattcgattttgacaatgcgagtttacaaaaaccataaaaccatgtatattaaacagtgtagcttactaattgtaagcaatatggcaaaaggagagactgcccatggcaaaaaaatatgatgtaatcgtgatcggtgccggcccaggtggtatgacggctgcactttatgcatcgcgtgccaatttatctgtgctgatgctggatcgcggcgtctatggcgggcagatgaacaacaccgctgaagttgaaaactatccgggtttcaagtcaatcctcgggccagatcttggtcagaaaatgtatgatggtgccacccaatttggtgctgagtatgcctatggcaatgtcgtcagcgttcaaaaccgcggtgccgtcaagctagtgaaaactgacgaggatgagtacgaggctaaagcgattgtcattgcgacaggcgcagagcataagaagttgggcgtaccgggcgaagaagcctacagtggtcgtggcgtttcatactgtgctgtctgcgatggcgccttctttaaggatcgcgagttggccgttattggtggtggcgattccgcgattgaagaaggcctttacctgacacaaatggccaagaaggtcacagttattcatcgccgtgatcaattgcgtgctcagcagattatccagaagcgagcatttgccaatgataagatgcatttcgtttggaatgctcaggttcaggaaatccaaggtgacgatatgaaagtcaccggcgtgaagtaccgtgataaggaaactggcgaggaacatgttttgccagtcgccggggttttcatttatgttggcattatgccgatgactgaagccttccaagatttaggtgttctggatgagcatggttggattccaaccgacgagcatatgcggacaaaggttccaggcgttttcgcgatcggcgatgttcgcgccaaggacctgcggcagattaccacagctgttggtgaaggtggcacagctggacaaggcgtcttcaactatatccagagtttgaatgatacgaatattgagattaaggcgtaattttgttcgagaccagcgatgcgagtcgctggtttttttgtgtctgtgagcagaaacgcttagaaacaagcagtcttggaaacttgttttagctagcacgcatcatcggtaataaaagaattttcttatttgagcgcgttttcaacccagcactcgtccacttatagtatgattgggacgggaagggtattgcccgaaattattaattatagacagatgggagctgatcacgtgagttatcgtgatacgtatcaacaatgggtcgacgaaccgacccttgatccggagctgaaagctgatcttaagaatatggctgatgatgagacgacaaaggaagaggcatttgctgctcctatggcgtttggcacggcaggcatgcgtggtgttcttggtgccgggattggtcggatgaatatttacacggttcggcaagccactgaaggtttggcccggtttatggacacactgtcggatgaaactaaggcccggggggttgcgattagttacgactcccgttacatgagtcaagagtttgcttatgaaagtgccggggtcttgggtgctcatggtattaagagttatgtttttgatcagttgcggccaacaccggaattaagttttgcggtgcgtcatttaaagacctatgcaggcattatgatcactgctagtcataaccctaagcagtacaacgggtataagatttacggtccagatggcgggcagatgccaccggaagaatccgacaaaatcaccaaatatgctcgttcagcagcggatctttttgctatcaagtctctgaacgtccatgtgctacgcgccaaaaagttgatgcaaccgattggtgaagatgttgatgaagcttactatgctgaagtggccacggtcaccatcaaccatgatttgattaacaaagtcggcaagaacatgtcgttggtttatagcccactgcacgggactggacggattccagcgcaaatggttttgcgtaatgctggtttcgaaaacttccggttggtacctgagcaaagtattgctgatccagaatttgcaactaccccattcccgaacccagagttcgctcaagtctttgatttgccaattgcattaggcaaaaaaatcggcgctgatgtcttaatcgcgactgatcccgatgctgatcggctgggcacagcagttaaagtcggcgaccattatcagttgttgactggtaaccaaatcgcttcggtcttattgcattatattctggaagcgcgcaagcaagctggcacactgccgaagaatggcgcggttgtgaagtcaatcgtgtcgacggaattggcaaccgccattgcgaaggattatggcgtggacatgatcaatgtgctgactggtttcaagtttatcggtgatcagatcaagcattttcaagctactggcgagcacgaatttctgtttggctttgaggaaagttacggctatctgatcaagccattcgtgcgcgacaaggatgcgattcagtcaacagtgctgctggctgaagttgccgcctactatcagtcacaaggcaaaacgctttgggacggcgttcaggaactgtacaagaagtatggttactatgctgaaaagaccgttggtgttgactttgaaggggttgacggtcagaagcaaatggctaacttgatgaccaagttccgcgaagaacagcctgctgattttgcgggtgtcaagattacgaaggttgaagacttcctgagtcaggaagctaaatctgctgatggcactgttgaaaaactgaccatgccatcaagcaacgttctgaagtatattttggcagacggtacttggattgctatccggccatccggcaccgaaccgaaagttaagttctatgtcggtaccaaagcagacacagaagctaaggcccaagaaaaattggatgccttcgaaaaggcgctcaatgattttcgtgaagaagcttagtttgttttaaacgaatcaatgtgtgaatcctgacgattaagcaggtgaagcaagatagcggcgaacgtattgtcccaaatttgggacaaggcgttcgccgttttctgtagggactatccggactttttcggtttctaaaagcgattgttcaatgtcctttaaaaaacgttgtcatccccacagccatgtttctccggtatactttaatcaaggtaatgatacgggggtggcatgatgaactatttaatcgttgaagatgaaccggcattagccgagacactgcgcgcctatttggccaaagacggtcaggccctgctagcgacctcgttagcgcaagccaatgaacgagtcgcgcagatttcgcccgatgtcatcattttagatctgaacatgcccgatggtgacggcttgacttggttagcgcaatggcggaagcatttgactgctaaggtgattgttttgacggctaatgacgaggagctaacgatgctaaaaggactccgacttgctgatgattacgtggtaaaaccggttagtttacgtgttttaaaggctcgcattgctaaacagctgccgatgacagtgcaacaatttggggcggttagcctgaatttagccactggtcaagtgacgaaaaatgagacagcggttgtgctaacggcggccgagtatcgtttgctggcctatttttttgccaaccccaatcaaattttggcaagagatcagttgctagcagccttgtgggacacgcgtgagcagtttgtggcggataatactttaaccgtgaccatcaaacgtctgcgggaaaagcttgaggatgatccggcacatccgaccttaattcggactgtgcggggaatggggtattttattgatggttaagcatgattattgggctatgccggaaaccaaaagtgtgctgagattgacagtgtggttgatagttattttgtgggccgctttactcacggtgatggtgcttgtgccagtcactcggctttggctagttgttattggccttggcagcacactgaccagtagttgggtcgtgttgcggtgggcagtcaagtttagtcagcgttttgacttggcgctgcgacaactagatctgacaaaggcaggtgcaagcaactatgcgattgatcggaatgatgaaggactgttttccgatctcaacaatcgactttatcaatatgcccgccaaatgcaggctgaacgcacggcggtgaagcgtgatcgcgatcagctgagtgttgctattaccgatattgcgcatcagttgcgaacacctttagcggcgaataataatttgcttgaaatgatgaccgcggctaattgggaggtcacccgtcaggagcttttagcgcagcacacgcgtcaagcagagttagttgagcagctcattttattagctaaggtggatacacatacgctgagccaaactagacaagatgtgagcgtagcggcgctggggaaagaggcattgaagccactgctgcgaatggttgctgataatcagttgacgattgattggcaggtatcaccagacctaatgcttcatgtgaacccggcattggtcaaagaagcgttggtcaatgtcttgaaaaatgcggttgaacatactgcttttggcggtcaaattcagattattgggattgctgatcctattcgcgtccgcctgaagattatcaatacaggctcaccaattgctgaagcagatatgccgcatttatttgagcgttttttccgtggtcaatatgccactgccaataacgtgggcattgggttagcgatcgctgctggcattacgcgtgaaaacgatggccgcttatctgctgaaaataccgcggaaggcgtacaattcacgtttgaattttttcgttgagcgtgttttgtcacttacttgtcacttaccattgataggctgagagtatcataagaaagccaacacagattgatgtgtcaggcgcgaggaggggtactagtggccattttgacagcacgacaactgacgaagcaatatgcaggggaaagtcgaccagcgttagatcacgctgattttagtattgaaaaaggtgaatttgtggcaatcgttgggccgagtggttcgggtaagtcaaccttgctacatctgctgggcggtattgatcaaccaaccagtggtcgggtacagctatacgatacagatatttatgctttggatcagacccaattggcgatttttcggcggcgacaagtcgggttgatttatcaattctataatctgattcccgatttgacagtggtcgagaacatgacgctgcccgctgacttggacggtcgaaccgtcgcgacatctgagttgacagaattactggctactttgggcctgacggaaaagcaagatgctttgccaaatcaactgtcaggcggccaacagcagcgcgttgcgattggccgggcgctgatcaatcatccggccattattttagccgatgaaccaacgggcaacttggaccgccgtaattcacaagacatcatgaccttattgcgacaggcgaatatcaagcaaggtcagactttaattgtgattacgcatgatcccgatatcgctaagcaagcagatcgcgttgtaaccatcaatgacggtgtgctgcgtgaagggcggtgagcgtcatggggacgatgacccatttagtttggcgtcaactgattaaggagaaggcgcgcacgttcacaaccattctggcgatggcagttgctgcgaccttaactgtggccaccttgattggcattaattcggctcggcattcaatgtatcaagataatattcaaaataccggcggcctacagtttgttttatcgaaggttaaccaagaaaccgcactggctattcagaaaaaagccgatatttccgaaagtgtccgttatcagcaacaaggacaaatcagctttgctgatcaggtacctaaccaaccagattcgcctttgttaatgttgccgaaaccggcgctgcagcgattaatccaacccattcttttggaagggcggctaccccaaaatgagcaagaagtcatgttagcccaagatttgatttctgatgtttatgcagtgggcaaaaccgtggcggcacagcgcaatggtcagcacgtcgttcttaagatcgtcggtagttaccgtggctatgctggcctcatggcaagtgatggcgctgtcaccaccggccattttgacggcacgaagaactatgctgttgcagcggcttttggcaactatggcaatttttacgcgaagttgaagaaactcacagcgcagtatcatgttggatccgaccagcagagaatgaatgaattagctttggaacgggccggtgagtcgcgagatgtcaaggtccgtgccatgttcgtattacttgtcatcgtggtgctaagtgtgattggtttggtgtcattggcgttgatttataccggcatcaatctgagtgtacaagcacaaacgcagcgttatggcttattgcgttcaattggtgcaacgccgagacaaatccggcaatcggtgtatctgcaagcactgactttggcattgccagcgattttactgggtttgcttgcaggaataggtgggttgtcactcgcttttcatgaattgaatcgaatttttaaggcgagtggtaacacctttcagctcctactcacgatcagttggtggccgattttagtcagcggatttttcatgttgcttgtcacgttactagcagcacgacgaccagccaaacgcgccgcacaagtgagtccgattgccgcagttcgcgcgcagtcagcaagtcggaaggtgagtcagcgtatgttacggcaagggatgctgggacgatttttgccgacgccgattgctaaattggcttataaacattatcggcgtttgggctggtcaaaagtcacgatgatgacaacgctggccttgtcactcatgatctttatcggctttaccagtttctttcgcggcatgttaacttttagcgatgaaacgattagtcgccaggcagatgtgacgatcaccaagacacaatcgctggcatcagcgaatttctcttttaatccgaggcgactgccaggggtgaaacgcggaacggtgactggcacaactcaagtcggtttgaaaaacgctccacaagcatttcatgatcggctgaatgtgatcgtggtgagtgaccaaacgttcggcactgtttttaaagatcagccgacgattatcacgggcagtcggttagtgacgaactcaaaaacaggcaagcgccagcagcaatgggacacgccaaaagattttgcaggaaccttggagcttgctaacgagcaaagtagccaaaagactttaacgcagccgatgaaggtcgtcaccaagactgctgcggaaatgaccgattggcttgtcagtgaccaaagtggtttggtgctttctgctagccggttccgtcaaatcagccaagcactccaaattaaaaatgatgacgtcacgtatgccattcaagtcttactaattaaaccaagttttcatgagacggtggccagtgctttacggcatgaagtgccacatgcagcactttttgatcaaattgaaaatgatgcgcgtggcaccagctttcagcttgctattcaagtcatggtctatggctttttaaccctgctgacccttgtgagtctggcgaacattgtgaatcatatttttgctaatctgttgcaacggcggcgaagtctcgccatgctgcaaagtgtcggtacgacacctggtcaaattgttcggatgttggcacttgagaatgggtttctgtttgggacaagtatggtgattgggtcgttgctggggacactgcttggctggattctgcatcaagctgtcaacaccggtattacgatggcttttcaggttccttggttagagatggggatggccggacttgcattactggttatctggggtatttttgcaggcattagttttcagattatgcgacatcaggatattgatcaattgattcgtgtgggttaagacaaaagtgaaatgattgatggcactgatgctccggtttctaaccgggctggttcacgctcttgctgaaacgcgttctcaggcgcagaaacctgcacataaggacctcggacataaatggccaaagcccagccatttgtgtccgaggccacttatgctccggtttctaaccgcgcctgatcacgctctgctcttgcaatgggcttcacaaggtggtagtcttttaacaatttaatttactgccatcactatcacgccacgaatatcaggaggtcatttaatcatgggcatgcaccaatttatccaaggactaagcaacttagagacactgcgtcgggcaccgggattctttaagtatcaggaacattcagtggcggcacatagtttcaaagttgccgaaatcgcgcaaatgctaggcgatgtcgaggagttagctggtaacaaggttaattggcagatgctctatgagaaatctctgaatcacgattatactgaacgttttatcggcgacatcaaaacgccggttaaatatgctaccccgacactgcgccacatgctggctgatgttgaagcgaccatgacggagaactttatcaaaaatgaaattccccgtgactttcaggatcgctatcgtcgtcgtctttctgaaggcaaggatgaaacgcttgaagggcagatcttgagtgttgctgataaaattgatctgctatacgaaggttttggcgaaatcgagaaaggcaatcctgaacaggtttttctggatatctactccgaaagcttaagcacgatcctgcaatttcggaatcgtcctagcgtgcgctacttcttggaggaagtgttgccggacatgcttgatgaaaaatttgccagccgcgatcagcttgctaaactgactaaagaaaccatggcagaacatgaaccaaacaagtagcgaaagtatgttcgctatgttataataagcaagacaaaagttggaatgcgcatcatgtcgattccaacttttttgatgacgaaattttgtttggataatgtaaaaatgcgttcactggggcttttttcctgcacggattgacacgtgttcaccttgtattcggaatgaatgatgcccatgtgattgttttataggaggcatgtcgatgatcgaacgaatagccgatcgtaaatttgatctggtttcaccttaccaaccagctggtgatcagccacaggccattgccaagttgacaaagggctttgaagagggtaagaaagaacagatcttgttgggtgcaactgggactgggaagacctttacgatgagcaacatcatcgccaacctgaacaagccgaccttgattttgtctcacaacaaaacattggccgggcagctttatggtgaattcaaggaattcttcccgcataacgcggttgagtattttgtttcctactatgattattatcaacctgaagcctatgtcccgagtaccgacacgtatattgaaaaagatagtgcgattaacgacgaaattgataaactgcggcacagcgccaccagtgcgttgttggaacgaaatgatgtcatcgtggtggcctcagtgtcgtcaatctttggtttaggtgatccgcatgaatacaagaatcatgtgctgtcattgcgaactggcatgacgattgatcgtaatacactgttacgccaacttgtagatattcaatttgatcgaaacgacattgattttcaacgtggtcgctttcgagttcgcggcgatgtcgttgaaattttcccggccagtcgtgatgaccatgcgattcgagtcgagtttttcggtgacgaaattgatcggattaccgaagtcgacgcattgaccggcgaagtcatcgggacacgtgatcatgtggcaattttcccggcaacgcatttcatgaccagcgatgaacagatgcagcgagcgattaagagcattgctgctgagttagaggcacaattgaaagtcctgcgcagtgaaaacaaactgttggaggcgcaacggttagagcagcggacgaactatgatatcgaaatgatgcgggaaatgggtttcaccagcggcattgaaaactattcacgccatatggatggccgtaagcctggtgaaccaccgtatacactgctggactttttcccgaaagacttcaacattatggtggatgaaagtcatgtcaccatgccgcaaattcgcgggatgtacaatggcgaccgagcgcggaagcaaatgctggtcaactacggcttccgtttaccaagtgctttggacaaccgaccattgaaaatcaatgaatttgaacaacatgtccatcgtattttgtatgtgagtgctactcctggtccttatgaactggatcgggttcctaaagacgatattgctgagcaaatcattcggccaaccgggttgttggatccgaagatcgaggttcgaccggtcatgggtcaaattgatgatcttgttggtgaaattaacaaacgggttgatgctcacgaacgtgttttcatcaccaccttgaccaagaaaatggctgaagatctgactgactacctgaaagacatgggcatcaaggttcgctacttgcatagtgacatcaagacacttgaacggacgcagattattcgtgatttgcgacttggcaagtttgatgtgctgattgggattaaccttttgcgtgaagggattgatgtccctgaagtttcgttgattgcaatcttggatgctgacaaggaaggctttttgcgtgccgaacgttccttgattcaaaccattgggcgggcttcacgtaacgagcatggcaaagtcatcatgtatgctgataaggtgacagattccatgaaggctgccattgatgaaacccaacgtcgacggacgattcaggagaagttcaacgaagaacatcacatcacgccaaagaccattatcaaaccgattcgggcagctatttccagctatgaacaatcagatgatgataaagccgaggccaagaagacttttgctgaagttgattatgaggatatgagcaaggctgataagaaggagttagtagcaaacctgcgctcacaaatgcaggcggcagctaagaagcttgatttcgagcaggcagcgtcattacgcgacacaattcttgaattgcaggctgatatgtcttaatcagatcgcacttgcacgatggtaccaagtcagccatgattgctttgaacagatccggtgagcgcgaaccagcccggttagaaaccggagcataagtggccttgaacgtgatggccggtctttggccattgcgttcaaggtccttatgtgcaggtttttgggctggcgagcacgttaaggtgagcggtcagaagtcggcgtataagctgttgtggcaatgtgattttcgccaatactgcttgctaaaaatgaggagatcttttgtgaatggcaaacgataaaattgtgatccatggggctcgtgcccacaatttaaagaatattgatgtgacgattccccgcaataaactggtcgtgatgaccggcctatctggttcaggtaagtccagtctggcttttgacacgctttacgccgaaggtcagcgtcgttacgtggaaagtctctcagcatatgccagacagtttctgggacagatggaaaaaccggatgtcgattcgattgacggcttaagtccggcgatttcgatcgatcagaaaaccacttcaaaaaatccccgatcaactgtgggaacagtcactgaaatcaacgattacttgcgcttgctgtgggcacgtgttgggcatccgatttgtccaaatgatggcacaccgattaccagtcaaagtgttgaacagatggtggatcgcgttttagccttacctgataagacccggattcaaattctgtcaccagtggtgcgtcgcaagaaaggcagtcataaaaaagtcttcgccaaaatcatgcgtgaaggttatgtccggatgcgtgttgatggtgaagttgttgatgcaacggctgattatgaactggataaaaataagtcgcatgacattgatattgtgattgaccgaattgtggttaaacctgaggcgcgcagtcggcttttcgattcatttgaagcagctctgcggttgtcagaagggtatgccaacgtggacgtgattggcggtgaaccactgcgcttttccgaacattttgcctgcccgatttgtggctttacgattggcgaaatggaaccacgactattttcattcaacgctccttttggcgcttgcccagaatgtgacgggttgggtgttaagctgacagttgacatggatttggtgctgccagaaccgagtatgactttggcagaaggggcaatcgcaccatggaatccaatcagttcccagtactatccggaactgctggctcaggcggcgaaaaccttcaaagtacgaatggacgtaccctttaaaaagctgacccaccgtgagcgcaatgtggtgcttaatgggagcgaaggcaagttattccattttcattatgaaaatgactttggcggtgtacgcgatgttgatgtgccttttgaaggggtgctgaataacatttcccgccgatatgcagaaacaaatagtgattttactcgccagcagatgcgcagttatatgacagcattgccgtgcccggtttgtcacggcaaacggctgaatcggcaggctttggctgttaaaattgaaggtcgcgatattgcagaagtttctgatcttgccatcaaggatgccctaccatttttcaaaaccgtgcatcttagtgaagccgaaagtgtcattgcccaaccaatcgtgaaagaagtcgttgaccgcttgacattcttggtcaacgttggtcttggttatctcacattgagtcgtagtgctggtacactatccggcggcgaggctcagcgaattcgcctagctacccaaatcggttcgaatctgagcggcgtcatgtatgtgcttgatgaaccatctatcggcttgcatcagcgcgacaacgatcgcctgattgcctccttgaaaaaaatgcgagatcttggcaacacgttgatcgtggtcgaacatgatgaagatacgatgcgcgccgccgattatctgattgatgtcggaccgggggctggcgaacatggtggccgcatcatggcatccggtacccctaaacaagttgcacgtgtgcgcaaatcaatcactggccaatatttatcagggcgcaagtttattccggtaccactaaaacggcgacaaggtagtggcaaagtgattcgtttggaaggcgccactgaccacaacttaaaaaacatcgacgttgattttccattaggtaaattcatcgtggtttctggtgtttctgggtcaggtaaatctactttggttaactcgattcttcggcgtgcattggctcaaaagttaaatcataattctgagaaaccgggtccatacaaaaagattcttggctataaaaatattgaaaagctgatcaatattgaccaaagtccaattggccgcacaccgcggagcaatccggctacctatacgagtgttttcgatgacattcgcgggctatttgccgaaaccaacgaagctaaattacgtggttacaaaaaaggccgctttagtttcaacattaagggtggtcgctgtgagaactgtaaaggcgacgggatcatcaagattgaaatgaactttttacctgatgtttacgtgccttgcgaagtttgccatggcaaacggtataactctgaaaccctcgaagtaacgtataagggcaagaatattgctgaagtgcttgatatgactgtcgaagaagccactgacttcttcaagaatattccaaagattcggcgcaagttgcaaaccatcgtggatgttggccttggttacgttaagctgggacaaagcgctaccaccttgtctggtggcgaggctcaacggatgaagcttgcaagcgaactgcagaagctttcaaccggcaagaatttttatattcttgacgaacccaccactggtctgcatacagatgatatcaagcggctgctggaagtgttggaacggctagtcgatgaaggcaataccgtactggttatcgagcataatctagatgtcgtcaaaacagctgactgggtcattgatcttggccctgaaggcggagacggcggcggtcagatcatcgccactggcacacctgaacaggtggctaatgtggccgatagttatactggccaatacttgaaaccaatcctcgttcgcgacactcaacggactaaggaagctgcgcaaacatcaactaagaatgaagcgcaggcagtaagcaagaagtagattgactgaccaggttggaccatcattcacggcggttaataagggcaaacaatgacaacaaaattgtttgcctttttgatatgggaaatttattagaattttcgagacactagtaccaaggcggagcaatcgtagaccggatggggatcagcagtacaaaaagcacggcgaccgcgccttgttactgatgttgttaggcgacttcgagaccgcgagctttgcgggcttggagcgttgtctccggtctagcaacgcggccggcccagaaaccgagttgtttcacactctgatttgctcattctcgtgcttaatattatgatgaataggattaagaaagtagggaaatagatgttaaatcgaaaaagttttggttttgactgggggcagtttatcactggtatcctgttcctgatcgccgcatttgtcgtcatgcgctatccgctggcaacgttgaaaacggtgacctttatctttgctgttgttgccattattcgtgggattgcgattttagcagggtattcaacgcttcgccagctcactggtaaactagcttgggtgtcgctcttgatggggatttttgaccttgttattggtgtcattttcctggtcaacagtaattttggtgttgcaacgattaccatgatgtttgcaatctggttcttagttgattcagttggttcgctattcaacgtgggccatttgcgaattgcaggtactggctggtttgtcctttacctcgttttggatattctggcagtgattgtgtctttgatgctgttcatgcagccagtggttgcggccatcacgttggtcacattattgtcgatgtttttcgtcctattcggcatcgaatgtattgtccttgcctttgcacgacgcaatatttaatgaacatcgcttttatttaacctgatgcagctgattcattgcgctgcatcaggttttttaataacaacgcttgatgatgcggtgaaaagaaaccggggatcggtaggaatgacacgcccggcatgttatacttgaataaatatgatcaaaaaggagccttttatgactgaaagtttggatcttgtcattatcaccggtatgtccggtgccggtaaaaccgttgccatgcaggcattcgaagacctgggatatttttgcgtcgataatatgcctccagctttgttgccgaagttttgggaattggtaaaagaatccggaaagatcacgaaggtcgcgcttgttgtcgatctgcgcagtcgtgctttttacgatcagattatcgatatgctggctaatttggacaacaatgcctatgttcattctcgcatcttattcttggatgcaactgatgaagagctggtttctcggtacaaggaaacccgtcgctctcatccgttggccatggaaggccgattgatggacggcattaaaaaagaacgtgcattactcacagagttgcgcaatcgcgcgcaggttgtgattgataccacgaccttaagtccacgtcagttacgggaaaagattttccttaactttaaggaaagcggtagtcaaccagcatttcatattgaagtcatgtcatttgggtttaaatacggattaccaatagacgctgatattgtcatggatgtccgtttcctgcctaatcctttttacattaaggattatcggcccaagactgggcttgatccggaagtttacaattacgtgatggataatgaagatgccgaaagtttctataacaagttttatgatctattgtctgaaatcatgccaaagtacaaggcagaaggcaaaaccagcgtaacgattgcgattggctgcacaggcggccagcatcggagtgtggcttttgccgagcggattggtaaggcgttttcagatgcatatgccgttgatatcacgcatcgagacattaagaagcataaggagacggtgaatcgctcatgagtcgtgaaactaaatttattcgggtcatccgcggtcggcgtccaaaggtggttgtcattggcggtggaacaggcttgccggtcattctgcatagtttgcatgagcaagatgcagatgtgactgcaattgtgactgttgccgatgacggcggttcatcagggacaatccgcaactatatcaacgtagtgccgcctggtgatattcgcaatgtgctagtggctttatcggagttgccgagtttgtatttggatatttttcaatatcggttcaatacaactgatgcttttttcgctgggcatgcgattggcaatctgattattgccgcgctgtctgaaatgaaaggcggcattttcccagcggttcagcaactaagcgaaatgatgcaagttgatggtcacgtttatccggccagcaacacgccgttaaccttaaatgctgaattcaccgatggtacaaagctgtctggtgaagctgagattacagcggctgggaaaaacatcaagcatatttcggtttcagaaacagatcctgccaatggcaaaccagaggcggtcaaagaagttatcgatgcgattatggacgctgatgttgttgttttaggcccaggcagtcttttcactagcattttgcctaacttgatgattgaaaatctgggggatgcggtgaagaagacgcaagccgaagtgatttacattgtcaatatcatgacccaaaaaggcgaaactcagcattttaccgatgccgatcatgtccgggttctgaatgaacaaatgggcgagaactttgtggatacggttttggttaatattgaaccagtccccgataattatctggatcatcaaaagtacaacgaaattctcacgccggttaagcataactatcaaggcttgcgagacatgggctgccgcgtgatttccgaagactttttaaagttgcgcgatcatggtgtctttcatgatggtgataaagtcgccaaggagattttaaacttggcctttcaggtcagcggcaaaacccggaggtgagggtatggcaagtttcgccagtctggtgaaaaaagaactgacacagctcgaggtacatccagaacatgctaaggctgaattgtctgctttgattcgtatgaacggcagcctgacactgatggctcatcgttttgtgttaaatattcaaaccgaaaatccggctattgcacgtcggatttatagcttgattcgccaagtctatcatcacgaagctaatctggttgttcaccgtaagatgaagctcaagaagaattatcaatacattgtgcggctaacagaaggcgtcaatgacatcttgtcggatctatcaattttagatccggataccatggcgatttcaacaaccgttccagcttcggtgttgaaggaaccgcagcggatgcgttcttatttacgcggtgcctttttggccagtggttcagtgaataacccggaaacctcgcgttatcatctggaaatctattctttatacgataatcacaatgctggtattttgaaaatgatgaatcattttaatctgaacgctcgcaccgtagaacggcgaagcggctacattgtttacctcaaggaagcagaaaagattgccgatttcttgcaggttattggggccacgaatgccatgctgaagtttgaagatgttcggatcatgcgggatatgcggaattcagtgaatcgattagttaactgtgaaaatgcgaatatgaataaaacgattgacgctgcacagaagcagattgagaatattaactatttaaagaaccatgttgggctagataacttaccggccaaattgcgggaaattgcagttttacgcttagcacatcctgacgtctcacttcaagagcttggagcgatgatgccgagcggccaaatttcaaagtctggggtcaatcaccggttgcggaaattgaatcagattgctgaagggtatcaacaaccagaagacgcttgagcactaatgcgaagtgggttgcgttcatcataatcgggtgttgacaatcaacaaatcaatccctttgtttcctcaagctaatcgtgtacaatgtaaccgacatcaagttattttttcgctgaagattgactgttttggacgcatgtcgatgtcttttagcttggatgtatccctttggcgacgacttgtttgaaggagccgtgatgatcttggcaaccagagagaagcgccatcgcttttttgagatgactgtcttgaagcaatgacgcgagccccgtcggtgttgatggtggctaataattgatagatgagcgcatttttcacagtgtggacggcttttgcgagctgttcgcgcgtttaaaggtaagttttaggaggaagcagcatggttaaaccgattactttgaacgaacagctttgttttgcgatttacaaagcacaaaaacaatacaatcatttctattcacaagcgctagccccgttcaagttaacctatccgcagtacatcacgttattgtcgctatatgaacatggcacaatgtcggttaagcaagtcggacaaacacttgaactggatagtggtaccttgacgccgttaatgaaacggcttgaaaaagatggctggatcagccgaaagcgttccactgaagatgaacggcgagtggatgtcagtttaacccaaaaggcgctggatgcccgtgatcagatttttgaacacgttggatcttgcatggagttgatgaatcttcctaagcctgagtatgatcatatcaagtcagaagtcagtcgggttgatgagcatttaagtgccattcccgacggtgcttttcccgaagcttaacatcaaaaaataaggtcaaagatttttatctaaatctttgaccttatttgactttagttgtatacttagcactgtacttttaagagtgctaataacgattatcaggaggttaggacatgctagtacctaccgtcgttgaacaaactagtcgtggcgaacgtgcttacgacatttactcacgtctattaaaagaccgaatcattatgttatccggtgaagtcaatgatcaaatggccaattctgtcatcgcgcaactgctcttcttggacgcgcaagactctgaaaaggatatctatctctacatcaacagtcccggtggtgttatcaccagtggcttggcgatgctggatacgatgaacttcatcaagtcagatgtgcagacgatcgccatcgggatggctgcctcaatggcgtccgttttgctggctggtgggacgaaagggaagcggttcgcattgccgaactcaaccatcctgatccatcaaccttcaggcggtgcccaaggtcagcagaccgaaattgaaatcgctgctgaagaaatcttgaagacacgtcgcaagatgaaccaaattttggccgacgcaactggtcaaacgattgagcaaatcaagaaggacaccgagcgtgatcattatatgagcgctcaggaagccaaggattacggcttaatcgatgatatcttggtcaacaaaaatacgcaaaaataagctgtaaaaagaaaagcgcgttgccgtatcgtggcaacgcgcttttgtttccccgaaaagacttgcaaagcgaggacatattgagtaatataattaggtacttgcgcggttagtgtaatggatcgcacgtgagattccggttctcgaaatccgggttcgactcccgggctgcgcagaaacccggttaaatgggaaaaggtaggacagcaaaaaccccgagaaatcggggtttttgttttggtttgaaaaagatgcagccatggccttacatgttttttgcagaacttttgtgtcaataattcgcaacaataaagaaatcgaattatttatttaaattctgaatggcatagttagcttcatcagcggtgaatttttcaccattttcagaggttaattgctcacgaaccgcatcaggggacatatccatatccttttggtatgtttttgctttggcaagtgcatttttattccaatcggctttgacattttcaatggcatagttcgcttcttctgccgtaaacttttcaccgctttgagaggtcagttgatcatagatgcctgcctttgacatatgcattgaatcggcataactcttagctttgttcaacgcgtttttattccaatcagctttaaggtgatcaattgcatattgagccgcttcggccgaaaacttttcgccactttgcgaaactaattgatcgtaaacgcctgcttttgacatgttcattgcagatgcgtaggtagttcccttattcaaagcagattgatattctgccggaacatctgctgtcttactttcgcttgtcgcctctgacgccacacttgattgctggtggcttttgtcagccgctgaagaggatgaactctccgcagtggtatttgagttgtttgttttacttcccgtcatattcacgccaacaatgatgaataaaaccacaatgatccaaaaccagattcgcttgtaaattggtttctttttcttcattttgaactcccccatgaagatttcttaaaaaggtgcagtaaaatcaaaaattagctgtagctagaactaagcctccctttctcaagtaatgttgttactttgcggttaacatcccttccactcatagagaaaccgctttcaattatcatatgcaaaattgctaaatttagcaaatctcaatgcgtatttaggcgaaaatcgtgatccaatcgtgaatcgttaaattttgaatgaacaactttctttttatgaaaggtgagtttacgtgcctgaaaattgaactcaacaaaatgcactagtgaaaaaacgatgtatgctattagtgacttaatacacgaaatgagccactttccctcgcatgaaaattccattagaaacaacccgaaactcgctttcaaaaaaggctgcaagaggggaccaaattttagtaaaatccgaataatcttcacatcaataaaatagatgttccaagtttgccgaatatgtgattgtttctggacgattagggccgcagacttgcgataaagcggaacccctgctacaattggtcttgttggtaaaggaaaacagcatttgttgggttcctaatttttttcagcttgctgggtcggcgaacgactcggagggacgtgaaatgacccattaaagaaggacgtgccttatgcatactgaacttgcgtggctcaaagcgatcgcgcctgatctgatgggcgttgtcactaaacgctatcaggtccttcaatttattaactggatggcaccagttggccggcgaacgttggccgaacagatgaagatctcagaacgtgctttgcgcacagaaacggattttctgcgtagtcaaggtttgttggaaagctcaaaatctggcatggtgctaacagcaaaagggttagagacatttcatggccttgatcatcttatgaatcagctgttaggaattaaggatgatgaaaaacgacttgctgcccagcttaaaatcgatcattgtttggtcgtatctggcgatgccgatcaaagtggtcgggtgcttgatgagctggggaagacgttgaattcgaccttacaattactgctgccgccgggtcgcttgacggttgccgtgatgggtggaacgacaatggcacatcttgcaaggcagctgacatttcagttgtctgcaggacgtgaattgacgtttgtccctgctcgcggtggcttaggcgaagcggtgacgattcaggccaactcgattgctgctgcgatggcggaagcaaccgacagcaactaccgagcgttgtatgtaccggaaaatcttagctcggaatcctacgaatcattgattaaagagccttctgttaaagaggttttagggctgattgataaggctcaggtcgtgattcatagtgtgggtgacgctttggtcatggctcgtcgccgtggcatgtcatctgacacgatcagcatgttgaaagccaaacatgccgttgccgaagcattcggtgttttctacgatgcgagcggcaaggtcgtttacaagataccgcagattggtttacagctcgcggatcttgatcatataccgtatgtattcgctgttgctgctggcaaaagtaagtccaaagcaattgcggcatatatgcaacacgcaccgagtcggacgtggctgttaacagacgtcggtgcaactaattcgattttaactggggcaacccgttagaataaaaccttatttcctaaaggaggaaattttagcatgactgttaagattggtattaatggttttggccgtatcggtcgtttggcattccgtcgtatttacgaattgggtgcaaagagcaatgacatccaggttgttgcaattaacgatctgaccagcccaaccatgctggctcacttgctgaagtatgattcaacccacggtactttccctggtgaagttagtgcaaccgataacggtatcgtcgttgacggtaaagaataccgtgtctacgcagaaccgcaagcccagaatattccttgggttaagaacgatggcgttgactatgttcttgaatgcacaggcttctacacctctgctgaaaagtcacaagctcatttggacgcaggcgcaaagcgtgttctgatttctgccccagccggcaagatgaagaccatcgtttacaacgtcaacgatgacactctgaatgcagacgacaagattgtttctgctggttcttgcacaaccaactgcttggcaccaatggcttacttcctgaacaaggaattcggcatcgaagttggtaccatgaccaccgttcatgcttacacctcaactcagatgttgcttgacggcccagttcgcggtggcaacctgcgcgctgcacgttccgctgctgctaacacgattcctcacagcacaggtgctgctaaggctatcggtttggttatcccagaattgaacggcaagttgcagggccacgcacagcgtgtttctgttgttgacggttctttgaccgaattggtttccatcttgaagaccaagaacgttactgctgaccaagttaacgaagctatcaagaagcacaccgaaaacaaccctagctttggctggaacgaagacgaaatcgtatcttccgatgttatcggtacgacacaaggttcaatctttgatcctacacagaccgaagttacaactgctggtgactatcaattagttaagacggttgcttggtacgataacgaatatggctttacttgccagatgatccgtaccttgctgaaatttgctactctctaatccggagtaacgcttttctagccgcaacatccgaagcggagggagcttactccctccgctttttttggaaataggcgatcaattctcaggatgttttagcatcctgctgaaaacgagcgcttatttctggtgttaagcggtcgttacttgaagttaagtcatctttaggaaaaataggaggtcatttctcttggctaaattaattgtttcagacttagatgttaaggacaaaaaagtcctgatccgcgttgacttcaacgtgccgatcaaagatggtgttatcggtgatgataaccggatcgtggcagcattgccaaccatccagtatgttattgatcatggtggcaaggcaatcctcttgtcacatctcggccgtgtcaagaccgaagaagacaaggctaagctgaccttgaagccagttgcagaacgtttgagtgaattgctgaagaagccagtgacatttgtcccggcaactcgcggcaaggaacttgaagatgctatcaacaagatgaatgatggcgacgttcttgttatggaaaacacccggtttgaagatcttgacggcaagaaagaatccggcaacgatcctgaacttggcaagtactgggcaagtcttggcgacttattcgttaacgatgcctttgggactgcacaccgcagccatgcttcaaacgtcggcattgcttccaacatgaagcaaactgctgccggcttcttgatggaaaaggaaatcaagttcttaggcgatgccgttgacaacccgaaacacccattcattgctatcttgggtggtgcaaaggtttccgataagatcggcgtgatcgaaaacttggtacctaaggctgataagattcttatcggcggcggcatgacctatactttctatgctgctaagggtatgagcatcggtaagtctttggttgaaaaagacaagatcgaacttgccaagaagatcatggatcaggctggcgacaagctgcttttgccggttgattccgttgttgcaactgaattctctaacgatgccccacataaagttgttgacggcgacattcctgatggctatatggccttggatatcggcccgaagacaatcaaagaattcaaagatgctttgcaaggtgccaagaccgttgtttggaatggcccaatgggtgtcttcgaaatgagcaactatgctgaaggaacccttgaagtcggccgtgcccttggcgacttgaaggatgctactacaattatcggcggcggcgattcaacagctgctgctaagcaattgggtattgcacctaagattacccatatttccactggcggtggcgctagccttgaatatcttgaaggcaagaccttgccaggtatcgcagctatttctgacaagtaattgtcaggcatgctgatctaacagtcactaccggcagacggtgtctgtcggtacatatgaaaggaagatatgccatgcgtacaccattcattgctggtaactggaaaatgaacaaaaatcctaaggaaacgcaagaattcttagacggcgttaaaggcaagttgcctgatgcaagcaaggttgagactgtcattggcgcacctgccattgatttgaccaccttagttgctggcgctgaaggcacacctttgaagacggcggctgaaaactgctactttgaagacgaaggtgccttcactggtgaaaccagcccgaaagctttgaaagaaatgaacgttgattacgtcattatcggtcacagcgaacgtcgcggctatttccacgaaaccgatgaagatatcaataagaaggctaaggccatctttaagaacaatcttttgccaatcatttgctgcggcgaaagtttggctcagcgcgaagctggccaaaccgaagactgggttgcttcacagattgaagctgctttggctggtttaagtgctgaccaagtcaaagtttcagtcttagcctatgaaccaatctgggctatcgggacaggtaagacggcaactgccgatcaggcacaagaagttgtcgcacatattcgtgcaacggttgagaagttgtataataaagatacggcagatgctgttcgtattctttacggcggctctgttaaaccagcgaacgtcaaggaattaatggctaagcctgatatcgatggcggcttagtcggtggcgcttcgatggatcctgaaagtttcatcgccttggctaactaccaagattaatctgggttctactattaaacagccttctggcaaaaaggagaagaatttatgtctatcattactgatgtattggcacgcgaagtcttagactcccgtggcaaccctactgttgaagttgaattgtacactgaagacggcggctttggccgtgcgttggtaccatcaggtgcttcaaccggtgaacacgaagccgttgaacttcgtgatggtgacaaggatcgttttggcggcaagggtgttttgaaggccgttggtcatgtgaacaacgaaatcgctaaggcggttattggccttgacgtgactgaacaacgcctaattgaccaaaccatgattgaccttgacggtaccccgaacaagggcaagtttggcgccaatgctatcttgggtgtttccttggctgcagcccgtgctgctgctgatgaagttggcctgccattgtatcaatatcttggcggcccgaatgcccacgttctgccaacgccaatgatgaacgtcctcaatggtggtgcacactcaaccaacaccgttgacttccaggaattcatgatcatgcctgttggcgctaagagcgttcgtgaagctgttcggatgggttcagaaaccttccatgctttacaggcactgttgaagagtaaaggcgacatcaccgctgttggtgatgaaggcggctttgccccgaacttgaaggataacgaagaagccttcgaacttcttgttgaagcaatcaagaaggctggctacaagccaggcgacgacattgctttggcctttgacgttgctgcttcagaaatgtacgatgccgagagcaagacatacacaaccaagtggtctaaccctgacaagaagtacaccactgaagaatggaccgacatgattgatggttacattaacaagtacccaatcgtttctgttgaagatcctatcgacgaaaacgactgggaaggctggcagacattcaccaagaagatgggcgacaaagtccaaatcgttggtgatgatctgtttgttaccaacaccgactacctgaagaagggtatcgatatgggtgttgctaactccatcctgatcaagctgaaccagatcggtacattgaccgaaaccttcgaagccatcgaaatggctaaagaagctggttacacagctgttgtttcacatcgttccggtgaaactgaagatacaacgattgctgacttggttgttgcaaccaacgctggccagatcaagactggttcaatgagccggacagatcgtatcgctaagtacaaccagttaatgcggatcgaagaccaattgggtgcacaatcccagtacaagggccgcaagtccttctacaatgtgaaagcaatcgactaattcgcttaattagttggcagcttggaaagcacgtttccgttaaggagcgtgctttttttgtggagcgtgagctggcgcggttagaaaccagagtgtgtaagttcaaggtccttacatgcaggtttccgcgccagcgagcgcgtttaattgtgcgcgaacaggagcgcttagaagccggaacataagtggcttcgaccaaatggcgtggttttagcgagttctcttgggctgaaagaatcaggattttttaatcggtgagactgaatcgcggttgtcgggtgcacctttctgtatactagggataagcacaaatgaaaggacagttttctatgcaaacgacgccacctcattggcaacgaaacattgctctctttttgcttggtcaatttctttctggcattaccagtatgacggttcagtatgcgatcatttggtacttaacggctaaaactggttctgcaacgattctcagcattgctactttattaggtatgttgccgacgattctgctgagtccttttgtcgggccttatattgatcgcttgaacaagaaaatgttgttgattgtaccggatattatcgccgctatggtggcacttattttgagtgccgttggcgagtttggtggtttttttcctgtttggctgatctttgtgtcgttgctggtgcgggcgttggcacaaacattccagatgccgacgattcaggctattttgccaaccatggtacctggtgatcagttgacgcgcgtgaacggtcaactcggtgtggtgaattcggcgaacatgattattgcgccggcactgggagctgtcctttttggcctgatgccgatgccgcttttgattttgttagatgttttaggtgcgattctaggagtcagcttgctgttgttcgttagtattccagaaaatcgcttggtcgggacaaccgtccatgttgcgcaggatgccaaggtcgggtggcaattgttgcgaggcaatcgtggcctgtggtatatgactttaattggcatgttgacgacgtttgccttcatgccagccgctagtatgtatcctttaatgaccatgcgttattttcatggcactgtcggtcaagctgggttgattgaagctgtttattttgctggctcgttacttggcggcctgctcattagcgtctttggccattttcgtgatcgtattcatccgattgtctgggggatggtggtcattggcgtgacgtttggattaagtggtgttttgccacgaactgaaaatggctttttatggtttcttatcttgaatggcgttgctggcttagcttggccgtttttcaacacgcctttgatcgcgatgtatcagcaaagctatgctcctgagacgctcgggcgggttatggggattttgaatgcactaatgagtttgccagggccggtcggcttgatttttgctggtcccatcgccgatcgctttggtatcgcaactttatttgtagttgcagggatcggcgtgttactggccgctggcgttatgttcggcttgaagatcacccgcgaatatgaccgtcagttgcaagcagacgggtcatcagatttgactaaaaggggatagatcgtttgaaaaaatttttcaccgtgtttgcttggctagaagttgttttaggattgacgatgttatggatgacgtgggatgtcggcttgcgagcatctggccagatttttggcgccttagttgttttaatcgggattgtgcttttatacgggttgatcatttatgcgttgattggctggttcatggatcctacgcaccgttactggtatgtgctgacactggtgctaactttgctgtacaacgtgttagtctggacctttcccagcgtcatgatccaaacatgggcaacatatccatttccgcttatcactttgttaatcggtgcaatgttggtttgggtggctcggcaagaaaaacaataattggttttgctgactcgggtgactgagtcgtttttgattcccagccagaggtatatactgagatcatgttgtactggaggggaattacttggcacgacctgtaaaagaaaaatttgacgttactcgcctgcgatttgtgctactcggactactcgttggtttaatgagcggcactgttgtcagcgcgtttcgctattgtattgaggtagggctgcgctatagtcggctggtatatgggcacttgcgaatagcaccgtttgtctggtggcaatgggcgttgttgatcggtgtcaatcttggtttggcgttgatcgtggcgtggcttctcaagaaagagccctatatttctggctctgggattccgcaagttgaaggccaattggctggtgaattggaaatgcactggtggtcgatcctctggcgaaaatttgtcggcggtgttctggcgctggggcctgggttgtttctcggacgggaaggaccgtcgattcagttaggcgcttcagtcgggcaaggtttagctgctgggttcaagctatcaggaactgatcggcgattgttaattgcatccggttctgctgctggcttggcggcggcatttaatgcacccattgctgggaccttgttcgtcttagaagaggtttatcataatttctcaccgcttgtttggttaacggcattggctggggcaattggatcggattttgtttcactgaatgttttcggacttgttccggtgctgcatttaagctattcgcgtagtttacctgtatcgagttattggcatttaattttgctaggcattcttttgggcttgtttgggtacttataccagcgaatcttgttggtgatgccgcggtggtatcgcaacttgacacatttaccgcggccattacaaggcattgtaccgtttctgctggtgattctggttggctattttgcaccaaacttacttggtggtggcaatggtttgattgtcggttttggccagtatgtgccatctttgcttgtattgatcgcaatttttgttgtacgtttcgttttttcaatgatttcatatggttctggattaccaggtggcatttttctgccgattctttctttgggtgccgtgattggtgccatttatggcgtcttcatgaatcaactcggcttattgccgcacgtttatatcatgaacttaatcattttttcaatggccggttactttgctggcattgggaaagcaccgtttactgcgattctattggtaacggagatggttggtaatttgacgcatttgatgccgttagcggtcctatcgttaactgcttatctcgtggttgatttgcttggcggtgcgccgatctatgaagcgttactcgagcaaatgacaatgccgaaaacagttcaacagcttcatcgacccgatcgactggaaataccggttttcttcggcagtcccttgaatggcaaaatggtccgcgatatgccatggcctaaagaagcattactaatcggaatccggcgtggcgaacaggaagtgatcccacatggtgattccttgatccgtgaaggtgatacgttggtgctgttaacggatgcgacccaacgtgctcgggtcaagcggcggattgatgcactatcggcggcgttggggaaaacgcaccaaaactcatgagcaagttatctgtcaggacgttgacgtgctactattgtgagttattctacttgctgtgagacggttcaagtagctaaaaaggtggatttcagcaaagatgcctcttttaggtagaatgcgttcgcctttatgttgcttttatgctaaactactagggtgagatttttcgcaagggaggcaacaacttgcaaagtttattgaccacatttcttgtgatcgattcgattttgatcgtgatcgcaacattaatgcaaccaagcaaacaacaagatgcgttaagcgcattgtccggtggggcaacagatcttttcgggaagacgaaatcccgcggcttcgaagctttcatggagaaagtcaccgttgtactaggtgttattttcttcggcctcgcaatcgcgctggtatatctggaagcccattaacgaaagtctcctggtactcaggagactttttttgcagagcgttcattggcccggtttctgggccaggaaacgcgtttcgacagcaactgcggtggaatagccaaccatatgacaaggctgactttatccgccaatagacaagacctacaaccgttttttcaccgcaatatcgagccttttcaccaagagattgaagttccacttgtccacccagccacttgccacaaaggatgaaacccatcatgatctttcgtgaaccgcaaccattcgaatacgagggcactgataccggtgttgttttgctgcatgcctatactggcagcccaaacgacatgaacttcatggggcgggccttgcagcgggctgggtatggcgtgtatgcgccgttgttcacgggacatggtaccattgagccaatggatattctgactaagggcaacccagatatttggtgggcagaggccagcgccgctgtttcgcatatgacagcaaagtatgaccgtgtttttgtttttggattatcactcggcggtattttcgccatgaaagctttggaaatattacccggtgtcacagctggcggcgttttttcatcgccgatcttaccgggtaagcaccatctcgtgccagggtttctgaaatacgcacaatatatgaatcgtttggcaggtgtaccagacgaaagtactcagattttggcttacttaccaggccagctggcggcgattgacaatttcgccactggggttgccgctgatctgtatttagttaataagccgatttttatcggccaagccggtgctgatgaattagttgatgggcagctggcctatcagctacgggatgcactcatcaatgcaccgcaagtagattttcattggtatgacaatgccaagcatgtgatcaccgtgaattcggcgcatcacgcactacaacaagacgttatcgcatttatgcaacaagaaaacgagggatagcatgaccacagttggccatattcgtaatgaacttttagcaacatttcgtaaaagtccgaagattgattattcggtccagacgctgagccgtgccttgaaattaaacgaaggcactgattttaaaacgctggttcaagccttaactggtatggaaaatgacaatttaatccatcccattagtgaaggccgttatgcttggggcggcacgcctaaagtgttgacaggtattttccatggcaatgaaaaaggttttggtttcgttgcgattgaagatcaggacaatgatgtttatgtgccgtcaacgagcactgattttgctttggacggtgataccgttgaagtccgtatcgtccgtgaagcacgtccaaacgatacgcgtggaccagaaggcgaaatcactaaggttgttgaacgcagcctaacgacacttgtaggcgaattcaaaccattttccgacaaagatcgggccaagtctggttttattggtatggttgtcagccacgagaagaaactgaagaattttccggtttatgtcaaagacactggtaccatgccgcaattaggcgacatgacggttaccgagattacggaatttcctaatgaacaccatccgaagctgatgtatggcatggtggttgaaacattgggaaataagaatgatcccggtgtggatattatgtcattagtgatgcaaaaccatatcaagactgagtttcctgatgaggtaatgactcaaactaatgatatcccggatcatgtcaccccagaagaacgggtgaaccgtaaagatatcaccgatcaagccgttgtgacgattgacggcgacgacagtaaagacttcgatgatgccgttgtcgtttggaaattgccaaacggaaacttccatcttggtgtgcatattgcagacgtgtcgcactatgttacagaaggctcagccttggacaaagaagcgtttgatcgcgggactagtacgtatctggtcgaccgtgtcattccgatgctgccattccggctgtctaatggcatttgttcgttgaatcctggcgttgatcgcttggcgatgtcttgtgatatggaaattgatcaagatggtcacgtggttaatcacgagatttatcaaagcatcatcaagagccatgcgcggatgacttataacaacgtcaacaagattgtgaccgaccatgacccagaagtgatggccgagtaccaggaacttgtgccgatgtttgaagacatggttcagctgcatcaaattctttacaagatgcggcatgctcgaggtgccattgacttcgaagaaaacgaagccaagatcattgttgatgatatgggtcacccaacagacattgttctgcgtgagcgtggtgtgtcagaacgaatgattgaatccttcatgctggccgctaacgaaaccgtcgctgaacattacaacaagcaacatttaccattcttataccgggttcacgaaacaccagatgccgaccgcattaaagaattcatggaattcattgctagttttggtatcaccgtgccgatgaaaaaaggcaaagaaatcaccccaaagcaacttcaggatgttgtgacagatgtcaccggcacgcctgaagaagcaatggtgagcgttaaaatgctgcggagtttaaaacaggctcggtattcaccagatccacttggacattttggcttggcagcaaagtattactgccactttaccagtccaattcggcgttatcctgacttggtcgctcatcgcttgattcgtgattatgcggttgaaggcactggcgacgatatcaaggcaagctggaataagaaattaccagatattgctgctcaggcatccatggcggaacggcggagcattgacgctgagcgtgcagttgacgatcttaagaaagctgaatttatggctgataaggtcggcgaagaatttgatgctgttgttagcggcgtgacgagctttgggatgtttgtggctttgccgaacaccgtagaagggcttgttcatatcacgcggatgaccgatgattattattcattcatcgatagtcagatggctttagttggcgaacgcaccaagcgcacgtaccgaattggccagtctttgcgagttaaacttgataatgttgatattgatcaacgacaggtagacttttcattgattcctgatgaaaatacgccaacaagtgatctgggcaagttcgtcaaaaaagaagaccggcgtgaacgtcggccaaatggcaacaagcctggttttggcaataataaccatggtgggccaaatcgtaatcaacacaacaatcgaccacgcaaaccagctggtgcgccacatcaaggcaagcactataatgccaagcgcggcactaaataacgctggcaacttttgaaagggggatggttcaatggcgaagaaacatcgacaaaaacctgacaacctgctcgcccagaataaaaaggccggtcatgattacaacattcttgatacctacgaagccggtattgcgctgacaggtaccgaaatcaaatccgtgcgtgatggcaaacttaatttacgtgacggttttgcccgaattcggaataatgaggcgtggttagaaaacgtccacattagtccgtataaagagggcaatttattcaacgttgacccaatgcgtaatcgcaagctgctcctgcacaaacgagaaattcgcaagttaggtcaaatgacagcgcgccaaggtgtcacgcttgtgccgttgcggatgtatttaaaacacggctatgccaaggttttgattggtgtggctgaagggaagcataactacgacaaacgtgaaaccttaaagcgcaaggatcaggaacgcgaggttcagcgcgctttgaaggcacggtattaaacgcccagtggcattaagctaatgctgatctgagcatcaaaaatcgatcttctagcttgtccatcagcaatatcatgatgtcgctgatgtgcaggttaggtgacgttatgccaactgagttttatcagtaaagagcatcgggagaaacctgatgctctttttgttttgctatcatttatttctaaacaagctaaagtgttgatgttatataaataattacactattgattgattaataatttctttttcattgttttgcttatttatttatataaaatggtgatttttccttctaaggttttacttaagtaagaactaatataaaatagggcaaggagactgtcgttggtcaatgcctttgtcgcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcggaaaatagtagcgaagttctcg

SEQ ID NO: 62 - DNA, 3953 bp, Lactobacillus paracasei
caacgagttgcatatgttcacggtgctaccgcaacgatggatcgttgaacgttcatggagttggctagacaaatgtcggcgactttggaaaaactgtgaacgcgcccttaacagcagtcttcaaatggttgtattggccttcctgaagatagttcttaaaagatactagacaggttcttaggagcgactgggtgaaaggcgtgacccgtgttgacggtgtagcgcttattgacgaggagaaacgccttcttctccacttaacggtcacgttttgccacacgaatcgaagcgtggatacctgacaactacgtgattcggcgaactcggctgtgactcacgtggtaatgcgtctccgcgttgatgtacgtcatgatccgtttaacgctgaagatgtcgtgcttcttctcttcgagctcaatgatgtcgtcccggatggcctgattctcctactcatggactgtcactttatgatgtgtccactggtagtattctgctcttgagatgcccatcacctggcaagccgtgctaataccatagaacctgcctgcgtctgggttacttcttgtgcaagttgttgagtggtctgatattgttcgtctgaacggcataccttcttgccaatttctggagttttttagcactaccgcctccgttgacacatgggtcaggcgcacttgtagtcgcttatcttcgagcctcagacgctcaatatcaattagttgcccattgttctccttcgccacgccggtcttccaaggcaggctcgccgccttgcttgaacttcttgacccagtcgtatacctgcccataagagatggatatactcctccctaggaagacaagctttaattatttgcttgtctacccaagaaggagtatatcccgccattcggcagaacggacgtgcggacaatttttgtccggatcattggcgcctatgctgtaattacggacaaaaatagtttgtgcgataattgacaggtgaggcgccgtttgaagcactagtgagttgtctcattcaaatgtttctgctatatcagcagcctgactgcttcaaagttgccggatattgatcagtgaacaatcggtgatttgcggggctttaagcaacggcctttgggctcaacagcttctaagctgatcaccttttgaaagtagcgttcctcaaagctgagccatgcacacaatatctcggttcttgttaccaagtatattaaaatgaaatcaatggcaaagatttgcaccatacccaagtgttttaggtgattaagacgttaattaggaggatttaatgatgcaggatcgttatgtcggtgatattggggattttggaaaactcggatttctccgagcgctagagattgccggtttgtctttgggagtcaattggtactacacgactcccagtggtagtgagaaaactcaaggggacgggagacatctaattgatcaaaaatactttgactgtgatcaggatcttgccagtactctctataagctttcaaaaagtcagactagtcgaaacttagatacgttaggaaattcacatgtacttcaaaccggcatctttttccgagcacaagtgctggacaaaaaatcacgcgtgaattggcatcaaaatgcgttagatgctcttcaacaagcagatcttgtatttcttgatcctgacaatggcctctctgtgaagagcgttagtaaaaattcaaaaaaagcagttaaatacgtattcgatgatgaaatacgagattacctcgtaagaggacaatccgttgccttttaccaacacaggcctcataagttggaacatttatatctttcagaagcaaagtcaaggattgataatatatgcaattcactaaaactttctatatgggttttgacacttccgaggcattcagtcagagaaatctttgtcattagccctgacgagcgtcaggatcggctaataagtaaggcggttttatcgatcaccaatggcagttggaataaatatgggatcataaaattgcaatctacacagcctcgtacttaaaaaggatctggtgcaaataatctgagtgatgtccgtttaaccaactattgatactatgctgaaggttaggcagctatcaatacttctaattcgtccacgactgagaacccgaagaaacttaattctcgtcgggttctttcacgtattgcatgaatggtttccacatcgctcaatgtggcactagcagttcggatactttgaaaactggcggatcggacatgatgtcgtttgatgaagcgatgatcctgctcaattagattgtttcgatatttgaaacattgatgcgctgatttgctgagaaagccttggtttatcaggtgctttactgctttcagtgtcgctcgatgttgatcagtgactaaacggtcaggccgaccattggtcgtcaaaaatcgtttcaaaaagtggtgggctgcggcataataacggtacttccgcaactcaaagtcgagcgcttattaactatgcttttaattaggcaaaatctttgagcaaagaatacatctggcttggagtttgggaacgaaattctgcagcgcttagtttttataaaaagttaggttttttagcttttagtaaccacagatttaacttagggggagatttataaagagacattctaatgaagcaaactctgggcagagaatcctaaaacaagtttttagttacaatagggtgtaccctattgttaccacctgtaagttcgacaaacattagtaacatataggtgacccgatgggaaacgtgaagtgcgtgaaaaatgagaatagaggtaaggacatgagtgagacatttaaaatgatgaattggcagcttgatcaatttacagatcaagtcctagtcgcgctggatccgcttatttcaatcgtattatcaccgtttgtttggttcttccaacatccgcttgctgatttttgtaaatggcttttcggaccgcaatctattgcacagggggaaacggcattggccgttattctcgttgctttgggagcatatgcaatctttttcgtgtttcacacagcagcattggtagccattgcaacgtttgtcataccagctctcttgtcactcctcgggcatatattccactttggatttaaggttctaattatttatttggcaatccgtttttgcattgcgttagttaagttttccggtaaatggatagacaaaatgttgggacttgccccaaacagataacactccaattgtttgcacctgacaactcatgctataatgaacatagcaaaagagcgttgcatccatcgacgcaacgctccctgcaagccgcttcaaaggcggtggcaagattacctaaacaacacgaatgctgtcctgtgaccttccaaagttacacagggcggcttttttattacttctttttgccgttgagaatggttgcgactagtaagccgaacgcaatcatcagcgacagtgcctgaaagacactcattggctgtgaaacctttctggagattcttccatgttcccatagacatcacctcatcgggaaaagacagccaccgcccttaaaacctcttgcttgtctagcataccacagcttacttgaccgtcattgaaaatcaatgacggtttttatttggcatactgaccaaatcttttgaacgtgaattaaaaaaactagtcaaaaaacatttcccaataactgtcttgaagccttgtttagaagcaattgttgaacaagatgtacttgttttgaaacagattaaagatcatgcattaagaacctgtctagtatcttttaagaactatcttcaggaaggccaatacaaccatttgaagactgctgttaagggcgcgttcacagtttttccaaagtcgccgacatttgtctagccaactccatgaacgttcaacgatccatcgttgcggtagcaccgtgaacatatgcaactcgttg

SEQ ID NO: 63 - DNA, 1605 bp, Lactobacillus paracasei
atgaatcggtggtcctgttcaatcaaattatttcgatatttggaacattggtgggctgatttgctcaaatagtcttgctttatcaggtgcttcactgctttcagtgttgcccgatattgatcagtgactaatcgatcaggccgaccattggtcgtcaagagacgcttcaaaaagtgatagaatgcggtataatcgcggtgttttcgtagctcaaaatccatggtcaaaccgttactgtcaatagcgcgatacaaataggcccaacggcctttaactcgaatataggtctcatcgattcgccaacttttagcgtgagctgtttgatgccgacgccatagagccttaaagatggggccatagggcaagaatgtcaatggtccggacaaaaattgtccggttctgccgaatgcgtatgattgtcacttaaattcacgcattatcagatcttctatcagcgtttaatcttgtttaacgtgcaagagggactacaaacaagccctggcatctggtgctttccccagggctgtgcgcctattgaaaggttacttatgcagctgctgactttcttttgcaagcaccgcgaccgttggtctcgcgatcatgattgtagaaggtgttgtaacgagcaatggattcagtgacgtctagaattgattcatagttgatctgctccagccggacccattctcgtttcaatagcgaatggtaggcttcgatccgcccgttatcagccggtttgcctttgcgcgaatatgagtgacgcaggtgcgcatctgtcaatgttgtctcaaataaacgactggtatattgactacccatatcgctatgcaccatcttaaaagtataaccttggtgaattaacgcttgaatcggtgcgaccgcgaggtcttgtgtcatctgttgacccacttgccaagctaagacttttctcgcttttggatcgtacgctgttgcaaggtaaacccatttttggttgatcagttgaatataggtgatatcggtggtcacgacctcagacaagtcagctaggtgtcgcattaaattaggtttttgtggcatgtcagtggttgtggtaggctttttagagcgtttacgatacattgtcgattgaatccccaattcacgcatgactttccaaatcgtgcggtcacttaagcggcatttaagtaatttacgaatgcgtttagcaatccgcacgtatccgtaaaattttcgacgttgccaaagaacctgaaccagctctttaagcttaattcggcggcgatttcgtgacttgggatgccactttaaccagtcatagtaggtactcgaagggatccgtaacgctcggagaataactgtgatgcggtgcccccggctcaattgatcttgaatcataaaaagagcggcctttcggccgctatgaatcaacggatatactccttcttgggtagacaagcaaataattaaagcttgtcttcctagggaggagtttttgtatgggccgaaagggttccagatacacgctggaggagaaattattctatattggtctggttcgtgagggtggctgggcaccttgggctgtccagcgagaatatggtgttaggcataatcaggttcgac

SEQ ID NO: 64 - DNA, 1632 bp, Lactobacillus paracasei
aaaacattctaagcttagtgatgaaccatgatccgacggggttgtgattcaccactaagcttttttggtacagtggtaacggagttgacatgtcggaggttattttggcgcaaagacgtcgcaaaaaaaactggcaacttcgcagattcatcaatgaactcgatcgaagagtgttggcgcttgacgccgtgtattgaaaattgagatgagtgagtcggtgaaacaacttcaaaaggtggtgtatcaaatggaatgcatatttggtattgatatcagtaaacacacagctaatgtggccgttttgattgatagacaagttatcaaagaatttaagctatcaagcaatcgtgaagggtttgagcgactcgaagatgagttaaacagctttagggaaccaaagattatatttgaatcaacaggaatctactcacgaccgtggcgcgcattttttcatcgtaacggttggctgtatactgagataaatcccctaaaagctaagaaagtaatggacagttttagaattgtcaaaacagattcggttgacgctgttggtctggcagaagcgatgtccagaaacaattttgcaccatcgtttcaagaaaagcctgaatacacagaattacgtgatctacatcgaatctatcaagagcacaacgacgacgtcgtgcgtaataagaatcgccttcatcatgaattacagcttactttcccggaaatagaacattttctaagtaggactgagggggccttatactggcacattgtccagatatttccacacccatatctggtgttacaacatagttccaccgaattaacgtcaattatattgaaagctacttcaaagaatatgggccctaaacgggctcagcatttagctgaacatctcctggagttggccaaaagttcagggccagcagtagatattgattcatacgcgcttaagcgagttaccgagttagcatatgaagttgaacgtatcgaccgctcaaaaaaatctttaattgaggagatggctaaaattggtacaaacttgcctgaggttgcaattttaacgacaattcctgggattgcgcttaaatcagcgttgtgtattatcgcggaattaggcgatattcggcgatttcatagtgccaatgccattaacgcgtatattggtattgatttaaccacttaccaatctggggactatacggccgaacagcgtatccgaaaacgtgggaaccctttggcaagaaaggtcttgtaccgtacagtcattaatattatcagtgcgtcctcatatcgaccgacacgctttaacgacttctaccaaatgaaaaagcaatcctctcagtctaagggaaccaagaagattgcggtcgcggttatgagtcgtctaaatagaatgatcttccacctagttttgcacaatgaagtttatgagccaactgtgtctcaaccaagacagtaactcatacagcctatgaagacagtatagcatcttggaaaattaacgtttcaagaggtttatttagtttaccttcaaagcattgctttccacaaatcaactgaaaaaagacctcatatacaagcttagcctgtatatgaaatcctatgcaatcaacgttttacttgactaatggtagaaaa

SEQ ID NO: 65 - DNA, 4725 bp, Lactobacillus paracasei
ccgaagcaattcaacgatgtcacgatagctgagactgaatctgaaatagtagccaacggctactaagatgatgtccttttgaaagtggcgtcccttaaagtgattcatgcgcgcaatccctcgtttcttggcacccagtatattaaaatcaagtcagcgaggaaaatttgcaccagaaccatatcaagtaacacttagctcactgaccagtaatttgatcatgttcacccggggtcaatattttggtcatcaccgtaatcaaatacgcttgttcgcgctcaatctcagttcccggcaattccagcattaaccgcgctaggtaaccgaatagctgcgataacaaactttgcagtatcaaatcattcggccattccacaatcaaatgatctgcttttagttgatttatgacacttcccatctgcttgaccatcttaggcgcaatctggctaagaatctgttcgcgtcgttcggcgtcaaaagctgccatttcaaaaatgacctttaactctttcacgttagctttagcaaatgcaactcggtccgtaaaaattgctgtgacgaatgcctgtagactgggataacgctgccgtaattcatcctctgaaaaatcactcgctaaaattggcacaatgtgcgcgacaattggtgctaagatggcatcccgtaaggcagccttagtcttataccgccgatagaccgtcccctccgcaacgccggcccgttgtgcaatatcactagtactggtctggtcaaaacccttttcagcaaacaaatcgagacttgcctggaggatggcccgttgcttaggtgtaatcgtttcattctgacttagatcctgttgaaaataatcccgtatccgtggtcgttccatatcctcacaccttccgataacgtttcattccaacaatattcaacattgttagtacgaccataaaccctactaatattaacaaattgacaccaatatcgccaagcccagcaccctttgtcacaacagccgtcaacgcattagcaccatagtataacggcatgatgtgggcaattgcttgcaaccaactggccatgccatcgactggaaccaacccagcaaaaaagatttgtggtacaacaatcagtggaataaactgaatcatttgaaattctgagttagcaaaggtggaaataaagatacccaaggtcaaagccactaacgctaataataagttagtaagaaagaccagccaaatactaccaactaagtgaatcttgaagaccgtaattgtaaaaacaacggtcaggacagtctgaatgatggcaaagcccccataaccaattagatagcccataataatttcactccgtcgaattggggttgcaagtagccggcttagggttccagtagtgcgttcattcaaaagtgaaacgccagaaatcaagaacacaaagaagaagacaaagaaaccgagaaaggctggcaaaaagttttcaaagaacgttgaatcactactaccataaatataatgagacttagtcgtataactggttgctttagctgactgagtcgaactagacgtcgtggctgtggcctgcttgagttgcttttgtaatttctcagcagttgcctggtcaccgcgggcctgggcttgtgcaatggcagtcttcagcttggtcaccgttgcttgtgtctgggctgctgtcagcttcttcaaagcggcttgttgcgattcaagggccgcgcgctgtttcttagtaacggtcaccagcgtcttcattttcaacttgactaatcctgactgtaaactcgccttaattaaagacgtgttggttggattgctatttgaataagtaatcgtcaattgaccatttttctgagtcaaatagccatctagatcatgctgcttaatcattttccgtgcctgtgaactatcataatgatgaatcgtcacgtttttggtatcgatcacgttaaccacggattggtctacatgatgaacacccaagcttgctacttgcgttgtgttgttttgaaataagaaatacatcagcgtcataatcagcaatggtgccaaaaacatcagcgccaaggtacgcttatcacgtaacatttgcttaaaaactcgtctaacgattgccatcgttcgcatcttgcatccgccccgctttcaaaaagacctgttcgatcgtatctactgcatactgttgtttcagtgccgcgggtgtcccctcagcaagcgcaatcccgtgccgaatcaacatgagataatcacaccgttctgcttcgtccatgacatgcgttgtcacgagcatcgacttaccggtatccttgagcttatttagttcggtccaaatttgttgccgtaattctggatcaatcccaacggtcggttcatctaaaatcaataattggggatcctgaatcagggcaattgccaacgacaagcgccgtttcatcccacccgaatagccactgacccgcttgtctaattgggacgttaaatcaactaatccggctgcataatcaatcatctgtgctaactttatttttggaacgctcatcaattgcccaaacaaggtcaggttttcacgggccgttagtgtctcatacaaagcgtcactttgggccatataccctacttgtgccattaccgccctattgggcatcaccgtatccatgactttaacagtgccactatccacagcttccatccctaaaatactcttgatcaaggtggtcttcccagctcctgatggcccaatcaagccataaatcattccagccggcagtgtcaaatcaatctgattgagcacttgctgatgaccaaagtgcttgctgacctgcttggcgatgacataatccgttgccattttaataaccctctttctcaaagagagtgtatactcactcacttaatggctttagtataatcagtacatctcggtttgtcaacattaaaatgagttatcactcacttattttgtttccggcccatttgtcaccgcattgcaaacaaaaatgcgccaccccgttgttgggatgtcgcattttaattaaatagtgactgcttaaaaattctataattcaggcagttaagctaatatatgcattattgcggtataataaatccattggaattagctgttttcctgcattttccttgcattttttgggaacctactcggaggttatcgtatggtctatcgtcacagcccgcttcaattgccatttgaatcctttggtgccggtttaagtaccccacttagctctaacaatgagtgggtccagttggcggaggccatgccctggaaagctctcgatgaggcataccaattggagttcaccaaaaatgcgggacgtgcggcaaaaccatttcgtttactctatggggcaatcctgatccaacaacggatgggtttaactgatcgtggggtggttgcggcaattcgtgataggggtcaatggaacatccatacgaaaagtagcggtaggatcccgaacaaaaaatcagaaacgttgatttaacagcgtttctgattttttatattggctttatttagaagctgtctaaaatctcttaagtaatagtgctaaaaacgctaaaacgaccatttgcagactggtggttaattgacgctcacaatttttccaaagtcgccgacaattctctagccaactaaaagatcgttcgactacccaacgttggggcatgacttcgaatcgatgcaactcattgcgcttcgcaacctgcacggttgcgtttaaattactggctacatcgagctggaaattaacgcctgaataaccaccatcaactaagacattttgaacctggcgtaaatgcatggcatgtaaagcgatcattgcactggccccgtctcgatcagagacgttcgctcgcgtcatgtgaatggcctgcggaaagccattgatatcaactgccagatggcgcttaatccccgagattttcttaccagcgtcgtaacctttgttttcagcagtagcggtgtttttgacgctctgagcgtcaacgataataaaggaagttaaagctgaacgtccttggtaagttcgccgagcaatgacaatttttttaaaacttgttccaataaagaatcagccgtaggctcagctttagttgaccaaattttgtaatagttgtaaactgaccgccattctgggaaatcaccggggacttgacgccattggcaaccggttttcaagacatataggaccgcacagaagacctcgtagaggtcatattttcgaggcttagttcgcttacgaaaattttctaaagctggtcgaattaattcaaattgttgccgagtaatattgctgggataatttttcatagcttaaacttgctttttacatagaagtatatcaaaaatcatagatcttggacaacttctaagagaattttttcatccaaacatttttttagcagcatatcaaaaagtagtttttcggtttcgtttgtaaaacgcgctcgctcaagcagccagtcgttcaggctcgctttgaccgcgggatcagtaaaggcttgataatgatattttcgcttaatcagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatg

SEQ ID NO: 66 - DNA, 6874 bp, Lactobacillus paracasei
ttgaccggcggggtattaggactcattatcggggtcatcatttacctcgtgcggaaatttacgattaatcaaagtaatgccacattcggtgcggatgtcatgatgggtgccgggaaccaaactgggcgtttccttggcccgctgatcattctgagtgcggtcaccgccagcattccgattgggatcggcagtacagtcggcgcagccctcttctacgcatggaaaaagccaatccccggcggtgccatcatcggcgccatggttatgggcttcttcttcccagtaaaattatagagtgtgaaccagcccggttagaaaccggagtgtcagtggcctctaacctaaatggctgggctttaaccatttaggttagaggtccttacacgaaggtttctgggctggcgaacacgtttcaaaaagagtgtgaactggcgcggttagctcggcgtagcgaagcggcagtcaagacaactggtctgggctttggaccagttgccttgactgtccttcgcatagccgagctgcgccagtgaacacgtttcggcaagagtgtgaacaggcgcggttagaaaccggagcataagtggccttaaagctaaatggctgggctttagccatttagctttaaggtccttatgtggaggtttctgcgccagtgaacacgtttcgaaaatcattttccacacagatttgaaaggcaggtaatcagcagtgtttgatgtcttaatcaagaatggcaaaaccgaacgcgaacaaccgattgaaattggaatcaatggcagccagattgcggcgcttgcccccaaacttgaaggggcaagcggcaaacaagaaatcgacctgcatcatgaagcttatgtgagtgcaggttggattgatgatcatgcccattgctatgaaaagttgacgctatattatgatgatcccgatgaagatggctataagacgggtgtgacaacggtgattgatgccggatcaaccggggccgataatattcgcgatttttacaacattacccgcgataagaaaaccaatgtctacgcgctgatcaatattggtcgaaccggtattttggcgcaggatgaattgggggacatcagcaaggtcaataaagaggcactgtttgatgctgtgcacgacttgcctgatttcattgtcgggattaaggcgcgcgaaagccattccgttgtgattgataatggcatcaaaccattattggcagctaaatcttacgctgctttgctgggcaacttaccagtcatggttcatgtgggcgctaatccgccggaacttaaagacattatgcaggccatgggtaaaggtgacgtgttgacgcatgcttacaatggcaagccaaatggcatggttgatgaacatggcgaaatcaaagagttcatatacgacgcctatgatcgcggtgtgattttcgatgtcggccacggcacagattcctttaatttcaaaaccatgcgcattgcccgtgaccatgggcttgatcctaagtcactcagcacggacatctaccaccgcaaccgcgaaaatggtccagtatacgatatggcaaccacgatggagaaaatgctgcaagttggctacacattgcctgaagtgattcgcatggtcacctttgctccagcagataatttccacttgctgaacaaaggccggctgcgtccgggtaaagacgctgacatcacgatctataatgtgacggatggtgaaaagacactgacggattccaacggcaacactgaaaccggccaccagctgattacaccaattcgcacgattgtcggcgggacagtttatgatttggagggacaacacgcatgagtgactactacaagacttatgatttaaaacacgtgattaatgctagcggtaaaatgacgattctcggcgtttccaaagtgcccgaggttgccattgcggcgcaacagttcggtgacacccatttctttgaaatcaaggatctggttgataaaactggcgcttatattgccgaaaagttaggcacagaaggcgctgttgtggtcaattcggcttccgccgggattgccgaagctgttgccggcatcatcggtcaaggcagtaagtaccatgcctaccatccgttttcgccacgctttaccaagcgcgaaatcattctgccaaaaggtcagaatgttgactatgggacgcctgaagaagtcatgatcgagcttggcggcggtcaggtggtcgaagccggttatgccaacatgtgcaccccggaacacattgagatgatgatcaccgagcagaccgcggcgatcttctatgtgaaaagtcaccatgccgttcaaaagagcatgttgaccattccagaagccctcgaagtcgctcacaaacatgatctgcctttaattctggatgcggcagctgaagaggacctgaaaaagtatgtcgatttgggcgttgatgtcgtgcttttctctggcgccaaagccattgaaggcccggcatccggtttggtcttcggcaaagaaccgtatatcggctggaccaagctgcaaagcctcggcatcggtcgcgctatgaagatcggcaaagaaaacattcttggcttcaccactgctttgattcattatctcgacaatggaccagaatccggtgacgccatgaaagctcggctgcatccgtttgtcgccgccttgaatgaggtgccgcatttgaatgtgaaagaagtccaagatggcgctggtcgcccaattttccgcgcggcggtgactgtcgaagccaccagcccaaagaatgccaagcaggtgacggcagcactcaaagccggcgacccggcgatctatacccgtgaatatcgcgccaatgaaggcatcattgaattcgatatccgtgcggtagatcaggccgaaatggatttgattgtcactcgtctcaaagaaattctcgcatagaaaggatcactatcatgaacttaacaccaaactattacaaaaaccgtgttgctctgaatgttttggctggttccatccaaaacgccgaagatatctaccaagccgctgaaggccatgtcgtggtgggcgttttgaccaaaaactacgacactgatgaagctgcgattgaagatatgaaaaagtatcaagctgtaacccaaaacggactctccgtcggccttggcgccggtgaccccaaccagagtgcgatggtcagccgcgtgtccaaggtgttgcagccgcaacatgtcaaccaagtcttcactggcgttggcaccagccgtgctttgttaggccaaaacgacaccgtgatcaatggcttagtttccccaaccggcaaagttggcattgtcaacgttgccactggtcctaagagtagccaaaaagctaccgctgaagtgcccgtagccactgctatcgcactgttgcaagacatgggcggcaccagcttcaagttcttcccaatgggcggcctgaagcacgaagaagagttccgtgcagttgccaaggcttgcgcagctgaaggcttcaacttggaaccaactggcggcattgatctggacaactttgaagccattcttcaaattgcgttagacgccggcgtgaagcaaatcattccgcacatctacagctccattatcgacaaagcaaccggcttgactcggccagaagatgtggctaaattgtgggcgattaccaagcgattggtggatgcgacggatttggtgacggctgagtgatgaattgatcgcattctgattagtcaaagacattcaagaataataaagatccgcagtttaggagtctggtcacctcagactagtgaactgcggattttttttgctggataacggggtgagtgctttgaaattctttgtaaagaaaagtaaacccagtaatgattaatgtatgtgctgacagttagatatcttttacacaacggaagccaaggttgttagcagcggtagcactgtgattgctatttcgtgcagcaattctgtagcgatgacagtaacttttatgacaaaggaatgagcctccacgagtagcaaaattaccatccagaggttttgcatatcttgactgaaaatactgagtactgtatttctgaaattgtgataaaggaattttgcttggatttaaacaccattcccatacattcccaataacttgatacaagccataatcattcggcttataccactttgctggagcaaggccagcaaaaccgtcctgaccattgtcattcatcgggaaatctccttgaaacgtattgcaggttggtttgccatctaaaaagaaactatctccccaaggcaacactttattgtctgttccaccttttgcagcaacttcccactcagcttcagtaggaagtctaactttattccatttgtaaaatgccaatgcatcattgcgagatacttgcacgactggattctcaagctgattatctgtaacaacgtcagagtctggaccagttggatgtcgccaatcggcaccatcaactgcgagccaccaaggttcctgcataacaactttggcatttctctttacatagtcggacgcttgtaggtgaaatacaaaactccaacctattcgttccgattcagtccggtaacctgtagcgtttacaaacgtttggaattcgtaattagtaatggttgttcgagatattaagaatgaaggaacaatgatgtcagtgacaggaccttcaagatccgtagcgaatccgtaattatcattggtacccagttgaaaggagccgcttggaatctttacaaaatctgttgcagtaaccattaattattcctccatgaggtgttatcaaaatttttaagggaagtctttgcccggtagagcagaattaagagaagtgtatttgaagtgggaaagttgtgtccaatataaaatttcttctgtatgaggcaatattatctctagtacggatcggtaaccacagaaatccccatcagagttaacatacattgcatccttcatgcgtttgcagcccccacaacagtattgtttgaaagggcaagttgcacacatagtcggtagcatgcgttttgtgtgcataaaatctaaggcaatgtgttccgagaaaagttggcgcaaagtcttttcttgaatgtaacctaatcgatattgatcaagtgcataaaagtcacatggataaacacttccatcagcctcgattatatattgaatctggcattgtccatccagaccacaggccgtccgtcgtttgtgggcgaattgattgataatatcatcgaaaagtttgacgctttggtactcaccattctgcaattgcttgaaccagtaggtgaaataagtttgataaaagttaaaaaaacggtttggcgtcaatgcgaagttgctacgatgattcacaccaaaatcatctaaacaaggaatgaactgaacgtagttaatattattttgactaagaaaatcgaacacttttttagcgtgctttgctaagggattagtgagtacgcatagtacgttgtaattgatctggtaacgatcaaaacgcctttttgtttccatcacgtgatgaaaggttccgttgccatggagatcgatgcgattgagatcatggtagagaggagttccatcaatggaaaggccgaccaaaaattcgtaagatttaagaaaagcacaccatgtatcgttaatcattgttccgtttgtttggagtgcataatgaactttaacctgttttatctgagcatcgataatgctagtaaagtattcgaaatatcgcaatcctgctagagtaggctcacctccttgaaaagtgatgcttagatcgtcaccgttttcaagatcagcgtaaacgttttttattaatgcatcaacaatagctggcttcattcgaccgtagtttttcacttcccgcattgaactgatatttgcgtagaagcaatacttacaacgtagattacatagtgaactagccggtttaattaaaattgaaatgctttttttcattaatttgcctctttcaaacaagatatccaattaagttgccagcgtctaaaatgaggacaaacaccactaccagattgaataacataagaatcctcttttcggtgattcggttactgataattgcccctagccaaccgcccaaaagtgcagtgattatgataacgatgatcattaaaggatcaacgttcattatgctttttgaagccaaagcttgaatgattttggctccctgactgaaaaaaatcgtgattattgaataaatagttgctggccgaatttcaagtcccagtagaactaaaaaacaagcaatattgattggcccaccaccgattccgagaacagttgctaaccaaccaagccctagtccgctcatgaacatgactgaggttccagctagatataatggctgtatatgtcctgaagaaccataaagtgacaatatcagtgagatgatcactaaaaccatttgtacgaccacgctaaggtcatcacccaaggcatcgtaaatttgtttgaaagtgaaatcacccagagctccaccaatgacagaacctattcccagccaaatagcgtatttcatgttgatatgttgttcagcatgtaactgtttcaaagttgaggttatagacatggtaaaaaccgcaacactcgaataaaagtttatgattagtactgaatctaaatcaaagatttgcagtgccggtttgatgatgacaccaccgcccattcctgaaattgcaccaatagtatttgctatgaggataacgatgggatatataagtagttgtgagggcatctgggcatctcctttcacacagaatttataataagagagagaaagattagtaagtatctataactattgaacggcccgtatcttttcaacaaacaagatggatacgagc

SEQ ID NO: 67 - DNA, 5128 bp, Lactobacillus paracasei
atgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggctttgactaccttgaaatcgaggcttttgtgttgcatcaagagtgtagcggatagcatagtgcagaagggcgggcaaaatggccttagcgatttttaacttattatcaataattttgatattcatcatcatttggctaacacgcaaagaaaaagtcgcaacgcgagcgggacgatataaccgagccttcttgattattattgcggtcatagagattgttctaattatttcggaaacatttattttcaaggattcaatttcacttcaatccgcatcattttcttgtagcttgttacttctgataaacctgttacttagctatagaatgcattaagcagcaaataagtgccatcacttttcaatctcatggaaagtgatggcactttttaaatggcgcaccaatgatggtaaagaaaacaatcaacgctatccactcgacgtaacgttggaagaaaaacggcagcttaaatcactttgtcgcattgtcaaggaatgaccttcaatatggttgcaacaattgatggtttccagaagggtattagatcggataaaaggctaaaacatgccgaatctcctctttagcaaacttaaaacaaaaattgtttcatgccttagtgatgaagatcggtcaaggactgcttaagctccgctatgtatcgaacggctgtatttgttttaaatatctctaatctgttaattatcgtacaaactaattatgtcagaaactacagcgtaggagccgactttctactgaatttaaacaggctccgaatttttgaattgattttggtgaaatccaagtaattaattttttgatttgctataaagttaaatttttcagcaatctgggggctgcttaatgcttcagcaaccgattaaaccaaaatatcgaaaaaattttcgatattttgacatttcaattgcggcttttgtgctattatcatgttgctttatgttgcctgcttatttatttattaacataaagtgcctattaccagacaaataagcaagacaaccaagtatattaatttaaatttaaggagattgacatatgatctttgatactaaacaacactacaagaggtgaggagtaaatatttcaatatgatcctacactgtccgttctttaaatatcggataagtgcctttgttcgtcatgagtatcgaaacaatgggccgtatcgctgcaagtatcatttgatagatgccaactacctatcgattcacctagtgttcacttgaggttttgaggcacgatacgttattggggttgacacaatccatgcgcgtgtcttcaacgaagtcgaggtactaccagtcgtggtcccggtgacgctattgcgacttttgtcacatggtcggtgccaagacgccgctcttgcaacatgatcacacgcttgctaattacataaaggccccgatcatgaaattggttttgagcgacttccagtcaaaacaattgtccgcattgtcgggatctcagtttccttgattcaactgtttgtcgaccaaaatctcaaatttcgaccggtccgacgcctacctatgcgccgctgttttgacgaattccgttccactcacggcaccagtcttgtttatctctctttgctggttcacatatattggcgccttgcttggtgatcaaatcaactgcatgattaagaatttcttcatcgcccattattctcttgctgaacgcactcaggttccgactgtccctatggatatgaatgcagcttatcaggcaaatgttcatgagggtttcacccaagttcaagcaaacatatgagaactatttagcgcttcatgatgctctgatggtgagaaaacatcccgcaaacctggccaacctgttagctacttgcgagccaaacggtgcggcaatagacatgacgaccgcaacacttaagtgacacaaagtcgctgttctcaatgccatcaccagccctattccaacggtccgatcgaagggattaaccgcttcatcgagtcactcaaacgatcctgttttggcttcaaaaatcagcagaacttcttcaaaaaaatcacagcataatacgacaaagacggctccccaaatggagaaccgcctcaaatgataaatttattcttcaacatcagtcgacgtagagccaaaattcgaagcatgtccgttgcttataaaaagtataacaaagttacttgcaaacgaatgcttaatgagatgaaatggtgcttgtatcaagtcgaacttttgaagatcttcccgcttaattggctgaatttggtttgggacacttatgcaatttgaatgccagcttctaaggtattatccaatttatagattcgttcaacatcaatgaccaccacgccagcgcgtgggaaacgatcaaagatgttagttttatctagaatctgattagcaaagtcatctgcttcatgaatatgagccgttccctcaaagcgaaatcccttttgagcgcctctatcagcaaccgcaaccgccgccaaatggttgttcgagagattattataggcctgcctaaaggtgtgctcaaagtagattaaatgtgagtcatctaagacatgtagtgaacccttgggaccaacttgaggtttgccatcttttcctgttgttgctagaaaggggagctgattctttaacatatttttcatttcttctgtaagatttaccatttgattttctcctatcaacgtaatactggctatttatttacttttagtaaatatattgttgagatactattttgtcaatcctatgtcccaagatgaacatcgcagactaggatcacggaaggtttaaaaagattcccttgttttgtaaattggttaagcaaacatgtttatatcgttggtcatgctcaggatagatgggtattgtgagtgcaaccggattgagttgtttgtatgctgggcaatgttgacctcgatacagaggatcataccatttctgatttggatgataacctcgtttttccatttcacgtaacacaatacagtgaaattgaaataatttatatggggaatgtgcaaatacgtaattaacggtagcgtgtttccgtccccatccattaccgcgaagcgccgcaatttcacgatgctgtcccaataattgttgtcttgggagttgctgaattaaatcttgatgccataaacgcacgttacggcttcctttcttggaaactagtcttaatatttatgccatttggaggattacagtactgaaccattttatgacgaagcgccttttctataggttcatctgcagtataagcaatgggattcgctccaactcggattgtctgatcaatttgttcaattttgttggtgtgattgattatattgctcttgcaaagaaatgatatccttttttgctgtctttggagcagcgattgcaccctccgcatgaacatatacacggtttatacaagatggctttgaaagtgaagtcgtgccacctaattttgagtcgttttatcttaactaatacctatcacgccgaatttgttattagatcgtttaagcgtagaagaaactaaaatattcaataaattattcgaaaaatttcggaattaacaatatactttttagtccgtttattagctttttatgattgatcttctttttttctgactgcaagcacccacaaatgcgcgtgatttccttttgaggtcagtggccgtcaacaatacatttgttttcacattggcattaacatagccaaagcgtgtcaccgttggaattgcttcctcaaaaaactaatagctgtgagtcgcccaaacggttgattgactaaattgatacgcctttgcatactaatttccgcttgatgaggaggcatttaaagaattactttacctcagttgacaccatgaaataaaggctagttcgtcaatcgttcgaatgccttaagttctagtatacgtcaatttttgagtggttagtagttgatcggatagtttactaatgatagcccaatcacaattatatcgatgcttttgtcgatcccatgcacagtttttgcttctaggacagttgctaattaatatgcctgcaaacgacaacaagatcgtaagtgcggtaaaggcaattcgctttcttcttgtttaagatggcgacaggcctctttataaatataggttttttgaagattagctgaatgagacccatattcgaaaacgttgtcctgatattctcctgtttggcaatttcaatattttgttgttgtggcatctttatgggttcgcgattttcttgagcaatatatttatataaatcgacaatgattgctgtgatcaaattatgaaaattaaggccttcaatgctgtcacagctgggtagacttagaaccttcaattgaacttcacgataccgaatggcctcaatgatattagtaaaatcatgagaattgcgaccagccaatcaatcctcaatactaccacttctcatcacgaatatagtctagcacacatagaattcgccaattgagcctccgaatacttaataatgcctatataagttaggtttctgaatttgatgccaagaggccacaatcgttctaacaccagcgccaaaagctgattatgaaaagataatataaatattataatatttaaagagcatttcgaaattaatattcacttattcttctaaatatcgacggctttttttcatattttgacagaataatttactggtagtcggttctgaacgtatatgatcatcacgcaacgaattgctagaatacgaaaaagctgatatccatcaaccgaatcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaataca

SEQ ID NO: 68 - DNA, 6184 bp, Lactobacillus paracasei
tagtaagcgagtaaaggatggcattgaatacgtcataaagatcataacgacgcggtcttgtatgcttgcggaagttttctaaatcaggttgtattaacgcaaattgcgctcgagaaatattgcttggataatctggcatgacaaactcctcagtcggttttccacaattctaccagattccgcagatactagacaggttctaaaaggaaattggcgtggctatcgtgaattttaccctgccagatatggaaactatggtaaaaattatgacaactggattgttatttatcagctagatcatgatgaattgattttgttattggttgcaactggctcccatgaaatcttgaatcaatagctatagtttaggggcacttataaaaaaataaattaaaataacccccagtatctacattatagatattggggtctattctttcaatgtttttgaggggttatttgtatattatagaccctaaatactgaatcaaaaaactttaaatttcattcctatatcttgaatttcagatccagtcatataggggaatatgtctccttgtataagtaaatctataatagctctttgatttaaaattgaataactttcatcttccaatatacaatcacctcacaattctacggtaaattttctatttcttgctcaacatttctgccatcgttgtaagtaaagaatttaacaccataaagcttaacttgatcattctcaccaacaagttcaatattttcaggacgaatactttctaagagttcttgtttccactgatcctgatcaagcaattggggtcccttaggctcaatataaatttgataacaaaaatctttattctgtaaatagaggataaaatcaggcatgaaaccggcataatgagttgtctgacctttaaattgatgtagcttgaaattagtattgcgttcatcatttctaaataaataaatttgactatatttttgacttaatcggtcaacaaaagcgccgattaagtcaactaaagacttctccagcttatcaacaatggcttcttcaaaaacaaaccaaggtttatttttcattgagtagggtaagatcatttcactgactgatttattaaaatgtttggcaactttcttttggtagtccctaatcaaggattttataggaactggaataaagcgcttagtaccgtgttgtctttgatagttattaataatctgtttttgaacaaaagttaaatattgttcaactgctttaagttgctgcttacgatttaaggctggtgaaccattgctgacacgagcatacaaacgaatatttcccaaccaattatcagctgtcataaattcatttaaagagtccaaagtaggaatatactgcttcagagagttaaaccgatagaacttattacgtgagaaggcttttttaactaagattacggcatctcgaaacttaaacaaaaatctagtttctgttaaaggatctttctcaatagcaacagcattataatttgtttcccaagtgctctctaccaaattgacttcagccattgtggtggtattaaccccataacggtcaaggcaattaaattctttatctggtacaggctcaacttcgttgtagtaaagattaccctgttgataaactttagagtgtttaaatgacggtttaacattagtttcaaaaacatcaaaatcactatcatcttcgacaggtaggtccatcttatcaagtgacttcttaaggttatctaggtacttaggatcattgatagtgtggtaataaagactctctaataactgatatttaggattctggttgtcaaaacgacgtgtataagagttttcgccttgataaacaaaaggattgtagcgtgctcctcgaccaatcaactgagcttcactgtttgtttggttcaaggtagtggattgttcaccaatccgcacaatatcataaaggtttaaaacgtcccagccctcacttaacttagcgacagcaaaaataacccgaaagggattgtcagaactttccaaggtatttagattatgcaagtcatttaaatcacctaaaattccttctttggcactatcgttaacattaatagtattcatagcccgaaagtcacgttttaattcaacaattgcagtacccaaatcttgcgataaccagtaatcataagcttgtttcaatgcttgactatggctagtgttttgttgatgtttaagaaaatcggttaggtccgttatattcaactgtgagatcatgcttaaaaaagttgttcgagcatctttagaaaccgcaattttattagacttaaacaagattaccggtttaaagtcaggtatttttaattcattggcaattcgcttacgatactggctaagcaaaacagcattcagcattttgttctcatcgtcgttatttgcttgtaatcgatatacccgtttagaatatccttggtgaataaaacggcttaaatcgtatctataaacaatcttttgacgatatttttgataaatcgcttcattttgtaaatctagagttgcagtaaactcgaattgacgattatgtttattagcttgacgaatacgatccaggacatattcccaggaacgttctttttggtcatctttacttttagtaccagcagaaaaatgatgcgcttcatcagctagaataatcaacttctgtttctctaaatcgccataagttaagccattttcccgtggtgtatttaactcattagctaaagtttggatagttgttaatcttaaatagattacaccatcctctggtgtactaggagaccgagatactgagcgaagctcgattctttgaccgtggatagttaaaggttgggaaaaaagatatttaggtgaagcagtatttaataaattgtcataagtcttagccaccacagcatttgtatttactacaaaaataaaattatgataagtaaattcagtatacaaatacaagatcagggcagctaaaacgtctgttttaccactaccagtggccatattaaaaagtaattgattatattggtaatcagctaacggctgtcgctgtgtccagtctagattaactaaagcttgattttggtaaggtcgtaattggtgctttaaattacctttaatatattctgggataataaagggcttttcattactaagaagatcaatcttacgtttgttttccaataaatcgaccaatgggagttcaattttgcgcataactttttttttagccattagtttagtccctctttccatagaagctttgattaaattgataatccttatcggaaatcaggtcacggacatcggcatcatcaatattattgaagttgtagtaaagttgattcttatccaataatttaactaataactgcttttgttcttcaaaagacaaagctttacgttctgcatcattttcatatttatcaagatccactcgaaagtcgaaatctgctcccactttcatgcgtttatatacagcatctaattcatttatatctttagccgctagcagatcttttaggtagccttgatttttttccatcaactctgcataaacaaaggaaccgccaccttgccagttgacttccttagaaataccactatttttaccattaattgcatcacttaatcttttaatttctatctctacttgagaatctatttgttcaacagttataaactttcttcttaactttaaagatactgccgcagtagttcctgaaccaccaaaaaaatctaatacaacatcccctggatcgctactcatttctaatattctttttaacagtttctctggtttttgacctgaattaccaaaattaaactcaatctcagatgatgatctatttgcttctttataagcctgaggattagcgtatacctgctttatatcagtccatactgttgtcaatggtacaccatttgattcatccaaatattgcttatgccaaatgggattaccttgttcatctttgcctcgttgccttctctggtatactcttccatcttcatccttatacttaaaccaattattgatatactcttttgaataaggagtataagatttattttgttttctaaccggataattcttcgcataatgtaatatataatcatgaatattaactggctttgctcctgcagcacggcctccagaagctgatccatatgaccatattatttcttcaacaaaattagatttgccaaaaatattatcagcaagaaccttcaatttatgattttcattaatatctatgtgtataaatatattgcccgtttcagccaataggtcctttgctacttctaatcgatttttcataaaggtcaaccacgcagattcattaaatctatcattatatttaaatgaatctgatccagtattaaacggaggatctaagtaaattaattttatccttctcccatataatctttttagtgaatagagagcaattaagttattgcctttaatgattaaattatcttgatcagaaaaactaaatgcattatgttcaccgttttgatcatactttttagcattaacaaatattttaggttctaatagctcatcaatttcaggcttagcaatgatttcgtttaaaaatggctcatcagcagattcatctttatctagatcttctttagtcataccagcttttaaaacagtatctttaaaaggaaaatctaaaacaacatcagcagattcatcaataaattttccattagctgttaaaccaattttatttgtaaatttggtataactatcttcccaaaaattcttatattcaaacatttcaacgaactggttaagtttaaatacttcggcgtcagcaattttttctacataatttttatgtattaagggatctttaaatagctttgtcatcagtacatggtcgaatttatccaagtcattaattacattatttcgtttcaaggaacccttactagttaaatacttatttccaaactctcctaaaatgcttttgacttgagacattatcttaggttctatttccattgttaatccacctttttaatttttaccaaaaatgccaccaacccttgttagttttatttttatgtatttttttttgtattttattagtgccaacaacactatctttatcttgcttgtcgttttttttcttgctgtgactggtattagaactattcgacaaggtatcgtccttgtcgtttacttgttgctgttgagttgtactagaaggttcaagcaagccactcaatttctgaacatgctctttcaattgtcgattttcggcaagcgttgctaattgtagccgttgttgctgatccaaggacttttgtaatttagaagcttgctaatttttaacatcaagttagtgtagcaagacattatcaatattatcttggttgattgttcttaattatgaaccatggctctggtgcaaatagtctgagagtgtgccttttacctagttgttgatagggtgttgtaggttatgctggcaccatcgcttttaattcgtccacggctgaaaacccgatgaggcttagctctcgtcgggttttcttgcgtaatgcatggatgacttcaatgccgctgagtgttgcactagcggttcggatgctttggaaacttgctgaccgcacccggtgtcgtttaatgaatcgatgatcttgttcgattaaattgtttcgatacttggaacattggtgtgctgatttgctcaagtagtcttgtttcatcaggtgcttcactgccttaagtgttgctcgatattgatcggtgactaagcgatcaggacgaccattggtcgtcaaaagccgtttcaaaaagtgataggctgccgcataatcacgatgctttcgcagttcgaagtcgagcgtcagaccgttgctatcaattgcacgatacagataagtccaatgacctttgacgttaatgtaagtctcgtctatcctccaacttttggtatgggaggtttgatgttggcgccataaagccttaaacctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctc

SEQ ID NO: 69 - DNA, 88275 bp, Lactobacillus paracasei
  misc_feature (76776)..(76856): n is a, c, g, or t
tttcagaatagcgaatcggcatccgatattgggtacccgccatgaaaaaacgtagaacttgcggatcaactgttttgcgaatatcgtgcacagtgatgaagttgccaagcgatttgctcattttctcgtcgtcttcaccaatcgtcacgaagccgttatgcatccaataccgaacgaactgcttgtcggttttagcttcgctttgggcgatttcattctcatgatgcggaaattccagatcctggccgccaccgtgaatgtcaaaagtatcacctaacagcttggtgctcatgactgagcattcaatgtgccatcctggccgtcctttgccccatggtgactcccaactgatctcaccgggtttggcggctttccacaaagcaaaatcaatcggatcttcttttttagctaattcgtcttgggtaatatgttgactggcaccttcttcaagttcatccacattctgatgagataactccccataatgtttaaacttgcgggcccggtaataaacatcgccgtcaacagcataagcgtattctttgtcgatcaaatcctgcacaaattcaataatatccgggatcatttgactggcgcgaggatgagccgttgccggttcgatccccagcgccgtcgtgtcttccatgaacgcatcaataaaccgttgcgccaagtccagcggagcttcaccggttttatgagcagcattgataatcttgtcatcaacatcggtgaagttcgaaacataggtcactttatatccgcgatattcaaaataccggcggatggtatcaaacgcgatcgcactgcgcgcgttaccgatgtggatgtaattgtaaacagtcgggccgcagacatacatccggatttctcccgggtgcaacggcgtgaatgtctcttttttccgggacattgtattgtataacgttaacatcggctcatttccttcctgtagcgtcttaactgtattttacaggaaacgaccgtgattataaaggaacggggcgggcgattgcaacattctgtgccgtgccaaacgccgcaatctccgccttggcactacgaccttaatgcttagcagactatctatcaaaaaataaaaaggaatgattttcctaaatacggcaatcattccttttggagctgcgcatgacgttcctgtttttcagcagccttaatcaattttccgcttcggattcagaatccccaacggatcaaacaatcctttaatttgatgctgaatctcatcaacatcaaagcctaattcttcattgttccattggttcttgctcatccccaccgcatgttcaccggaaatggtgccgccaagtgccaatgctttgcggaacatcagacgaatagcgtggagcgcttctttgggcggttcttcctcatcagccggccagatgacggttggatgcacattaccatcgcccgcatgacctgccgtgtaaatttcgacatttaagtcctgtgcaactgacgcaatatagtccatcatttcaggcagtttagacaacggcaccgccatgtcttccataatatgttggccgttagcgaaaaccgccggcaacatgtcctgacgcaacttgataatcgccgctgcttctttgggatcactggtgaccttgatgtttttggcatgatcgtcatttaaaatctgctccgccattttcagactagcttcaccaccagcatctaaccggaacaggagcattgcctcggcgccttcagcatagtgagtgccttcataacgatccaacgcagcaactgtcaggccatcaagtgcttcaagcatgaccggatagataccggaaagccgcaaatcctccacccctttagccaatgctgtcatgttgtcaaaataggcaattccaacaaccggcgtgccaattggaataggattcagtttgacagtgacttcagtgatgatgcccaacgtgccttccgagccgacgaataagtgcgtcaaatcgtaactaaacgcatgcttgtaagttcggccgccaagtttgatttcacggccgtctgccaaaaccactttaaggccaagcacattgtcggttgtcgccccatacttcacggtactcatcccaccagcattggttgccgcattgccaccaatgcttgaaattggcttagatccaggatcaggtgcgtaaaaaagaccttgcgcacgcgctgccttatccagatccccgttgatcacaccaggctcaaccactgccaacaaatcgcctttgctaatctctttaatccgattcattcgcgctgtcgacaaaataagactgccgtttatgccgtcagaaccgatcacggtgctcgtatctgcgctttgaggaactactggcatatgatattgacgcgcgatttttaacacaccttgaatatctgcaacatcgctgactgcaacatatgccagaattttcccggcaatctcacgctgggcattgccattggcgctatgttcgcgcgcgattttatcatcaatgtggatttcggcatgcggggccgcgtcttgcaaggctgccagaatttccgagttatcataagctgtaaaaattgccatcacaaaaacctcctcaacacctctaaaggcaggtggcagcgttggccattcgcctctgaagcgtcgactttattatggactattttggtaaagatggcttagtaagacgctcggtggtgtgcctattaagacgccgattgaccctgcgatgagattgactgtcctgcctttgtctcaccagcaatggtttccttgggatgaacggtaataacagcctctcctagccaagtcgtttctggtgccatggctgccaagcgataaggttgacgtggttggccgctgcctgttattggcgttggtgtggcaacacaaatcgtcaagacatctgtgtccacaccagcgtctgctagatggcgaaagcggaccaaattaatggtctgttcttgtggtaccaccagtggttcgcagttgccgcgataatcgagtcgaacgacatgccggccatgtgtgtcaaaaccagataaaacggccacctctggacgaccaagtacttgagttcgcggatcaaagccgtcaaagctggcgaaacgcggcaatatgtaatagaagatcggtgacgccagggccacaggttccttgcttagtaaatgcaggccgactttcccgccaaaacagccggctgcagctgatcccggcaaatattgcaaggcaaaagttggttttgtggtcaatgtgtctgacggttccttgtcgttattgcgattgtcacgcatcagtggtcactcctgtcaaaattatgcttgatataattaaaatgatactcgcttgatccataaaaacgcacgttataagatttaccgaatttttgctgacgattcaatccgagccattgggccagattctccaagtaagcctgaaaaagcgcgactgtgttgcggttatcaaaaaacaggtgtttgttcacggaccatcgtcggtcctgaacaaacacctgcagttgtgaaaaatcacaacatgaactcaacattaggaagacaacgacgaaaaccagaaaaacatgcgctgtccattaatcatgccggggattggcttatcaggtcaatgaaaaagccaggcataaatgatatgaaaaatcgctgccgtcaccagtcctgtcatcatacccagaacaaaatataaaagtaagtgctgccgcttacctttcatttttcattcctacccttcctacgttgcaaggagctagtctccctgtcatttagggtaaccgatgtcgacaagttctgggggaaataaatataaacgttaggaaatcaccgattaacgtcgtcctttaggcacactcactcatttattaacaacaagcgttgcccttcgcattccaccaagacttattgtttgcatgcaaaaacccgcacatctgcgcgggcttcctgcatcaattaaagttggccggtgacaagatcaacgtttttaaggacttgatcgcgacccatcagttcaatggtttcagcaagttgcggaccatgcatccgcaatgttgcagcgattcgaattggcatgtaaagcttgcggcccttgaccttggtttcctgcttgacttcattgacaataccgccaatggaataagcgtcaaacgtgtcgagtgcccgaatctttttggcgaaggctttgatgactggcttagcattgtcatctgccagttctttgcgttcgtcatcggttaggtcagtggctttgtcgaagaaaatatcggcaagcttgctgatctgagcagtgtaactcatttgatcggtgtaaagactaataagctggcgcgcccactcgatggtcttcggatctggatcactatgaattttgccatcttcaatcaagttagctaaggacaagctcatcaattcattcgggttcgtcttttgcttggccttgatgtattggttgttcacccattccaatttcttctggtcaaaacgggctgggctcttagatagccgctttggatcgaattgcttgatgaattcctttttggtgaaaatttcatcttcaccaactggggaccagccaaggagcgtaatgaagttgaacatcgcgtctggcaaatagccgagttcacgatattgttcaatgaactgtaacacggtttcatcacgcttcgacaacttcttaccggtggcgccgttgatgatcaaggtcatatggccaaaaattggtggttcccagccaaatgcatcgtaaatggccaattgcttcggtgtgttggcaatatgatcatccccacgcagcacgtggctgatttgcatcatatgatcgtctactaccaccgcaaaattgtacgttggcatgccatcacgcttctgaatgacaaaatcgccgcccagtgtgttggcatcaatcgagatttttcccttaacgatgtcgtcccactcgtaggtcttgtccattggaatgtggaaccgaatcacaggctccaagcccttcgctttggccgcggcaatcgcgtcagctttttcagcgtccgtcatgccctcatattcatattcgtaatgcggcatctcgtgacgagccttttgggcttcacgatcggctttcagttcctcttcggtccgataagactcgtaggcaaagcctttatcaacaagttgcttgatcagcttgtcatagatgtccttacgttcagactgccggtatgggccaaagtcgccgcctttgtcggggccttcatcccagtcaatcccgagccagtgaaggttctccatctgactcttttcgccgtctgcaacattccgctttgtatcggtgtcttcgatccgcagcaccaacgttccgttgttgtgccgtgcgaacaaataattgaacaacgccgtccgcgcattaccgatatgcaaatgcccggtcggacttggtgcataacgcacccgaattggtcgatctgccaatgtcttagcctccatttttctgtaaacatgcactgatagtgtaccacagaagggacgttcattgggctgatgtgggagattgaatctatgtcagttggcttctgatcgttctactaaacgacgcaacctttgcaatctatcattgccttaatcaaacgggaatctcatgccccatgcatttcgcacactgtccatgatatggctgacatcgtgagatagtagcaactgaccgtcatcgtgaccttcatcaatgtagcgctgaaaatcacggacttcataaactaaggcatcggcctgatcgcctgcgcttaatacctcgctggtcgtggtatgggcatcaggggtgtaggttactttggcggttgtggcacgcggatagtcatcaatttcaacgtagccttttgtacctgagatcacgccgcgttttggctgcttagcgcgtaatgacagtgccatgacggccaactgctgatcagcattttttaaaatgatccctgattgttcatcaacaccggtttcaaagtacttgacggtggtgagcgttacattgggctgagcatctaagaaggtacgagcaaaggcagttgcgtatccgccgatatcaagcaacgcgccaccagccagatccttattgaagaaacgattctttggatcaaagtctttcaagctaccgaagttaacttgaacaagatgaatgtcacctaacttgacacttgcaatcagctgcttgacttgttgataaaccggcatatggtacaaggttaacccttcagataaaatcaggcccttgtgcttggccaactgctggacatcatcaaattgcttagcattgaccgtaatcgctttttcggcaagaacgtgtttgccggcattcaaagcttttttgatgtatgggtaatgataggtatgcggcgttgcaatataaatcacatcaacgtttgggtcggcaatcaaggcatctggatctgtatatgttttggcaatatgtttttcaagagcgaacttcttaagcatgtcggcattgacatcagcgacggcgtagatgctgccgttttcccggtttaaagcgtcggccatttcatgtgcgatccaaccagttccgatcataccccagttatagtttatcatatgactcatcctttcttttaaacgcattctccagcccagaagcctgcgtgtaagaaccttggtcgcaatagtcagagtccgaccatcacgcctaaggtcacttacactccggtttttaaccgggccggttcacgcactgcttaatttcatgtgcctgaccatctggtgtttctattaagagtaatgtcgctaagtgagcaaagtatgacgtcgcaacaactcccggtaatgaggctagcaaatgatcaacttttgcgatatccgtccattccgccatcgtacaatcaattaattcattgccgtcgcgcgttcgcgtgtagcccatgtaagtggtagccattcgtcgttttgcctgcaagcctagcagcttggcagatgccatcacctgttcacttgccgcgctaacaacttccaatgtcagtggtaccgcggcattcagttgagcgttgacatttttctgagcagtgagaatcacataagcatggctcgcctgcgcgtgcaacttttcataaaaatgaatgccgccattacttttaagtaaattcaagtccttatcggcactgtcacagccatcaaaagcaatatcactgactatctgtgttgttgttggtaaccccagtgtctgacaataagccagcgttacttcagagggactgcaaatctgaatacccggcaatgcccgtgcgacaatgccatcagcaagcgtctgcatgtgccgaccaccgccaagactcactacctgatgcggctgaataagtgctagagcagcggcgatttgatctgtcatgaaagttgcttcctctcttttatttttgatgaaattatatttcacatataatgtaagactgaaatttagttttgtcaacagctagctgtgaggattgtcttttaaaattaatcgcgtagaataaaggccggagagtttcataaaacagattattcagaaatttaattgaaaaggagctgtgttatgagtattattgaccgtctttatagcatgctgccaacactgaccgcgactgaccgtaagattgcgcaggttgttctgacgaatcccggtgctgtcgtgaataccaccatcgccgccctcgcaaaagaaagtaacgttagcgaagcctcaatttctcgtttttgccggacaattggtgttgaaggctttcatcaactcaagattgagcttgctaaggttgctgaaaaccgtagtgcgtattatcaggaaattaacgccgacaatcttcagcaagccttaagcaatatcagtgccaacaaagtcgccgaaatcgaaggcacactaaaaaacgccagctcacatgacattcgaaaaattttggatttgttaaaacaagctagtgtaattttagtcgccgctgctggcgatacgcagccggttgccgatgacgccgtctataaattcaatcaactcggtctactagccatcacagacagttcttgggaaacggcgctcgcccaaaccatgaatgcacctgcagatgctttgttgctggttatctcaaattctggcgaaacgcggaatctcatcacccaaatcaaagccgctcaacaacgtggtattgctgtggtcgcgattaccaatcgcaaggattcacctattggcttggccgccgattatcagcttttgaccgcggttcggcagcaaattttcgagtctgaatatttcttctcacgcgtagccgccatgacggcggtggaagccttattcttgttgcttctagctgaggataaaactttcatggcacatattaaggctcatgaagcattgattgcggagactaagatttaggtgttcgtcttagaccgactcttatcatttaaaaatgccatttcttctaaaaaagagggatgatttttccgtaacacagaaaaatcatccctctttttttgcaagtatcaattatgtttcaaccttaactaggaaaagtcagcaactatgccgtcttcgccgttctcgtcatcacctgacgattttgacgccagaaccaatacgtgaaggccaaaactaaaattgtctgaacaactagtaggacttcttcaaccgcaccgttcagcgcaccaacctgcgttagtgccgccggaaagtcgataaaggcatgtaagccgattggcaacaatagccagaaccagcgcatgcgtttcataatgatgatccacacaaccacggataatgcaatctgaaccgccaaggcaagtagtcgttccatcaaggataacgaaatcgtccagcccgtcgttgccatcaattgtttcacttgcgtattgagcaccgaacgcgagctagcgggtaccttttcaagcatttcgtttactttgccgccattaatcagcattgcaaacataaagttgctgaacatggtcaggctgccaatcagaatcatttcaagcccgccatgacctaatccgtataggaatggtgtttcgggtgtcgccgccttggttggtatgcgtttattaataaacttaagtcctagataacggccaacctcttcaaaaacaccagctaacagcgcgccatacaacgcatatagaaacggcacatgttggaaatcttttgcgatgccgcggaagggtccttccaatacaccagcgaataggaaaaaaacgcccatgccaataaagaaaaccttaacagcacctttttttggcttgctgcaacgcagaatcacccagattaacaaaataatcggtaaggcaaaacaaagtagcatctcaacgcccatcatgttaaccgtgaattggctgacagggctgttattcacaactttatccattctgaacacccctcaatcaagtataaaagaaatgatgacaatacccgcgacgatcaatagaaaaccgacaaggatcacccaactcatcgttttggccatattgagcgtgaacccaatccccaaccgtttttcaacaaagagcgccggatcagttggattatagtaaaacatcccccagacccaatgctgattatcattcaacacagatcctttggccgcaagtcggcgagtccccagaatatacaccaacggcaaaaagctgacggagagcagtgtcagggttagtgtgatgatcacaaaccaccattgaccttcagctgacatattcggcagcatgagttggagaaccagtaagctttgactcagaaaacctgtgaacagcagataatacaaaacggaattgcgcaccttaccagctcgcggttcagcatccggattgccgcgaactgccccgcgcgctctgcgggaaagataaaaagcacccagcacagttagcgtttcaaccgccagcgccaaaattatgacccatgaatctgctgatgtttgctgaaaaccaagtacaagggctaaaaagaactgcggcaccaagacgagcccataggctgccggaaccagcgtttggggcttgagcttattcaggtcaacagtcaccttgctttgggtaagctcctgctgattccccatctctttaaggagttgcaaacttttccgatgtgccgccacaatcaaggcataattcagacagatcgaaagcaaaaaggcagcaatttgaatccaagcaagcgcagtcgccgcaaagtgcatggcggccgcaatcccaatgccaatcactgaaaggattgccgcccctgttaatgaaaaggcgagataacgacggcgcaattttttagctgctggcgttgtccaaatgctgttacgggcatatacaacgccgaataaaacatttcgccgtgacagccatggtgtgacaacctgaatcgcaaccaatatcaaccacgtaacaactaaaatcaccatttctgcttgcatctttaatcactccttcagatcatcataaagttcatcaatcatggtgtgcagtgcatcccgatctaaatgtcgggccactgcctccgcgacaaccttttctaaggcaggtcgcagcacctctgccactgcttgattcggggagccatgcgcgtgaacaacgacaccacgacctcgctggatctcaacaaagccttccctttgtagttccttataggctttattcaccgtatgcaggttaaccccaagttcattgcccagcgcgcggatagacggcaaaatagtgccattcgtcaagtccccagtggcaatgccactcacgatagcatcgcgaatctgcgtatacagcggaatcttagaatcgaaatcgattgtcagttgcacgtcttcaccttctaactgttctagttgttatagttagtatataacactgaacgctcacttagtcaacaattcacaactcaaaaggcgataagcgcaaaaaaagtcccacgcaagaaatgtcatcgtgagactctttacaaactctttttttacagatcaataactacttttcccgacgacgcagtccaaatgatccaaaactgatcaaggcaagcagcaaagccaccccgatcgcaattaagctggtccgttggttatcaccggtattcggcaagtaacggcttatttgcttggttgggataataacttcgattggtgcggtgtcattatcggatagcggtgccgattctgtcggcgtatccgacatacttggcaaaacttgagttgacggtgttgttggtgttgatggcgtgactggcgttgatggggtcacaggtgacgcttgctttgcgtaaacgaacgtcacggttagactgcctgttgcaaaagcaccattttccgcgatgctgccagatgctaatcgtaagtagtgataattcgcgatcatcgttggtgtaacagcatacggatcgccgacatgaccggtcagaatcttatcaggcgcaatctgcttgccattgtcatcgacatatttcacgtcaacagttccttgagcaactggattcttagtgtagatgaaggtgacggtttgcgtaccgtccgtaaatgaaccatcttccggcgcactgcctgtcgccaaacgagcaaattggtaattcgtcatatcaattggtcttgcttcgtaaggatcaccggcttgaccagtgagtattttatcagatgccaaccgtttgccgtctacgtcaacaaacttcacgttgacactgccacgcggaattggtgtcttcgtataaacaaaggtgaccgtctgtacgtcattggtgaaagtcccgtttgctggtgcgctgtctgtggctaattggggattttcataatagtcaaaggcaggtgctgtcatcatataaggatcaccgactttgccagtgatcaccttatcaggtgccaacatattaccctctatatcaacacacctaacgacgacggcattgccagttatgggtaaactacgattctgataaacatcggtgtctggcacagcgctcgttgtgtcatcgccagcgtctgtgacacccttagtcgaatattgaccggtttgatgaccggcaatgatctggtcattcatgccagtttcttgctgtttcaataccgttgcttgattagtcggcgttgttccagtcgcgttggtgaccactgaatgaatatgcgatgtcgatgctgtaactgactggatttgactaccacccacacaaatccccacgccaatcaacgctgccacccatagcgtacccgctttatacatcttatgctgagacttttcgttactaaatgcctgcaatgattttgcccccttctcatgacccaagccgagacgcactcaaccgaaaacaacaaagtaaatattacatattggtgacaagtataacacttgacatttttctatgtagctccagcacaaaaagcctctttcaattgccgtattgcaattcaaaaaaagacttcatagaaccgagtctaaaagtctttatcaattaactaatatttgagtgtttaaaaaccgtctacgtgccacaaagcaatgttctttagattgtttaaaacccaaacctgaagtcatgaccagtccacatccgcaatccaaatgcttcttttatttagcgttcattacgatacttgaaaaccactagacttaaagccaaaaaggcagctgcataaatcagataaccaagactaatttgactaaggggcagccgcgtcaacttacttagttcagcgttctgcaattgattgcctaaattcatcatgttaaccggattccattttatccattcatgttgtttgatcatcataaacatcaactgattaaaaattgaaacaatgaagtatgtactgaggccaatgatgatagcgggtgttgagttttcaaacagcgttgcgagtagacaaacaaaactcaatatgaatatcagcgttaagaatgaggaaatgttgttcattaaccatatttgccaaacttgctgtccttttatgccctttgcgactaaatcaatcttgccattaaaaactgttattgcgagacataagctcattattaagctactggcatataaaacgagcgtgcatagcaatagcgtcacccacttgcttgccaagattttgcttgacgaatatcgacgataaagtaaggattttaaagtgccgtattggatttctgacgataactgcgtacttgttaacgcaagcatatagaaaacaatcaaaaccggcgcataaaaactgttgatgaataatgaactagggttagaagcattggggtgggttaataagtacacggcaattgcaacttggaaaagggtcagaccgaaccagaaaacgaataatgaaggccttttgactagtttgtaactttcatgcttaactaaggtgaccaaaaaatgacgcctcctttttattttgttgatgccaaaacatccagtagagatttttctaagtctccttgcgtttcttttatatctttaatgacaatatctttgcgccataatagttttaacaggtcattaatgctagaaatggacgatcggctaatttttaaaccttgctcttcattactaaccacgtagccctgttccgctaacagtttctgagccagctcatcttgatcagtcgctatccaaaagtatgtttgacttttcttcaataactcactcatagtcgcatcaataattaaacgaccttgatcaataataatgacatcatcagcaactttttgcagttcactcaaaatatggcttgaaatgagaaaggtggtcccctcatcacgtttacggataatcaactgacgaagcgccatggtcgctttaggatccagcccattcatcggctcatctaaaatcaccagttctggacgattgacgaatgcaagtgcgattccaagcttttggcgcatacccagcgaatattttttggttttaacatccgcatatgctgcaagatgcaactcctcaatcgtttggttgacgcgttcatgccgctgaggaccattggcaaaaagaagcaattgttctcggcctgtcagataaggatacaaacctggatattcaataagtgcgcccacatgctctaaagcactatgattatccacggtgattttttgatcatccaattgaatatccccatcaaacgccgtgattcccaaaatggccttcatgatcgtggtttttccggcaccgttcgcaccaattaaaccaacaatatgaccgcgttttatctcaaaggaaatctgatgtaatacttgcttctttccaaagaacttatcgagctgatttattttcaacataccttgctgtcactgcccttccaatgcgctcagccattttagactttaaacatgctctatttggcatctttattatcctaaatgtaacatgtccaagttagataactgttgtttttgacaaaacagaaaattaacttatataattggttgctgtttgattataggaaaatagaggtgtggcacatgtctgagatgacaacaggttatctgtacaagaagatccggcttgaacgcggtttaagaattgcagacgtcgcaggtgaaatcagcgtcagtacagtttctaagtttgaaaatggccattccgagatttctgctgacaaacttataaaacttctcaacaaattagggatggataccagcgagttttttgaaattctggatcaagcccacacttctaacgctatttccacaaatacttctcaaagaagatttgtacaaacgttaagacaacttggcttagaacaagacattgacggtctaaaaagatttcgttcgcagttcactaatcaattccaaaaaacacacaggaagctcaataagcttcgagaaattatcatctcatcaattattatggatactcaagatgcacataagttgctatctttaagtgactctaaatacgtcagcgattatctccttgaaagagacatctggtacaagctggaatacgttttatacagtgactgcgtcccttttttgcaaccacaggactttcagcgattatatacaaagtttttaaccattcatttttctttccgccaacgaggcaactatttgcctttgtttttccaatctttttataatacagccgttgcattatattaccggaaggaatattcacaagcaatccaaacactagacagactgaaagagcaacaaattccagataatttattctcagtacgattacatctccgattattacgtggattatgcctctaccagctcacaaagagtcctgaaacggctgaagaattagcatctctcgttaaagtaatctccaaagtcagccctgtatttggtcgacgttggaaagctgagtttcattttcatgaacctattggggataatgcctaaagctaggaaaattcgataaaatagaatatcagctaaaaaggcagttccagcatttccttcaaaggaatgctgaaactgcctttttaattttgaacatttagattatctttctttatcccgaattgccttttgctgatgcgctggctttgcgaagatcatgcgccctgcagccgtttgtaaggcactggtgacaatcacttctaacggtttgttcatgtagaacttgccgtcttcaacaacgaccatggtgccgtcttccagatacgcgaccccttgctggcgctcagagccggatttgatgacggtgaccgtcatgccttcaccgggaatgacatctggtttcagcgcattggctaaagcgttgatgttgagtaccggcacattttggaactgggctactttgttaaggttaaagtcattcgtcataacgatgccatccagcaatttagcgagcttaagcagcttgctgtcgacttcggtcatatcttcgaaatcgccttcatacatctcaatatgaatgtctttatccttttgcatggcattgagaatatccaatcctcggcgaccacgcattcttttcatggaatctgcggagtcggagattagctgaagctcatgcaaaacaaaattgggcacgagcatggtgccttcgataaaaccggttttggcgatggcctgaacacgaccatcaatgatcacactggtatccagcaacttgtacttgcggaaatgatcgccgactttacgttctaacacctgatcattttccgtatctgcagttcggcggttacggaagctcaaaagccgccgccattcttcgctgcgtgtcgtacccacccgaaaacccaagtaaccgaataatagcatgatgatgagtggtaggaagatattcagcggtgcaacgaagccatagaacggaattgaaataattgccgccaagatcaagccgataatcgtggataagctgccgaacaacaagtagcttggcgactttgtgttcagtgtcttctccaacactttcaaccgacctagaatccaaccaacgctgaggcttgccaacagcaggaaaacaacgccgccaatcaagccgtcaattaacagattgttcagaaaatggttgtctgcccagccgatcaaatcccaaagcggcggcaaggtgcccatcccgaccccaatgccaatcaggccgaagatgatatagataattcgtttcttcataaaatgaccccctttcttagtttaattaaagaccttatgcagcgcttcggcaatgcttgtaacaccaatgacttgaatatcttttggcgcatgccagccttgcaagttgttacggggtacaaaaatccgtttgaaacccaatttggccgcctctttgacacgttcttcgatccgattgacgcggcgcacttcccccgtcaatccgatttcaccgacaaaacaatctgtcggtgaaatctccttatctcgataagatgacgcaattgccacagccatggcgaggtcaatcgccggctcatcgagtttcacaccgcctgttgccttgagataggcgtcctgattttgcaacatcaagttagcccgcttctcaagaacggccatgatcaagctcacgcgattgtgatccaacccactgctcgtccgtttagcattgccatacatcgttggactgatcaaggcttgaatctcgactaagattggtcgggtgccttccatcgaaacaaccaccgcagaaccggttgcccccgccaagcgttcttccaagaagatttccgagggattggcgacttcctgtaacccgtcttgatgcatttcaaaaatgccgatttcattggtcgatccaaatcgatttttgacagatcttaagattcgatacgtgtggtgcatgtcgccttcaaaatagagcaccgtgtcgaccatatgctcaagaatcttcggcccggcaatcgccccttccttagtgacatggccaacgatgaaaatggtcacgcctttggacttggcaatgcgcatcagttctgccgtcacttcacgaatctgtgccacagaaccgaccgctgaattcatttctggcacattcatagtttgaacggagtcgatcacaacgtaatccggctgcatttggttgatgacgtcttcaatactcggcatgtcggtttcgggatacaagtacatccccgaatttgccacgccaagccggccagcccgcattttgatctgactggcactttcttcgccagagacatacaaaacggttccgccggtattagccaactgccctgacacttgtaatagcaaggttgatttaccaatccccggatccccgccgatcagcaccagtgaccctggcaccactccgccgccaagcacccggttcagttcatctaagccagtcttgacgcgcgtttctttggtgatcgtcacatcgttcatccgcgtcggctttaccttactgccggctgctgtttgtcgcggcacagacttgcttgaactgacggtttcttccactaaggtgttccagccgccgcaatttggacaccggcctagataagtggctgaaatatagccacagttttggcaaacatattgtgtttttgctttcgccatattatcccttcaatagttacgctttatcggttgaaccgaacccgctttgtcgcttggctaggccgccttcatcgccgtctgccaataagaatggcatgaaaataccttgaccgatacgatcgccttttttaatcacgacatcgcgcgggaaaaaattaagtagctgaataaagatttcgccttcattggctggattgttatagtaatccgcatcaatcacgccaatcccgttcggcaacaccaagccatgcttcaatggactgctcgaacgattcgctagcactaaaacttcattgggctgcatataggctttgatcccagtcggcaccaagtaaggtttcaacaccttcttagcgcgctcaaagtctttattggtcagtggatgctcatttttaatcaagcggaaaagacggataaagtcgtaccgccaaatacttcttaagacgaagtcctcacgtgcataaaagtcgtaaccagcggcctgcttcgtctgccgggtcggcaaagttaaatcttcatcttgatactttgaaacaatctcaaaacctcgggtcttcatagctgcctccatttaaatagtgtccaaagtatcataccatgcgggcacatggcacggctatggtgaaagggcttccctccttgtaattataccgcgttcctgatagatttggggtagtagacaggttattaaacaggcaaacatgtaagcgtctgaagctgcttaagaatcctctaaaagtttacctgtaccatcacgaattgacccaaggaggtgccccatggaattccaacgagaaccaggtcgtttttttaacacggactgggacggccgcttaatggccgaagtcacttttcaagacattgatgacggtcacgcgtgggcggttgaccatacgtttgttgacgaaagcttgcgcggtcaagggattgccggccagctgattgaaacagtcgtggctgcagcccgcaaggaagacaaaacgattgaaccgctttgttcatacgccgtccatgctttccacaatcaccccgaatatgccgatgtcttgcggccaacaaaagaagcttaatcgtccgccgtaccgacatcatcacagcaacaaaaaaagccgctatgagcggtttttttggtgagcgcaagcagactcccttagaaacctgcaaccgggtaataggcgacaattgtctatgctagccgatcattccagcgattcttcttagttggcaacaggaagtaaatcaataaccagatttggccgatgattggcacataccaaagcaaaacccaccaaccacggcgatccgtgtcatgcaaacgccgaactgacagcgaccaattggcaataaaaataatgaaattaatcagtgatgcaagaaaggtttcttttccaggctgaaaattcaaaacacgcgtgacgttcatgccaaaaatattaaataaaatcgtcatgatgacatagccaacgataacattaagcaaccacggccaccaaaattcacgccgcgacgccgtgccagaaaagttgcctaaatgcttaaaatagttctgatatgccttaaccataagcttaaacccacctaactagataattgtatgtccaaataatactggacatagtctaaattatacttttagtaagtgcttattaaaagtaaaataccccgaaacttcttcttctgagaatctgcaacattttgttgaatagattaacgagcttgtgccactcaatgatccattgattttccatctttaaattcaaattaaaatgaggtaaggtttctttaatgcaataaaaaggagatcgcctatgtcagaaattacatttgatcaaattaaagactttcaagcccaactagccaaacagccggctgccggcgccacagctcgtgcggtgcaaaacgttggcccacaagctgcaagtcgcgaacccattgacggcgaagatatgaaaccggtcttttctcttgatcttgataccggtaccgttgctaaccaaaagaaaagtggccgctgttggctctttgccaccctcaacaccgttcgccacggcattgctgatgaattcggcattaaggacttcgagttttcacaaaactacaacgccttctttgatcgtttggaaaaagctaatttattttatgaaaacattttagcaacggccgataaaccgcttgatgaccgcgaagttgccgattatctgagtggcccggatcaggatggcggtcactatgatcaggctgaagcactgatcgaaaaatacggtctagtccctaagtcaatcatgccagaaacctacaacagcgaaaaaacggttgaactcaacagcgttttgaatgagaagctgcgcaaagatgccaaagtcttgcgtgagttgaaacaggccaacgctggcgatgacgccattgccgcaaaaaaacgcgaatttctcagcgttgtttaccgcattctcgcttacacttttggcaacccgccaacccaatttgactttgaatatcgcgatgataagaagcagtaccaccgcgacaccaacctgacaccgcagtctttcttcaaaaaatatgtgaagtggcattttgacgattacgttgtggttgcgagtgatccggagccgaataaaaaatatcatcagctgtataccatcgcttctgcgaacaccgttgtcggcggtcatcccctgaccattctgaatctaccacctgaccagttgaaaaaactggctttaacccagctacaggccggtgaagccgtttggttcggcaatgatgtgctcgctgatatggatcgcaaatctggcacgcttaaaggcgggctgtataactacagtgacttattcgatctggatcttcatttcgacaaaactgatcgaattgtgaccaccgaagcagaaatgtcgcatgctatgacgctgaccggcgctgatgttgttgacggcgaggtcaccaaatggaaagtcgaaaattcttggggcaaagacaacggtcacgatggctattttgttgctgatgcatcttggttcgaccaatatgtttatgaagtggtcgttcgcaaagatctgctcgatccagctgatcaagcagcacttaaagcaacaccaattaacgtaccagtctgggattttctgaattaaattagacttgtatgctagactaatgatgttcgacaaaggcagtgcacctacatgctagctcatgctttcatgaacgcgcttgtcttcgtcttcataacgcgcttgcagtcgcagaaacctgcacatttgggttcaagcccgcttatgctccggcttctaagcgcttctgctcgcgcttaactttaacgcgctcgccagcccagaaacctgcgtgtaaggacctcagatgcaatggccaaaaccgggccatcacatctggcgccgcttacactccggtttctaaccgggctggctcgcgctcacaaaaaaggagtgtcttttaatgtctgcagaaattaccactggcgatctggctcaattcaaacaagatctccaagccacacccggtgcatccgctcttcaaaaagcggtcatgaacaacggtatcaacgcaactgctgagaacaccgacagcaaagttgccatgaccccgactttttctattgaacttgataccggcagcgttgccaaccaaaagcaaagtggccgttgctggatgtttgccgccctcaacacgatgcgtcacggcattcaagcacaatttaaaatcaaagacttcgaactttctcagaattacaccttcttctgggacaaatttgaaaaatccaattatttttatgaaaatgttctgaaaaccgccgatcaaccactcgacagccgtaaagttgcctttttgatgaccacaccacaacaggatggtggtcagtgggatatgttgtctgctttgatcgaaaaatacgggatcgttcctaagtccgtgatgccggaaacttacagctcaagtaaaagtagcgagttgaacggtttgttgaacttgaagttgcgcaaggacgccgttgcgcttcgcaaactggttgctgataaagcaagcgatgctgatattgaagcagctaagcagaaaatgttagctgacgattatcggattttggcttacaccttaggcaacccgccgacgaagttcgacttcgaatatcgcgatgatgataagcagtatcatattgaccgcgaactcaccccgcagaccttcttcaagaagtacgttgcgtggaaccttgatgattaccaaagtatcatcaatgcgccaactgacgacaagccatacaaccatttatacacggttgaaatgctcggcaacgttgtcggcggccgcgaagttcggcacttgaacctcgatatcgatactttcaaagccttggccgttaagcaactcaaggcaggcgaatcagtttggttcggttctgatgttggtcagagttctgatcggcaattgggcatcatggataccaacatctataagaaggatgatcttttcaacaccgacttcaccatgaccaaggcggaacgcctcgattacggcgaaagcctcatgactcacgcaatggtcctcaccggcgttgacattgtcgacggcaagccaaccaagtggaaggttgaaaactcttggggcgacaaggtcggtgacaaaggctattttgtggccagtgattcttggtttgacgagttcgtttaccaagttgtcatctccaaaaagtacctgtcagctgacttgcaagacgtcatcaagaacgaatacgacaaaccaaccgttctggccccatgggatccaatgggtgctttagcttccaaataagtccatacgaattggtaagctgtcatattgcaaagcctcacggtcaatgatcgtgaggctttttgctgttcgcaaaccccttgcgaaaccatcaaaaaatgttttgctagttgacgtatcgaacttttttgattaaagaaaaatgtggtattctggtgacacatcgtaaccacgcgttttttgataccggagtcatctcagaaaacgctcactttggagggcaatgtatggggacacaattcgcctttgactggcgccaaatcattcattcacgaaaaaacatggccgtactcgggttgttcatggccgcttttatcgtggcgtttttcgctttaagttggaccaaacggctcgatgtcactcaaacatcacaagcaacagccaacgccgcgttggccaactatgctgaatataatctggacacgttgagtcaagcacaaaaaccattattggctaatcttgacgcccaaaattcagcaaccggcgtcattggcttgggcctgcagcttgatgagcctgacactacccgtaatgggctgcttagtttacgtacggcgcagctagccatgcgccaacatcattacaaagcgctcaacacgatgccgctgccaccgttgcatcagcttactggcgatgtgcggagcctgaacgttttaaaatctgaaggccggcctgctgcaacaagcgttagcacaagtgcttcttatattgttttggtgttaccttatctcggctggatcactggcgccgctgcgatattgctcagtttcgacagttggatcgagcggcggcgacaccggacactcatcactgctcgtcctttgacagctggccttgcggggagcagccgcctactaatgcttactgggttttacatcttaacgctgcttgccggttttgctttgatggttgcgacaccagccctgacagctggcctaggtgacttcaattatccgatcgctgtcatgggtacagccatactgccattgtggcaatacatacttttgtttggcggcctgacaatcttagccggtatttggctcatcagttttagtatgctagtcaatacttggatcaccaacgtttatctgaccgcctttatcgtcatggcagccggattattgccagtcatgctgccacagctcttccatttcctgtggttcctgccaatgccatatctagacagttacgcgacattaagcggtaccttagtggatcgcttgaaccagccacttgctagcgtcgtcattggcactggtttgctgtttctctggacctttgttaatctctttatctttggcatacgtgtcaaaaaggaggcagcatgatggcttattttcgttttcagttccaccagctgctgactaaccggaaaaatctagcggtaattggtatcgccttagttgccctgatctgccaatttgtctttttcccaccgaacaccacaccggtcgagttaccgacagcaactgttttaacccgtgatcgcgataaaaatattgcctttgtcaacgaatcgcacgggcctaataccgctgtgtgggtgccatcaacacgcgaatttgctaagcttgaaacccagatgttaacagcgcaaaagcaaggaaaaaataaagcttacgttcgcgcaactatcaactatctcggctttttgcgaagatatgctgctaatcccgatgcccaaagcagtccgttccattacccgctcacctattattacgaaaatcgtcaatatcccgatgctgatgctgcttacgctaatgttgttttaacgcaatcactaatacctttggcaaaacaagcacatccagatgtatcgacaattcatcagcaaacattctggcagacacttttccgcggcgcactgggtggctggctgacagcgttgttgctcatcaccattctgcttgcgaatgatctgctgaccagcgagcaacgtcatcgcagtattgcgcgttctttgccacttagtccgtggcatgccatcaataccaaaacgctgacggtacttggtaccctcgccggggcagtcaccctgctaattggtgtgactgctgtatgtgtcatccccttccatggtcttggttcactaaccacagccatcagtaactttgccaaaaacgggtcttacgcttatgttcagccactggcacttggttctgctttactcatgatgcttggtttgactgtactgctcatgtggctgttcattcgacttaacttgctttgccaattgctctttcacaacgaattgatcggactggttctcagcgccctactgctctttggcgaaccgctctatttcatgcaaggtctagccttctccgtaccgcaaacagcctactatctgcctagttacatgaatccagcagccatcgtcaacggcctacaaaatttcagatacgataccggccaaatgacaccgttatctggggtcatcgtgattggcagtgtcattgtcctgctagaaatcatgctgttcatcgtgacacatcgccgacatgctgcgacggttaaatagagcgtgagctggcgcggttagaaaccagcgtgatgcgtacgcattttacaggagggtacatcatggaattgcaactgcaaaatcttgcattaagttttaaaaacaaacccaacatcattcacgacatcagcctcaccatgaatggcggatcaatcgtcgggattgtcgcccccaatggtaccggcaaaaccaccttgctgcgcttgattctcaatgatctaaaaccacaagcaggcaaagtgctggtagatggtaaaagttatggtagtcaaaaacaaagccttgcgctgcaccggcagatgtgccttttcccagttcaagatgatctttatccagatttatccggcaaagcgcacctcgagtattatgccaagctgtggcacaatcgttcgaagagcgtgaaacagattatcaatgtgctcgacatgcgggactacatcaatcaaccggtgcgtacctattcaatgggcatgaaacagcggttatgttttggtatggtcatggcggctaacaccccgatcatgctgttggatgaatttatgaacggacttgacacgatcaatgttgcgcgaatgtctcgcattttgcgcggcttacgcgcagaaggcaagctgatcattaccgtctcccacctactgaataatctgcaagggtatgccgacctcatctacttcatgcgcgatggtaagattatcaaaaccattgaccaacacgaacagcagcctttatatgtgcaagttgctgaagaaaacgccagccgcctaccacgcatgccatgggaacattaccccaacggcatgttggtgctgccaatccaaaaattgccaggtgagcatttcaatcaactactgttgggtttagcagcccaccatattcccttcaaacttgggccactcgatcttgatacttatttcaacgaattttacgaaactgatcaatgaaataaaaacaacataacgtaactcatgccgctgtttcttattcattagtggccgacaatataactaaatttattattcaggcgaacgaatgccgcaagttcgccttacaatatgtcgtgattctgctacaatgacggtattacttttcaggaggctcaaaaatggcgtcaggcttgactgctaataagaaactgcgacataaaattactgccgcggctttactggtaaccctcggtgtcgtctatggcgatatcgggacgtcaccactatacgtaatgaaatcaatcgttgctggcaacggcggcatgggacattttgatactgactttttggtcggctcagtgtccttgattttctggaccctgctcattatcaccacggttaaatatgtcttgattgcattacgggctgataacaatggtgaaggcgggatctttgcgctgtatacgcttgttcgccagcgtgctcgttggttggtactgcccgccatggttggcggtgctgctctgctggcagatgggatgctgacaccggctgtgaccgtcacaaccgcgattgaaggtttgaagggtgtccatattaacggcaacatcttaatcgacaatcagcaacaggtgatttgggtcaccattttgatcattaccttcctgttcttcattcagcgatttggtaccgatctgattggtaaggcgtttggtccgatcatgtttgtctggtttacattcttaggcgttgctggctttattgccttgtcaaaggactggtccatgttgcgcgccttgaacccttattacgcactccatttactggtcagtccagacaataaaatggggctcttcattcttggcagtattttcctagcaaccaccggtgctgaggcattgtattctgacatgggccatgttggtcgcggtaacatctatctcagctggccatatgtcaatatctgtttagtgctcaactattttggccaagctgtctggttggatcaaaattcaaaagtaacggcgttcaacaagattaccgacttcaacccgttctttcagatgttgccagaaagcatccggttaggcgcaattattttagcaaccttggcggcgatcatcgcgtcacaagcattgatttccggctcttatacactggtttccgaagctattaaactgcgcttcttgccacgactgcacatcatttacccaacaaggttaaaggggcagctttatattccagtcgtcaacaccattttatggttggcttgcttagcgatcattggctacttcaaaaccagtgctgaaatggaaggtgcttatggcttggccatcaccattactatgctgatgaccaccctactgttgtaccaatacctgcgttcgcgtcatgcgcctgctgtgattgcgatcgggacattgatcttctttagtgccattgaaacagtcttcttcatctccagcgcggttaagttcttgcacggtggttatgtcaccgccatgatcgcgtttatcattttggccgtgatgtatgtttggcaatacggtggcagaattcgcgacgataacacttatcgggccgaaatggcttcgctttttgcctataaaaatcaactgtccgaacttcgcaacgatccagattatccaacatacaccaccaacttggtttacatgacccaaattgcgaatgaccattacatcaaaaaggaaattctctactcaattttggacaaacggccaaaacgcgcacgggtttactggtttgttactgtcaatgttacggatgaaccgtataccgccgaatatacaacggatacgtatgggaccgattatatggtcaacgtccaactctatctcggcttccggatggaacaacaggtcaacgtgttcttacggcaaattgtcaatgacatgatgcgtgaaggtgaattaccaacgcaaccgcaaaaatacacaaccattccggatcgacaagttggcgactggacttttgtcttgctgcacgaagagctttcaccgcagacccagatcaaaggtttccagaaggccatcattcaggcgcggctacgactccagcacatcgcagtttcacccgcgcaatggttcggcttggaatatgcggataccatcgatgaaaccgtgccactggttcttggtaaaattccgattaccaaactcaatcggctaacgcgttcccaagcagaagctcaacccgaagacgaagacgattgagtcgcgttactaaaaagaagctatatctgatgcacagcattctgctgggcgcgatatagcttcttttttatccatcaagtcgattttcgttttttgtaaacttgtcatgtggaccagaaaatcgaactttttcgaaactttttactgcaagcggctttatgaaggttgcttcgtctgtttttccgcacgcaacgttgcctgagcagcagcgagacgagcaaccggcacccgatatggcgagcacgaaacgtagctgacgccgatttggttaaagaaggtcacagagtcaggatcgccaccgacttcaccacagacgccaatggtcagttgcggctttgtcgcccggcctttctcgacagccatctgcatgaaggccccaacaccttccgtatcaacggtttggaatggatctgctggtaaaatgcctttactcaaatagtccggcaagaacgagccaacatcatcacgggaatagccaaaggtcaactgcgtcaggtcattagtcccaaaactgaagaaatcggcagcattcgcaatcttatcggccgtgatgcaagcacgtggggtttcgatcatggtgccgacttcgtaatcgactttgattccttttgttgcgactagttgcttgatttgatctgtcaccaatttccgaacccagatcaattcagtctcggagttggtcagtggaatcatgatgtgcggggtgaccttcatgccttcgtcgacaagccggaataccgcatgcatcagggcccgaacctgcatctcataaatatccgggaaggtcacagctaatcgatcaccacgatgccccaacattggattgacttccttgagggcagccatccgttcgcgtagctgattttgctccaggccaagatcttgcgcaacttcactgacttctcggctatcatgtggcaagaactcatgcagcggcggatccaagaggcgaatcgtcactgctttaccattcgcaagccgatatagctcgtaaaaatcctgctcctgcattttttctagcgcttgtagcggcgtcttgcgaccagccgcatctttggccaaaatcaatcggcgcatctgcaacagccgttctggttggaaaaacatgtgctcggtccgagttaagccgataccgtcagcgccaaatgccagtgcttgttccaaatccttaggagtatctgcattggtaaacacggccatgcgacttgcatcttttgcccatgtcaataaagtggctaagctttccttgaccatcgccgccgttgtggtgatttgaccacgatacaaattgccagtggtaccgtcaaccgatacccaatcgccttcgtggagaacagttgacccaaccgtggcggttttggcgtgttcatcaacgcttagtgcgtgcatgccgacaaccccagtcgcacccatgccgcgagctacaaccgctgcatgggacgtcatcccgccacgcgccgtcacaattgcctgactgacaatcataccttcaatatcttcaggcgaggtatcttgtcgcatcaaaataacttgatggccggcatcatgcgccgttttggcatcagcggcagtgaagtagacttcaccagaagccgctcctggtgaagctggcaaaccagttgccaaaacagtatgcgctgccagtacttcaggatcaaattccggatgcagcatgtcactgatcgatttaggtgccacccgcagaatagcctcatgctgattgatcagtccttcattaactaaatcaaccgcgattttcaccgccgcggctggcgttcttttcccattacgcgcctgcaacagataaaaatggccgtgttcaatcgtgaactccaaatcctgcatatcacgataatgttgctccagtttcgtagcgatggttgccagctgatcataaactgctggcatttgtgcctgcaaaacggcgactggctgcggcgtccgcacaccggaaaccacatcctcaccttgtgcattcaatagatattcgccgaacaaggcgcgttcgccagttgccggatcacgtgtaaaggcaaccccggtaccagaatcttcaccagcattcccgaaaaccatggtctgaatgttcaccgcagtcccaagatcttcagggatttgattttcccgacgataaatcacggctctgtggttattccatgactcaaagacggctgcaatcgccgctaacatctgatccttaggcgcctgtgggaacgttttgcctgcctgctcatacagttgcttaaatgatgcaatgattgcctgcaaatcagtcgttgtcagatccaaatctgaagcatagcccttatcacgtttcatggtcgttagaacgtcatcaaacgctttttccgaaaggccgtagaccacattgccgaacatcgcaagcaagcggcgataactgtcatacgcaaatcgcggatcattcgtgagttttgccaaagccacaacggtttgatcattcaatccgatgtttaggattgtatccatcatccccggcattgaaatcggcgcgccggaacgaaccgacacgagcaacggaaatgtctgatcatcgaactgcttgccagttgcctgctccaaggccgtcaagtgcgtatctaattcttgcaacaaatcatctgagagaccgtgattggtttgatagctgtggcatgcagcggtggtaatcgtgaatcccggcggcaccggcagaccaagattcgtcatttcggccaaattagcacctttgccacctaaaagtgcgcgcatctccatgttgccttcagcaaatgcataaatctgtttcatcataaagtcttcctttcgtttaatgtgacgtgatatatgttcgatttataatgtattatttttgaagacaaaatgcaagcgtttacacctagaattggcctaattattttttgaatcattaatgacaacaaaaaagccgctcgcaacaatgtacgaacagcttatgggacaagggtttcaatgagatatttaaaaattcggttttttgtaatttttccaatcacatgggtatcgccaacattttggactaccggcagcgaatcaacattgtgtttaaggagcagtttgctggccgcgatgatcgatgtatcagcggtgacggtaatcacattcggcatgcgggtcatgacgatgctcgctggtaacgttgtatcgcgattagtaaagcttgctcgtaacaaatctttacgcgagatgaggccaactaaagcaccatcatcatctaatacgtacaatgaaccaacgtcggctaaaaacagtttggtgacggcttcttccattgatgtcgtcaatttaatctccgtcggcggcagtaagatagcagcaatagtggtctgaaagaacttttggctatccatttgcaacagattctcgccttgatacgcatagccgactttaggtcgcgcatctaagattccaattgttgtcaacagccgtaaatcagcgcgaattgtcgccaaactaatgttgagcttagtcgccaacgtttcccctgtcatcggactttccgctttcagtagctgaatgattttattttggcgctgggtcagttgcgtgacggccacctcctattcattaatgttaattataacatttttgcgatatatgacgtgatatttcgtcgcgaaaaagtttggcaacttatttggagaggctgaatactagcaaaataaagtggctgggtcataattcttagtcagctattaaaaacgaacggttttccgttattggaaaaccgttcgtttttgacttctcatggattatttattgcgattttaaagaccgtagtgccaaggcggagcaatcgtaggccagatggggctcagccgtgcaaacaacacagcgaccgggctttgtcgctgatgttgttaggcgacttcgagaccgcgggctttgcgggctcgaagcgccgtctccgctctagctacgcgtcgccaccccagctggccggagattgcgtagtttggcacggcaaaaaagttttagcccagcgactttctacgattattcggaatttaatgaatcacaagtcttgcaagggaattatggctcagtctccataattttataaagtttgcttatccagaatgattagcttgtcatccaaggtgtaaacaatcggttgggcatttccaatttcgaccttgttgatgccagcatcgctgatgtcttccataaacttcaccaaggcgcgcagagtagagccgtgagcgacaatgagctgatttttcccggacaaaaggcgcggtgccagttcagctgtccaatacggtaacaaccgttgactcgcatcggcaaggctctcgccgcgcgggatgatcgtggctggataacagtggtaacgccgggttcgactaggattagcaagtaatggcgggtgtgcggaaaaacttcgccgccaacttgcaacctgatccgggccgaacagcttgcgcgtcaagtccttgttaataccacgtaaggcaccgtaatgccgctcattaagccgccaacttttcgtgatcggcaggtagttctggccgatcttatcttgcacgatgtatgccgtcatgattgcccgcgatagcacgctcgtatgaacatgatcaaacaagatccccgtggacgcgattttttccccagctgtctcagcctgtgccttaccctctgcggttaaacccacatccgaccagccggtataagtattcttctgattggcgatgctctcgccatgccttaacaggactaatttaaccacaaaacggcctccttaacccaactagtataccagactgcgcgggcgagtggtaaacgcatcaaatagtgctactttgcttagtttcatgtttgtcattctacttcattgatgaaaccagcggaatagcaatggactcaatggtcaaagcgaagcagttttcttcgctttgactaacacctagcggcgagacggcgttggccttgcgcattagctcgaaattgtgccccaccactctaaccagctcgggcttccggaacaagctcattagaagagaactaaaacccgaaccatccccattttctcactgaaccacgcgaacaggcccagaagcctccacataagggccccccaaagcccagccatttaggcttgaggtcatttacgttccagcttctaactgggccttttcgcgctctgcatttttgccggaaaagctggaaaatgataggctactatatatacgagatcggcgaaggcttgtctctttgcctttagaaagaaggatgctcatgacccagtcgcataaatcggttacgatggtcgagctgttctatgatttaatttttgcctatgccgttggccgtatggcgcaagcgcttgcactgccgacacatggtttcattgctccgcgtatgcttggtgagtttttgatgatgctacttgttttctgggtgatttggacttaccaaactgtcttagccaaccggtactttaacaaccaactagcccaaagtctctttactctttttaatatgttctgggtcatcgtcttgagtaccgccatcaacgttgatttcgttaaaacaaaatggtcctttcaattgagcaccgccattttgtttttgagtgttgcgattcaatatggcctgatctggcggcaaaaacatgctgctttacccaaaatttttggtctgaccttaacaattgctggcgcgctggcacttgtatcgcctttcctaaccccatactcgctgtcattcacggtcttctttttgggcgtcgtgggggccagttttgtcccgctgcttttctggcgaacgatcaatgctgccccggtggattttagtcatttgagtgagcgttactcgctactggtcctgctgattttcggagaagcggttattggcgtggccgatacggtttatagcggcttatcactgcaggccggtttgtttttctttgtggttatattgctttttgtggcttatcagctagtttatgataacggccttaaccgccagataaaaacaggcggtttggcagctattcatcttcattacccgttattagcggccatccttagcatcagcacgtttatccacctgtggttgactcaggaattagatccgcgttggtttgccgcggcgattaccttggctttagctgtttactattttagcctgattggctatttgcgcgcctatccaaccagcaagatcgacatcggcttcaagcgttggttttatttagggttttcactcatgatttttggggtatacagcttcatgacggcggctatgccattgccatttatgctaggcttaactgcgtatttgctggccaataccttatatctttggcaattcattctccatcccaacgacccgttgtataatgaaagtgatcaatgaagggagaattcatatgacaacatatgatgtcacattcaacaccgtcgatggcaagtcgctgattaagcgcaacgtggaaagcgaccacgaaaacgcccgggtctgggaggacgcggttgagcgatttgacgccgatcacctctacatcaaaatgaacgacaagacaatggtcagccttttgcggcgtgccgttgttcgtatcgacatgactgaattacctagtgatgtcgaaaaaaaggctaatcgccgagatgaatttcgtaatgccatgtacacattaagtcaaatcgggctgtgacctgattgccgctaagccttgttgccatttcaaatggcagcggggcttttttgatgggatcgttagcagataaagctgactgtgattgcccttaaaaccaattgaaatggcacaaagacaaaaaatcctccgcaacagcaaagtcgcggaggtcatgattttatatttttaaagcacgcttctggctgaattagtcagcatagttgaagtgtgttaatggtgcgtgcttcacatcagcaatcgtcttagtgccagcaagttgcatgatgatttcaagttcgtgatcgatctgctcgaacacgctttgaacaccttctgcaccacccaaagccaagccatagatcactggccgaccaaaggcaactagatcagcaccggctgctaacgctttgaaggcgtgactgccgcgccgaacaccggaatcaaagatgattggaacgcgcttgttaactgcctttgcgatcgctggcaaaacgtcgaaggatgccggaccaccgttcaactgacggccgccatggttggaaacataaatcgcggctgcaccggcaccaattgcgcgcaaagcatcttcaggagactgaacccctttgacgatgactggcagatcggtgtattcggcaattcgacgaacatcgtcttcactgatcttttgagcagcagaggcataaatctcgccaattcctttgcctttaccgtcaccggctgaatacttttccaagttcggcattggaattggaaactggaagttgttaatgatatcttcttcacgataaccatcaacagtggcatcaaccgtcaaaatgatgcccttcacaccggccttcttagcctcatcgagcaagctcttgttgaaatcccaatccttactcatgtacagttggaacaactgcggtgcgccattgctggccgcggctgtatcagcgatggatgttgagctgtaggtactctgagccatcaacccgccaacggctgcaacgccccgcgcagtatctttttcgccttggctatgagccaaaccttgcgcagcagtcggtgccatcataattggcgtcttgagatcaatgcccaagaagttggtggacagatctggagaatcaatgttggacaatgccttaggaacaatctgagcgtgattaaacgcctttgtattttcggccaaggtccactcatcttcagaacccccgacgatataaccataaccgccagtaggaataatcttctttgcttcatctgccaatgacggcaagttcaaaatgttcaatttcttttctgcatcgctttgttcgtaaccattaacaactgtcatgtgtaaaaagcctcccaaaattgcttacttatcagaacacagacaagtgtatcacttataattagtaagtaaagggattttgctaattttttgtaagtgattatagtgcggctttgttcctacaaaaaaagaacgccatctgtcggcgttctctctggtttgaccaatcggagccacatcccccgatttagtcctcttttttcttagtcttatctacaacgtcattgaacttctcggcaactttatcttttgcttcgccaagtttttctttcacgtcgccagcaatctgttgggccttacccttagcttcggttgattcatcaccagttaatttaccagcggtttctttaaccttgccgctaaccttgtcttttgctgcatcataatctgtcatatgatttcctccttctttgcttaatttaaggataccaagttgacattatgccatgccactttggggctcacgcaacctctaaggaaaataaaaaagtctgtacaatcggcgtacagtccttttcattacacgctagtgacgtgcacccggtcgtttttcttcaggcgctggcgggataaccgctttgccgccttttttaatatgcttgtagttcacgaccgtcttattcttcatatcttcaaccagtgaggcatcatcaggcgaaaaactgtcgattgtcagcattgccgcgttggcatagagcttttcaaccgtgcctttgaaactcaatggcacatcttttgctttacgaactgatactttatcaccaataacgatttcttgtgacacagaaaaacctccttaaaggcattcgccagcaaattcgccgtgcgggcttaacttgctggcgggtaagtgcttacttggtggcctgcactttcactttgatcggtgcatccaagtcaaccgaatcactgaaatgttgcaacaaatagcgctgcatagcgtcgcgcgcttctcgcttagtcatctgatgacagacccgggaagaatcgtgccgatgcccccatttatccgtatactgaccaacgacttcataatcacgaagatgtgctgcaaataacatgattcctcttgaccacctttattaattgtaccatgagtcggcacacgtttttgtatcacaagaagcatttatacaccctagaggcatcagtttcaactattctaagaaaaaagtttataaactgctattgacaacgctggtggccttgatcttgcggctttttacggcagcactcgatgctgtaatcctcattttagaggccatgcaactaacttcgtcgttagctacccgacactttctttaacttgattttgtgttgttgctaactgcgtcgtttgactgcgtttcatgcgattgaatgcaatgactgtgcgaccaattaaatcctgtacgtttacttgatcctgcggcgcataatcaagaatttcgaccaatgcagaattttcatagcatttctgaatgcgaccaacaaaatcatgttccatattgccattcgcacgacataaaacgaccatgccttcttttgcctgcttcatgattaagttcccccttgttatgtgttgagctaaggttaacaggccgaaagttttatcgtcaacataaatgatcaattatatataaattttcataatttcgtcacaatcccgccaaaaggcagttgaatgcgcttttattttttgactttaattaaaaaagttctcaaaatattgacaagtcaaccgcctctttttactgaaaagtgttgctttcatcgattgaaaagtcgataccacttgcaaaaggcgccctgcttcagtattgacatcttcactgaaaaagccaacgataagaaacaatagactccaaacaaggcgatgattttcatggataggcacatttttggtgcaactttctcttcactgcggtcaaccaatttccgccgcttctggattggccaatgtatctctgtcatgggcacttggatccaacgaacaacgcaaacatggttggtctatcaaatgaccaaatctgcatttctggttggcttgctcgcagcggctcaatttgttcctatcatggcactcaccttaatcgccggtacgctcattgatcgctaccccaaacgacggattcttttgatgacccaatttggttttctagtcttgggtgctgccatgacgatcatcacttttctaaaaattgttcaatactggcaaattctggtaattgccttaggctatggcattcttcaaagttttgatacgccaactcgacaatcctatgttattgaacttgttggcaaaaaagacctcatgaacggtatttcattgaactcttccattttcaatttggcaaaaattgcgggtccttccctagccggggtgctcatggtcaccataggagtggcgccgtgttttctagttgacaccttgagttacattgccattattattggtttattgatgattcatcagcagcatcctgttgccagtcacacaccgcgccacatcattgctgatgtcaaagaagggcttgcttacatcgtccaccatgacaacgttaaattaagtgccgaattaatgatgattatttgcacactgaactttaacaataatgtcatcatccccatctatgcgcaggaagttttaggccgtggtgcacaaggctatgccaatctgctatcagcaacagggattggctcactgattgcagcgttcctcatgagttatctggctcggtttggcctacgccgcgatttataccttctagtggcattagggacggccttggttcaatcgctgatgatttttgttcacgtttattggttggcgatgatttttatggttgtcattggattttgcaacatggttttcttgaatcaatccaatgctgcttttcagttctctatccccaatgagttgcgtggccggatcatgagcgtctacgttctgctcaaccaaggctctacgcccattggcagtttatacgtcggtggtttaatggacatggctggcggcctgtgggggtttccttcctgtggtttgttggcgttgctgttaaccataccgatcctgcttagccatcaaacaacagttaagcattggctccatgcttagaccgtaaaaaatggcgttgacacaaactatctgtgatcaatagattgtgccaacgccattgctattcaaaataaactttcaatttttccggatctgcccattgcccaaaacctgatacttaatcgtggtcagtgcggctaatcccattggcccacgagcatgcaatttttgtgtgctgatgccgatttcggcgccaaaaccaaattcatagccatccgtgaagcgggtcgaggcattcacgtaaaccacggcggcatccacctgctgtaagaactgctgactattttggtaattgtctgtgataatcgcctcactgtgctttgtattatgcgcattgatgtgttgaatggcttcttcttctgagtcaacgaccttaacggccataatcaggtcattgaattccgtatcccagtcttcagcggtagcagcgtgcatactcggcacgatggcgcgggcacgttcatcgccgcgtaattcaacgccatgatcttgcaaggctttagcaatgactggcaactgttcatttgccacatcagcgtgaatcaaaagcttctcggctgcattgcagacagatggccgttgcaccttggcattgacaacaatcgccaccgccatttgcaattgggcatgggcatcaacataaatgtgacaattgccagctccggtttcgatcaccggaaccgctgcctgttcaaccaccgctttaatcaaccctttgccgccacgcggaatcagcacatcaatgtagccgtttaagtgcatcatctgagtggcaacggcacggctaggatcggtgatcaattgcacggcatcacgcggtaacccttttgctgccagcgcatcttgtaaaactttcgccaacgcaagattgctgtgtaatgcttccttgccaccgcgtaaaatgaccgcattgccgcttttaaaggtcaaggcagctgcatccaccgtcacatttggccgtgcttcgtaaatcatgccaacaacacccaatggcacgcgtttttgagcaatcgtcaagccggcttcgttcacccacgccctgtccgtttgcgcagtcggatcatccagtgtggcaacctgtcgtaccccagctgccatgtcggcaatgcgtgccttcgttaacgcgagccgatcaacaaacttttccggcaaggcgctcgcagctgcaagatcagccttatttgccgccaagatggtatcggcatgcgtctccagcgcagccgccatcgctaacaagccggtatttttctgtagtgtcgtcaattggccaagcgtcatcgccgccgttttggctgcccgccccatctgttcaagatcaattgtcgttgcgtccatatcatcggtctccttttttagtgcacgcgagcaagcttctgcgtctgccaacgtgatatgagccgtttaaaagtgctactaaaacctactattgaaaactttgactgacacttgctgcttgtttgggctgaccgaaccaagtaccgactgggtcgccggccaagatttgtaaaacaatccgcggatcacgaccactagcaagcaccatttgtttgccagcaagcatcatcgtcttggcggccttcagttttgtcaccatgccgccggtcccgaagcgcgtcgaactgccgcctgcagctgccagcactttggcagatagctgcgtaatcgtcggcatgagcgcagcatccggatggcgattcgggtcacggtcatacaacccgtcaatatctgaaaggacgaccaacaaatcagcgcctatttgcttagccactaacgccgacaattggtcattatcaccaaatgtcgtgcgatgatccaactcgtcaaccgctacactgtcattttcgttgatcaccggaatcacttgctgagccaataacgcatcaatcgtgtccagcacatgctgacgattcatcggataatcaaatacatcatgtgttagcagcaattggccaattttcgcaccataatcactaaaccgctgtgtgtacaaggtcatcaattccgactggccaatcgcagcaagcgcttgttgctcggcaatgacagctggtcgcttcgacatgcctagttccgccattcccacgccaattgcgccagaggtgactaacaccagctcatagccttgattattcagcgccgtcaaagagtatgccaatcgatcgatggtttgtaaattgactttgccatttggatgaatcaggctactcgtgccaatcttcactactaatcgtttacattgcatcgcccgttttgccattgctacctccgctgaatgcatacttgtcgagaaatctaatctatcaaaaaaagcaccgccttgatcgagacacccgttaaggcggtaccattctcgttcaaagcaatgctttgcgcttttatcgttatttaagttttgtgagactcatcatacaagcttggattcgcgcacatttcaggactttcagcgattgtcctgatctctgtgaggcgctactatgacttgatgaagtgaattgtatgcgggcaatgacgaaaagtcaagcgcaggtattccgaagcgttgattaccacttatacgcacgcctcatcgttactcaactccgagcaaataattgcctaaggtgtgcccctagaagaaccaagaacccactgagactgccacaaactaagataaactgaaaaggttggctaacccctttaaagaaaagcaggtagcaagccaccacgataaaactcacggttaaaagcaacgcatttgccattttgttttgtttctttttcgcgcgcatcaatcattcctccaagaactgcaaaagattttaaaacgacacaatgctttcaaaaacattgtatcgtacaagaaagcatctaagcgggttcaaaaataaacgttgtatttgcgccgataatcgtgtgtcactgctatctcaacaaccgaaattcagcggggattaaaaactcttttccgcatcaagccagccaaccatttactgaaataaggacgaaaaatataaactaggcataggcagtgtcaacaatcgctcactgccgcgtcaccgccacccgaaaagcgtaaattctaggcagttcctctcctgtatgaatggcctgaccattggccgtgatgccagtgcgcttcacgtgaatcttgacaggcagcggcattttggtcgcatatggccgcggcaaaagtaggcgctcactgtaaaaagtcccaactggtaggttcttggcgatggcaacaataccgtgccgatctgcttttaccttataggcttctttagaagttaatggattcccaactgaccgccaatgaccatccgttgttcgatagcggcggcggcctgaactgtcgaatcgataaaaagcaaagatgccgccagcaagtggttgctgcgtgccatccggaaagacggctagttgttgaaagagtggtctaaccttcttggcctcataaactgcggcaacatgattggcttttaatggcgtcggctcactttccgctgagccgcttggcatgcccaacatcaccagcagcatgccaagcgccgccagtccttttatcccatattgacgcatccccacacccccaaaataagtcaattaatattgtaataataactttatcattttggccaaacgatgtgcgaacaaaacaggtgttattaaaattgctagtttctgagacaaacaaaaagcagtttccgcaatcaccttctgattgcaaaacctgcttttggcttctctcttactgtcaagccatgcaattactggacttggccttttttaaccaacactggcaaaataatgacccgatccatgtaactcggacgatgcatgaaggagcctgcttcacgataagctttggcaccactttcaaagatcatcgaaatgtgcttctcagaaggatcaaggctgatttcttcaaccgagtttggcacgttaataattttagatcctgactttggtgcagtgaagtctagtttagtccagcttttattgcccggaacccgaatccagattttgcctggtgcgctgccatttgactgactgagcaacgtcagcccacttttggcaatggcaatgccttgaagccgatcccagccattgttatacgaattaatgactttcttttgaatcagcgatttaaagaccatgttaacttcttgatcgagtgttttgccggcaaactttggtgcaagttccaaagcccatgctttcatttgcttcatcgtgatgggtgctggcagcccatttgcattgagcggtaaggcaaggatcgaacggttctttttgttctgaccatatttaacaaaaaccaattgattgttatatagggcaatcgctgaggtccgtcttgccaaatgaagttcaatccgggttgactttatcggttgttgcgttgctttagccgaataggcatcgatttcgcgctgtgacacataactgataccagcacctgttgtctgcgcggcatcatcagaccaaagcagccgctgatggtcgatgtcgtaagtgataccgccaacgtgcgatttactccttaaaattaaagttttattgtacttagcattatgcttgttcacctgaacaatgattgaattcagtttgtgattaccatcatacaagctcatatagatcgcatctttggactgggtgaccccctgaggcacccagttattgccaaaacccgcttttttggttttagcattgatcgaccaagcaccgcgaagtccaggaatcaccactaatttggcatcggtggccgcgcgtttttcaagcggatctgattgcccgatagctttaatttgcttaattgccgcgcttttggactgcaacggccgcggatcagcttcccattttttaacatcacttggctgatcaactaactggctgtactgataatgatcaatcaacgcccagccgccaaagccaagtgcaacgataccgatgactgacaataccgtcacccaaacccattttttaaacatgcacacactccttcatatcagaattataatatacctgaattaaccacgcgattatattacccggtaattgccagaaaaaagcaaaaggcggccttgatcgttcttgaaaaaccgtatcacttttttgtcgaatgctacttcaggaataacttttggccatgtcacggaaaacaggtcaggacatctttctcagtcggcaaaataaaagcgaacaaatttctacttaaaggaaatttgttcgcttttgcctgctcataggttatttattatgattttaaagaccggagtgccagggcggagcaatcgtaggccagatggggctcagccgtgcaaacaacacagcgaccggtctttgtcgctgatgttgttaggcgactttcgagaccgcgggctttgcgggctcaaagcgccgtcacagcgttccagccccagctggccggagattgcggagtttggcacggcaaggaaattttagccaagcatctccctgcgattattcggagtttaatgaatcacgagtcctacgttggaattatggtgcaccctctttttcacaaaattggtcaatcgaacttgtcttcctgacctttcatgacctgcgctgtcggcgcaagtaatggcgggctaaccagacgatcagcacagctagcagtagcacaccgccgataattgcagcgcttttccaaaagcgccattgattagcggcttttgctgcttgtcccaacgattccgtatagggcacgcgtttaccagtgaccaacaagcgatgcgagttgatcatgtatggcgtgcacgtcatgagcgttgctaaatcctggcctgattcaatctgcaagctttcagtctgatctggtttcacagtttgaatgcgaaagaccttgtatgctagtttcttgccgttaacttcaatcagaaactgctgacctttcttgagcttcttcaaccccgtaaagtagcgcttggttggcaagccgccatgggctgaaatcactgtgtgcgtatttttaccgccgcgcggataactagtacccggtaaaactacggcgccttgatcaagtaaggtgttgttggtggtatcaaatagtggcaagtcgacttctattttcggaatcgcaattcgcccaattaaatgctttttaacataagcctgcttgactttttgctcactgttaaaggggtcttggccgggtcgcaggccggtttcggcgagcgcgcgattctcagaagcgcgttgtgcatcttgggctgcggcatttttggctgcttcgcgatcggcttcagcacgacgactggtcatgatgacttcattgatcgccgtcgccgcaaaagggtagcagaagcaggcagcccccgcggtgaagaggatgatcacgagccagcgcaacagccggttcgaccctttcgcctgcttagccataggcgatcaggctttcttgccggtttgcttcttcacatagtagccaccgctcatcaagacgatgccgatcagcagaaatgcgagcagtcccatcccgccggtcatcggcagcaatgtgcgtacgggggtgtttgtgatgcgaacgattttctcgccccacgtacctgcaacaatctcaaagtccgtggttggatccgtgatttcatagccatcaggggcatctgtttcaatcaaggtataagtccctggcagcatcccttgaatcgacaggttaaatggctttcctgcgctagtggtcagttcggttgcatcagctttcgttgtcgtccaagtgatcttgcttggggcataagcgcctgtcataccggtgacaccttcaagcacagcatattctgttgcattgccagtttgtcgctgaatgatgaactttgcaccagccaacgacttgtcatcggaaccagtttcatatttgaagaacttcatcccgccagtctgaatttccgggccgttaacagtgattttggtatcaggatcaaaagagacaactgctgtgttcccgattttttgatcaggtaccatcttctcgttcacgatccccgtatagccaacggtcacccgtttaccggcatacttcgtcaacaaattacgaacggcattggcgtctgatccgcctaagaaatctaatttgaagccgaatggatagttgccatgcgcggtttgccatgccgcgtcatttgaggtcatcagcgcgattttgcctgttaagtcgttcaaaatattctgaccgtccacagtcactgcggttagttctttaaacgtcaagccggctttggtcatgtaatccagcacttcaaattgattgtacttgaacacgccggattgattatccgccattgcgccaatatcatggggaatctgaaattggatattgtaagtcaacacatcaccgacagcaacgtcatgtaagtctttagcggcaactgctccgccattgatagcatctaaatgtttggtaaccacactatccttagggtaaagatggatattagttaagtcattgccattcttgtcacgcaccggcagactcacgatcatatcagctgctttttgatagggctgaggcgtccatgtttcactaaaagcataaacgctgagccgaccaccggttttagctggcagttgattaaaaactgccaacccatcttgacccgtcgtgatttctggcgcatttggatcttgaagatttgcatagttgcccagattctgcgacatcatcgccgccgcagtctctttatcgtgtgtctctaatagctgataaaaagcatctgtaacattaaacactttgaattttgcaccgacaactggggttctgccagtgagacctaaatcatggccagtgttttgaatctgttcatctgcagtttgttcaattttgtgaagggtaaatgcaacctggctttcggcagcttgaacggttctgccagcgcccaatagcggtagtaacacgctcatgagcatcaaagcggctaataggccgtgtccgatcttttttatcgtggcattcatgggtggttcctcgctttcttatgcttgatcaggaagtaagttgccaatgtcaggagtcctacaccgatgagaacgagacttaggctttgccagtcagacattgccggcaaatatccagttgcgcctgtgccagtcggtttgtctgactgatcagactggcctgtcggcggtgtcgggtcggattcgcttgaagtgctgctgcgatctgtatagttataaactcggggattaccgatactgatcatttccggtgtcacgatcccgccgatgttttctttcatcggctggccgtcaatcagtacataacggtaattgtcatcatcatctaaccaagagtcgggaatttcgattttaatcgcccgacttttttcgtccaattcataacctggtactgactgtaattcttcaaaataatacgtgcccgccgacaagaatcgttcacctgtgttcactaaaccgtctttgtccgaaacaaatttattcacacgatcatcatgaagagcatcggttgatgcaacccatttgttcttcaagtcagtagctggtgacaagtcgagatatagtttctgaccgtccacgattcggtagatcgcgaaaatggccccggctaatcgccgactcgtcccgtcaggatgaacgccgaatttaaagaagtacgggtcccggacataaccgacgttcttgggataaagatgcacggtcgacattgggtcacctgaagtcggatcttttaccggaaaaacaatcagcatcggtgagctttttctttccatgtcaacgttcagatcggtggagaaatccaacgcggtttcaatcagcagatacgctttctcaaagctgccttgaccagtgtcaactgtgacgcgtccaatcccgtcttcaccaagatttttatcggtggtggtgttaatcaagccaagtcctttattcccttgacctgcaagttgcaggtttgcccgcgcaaacttaagtgcctgcttgcgagtcatattttgatacttttcgatcagtgcctgaacgtcatccggtgtcatatctgacttcaacaaggaactagcatcgtaaacttcaaaattagcgccattcagaccactagttttgctcaacagtttatatccagccttgtcggggttttccggatcaattatctgaccgtcattgtcataccaaacgtcttcaggttgccgcacatctcggtaaatgcgtttatgcaagacaatttcggcagtgttttcagccgcgctgactggctgaagaccaagcagcgtgccaactaataggaggagtgggataacccaccatagcaatcgtagtcgcatcttaacgcgcctcctttcgcttgagcacaatggctagcagtaatccgctagcgccggccactaatgccattagcagaaatagcacaatgccattgccgcctgttttcggtaacaaactctcaaggctgtgattgacgactgtaaagctaatgcgattaaccttgtcgctggcgtccggttggaatttaaattcataatcatcagtcgtcagatcactgccgctgtattttaaatcaaccatggtgccggtttgattgatcgtaaatgtgaatgcccccgccaatttatcgaaaccctcaggtgctttggtttcaactaaccggtagctgccaggggttagctgatgatcaaaaagcaaccgcccttcatcatttgtgttgtccgaagcaaccggctcagtctgaccatcgcgatacagtgcaaacgtagccttggctaatggtttgttacttttattgaccttgagtaactcaagttcagttggtttcaactgattaaccaccgtgttgtcgtcccaaatctccccttgccgtccaatcgtcacgtcaccattttcagcgacaattaagtcaaactctggttggagcaagtgtcctggtgacatcacttcggcaacggtgtactttccggggcgtaagccggtgaaggtcgcctgtccttgggcattggtgaccgcttcctgcaatggctggccagcttgtttcaacgtaaacttagttccttcaagtaaagcgccatgctgattctttttagtgatgctggcgtgaaaacgattcagcgggtctaaatgcacatccacctcgttagtttccttgctatagcgctctttcgtatcgaagaatttcaccaccgcgctgttggtcattgtcacgcgttgatcgatggtgtcaggatcgagggtcggccgaaccttgagtcgcagtgagaaatagccgctgtggaagtagattttctgcacatctgctcggccaatcgtcagcgtgatacgttggcggcccttttcctcagtcacctcaaacgatgaaacgccagacgtcagtgtcatggcccgatctttgttgggtgcatcaggatcagtcgcgttaaaaagttgaaaggcctgctcataagtcggtggcccattattttgatccgggatcaactcaatatttttgggcaataaatccgtcaccgtgatggtcgtcggctttaccacataatcgcccatgttgtacacttcttggttgatgtagtagtaaaaaggatcgccttggtaatgctcattgaccacctgatcattgagatcatttgatgtccaaattggcccctttttatccgccttggcgccaccgccagcaatcgcttgtgcgctgacactcttgttgttggtgacattcgggtcaattaactcaatctgtccgctgccattggcgacccatgtacttccaccgctcgaaaaggttcctcgcttaaacgtgtgactcgtaccattcagcgtataagccacagccccgcggccaaatgttggcgcgccgaggcggtcctcccactcacttagattgtcatgatcaatcggatcaacccagttcccccatgttttcgaggtatagcctttctgaccagtgccccgttcgccaagattctcttgatcaaaaacgtccttgttcgcggtaatccagttaccttcttgaaactgccagtcagtgacataatcagcattgtaagtcgcgttgatatctgactgctcagtccaaacgaactcgcctgggttcaatgatgtaaaggttaaagtcgaattctgattcagatcactttgcggaataaaattcagccgcttgccggtttctttttcataaaagaccacccgccagtcatagtggaggacgttagcgaaggacatcccagaaaagaaattgttcgagaagtcgatgccgacatctgttggcgttggtgcccattcaacgcggcgcacatggatattggtcatttccacataggccccgatctcaaagtgttgatcattcaaatcgctggccgaacctacatgattgatatcgactttaagcttggcatccaaaacattagacaagccatcttcttgggtaatcacgtctttaaaaatgaccgctgttgctgaagaactcggcacataatctgtcgagacattttctttcatggcagtttggctaccgtatttactgcggctgctaccgtttggctttcggtaaatctgagccgacccaatcggaaagtcagaaccatctgccttcgtgacctgaattttggtttcacccaacgctgcacgcggcaggatgagactgtgtgcatccaagctgtctgtgccgggttcgctcacatgatcgttcacgatcggacctggcaacttcagatctagattcagcgacaccacgtgatcagtgccgttgaacccgtctaggttgagcttgaagcttttttgcttttgttcctcactcgagagtttcttcgtcatctcatactcatgtgcagcccaattattactgtcaaacacatgattgatttcaccattcgtgtgagcaggttgtgacaccatatctgtaaatggcgtcacaacgactttttgtgtcctattctcactccacggcttgacgagctttagtttcaccttgatttcagcctgctgcatgtcgtatgtgtaagtcacgacatgctggccgaccgccgctgtccattgcccgccatcgtccaaaacaacatcttgtcgatcaaggcggttggtcaactccggcatctccgttttgacggtttggttctcagaactgctcattgctgcacttgtctgtttcttgtcagactcaattgtgtcttggctaattgccgcttgtccgctcgcatcgttctggtgtgaggatggatcggattttggcgccgcacggtcatgttcggtgatgtttgtctcaccgttgtcggctacagggacaacggcgctgccgacctgggtcagcatcaacatcgccaacatgacgatatggatcaacttcttaggcatctgtgcgcctccttccattgtttccggcgtctctcttcttccaacaccagcttaacaagttgaccccgcgcaaaggaatgataatgttcgttatttaacaagatatttttaacagtgcatacttattgacattataggtattaatctgtacatataatgtaaaaagctctatttataggtaaacaaggtcttcaaacccaaaagtagccttggaacagccggcgtattgccagtaagatccaagactacttataggttatttattcaactaattagtttaagctttgatgattttcccaactgcaattggtaaagtaacgtgggcatcgtagttcatgacagttccttgaacagtagccggtagcttcaaggtatccggcacaccatgaatataaatgacccttttatcgagctgcaaatcgtcactgccaaaagcggctttaaacgctgtctgcaattccttcagatcaacgagtttgtcataagcatagtgaccttctgcatcagccactgggtaactgtcatttggcacatgcatcttggccggttcagcgtcaaatggcaccatcgttgtaccggaaaccggttctgtttctggcagatcaacgaaaccgtcaccattagcatcttgtgccgctgtggcaatttctgctggcttaccatccgggaatccgtggaaatgttcccaatgctgcacattagcaggtgtatcaaacatatcgatatgaatcttcatttgcgcaccatcaatcgtgaacgtcgcggcaccgtgcggcgcggtgccaatcttctcagcgttcaatggcacaatttctgctgtatacttttcagccatgcaaaccactccttttagatttagactcagtttcagcatagtgctaactggaacgactcacaatctattgcatttcaaaagtgaggttgcaagattatttggccaattgcaataaccgttggcgcaaagcaggatcagctgcgtaaagataaagcccatgcttcgccctcttcagcagaatattaatggcattcatgataatcgcggctttagcgtcggtggtgtcggccaaatccgggcgctttttgaatgcttccttgtcttggtactgcgccagatcaaccgtaagtcggtcttttgagggatcatagcctagactcggccctagaatcacacctgcgtaattcaagtcaaagccttgaatagtataaatggaaccaacttcatgcaatgtctcaggacgttgtgcccacggacgatcggtgaagttgatcttgtcccaaggtaaccgcaaagagccagcttggacataccaggttttaccatcgagcactgtgaatggatagtcagctgtcgcgatcatgcgcgaaaggccggtttcggcattgcgccgctgaatgaggtcatacatcggctgaccatcagaaaaaacttgaaaatcaaaatgttgcggatgtggcaaaggcaacacttttccacgaacaaaatgatcaatccaatcattcaccgccgcatcgcctacccgcatctgttcggtcagatgataatgtgtcactgcgtaatcgcgcgtcactcttttcaataaagcaggtgtccaaaaactctttagcttgactagctggtggaaatcgaacacgagcaccaccactcgagccaactgaagaatatcagcaagctgattatgcccacggaatttattatacggatcaggcgtcgtcagtagtaaatggccttcatcgatcagcacgacatctgcccgcttaccggctttgcggtacgcgttaataaatggtgttggtttcataaagtctttctttcgaaaataagactttgtaccagcaatttctttgtaaatcttcagcatttcattgtgatttaccaacaacttgttgtctgtgccagccaactcgccgcttgtcgcacaggcagctttttgcaactgcgcaaaagcagcatccaacaccacacttttaccagcaccggcatcacccgaaatgatcaatagatgtgttgacgttgtgttgtgattgtcgttgataaaggtccaaattcgctgttccaatgctgactgttctgaggtcagtgtcgcatcttgcggcaaaataaacgttgactgtgctaaatctggcatacgaacacctccgttaacaacaatacagcattctggcgtgcaaacgctgctgtgacttgattttgtcggtacttttaaaacattttaaaaaagaacattaaatatacacaacaattaacagcatattacatactttaacccagtaaaccggttacactagagatagtcaatttctcgaaaaagttattcaagaactaggagtattgaaatgccttcaattgctgattaccctcaacgccatagcttggcgtcatttcaacaaacaccgctcactgaacttgatgcgggtttatttgcgcaactcggttatttgaacttcaattacctgatcggccagccctatgcgcgttttgccgatttaaatgacagtacccgcctaaacagggctaccttgacaacttgggcgattccaactcatcagatcatgttagacgccatgcgtcacagtgaacgttttgcccgggttacttgggacaactggctggaaacttgcagccatcgcaacgaagaagacttcgcggccatcacattcacattagcccccggggtttattgtgtcagttttcgggggacaaccaataaactggttggttggaaagaagatctcaatatgagcttcatgccaacgattccagcgcagcgtcgggcattaagttacttgattaaacaaatcagtcagcatcccggcacttattacctgactggccattccaaaggcggcagtatcgccacctatgcgtttgaccacttgccacaaccattagccagtcaagttgcccatgtctatagcttcgatgggccgagcggtgtcccgcttgatccaagccatcgtgaccgtgtcaccaagctcgttccacaaagctccttaattggcgtcagtctcgatccagcgatgaattttgaggtggtcaaaagtcgcgtgaagttgttcggccaacacgatgttcttacttggaacattgccgacacgaccttcgctcacttgccaaccacaacatgggcatcacgctatttccaaaaaacttttgcactttggttagctggccttgatgccaaagccactgcggttaccgtggatgcactttaccgcattttgcgcagtggcaatgccatcaccttagatgatctagctaaaacaaaaaatcattggcgccactatcttggggctttccggcgcctcgataaacatcatcggcaacaacttggccgctcattccgctgcctcctcggtgccatggctggctcgctggttcaaacgcattaagagggtcacaagctcggcagatgccgggcttttttattacacccatggtcgtgaaagctggccaaaagctaccccacattttagcaagtattcaacttatcctgcgcactagtgtcaacaatcatccatcagcaatgtgcatcagaatcgcgtcatatcaatgactctatgattctcagacctctatcaattgaaaaaagcttgtgtaattttattcctgcctcaacaataatagcaggtggtgaaggacatgcaattcagcgacaaactcaaactggctcgccaacagcagcaactcacacaaacacaaattgccgagcaattacacgtttccccaaaaacaatttccagctgggaaaatgcgcgcagttttcctgacatcggcacactcgtcaggattagcgatttttatgatatttctttggatcaactattacgggaggatcagacgatgacagatcattacgacgcgattgacaaacatgcacaacgggatcaaaagtattttcaagttacctattatttgaatgttacccttttcttagtcctctggggactgcaagctgtttcaaacaacttcaggtctgttgtcggttggctcacactcgcatttgtgattaacttgatcgtacttgcgactcactacccagactatcatgcatggattaccggtttgcctcatcgcatattgctttgacttctcattataggagtgagcaccattttctttctcattaacggaaagatcgctaatccccagcaaactaatgccgcttatttaaccggtttttacattggcagcgttgcgaagccactcatggaaacagccggggtcatcttcatgatttttggctatggtgagctaaaagaaactaagtaacccaccagctcaggctgatacgcccaattagtcagcatatgttgctgacttttttcttaaatgtgtatcttgctttacaaggtactcactcacgattatactatgcttaacaaggtaccaaaaggaggttaagccatgcaaccttcatcgcaaatgttaaaaggcattctcgaaggcgccattttacagatcatccaacaaggcgatatttatggctacggattacacgaacagttaggtgcgctgggctttggcgatattcctgaaggtaccatttacccgttgctactgaaactgcaaaaaaataaatcaattgtgggcgtccggcgagcatcggaaagcggaccggatcgaaaatactatcacttaaccgaggctggccaacaaacactggctgattttcaacaacaatggcaccaactgagtcaagcgatggctaagctcaaccaaggaggcacaacatgaaaaagttgaaccaaatgcgtatggccaacgatcaacagctcaaacaaattcacggcacagattacgcttataccgaaacggtggttatctatctgcgtggtgcgcttcgcaagaatccatatgcggttgagcatgcgattagcgatttgttgacaactttgattgatgctcaaacagcaggacgcaaagtctcaaccttctttggcgatgatcctgaaacagcagcagataatattttaaaagaattgccgcctgccccgcttgattattttgtcagcctattctggccttttgccatgtttccgctgattgacggcatcttgatgatggtggtcgatcacgaaacccgcctcttactaaccgactttttccccatattgatcgtttcgttaggcctctttggcatttcatttggtcgaggtatctcgtttaatcggctttctcgtaaaacaatccgtcgtgtcttgatcagcctattcctcatcgttggcttgcctctactaattggctatgtgtcaaatcatgttttcaacctatcgttttctagcaccacactgattcccatctgtggcggctttgtctttctgaatttagggcttgcggcctgctttcggaaaaacgctttattattccttgggtggtcagcaatctgggctttcacggcggcgacgcttttcttgccaatctcggaattatccgttggcttggcctttgttggcctaggcgcctgtttgctgctacttttctaccgtcctgagtcacagtcacatctggaagtatcctgacctgacgatccttatcacgacaacggtgccaaatgctttatggaggctactcatgaaaaagttaaaacaactccgaactgcaaacgatcaacaactaaaagccattcacggcactgactatacctacaccgaaaccgtcatcggctatttgcggactgatttacgcaaagatccgtacgctattgaacaagctatcaatgacctactaacgacattgaccgatgcacaaacagccggccatcgcgtggctgcattctttagtgacgatccgcagaccgcggcggacaatattttgaaggaattgccgcgtgtgcctgcctggtatctctttgatcaatactggccgattgtcatgtttctatttgcatccatcattttcacgatgctagttggccaagagcatcgactttcattaagcagtatcgcggcacctgttgctgtcgtgtttgctttcattggcgttccctttgcccgcggcatttcattcaacaaagtctcttctaaaaccattttcggccttctaatcgcctttgctctttttatcatcgtccctttgctaatcggctatttttcggctaaaacaaatgccttttcgttttcccgcccactcctcattagcctttgtgttggcatcgggctggtcaacttatgtctggctggctactttcgcaccattgctttactcctaattagttggactggcatctggctgctcgccttgctcggtctcctcttaccagcatccagtttaacggtcggcctagcaatcgctggtgtcctgtgcgcaacactactgcttttctatcatcctgagccaaaatccgtgattgcggcaaattaaaaaagcccttgcttgtgcaaaagcccttctgtaggtaggcaagttcatctaaaaatctgagtcaatccccagtctcgatcgtccattggcccaatcttcatataaagtttgttcagtgcgtcaggtgcatccaactgatgcaaggccacgtagcgtgaaatgctgttcttcaacttcacagcaaccatctgatagggatcaccattttgcagatgttgcaatgatgtgaacaacaactttcgaagatcatcctgtttggcaatctcagggtctgcataagcaacatcgattgcttcaaacaattgtgtttcttgttttttcatgaacgtgtcctccttacaaatattcaaagccaaacgctcaacccgccacctccacgcgctcgcatactagcgcctgctaccaatttataaactggctcaagtgcagacggatactgaaagtgatgaacctgcgaataagacgtgatgaagccgtcaaggcgggcagcgacgtaactgaaccgatcaccacgtgccaactgccgtgctgattcaaataaaaaacgtttaatctcatcatccgactgaactgcggcatcattataggcaccatcaatggcctgaaataaccgtgtttcctttccacccaatacgatcagctcctaacgataacggcagtttaacacttcaaaaaatgcggcgcaatgctgaaacggatgaccgatcagccactaaccaccgacatgtcaaacataacggctggttttaatttttcaaattgtcatgtgaactgaaccatgattgattgctgttaccgcccccaaaacactgcatggctattgttagtaaccataccgaatattcgccagggccatcaatgcatcaagcttatccgactcggaagcagttaacacaatctggttgtttttcagagcgctggaaatgtcgagattcatgcggctcagaatgaacggaacagctaattccttctttctaaacgcctctatataatcacttaacacttgttgtaacggcattttctgctgactatgatttaggtctgccaccagttcagttaaaatactgatcgcttgttctgctcggtcttgaccgccagcataccattttaaaatactcattcttccttcacctcttaaaagtctttcggaacacaaaaaggcccatttcgcgccatggtatgacgtgaaatgggccttttgtgtccaaccaaatgatgctctcaatcacttttccgccatcgcgaatccatgattaagcgggccgtaaacagtcccagtggtaaaaacatgataatcaaagcggcgcgggtcatccattcagcgccaacgccgatattatttaagccgatgttataaatcgctcgataaatatacaagccaggcaccatgatcacaatggatggcactgtgagcgagatccgcgggtagccgtcaattcgattgatcgccgaagcaagtaaccccgcgaccaacgcgccaataaaagcggcagccgccggtggaatcgtgctcaagtcgaccagttcaagtcgcagcgtattcgccactgccccgatcaaaccagcttgtaccgccatgcgctttggactgttaaacataaccgagaaaccaaagacgccgctgaaactggcaatcaaccgaaaaagcagcaaaagcatcggattcaatcccagatcaacaaagttttcagggcgcaagtgcacaatcatcgcgactaaccaaccgaccagtgatgcgacaatcgtaatcatcaaggcatacagcaggcgctccatccctgaccgcatatcttgcttcgaaatatctaacatactcgtgatgaacggaaaaccgggaatcacgaacagcatggcaccaatataaccggcctcatgccgcgcagcgatgcctagactcatttccaatccacgaaaaacaaggaagtacgctaagcaagcaacagcaacactgacgccaatgcaggccaacaaggtccagctgcggcgaatcataataccacgcaaccaattgccgatacccgcgccaacaaaacagcaaaccatctcaactggaccaccgccaagcagaaaaacgaaagcgcaacacgccagcgccgcagccaatcctgctcgcagcggatcataattacccgacattttctggatctgatcgagccgatgatgaatctcgcgcaccgtttccgtggtatattgcttttcaaaattgcgcacaaaccgttcaagtgcatcaagtttatctgtgttcacgccgctttgcgataatgagagaacttcggagtaggcgtggttgttactaaaacaagtgtaggataacgaaatgaggccaatatctgcagaacacgacattcgcaaagcacgcgcaaccgtgttcatagcttcacgcacgcgccatgccccagttccacacgccagcaacataatccccacccgaccaacgagtgaagcacgttcctcaagcgtggcatgatctgcctgccgttcttcgctgacaatcacgtcataccatggaatctgcatgtgatgtttttctgaaagtggccgcgttcctcgcgctgtctgattactttttgccgtcataacttgtgccgatccttcttcttataggaatgtgttatcttgaaaaaatgaaaataaacattcactattttagcacatctgacgtacacgcgttggcgatcaaaccaggcctcgtctcttaccccgacagtttacgctgaaatacggcactcaaatgacactttttaaagcagctaacacagcagctacgagataacaaatgatatgcccatcattcaaaacttaacctccttcgtctatgccactagccgcaaaaatgggtcgggtgcctctaggctagttttgattaaatcaccaacgcgtcgtcaaaccctagctttctgttctttaattagacgcagttcacgcctcaattgacgcaagttgcctagccacaaaaatgaaaaatccagttcaccattttcatcagcaaataccatataaggattttccggatcaattaattggctcatggctttgcttgataactgcaatccttgattcagggtcttaatctcgtgaatcaggtgtctgcgaagtattcttttccaaaagaccggcaccgcgtaacaaatgacaccgcccatcaccatcaagctcaccatacctgcatcgaccaaagcgtctatcttcaacaccccaaacttgtgatcctgctgccgatcaaacgatcgacacgctaagcgacaaccagtgtgtttccaatgtttttagttacagccaaacaaatgggcaaaaaagcgttgtatgccacgcctttccggttctggcttgccaagtggttccccgttcgccaaccgtcgaatgtcatcaatcgcatcccgccccaattgactcaactggatactttgtgttgacaaaatgaaatcaattttttgggcaaatctaaacaattggcgatcaaactccggtccatgcggcagttcattgtccatatcaccggcgactctatcaacgacatacgccatctccggcgaccgattaagcggatgcaactgatgaatttcatgacggagaatcataatcaatttcctagcttccatttcaagttgatattccatacccctttacctttcccttaacaaaagataattcccatcccaactttaacaagcacttgcttattgtaagattaccatctcccgcgttgtgtgacgcaatctgtcgattaacgtcgtgttttggccgattaacgtcgtatttttcatctttcagctaaaaaggagccttggttttactggtgattaaacattttatcgacaaaatattgccagtaagttttcgttccggtgataacggcggcctgtcctgcgataccgtagtgcaaggtctgccgctgttgtttactcagtggcactcgtgcctgtactttaaagtaattgccaactttagcattcacagttggtgcgacatcaatggcatcaatccggccagtcagcgtcatcggtgatgggacattctccgcaattcgcagtcgaacgctttgaccacgtttcaaactcatgatttccgctggcgaaaccgccagcttcaactcagcttctttttgcgtggctaagtctggcaagatttgcgccaaaacggtgccagctggaatgtacttgttgccacttaaggatgcttcaagatgcaaaacaccgcttgctgatgctttgacttggtagttcttactttcgtcctttagtgccgcaagtttcgcctcgccttcttgggtaccttgttggactttcacctgttctgcagtcatggtttgctgcatatggctttgcaacgaggccagttttgcctcattctgccccgtctgctgcgctgaaagatcggcctgcttctggttgatacgttgggtgcgcaaggaagcgagggtttccttttcggttgtcaataagttttgcaactgtgactggtactggcctttcaagctgttcaaattagcagcatcggcatttttagcctcggctttatattgcaaataaagatagttgtatgcgtgattgtcacttaatgggcgatcggttcgtatggccgtttgggcctcacgaatcgccgtcattttagcctcgcttgcctgcatactggtttgcaacaattgatcgatttctttgctcttaccatcgaccacaccttgggtcgcatgcaaggcttccgattccagttcgtaaacccgacgctgactgagataatcgcgaacttgttgctgataaccgaatttatcaggactcgcaaaaagatttttattggcagcaatactctggttgagaacttcgagctgcgctttttgatctttcaacgtcgccagttgctgttcaagcactttcaattgtgcaggatgagcaacatcgtgatacaccagcaacgtgtcgccgcgtttgacatgcttgccttccttcatatgattcgtcacaattcgattcgccgccgtcccttgaaccgtgaccgccgttttgaccggcgcaatttccgccgctgttaaaacggtcacctcgcgcttggcgaagatcagaaaaagcaacaacaaaacaaaaaggatcgcggtcggcacaataatgactgttgaaaaattacggtagcgatggttataaaactcggttgtctctaacttctttagatcaatcatcgcggcctcctcactcacttaccaaccgagcataatagccttgtttggccaataactcagtatgatttccttgttcaacaatcgcaccatggtccatgaccacaatctgttccgttttagcagcaatagtgagccgatgagccacaaaaataatggttcgatcagtcatcgctaacaaccgatcaacaatttttcgctcggtgatcgtatctaaactgctggtcgattcatcaaaaatcaacacttttgccggtgataataacgcgcgggcaattgctaggcgctgcttttgtccacccgataaaatactgccgctttcagaaagtttggtctgccatatctgcggcaaattcgaaatatctccggcaatttccgccactgaacaggcagcttcaatatcggcttcagtgatattcgaacggctacccaacgttaagttttcaatgactgagccagaaaaaataaacggatcttgcggtacatactcgatgtattggcgtaacgttgttagatcaacatcactgatgggaacaccattaaatgtgattttccctttgccagtgtccactggatagaaacctactagcaacttggctaaggtcgatttccctgatccactcatgccgacaatggtgtatttggcattcgccgggatttcaaggttgatttgtttcaaaacatcttgcccaaaaccatacttaaaggacacatcggtaacattgatggcgccatcaattaaatgccgatcattcaaacttcgctgttctttaaactccgattcaaccaaatacacttcattcagccggttattcgcgactttggccatttgcaattttggttgcaaattaatgatgctttctaacggattagtgaaatatgccaacaacgcattgaacgtcagcatctgtcctagactcatcttgttagccatcaccaaactcgcaccaatccacagcacgaccacattcaaaaccaacttcagcagtcccttgatcgcctgctgcagttgatcagcttttgtataattgaacgactttttcaaatacgtgacgaattcacggtcaacccgttcataactgactttctcaccggtcagtgatttaatcgtctcaatcccgttcaagtcctcgataatagatgaactcaaaatggcattgctttccatcgtctcttgattcagtcgattaaatggccgctgaaaagcgaacacaatcaccaaataacaaggcacagcaattaaagacaccaagaataaggtggtgttttgaatgcctaacacgatccctaaaattaagacaatccaaatatcaagaaacaaggtcataatcgtgtttgccagcgcatcaataatcttattagcatcggaaaaccgcgacacaatttccccagtgcgacgcgtggaaaagaaggacatcggtaattcataaaggtgtctgacgtaacccaaaatgacatcaatcgacaaacgttgtcctaaaacagccatcaaaaaattttgcccataggttaaaaccgactgcagcacataagcgaggatgagaccactggcaatcattcccaaagttgtgcgcatcccgtttggaatataagtatcaataatcgactgaagaaaataagacccgacaatactaatcaacgtgatcaacacagcggcgacaataatattggcaatgattcctttttgtcgcgctagcatcggcacaaacgcaaagagactgcctttgtcctctttgcgtggttgatattgcggttctggcgcaataaaaatagcgacccccgaccactccttcgcaaagcgctctttgggaagccaggtcatcgctactgatgaatcaggatcgccaatcaagatatgatcctttgtcgccttaaacaccacataataatgaagcaactcgccacgcttcaaaacatggacaagaaacggataaggaacatcatcaagatcaaacagcgtcatatccgccttgacagccttggtttcaaaatgaagcgcctgagcagctcggacaatccctaacgctgttgttccttcctgatccgtcttcgccaactgtcgcagatgcgctagcgaataatccgagccattaaattgcagcagcatattaagcgccgcaaccccgcaatcgcgctcatccacctgaggcgtgtagtaacgcttgtaatactgtgcttggccgagctttaggttgtatttgatcatgggcatgcctcctggttggtgctggatttttctaaataagtgataccttgaactgtttaaaaaatgggttgtcgttatgacaacccttaaccttacagaagagaagactgtcccagaagccactaatcagtcaaattctgcgaaggcttgtggaacaccattttctctgtaaaagcgtttaacataaaacttaaaatccaagaaaattgtgcaaagcatgaaattgtttagaaaagatatgatatatctgtcaccgataacgcggtacccgctttaataatatataaagttatttttatatattatcattgcagtaatataatcttttaattaaacaaatgatcaataatctaattcttttgttttaaagagctgccaaaacaagttggttaccggccttacctttatgtcatctaccttaatgatttagatgcgagcgaaacctcgtaaacacgatttccctgatttatttaaacaaaccatcaaaccatcttcttattttgttgaatgttggcgaaacatcacggatgctgtcacctccaatgaatcccaaaagttcttcgtcactcatattgaccattttctgctcatcaaactgtttcatttctttttcctcctcattcaagttgaagtgttcttttgctttacatgaattcaatgtaacagacttttggcttgttcttgttttccaaaaataaacgtagggttttcgccgattaacgtcgcttctacgtctcttcttagtttgttacaatggctttttaatcccactcagcattcagaggtcaactccatggaaacttattctgatctagcctatatttttttaacatcacccgtgttcatccttggcataacgtttctgtcatacattttcttccatcggattaatctcattcacgttttcttttggtctatcttagcgatagtgttctctacaacactatcgctacttggtgaaatcttctttggattgatctatgccttctacatgtcaaaaactcatagccaatctgatatattctgggttttcctatttttggaaattaacttgattattgtcaattttcaaacgctactaggaaatttctttgcactatcaatacccaataacttttttcttatacacatagcgtctaaattaatcatcaatattgcactgctcatattggctatttggttgtttggcacgaggaaaaaaattgtcaataatatgcgttatctggttcaagaaaaagatggcatttggatatcagctatcttctacctaggtgcttcttgcactgtcatgtacttcttagaattcacctttatactccttaagcttgataatgttcttactctactcatactagccgctttcatttttttcatgattgtcaatttatgctctctattttttattctgagatcttaccgatactatcttgagctactggtcgttaaacacaccaatgaatcacgacgagcttactatgcatcacttaaccaacaaagggaaaatactagcaagcttcttcatgattataagaacctactagcgacgctccaactttcattgcaacaaacttcagcaagtcaatcttctgacacgagcaatatcatcgcgcaagctcaaaggtcaatacaacaagctgaaagtggcaaggactcattagcagcaatcgaaagtgatccgcttcgaaatctcctctatttgaagtggtcagaagcgacgaatagtggtattagattacacatccacaccgaaggaacaatccaaccgctgagtaataatgccggttttgccgtcatcagagcacttggtatcttaatcgataacgccttagaagaatctatcaggattaacaagactcatttcagcgtcctgctagtggcttcagatcgggggctagaagcaagcgtcgtcaacgatatcaatgatgatttcaatctagcaaaatttgcagaacccggtttcacaaccaaaggccgcgggcatggcaatggcttgaccatcataaatgagttaatccagcagaataaaaatatcatcattaaaaagaccgttattaacaagcaactaaagatcactttgtttatagggagatgacttcatgaccaaccaccaaacgatgctgaagattttcattctggaagacaatgctgacttcttgaatttcctagaaagtacacttcgcaattatattatgattgaggcattgcatgccgaaatcaaattcaccactcagtcagcgacagatttgttagatgctgttgatctagaagagattaatgactgcctttttctgctggacattgacatccctggatcttctgtaagtggtattgatatcgccaccatccttcgaaaaaagtccttatacgctgacatcatgttcatcaccagtcacactgaagaagccttgtcgattctggcccacaaaattgcgcctttagacttaattgataaaagtgtgctttttgaagttgaagcgcgactgcgatcaaatattgtttacgccatcaagcgattgaaggcgcgtcaattgcaatcgccacgactttttaattacagcatagattcaaatctctttacagttatattagatgagctactttacattcaaacaacccctggtatctctggcacgttggaactacatgcagaacgcgaaattgcaacctttccgggaaacctgaaggaggtatcgctccaatacccaacattgtttcgctgtcatcgaagcattttgctcaacccaacgcatatttctaaattggacacgcatggccgttttgtttacatggataatcaagacaaacttgaggtcagcattcgtagagtgtcggccctgcgtcaggtcatgatgaccgcgaataaaccacagtctgctaccaatgatctgtcaaatgatgcttaaatggtatatctcttttttcgtgtctctactagaagcgaatctaaacggtgatgaaaataaaggtcacttgaaaaaactctgatattcccataacctggcagaaatatcaaagtttctagtaactgtttcatttaactgctgaatacgacaacagattcagtgttgtttcctctgaatctcttacagcagtgcttactcattaatgctgtttaattttgagatataaatacaccttagtccagctgattagttcatgagaaacaggcgctgcaatcaaaaactgtttcagtccttgattgcagcgcctgtctatttgatgacacctttagaataacttttaagaagcgacagattctcaaacctatttctttaacttgccctgtctcttgcccgattttgaagaagcaaaagtcaaagaagaagttgttaatattaacaacgggacgataacgtcaactttaggaatcacctttaatgcaaaagcaagcatgtacacgggtaaaaaaacaataccgagccatctaataaatcttgccattttatctccagttatgatcatgttgacctcctgattaactatttaagcgactgcccactttcccagctggtagccaaagctcaatatcatgcttcaatgccttttaacaccatgccaagtaacaagtccactaattttcagtgcctgcttagctaccttacacacagtatacgtccgacaaatggttctgtggtcctaaaatttttaacgttggtaatttaaagtttttcgttaattcttttaaaaaaagtgcaaaagtactgcggaatagacaattttgcgacgtttacttcttcggcttttaaactagtttatgatagacaaggcatcgaaaaaattcctaattttgtctacgttgcactagaaataaatccgcattatcacaacctaatctcttgttatctattacactctttcttcgaatgggcgtgataaggatcaatcaataaaagaattaggcttgttataaccacatcgcatccagttaataagtgcctataaaatgactaccacaaaaatacctccaactttcttgatttatcaagaaagttggaggttgtctggattttgaaaatggaactaattgctgcctcaaaaatgaacttcggcaaacatcccatgagcaggcacttcaataaaagatccaaaattgtctttcacgtttgtcgatcaaccacacgtgtgacaattaataaactcaaattgaagcatctatttgagacgccgagctatctctggtcactgctaatcgaagttaaaatgattgaagtaactaaagcaatggcgcagataccgacaatcttgtgacaacttttaagagatatatggtatcgataggcagtagtaagcataggtacgatgcttactatcagcaaatttcttcgtacgctatcgccgtgtgcaagctaggtcatcatattgataagccaaaatagtatacaaagttgaagaaatctcctttaagttggtagatgttgtcatccttgagtatatcaagcatctgttcttaagatcagcttgcgcatgaaacgagatggctaaccaattctacaaaccgattgacaaatcacaaactgtgggacttgtcagctagactccagccacttgtggcaccaccagcaatttcatctgcgtgactccacgcatccgatgctaggaatcccagaatggcagccaccgggatcacaaatgcaaaaccgccagtgatctggctaagttctttatcttttaagttagtcatggtgtacatcctttcttcctgtttagcttagaaattagtttttaggggttagttgcttgacaagatctattacaggacccctcgaaggtacaaacagactaccagtaagcacgcttcgtgcggagaatccaagaccgaagccaatgattgaccataaaccaccgttttcgccaccagcaatcttttccaagctgctgttatctaaagtcatgaattgttgcattgttatccctccattttctttgagtgattcattgctaaacatttggttcttaggtaaaacggtcgggggtgctagctaccctacacacaatatacggctagcaattgcttttgtggtgacttaaattttaacgttgatattttcaatttttttgtcagttctatcgtcaaaaaatctaaaatgcgacgaaaaaaggggattttacgacgtttattttttgatgacccatttttcttgaacactagttattatgagtatgaaatgatgtaatgatactgaaagtttaaagatgctgagcataacccaatggagatgactttcatgaatgcatacaagcagttgaaacaaccactgtcaatgtggatcattaattgttgcttagtggcgttgctctttcttgttcccgatgattcaagtatctttgtctatatcgtgattgacctcgcaatcgttgctaacggttttgatttattaaagaaactatttggtctgtcaaagcatgcggactggcaccacaacacttggaatcgtgatgaatcaaaataagcctacaaactaagcgtcgcctcgtcatcgcttaatttgtaggcttgtttttttgacttttttcacacaccacaataaaaataacaagaaagatcaaatagtagcgatcaataaatgaaatgtgaggtaacaaatctagatcacttaaaatcagccaaactatagcaaataaaaagccgccaccaacaataaagctgctcacttttctaaaactcataaacagacccactctctatcattcttcaatgtttatttttgcaataatacaaacgtttcatttgccaattgaggagattaaatgcatatagacatcatgatccgctgacttgaattatctgttcaacagttgcaataacaccttggtctggcaaagtgtttaagtgtgcacgagaaaacgaaagtcatattcacagatgaaaatcatttagagtttccttttttgaataaaccactcctcaaaaaatcgaatacagacaccaaaagagacgagcttatcatgctcgctataaaggtaaacaatatcacggctatgataacgaatctcattgtattgttagcgttgacttgataaatcatagaagcgaattcttttggatttataatcctgtacagaatactgagtatcattacctgtattgctgacaaagcaaggatcataatcattctttgactttttttagatttggtcacttgattcagctcctcttttttggatcttcctataattaaataagcgattatcatatccagtaataaagttttccgcaattgcgagtgaatgtgtccaagatactataaacttatttgattgcttggcctgctaaccttgccatgaacccttcttcgtcatgacagtgccataggacccacatggaaatggccaagtaaatcgtagcccagatcaacgaaacagttatgagcgtcgcttcgtcacttaccccatttaatttgctaggataagggccgtgaatcagcgttaccaagcagtcgatcatgaaatgaacaaaaatcggcatcagtaatgtgccataacgaacgtagagagcagccagcagcatgcccatcccgctgacttgaatcatctgacccacagttgcaacagcaccttggcttggcagattactcaagtgtgcaagcgaaaacgccagactgcttagtaacatgcaatagagaaagttacgtttggtaccaccacggttagcaaggtaaaaggcgcggagcaagccaccgaaaataaccccgcgatacaggtactcttcaggaacagcggcgatggtaccaatgacacttgcttgtaaaatatctaagaagtttcggttggtaaagatttgccaagccacaaggcagcccacaatatcccagaacacaaatttctgccagcttggccagccaaatgacgtcctaaagataatcttttgtcttaacagcaacagattgagccccagaatgataactaaactaagtactttatagagcacaatgtctgcccaaaaatccagctgtagaaaacttaaaaatggggtgaacacaaatgcttctataaattcatccaagataaaaatgtataaaacacgtaatccaggcgtgaacaaccgttgccgtttctttttcattccgtcaccttcatccaagttgacaaagccggctttttccgacattgctatgaacaatataccgattaatgaatggcttttagtcaactaattttaaacgtcgtgttttcgccatttaacgttgacgatcatccgtcaaaaattcgctagcggtcatttattgacaaaaaagccacttcactcggtaaacgacgctacgctaagccaagaagaagtgacgctgcagtgttgaaaaagtcgcggagcttgcaattggcgcaattcttcaccggtcacaaacacctacatgccctgccatccctttaaaaaccccgcaataatttggtcagtgtgtgaccaagcatctatcgcaatcaatcctaaaatcagcattgtcaggaatttacgctaggtcatcccttcaattatttgttgcaaatcatcattctttattcgatgcatctcatcgtgccccttccccaaccagtctaaataaagtggtaagtcacagtataaacagcgtaacactcgacttccgacttcgcatttgcgtgtgccaatattgggaacaaaccgatcaagtaatgaagtgcggtccgccaacctgactcagctcttcatgaatatcattctccatgaaatctttcagttgttgccaccactggtcagcttctggggataatttcatcccctgcaacccaattaaccggacaaagcgagaatacaggcgcgctaatgcgtagtcaatggctctattttgaagcacattttcttttttcaaaatgtgtagcgcatcatcaatgacctcttgtgcatcggtattcatgacactgacggttgcagttttttgaaagctttcgttgagccctgtcataataaaatagactttatttcgctgaatcatgttcatgatatgtcaccatttcctttgatgtcgtgacaatttttctatagaaatgtttgaaaagtatcgatgctatggcttttaggcaaagcaccggaaaacaatggctttatagcccgactgatggatcttgataccgtcttgtatttgaactcttttagatatgagtcatcgtaaccgattacattttaaaatcagtttgtccttgtgtacagaaattcggcttcacgtttttctaccttctaagcagacccaattcaatgcctcgctttttcatatccggcatcagtttcccgcaacaacgtgagtcctgccgccaaaagcagtagtggcagcgcaaagtcaccttggttgacccagcccatggcggcagccagcgtaaaaagaaagacaccactgatgcctatcagtaaaagaaaatgaattgctttattcaacgtcatcgccaacttgtatcccctcgtccagatgtacttcgactttttcttgcggatgctttcacgcacactatactggatagttcacacaacagcgcaaacttttttaaacgtagggttttgcccgattaacgtcgcttttttgtcaaatatcgaccaaattttctctttatcgatctgctactcggtttttcttaactggtgtcaacaagtttcatggcaaaaaaatagccgcagatcttagtctgcgacgtttttggcaaatcataactgattgatcatcaactttagcctcaccgtttaaaattcacagccctacatcggctaatgcccccaaacaatgggaatggcaactaagccagcggccaaggcttgcgcgcgataacgtgctgcatcaatatcggcagcaggtacatcttttttgatgtaattgaaaacggccaccagctcttctggtacggcgtgatgaatcagatagtatttggaaatgtcgtgggacaactgagtgacagccgtcacataagccttatcgtcatcaccttcatcaacctttttggcattggtttcaataagcgcccgcaattccggctctgctttgatcgtcggacttgagtatgccttgcttaacatcgacattaaagtttcacgtttatctgtcatcctgcacttcctttcgatgattaacctggcaattcatgctcactcagagcactttagtcattgtgaatattgttagaatgcgcttgtcaattgccattttcaagtatcaattcagcgtttagatcatgtcatgtcctgcaaaccctgttttatcagcagccgtgatctcgcggagcacttcgcaaggattacccgccgcaatcacgcgcgctgggatgtcgtgggtgacaacactacctgccccgataatcgtccccgcaccaatcgtgacgcctggtagcaccgtcacattggcagcgagccaacagccatccccgactacaatcggtttagcaatacagccaccaagttgtcgttcaagcggatcaaaaagatggttgctggtgtacaaaccgactttcgggccaaacaaaacgtgatcgccaatggtcaccggcgccccgtccaaaatggtacagtcgtaattggcataaaaatgatcgcctacacggatatttcgaccaaactcacagtgaaaatttggattcacaaacggtttgacgccagtttggcctaccaatttcctaaacaaggcattgcgtttggctggatcgtgttcattgttaagtgcatcagttttggcagttgcttcatcccgcacagccagtaacaaaggatccatatcgtcgtatggcttaccggttgccatgaaagcaaacttttcttctagattcattgcgccacctttctttcatggctcaagtttaccagacatttgcgcactgcgttgataattgccaatatgttaaggtatgcttatcggtacgcatgaagtctacaaaaagccaccacttcttgaagaaatggtggcttgaaaacaatgacatcgcttctgcacacagaaccacgcctgttttgttacaaacagaaacatacagttacagtcttcatcgtcacaaaattctggcgttaggaaatttcagctacttcctcggactttatcagcttaatccatagacttaatctcaagtgacattaactcagattttagcttttttaaatttgacatagagataaatgtaaagtcaagtcttccatctagagtagtgagaactatataagggttctggggattgattaacctactcagccccttactagatagtttcaaatcccgatttaacaaaagtatcttggcaatgactttgcttcttgctgccccttgccaaagtcctccaacaaatggtgctagataaaaagcgatcgtcgccagtaaaatcaagataactatgatgatacttattatcttatccatttgtatttcctcttccttttgcacaaatagactaatttgaaatcgatctttgactaagacaagaaaaagtgagcactaccaaggtgttagttatattgaacagttgcgataggagctaaccgtctttgtccaatattaggctgggtgaatgtaattagtgctgagacacaaggataatcctattgcagcgcctgcaacagttgtaaatggatttaatccagctgcccctgctaccgctcccccgatcgtggacacaatacacccactaggtttattgcgtcgcttggctcctccttggattaagaccaaatcatgctgttttaaagtaatgcccacttctttacttatcattgcatcccatctcctaagcatttaatagctgacccaaccgctcctaagtttccaccaactacggcgccgccgattatcccaaaaggaccaccagctaggccagtaatcgttcctgatccaataccagccgtgatgccagtaacaaatgtagcagcacaatcaaatttctttttcccacctgaaacccctgacaactgaaaatcgtcaagctggcgataattataagacataattttccttttttcttcaaaaagcaacaagttattttgtgtaaggtcgactttactgtctttaacatacattaattatttgtgtaaaatgccaaaattttttaaacgtaggaaatttccagtttaacgtcgtctttacacttttattgttcagttgcgctttaaaagtcaaaaattcttaacgtttaaatctccttgcttggtaaaaacttcaattttttgcaaaaaaaatcgtctcagcaatttgagacaattttttcatatcatcaacttacggcaaatcattccccgccgcaaagtaaatgtcataccattcttgtcgggtcaacgtgatgtccgcgccttccgcactttccttgatatgttcaggattcatagagccgagaatcacctgcacaccaactggatggnnnnnnnnnnnnnnnnnnnnnnnnnnnnnnnnnnnnnnnnnnnnnnnnnnnnnnnnnnnnnnnnnnnnnnnnnnnnnnnnnctggatggcgtaatagccaagcgactgcgattgcatttttattggtgtggtagtggtcagcgactttctgcagttcatcattcaacgccttaaacttcgggctatcgataaaggtgccttcaaacatgccgtattggaatggtgaccatgcttgtaaggtcatgtgtttgcgttgcaagtatggtaataggctgccatcatgatcgaccgaggcagcgtcggccatgttggtgtgcatccccgcattgaccatgccagtatgggcaacggagaattgaacttggtcaatcagcaaaggctgccgaatgccgctttcaagcaacgcaatttgttcagggttaaagttggagacgccaaaatgccgaaccttgccactttgttccaatgcatcaaaggccgccgcaacgtcatcgacttccattaacggatctggccgatgcagcaagaccgaatcaaggtaatcaacctgcaaccgtttcaaaatgtgatcaaccgctgacagtaagtgatcttttgaaaagtcgtaccgtttgccgaataccaaactgccatgagagcgttttggatcaacgacgatcccgactttcgattgaatgaataactgatcgcgggaaacgctggcttgcttcaaggcttcaccaaaaacttcttcggatttgccttggccataaatgtcggccgagtcgataaagttgatgccgtcattgtacgcactatccagcacattggccgctttgtcgggggccagcacattcatccgcatgatgcccaaggccacacttgacgcctgccaattggatccgcctaatcgaacttgtttcataaacacaaaactcccttcgatacgtcatttcaaattatgttactgacgacaagttaagtgtagcccctaaagtccacttgaggtcaagccaatattagaatttcaataaaacagcttgcatggtgctgagctgcgcggtaggttaacctgtgtctgttacttattttttcttagcaggataagcccataaaggaggccgtgattttgacagttaaagataaagtggttgtaatcacaggtgcatcgagcgggattggcgcggcaacggtacaagtgttggccaaggctggtgcaaaactagtcatcggtgcgcggcgcacagaacggttggctgaattggcggccagctttacggacggtcaggtgctgtatcaacaaaccgatgtgaccgaccagcagcaagtgaaagcgctgattgatttggcgttggataagtttggtcatgtggatgttttgtataacaacgctggcctgatgccactttctgaaatggccgaactcaaagtcaacgaatgggaacgtatgattgacgtcaacattaaaggcgtcttgtatgggatcgccgcggttttaccgcctatgattgcccaacacagtggccaaattatcacaacagactcagttgccggtcacattgttcaccctggaaccgccgtttactccggtaccaagtgggctatccaggcgatcatggacggcctacgacaagaacaagcggctaatcatattaaaacgaccatgatctcgcccggtgccgtgaatactgagcttttcagcacaattaccgatcctaagcgccgtgaagctgttgaagccgatgaaaaaaacaatggcctcagcgcctcggatgttgccaaggcagttttgtatgccattgatcaaccggccaatgttgccatcaatgaagtgctcttacggccagtcacgcaagaacgttaattttcgtctaaaggagtgtgattgcatgtcgggttatcattttttaaaaccgttcaccttcaagcaccaaaccatcacgttgaaaaatcgcattgtcattccgccgatgacaacgcgcctgtcgtttgaagacggcactgtgacgcgggacaaaatcaggtattaccagcaacgggccggtggcgtcggcatgtttattaccggtaccgccaatgtcaatgcgcttggcaaaggattcgaaggtgagctaagtgtcgctgatgatcgattcatccccggtttgagcaaactcgccgctgcgatgaaaacaggcggcaccaaggctattttgcaaatcttcagcgctggccgcatgagcaatagcaagattctgcgcggtgagcagccagtcagtgccagtgcggttgctgcgccacgggcgggttacgaaacaccgcgcgcattgacatcggcagaaatcgaggccactattcacgattttggtcaggctgtgcgccgcgccatccttgctggttttgatggcatcgaactgcatggtgccaacacctatctgatacagcaattctattcgccaaactctaatcgccgaaccgatgaatggggcggtgaccgcgataagcggatgcgttttccgttggcagtcgttcatgaagcagaaaaagtgattgccacaattgctgaccggccatttttgttaggctaccgcatttcgccggaagagttggaacagcctggcattaccttggatgataccttggccttaatcgacgctttgaaacaaaccaagattgattacctgcatgtctcccaaagtgacgtttggcgaacctcattgcgcaaccctgaggacacagccatcatgaatgaacaaattcgtgaccacgtcgccggtgcttttccagtgattgtggttggtggtctgaaaacgccagccgatgctgagaaagcggcagattcctttgacttggtcgccattggtcacgaaatgattcgcgagccgcactgggttcagaaggtcttagaccatgacgaaaaggcgatccgttaccagatcgcccctgctgatcttgaagaacttggcattgcgccgaccttcctcgattttatcgaaagtatttccggtggggcaaaaggtgtcccgttaacaactgcgcagtctatgacatcaagcaacgtgcctcaagattaatctagcatttcaaatcatcgtgcgagtcgagctgtaaaaagctcggcttttttcttgccgtcttcaacttacgcgatggtgcctggagctaccagtgatttataagttttaaatcaaggtgtgatcatcacctgctcacgctctgatttaaacgcgttcaccagcgcagctcggctatgcgaagaacagtgacacagatggtccaaagcccagaccatctgtgtcactgccacttcgctacgccgagctaaccgcgccagctcacgctcttgtcattcttaacgggtcgacccatttatcaaactgcgctgctgtgacgtcgccgcttttgatggcggctgcttttagatcgaggttttcttgctcagccaattgcgcgatggcggcacttttttcgtagccgatgtggggtgcgagggcggtgaccagcatgagcgaatgatcaacgagtgctctcatatgcggtgcgtggatggtcaagccggcagctaatttttcagtgaaactcgtgactgttttggttagtagatcagctgactctaaaaaggtactgatgataaccggcttgtagacgttcaattcaaaattgccttgtgacgcggccaccgtgatcgtcgtatcgttgcccatgactcgaacagcggccatggttagcgcttcggcctgtgtgggattcactttgcccggcatgatggaactaccaggctcattcgccggaatgcgcaactcgccgtatccagcacgtggaccactggcaaggaagcgaatgtcattggcgattttaagcagatcagccgctagcgttttaatggcaccatgaacaacgctaatttctgagtgagccgctaaagcagcaaacttattggttttcgccgaaagtggtaattgataaacatcgctcaatcggcccgccacaatcttgccaaaattagggtcagcgttaagccccgttccgactgctgttccgccaatggctaagtaaaaaagattgggctgaagctgctttaaagcaatctgatcatgctccatcatggccacccatccgctgatttcttggccaaacgttagcggcgttgcatcctgtaaatgagttcgaccgattttaacaacacgagcgtaagtgacggcttttgaatataaaacactgcacagttggttgacagcgtgcagcaactgattcacagcaatagccgccgtaatattcatcacagttggaaaagtatcattggagctttgactgtgattcacatcatcattcggtaagatcggcaagtcggggttgagttttgcagcttggtggctaatgacttcgttcacattcatatttgtttgtgtgccagacccggtttgatagacatgcagtggaaaatctttttgcagtttttcgtctggcaaggccaacaaggcatcgactgctcgcgtgattaattggccttttggtgccggtaaaacatcagcggccacatttgctcgcgctgccgcttttttgagttgcagcaaggccctaatcactggcatcggcatcaatggaccagcctgaaaattatgccggctgcgctctgtttgcggtccccacaaagcgtttgccggaatttcaactggtcctaatgtgtccgtttctgttcgatatttgctcatgtttacctccgtcatcaccatcagaaaaattcaaccaacatgcctatttgcatagacctattttacacgaattcgcccacggttaaacaactcaagtaaaacaaaaagccacccagcacggctaatcgccgtttagtgcaatattgtttcgacaagttgtgccgcttcggtttgagctttgatagaaccagtggtcagtaatgacaagtagagatggatcggatctgcctgtggtgtcgatataccaccatgcagccgacgactcaccgtagccggatcaactgaccatgtttgaatgatgactgcgcgactatcatcgacacgatgcttgctattggcaatttttagggttaattccgccttcagtaaacgatcatatgcagcctgtgagacagcataaatcaacggttggttactgccaaatatcgctgccttaattagaacggtgccagccgcctccaaaggaaagttttcactgaagtcaccgctgattttcagcaactgctcaaactcatcagcagtgtatgtgcgggttgctagaattggcgatgtcattagaccgttatattgcttgaaaagcgtccatggatcatttgccagttgataatgcttatgagttcgatggcgatcggccaataaagcgccagaaacctgtagttccaacctagcgcgcttcatgattgttcgactgccaatacctgctaattggccaaaatcttcaaaaaactgccgcccgccgcgaaacgacagacgcttcttgctgccgcttgcctgagaacccagacgatcagcatacataagactgatcagcaaatccgttgcatgttgcgacaacatggctggcgtttctaataactgtgttgacgtgcttgtttcttctccctgtgccatcccatcactcgctttctatattgtttacctattcatgagactatgaaactttagctcctatgctttctgtcataacgtgcaccggcttatacttaaaaaagccgctttgatcaacaaacagatgatcaaagcggctttactaggaaaactgacaacgataatgattatttggttgaatgcgtggccgtcttagattgcatatgatctaacccaagaatggcgaatagccaaggatcgtaccccacagattcctcgatcccatcgcaactcatggccaaagattcaaacaaatcattgttcgtcaacatctgccttcgcctctttttcatcggctacagctgcaagatgtgcttcataacgttgattgcctttatacagatcccagatcgtccaagcgagtaacgcgaggatggctacgatcagaacaatggcaatgatgttggccatgttggtttgtgtagccgttggatgatcgccgaagaatccggcgattgaatctggcaggcctttaaggttcagtccagttaagccgagaacggaaatccaaccgagcactttgacccaaccagtgttcttgaaccgatcgcccatttcgactttactgtttgtgaacatcaacagtggcaacattgagaatggtaacgcaaacgctagaaagacctgtgaattgttcatcaaggtatttaacgcctcatgttgctgaattggcgtgtctctagccgtcaacataacacagacgataactggaatgacggaaataatccgggtaaccaaccgtcgtgcccacagaggcattttcatatggacaaagccttccatgatgacctgacccgttaaggtaccggtgatggtggagttttgacctgatgccagtaacgcaaccgcgaacagaattgacagaataccagatttagcaacggcaattaaaacaccattacttaaggttgaagaatctgacaaagcttggaacaagccgaagaatgatggatctttaacggcaccactcttgaagactgcgacccccataaccaacagcaagcagttaacaacaaaggcgaatgacagctgaatgttagaatcccatgctgagaatttaacagcttgtgccacatcatccgggttcttgtgatcaattttccgcgtttgcgaaatggcactgtgcagataaaggttatgcggcataaccgtcgcaccaataatgccaagtgcaccttggataggactcatgccgttaatcgaaggtgaactagcgaatgtttcaccggttggaatgaatcccttcagcaaagcacccatgttcggatcggacaaagcaacctgataaacgaagaccagtaaaatgacaagaataagagcaacaacaatggcttcgatctttcggaacccgatcttggtcaacagcagcagcaccagcacatcaagcaccgttaccagaacggcgatgactagtggaatgtggaacaacagataaagcgcaatggcagcaccgataacttcagcgatgtcagtcgccataatggccaactcagtcaggatccacagcacaatccctaacttcttcgacgtccgtgcgcggatagcctgtgcaaggtccatttggctaacaatgccaagtttagctgccatgtattgcaatagcatcgcaatcaaacttgacatcaggataacggaaatcagtaagtactggaagttttgcccacctgtgatggacgttgaccaattcccgggatccatgtaaccaacggcaaccaacgcccctggcccggaataagcaaaaagcgtgcgccaaaaccctttcccgtgcggcacctcaacagtaccgttaatttcttccaatgacggcccattcgcgtattgaatgagcttaattggatggcgcttcttgtgatcatcactcacaataactctcccctttcgtttgaaaaaagttaagtccctggggaacaaggccttttaggtctccctaacttaatcctttcttaggatatgcctgtactgatatatcgtcaaccgttttatgaaaataatttgtgtttttaaaggaaaaattgtgaaaatgaccatacaagttattgcttagaattgccgttattgttaaaaagtcactagtgtgaggatgttcaaacgtctttttgaaaaatttatcgacccatcaggtttttcaacttttctgcaaatgctagtgtccccataaccgccattaacaaattgtttgcaaccggtttaggcataccatattatatagttagcaacaaaaaatttatattatgaaatgaggaatcatgcatggaagaagttcctgactcgcaaccacctgcgtctgcacacagtatcaaggacctgcagcaatcgttgcaggtcccgtccctcaaccacggactctccaacgaagaggccgctaaacgcctaaaggcaaatggaccgaactcaatcgagtcgcatccaacgccaaaatggctaatttttctgcgtcagtttaacaatctgatcatctatatcctgatcattgccgcgattttgacaaccgtgataggtgatgtgaccgatacctcagttatcgttttggtcattatcatcaatgccgccatcggctactatcaggaaagtaacgccagcgattccttggaaaaaatcaagaaaatgctggctcctgaagccacagtttaccgtgacggcgaacggcttgatatccctagtgccaatcttgtggtcggtgatgtcgtcttccttgaagcaggcgataatgtcccggctgatttgcgcttagttgatattgataatctcaccattcaggaagctgtcctcactggcgaagccaattccgtcatcaaaactaccgcaacattgccagctgacacaccattagctgaccaaagcaatattgcgttcgcctccactgccgttgctggtggcagtggcatcggcatcgtggttgccaccggccatcacaccgaatttggtaagatttcccaagcggtatcggatgtccgcaaaggccgctcgccgatgatgcgtgaaattgacggcatcggcaaaggcatctcctatgcgatcattgccgctgccatactgttgttcattttcggcctcgtcattggcaaatacagtttgcccgttctcgccttggccattgtcacgatggtcgtcggctctatgccagaaggcttgccagccaccacctcggtcatattggccatgggcgtgtccaacatggccaaaaagcagcatgtcattgtgaaaaccttgccagctgctgaaacgcttggctcagtggatgtcatctgtaccgacaaaactggtacactcaccaaaaacgagatgacgattaccaccatcgtgacaccgcaagcaacctacgatgtcagcggtaccggttatgcgccgactggtgacttttcaatggctggaaaagtgatcgatccagctgaacatgccgatttatcagcattactgactgctggatttgaagccaacgacacggaattgcaccaagaagacggtcgttatgtcattaatggcgaacccacagatggctcgtttctgactgcctactacaaggctttcaaacaggaaccggcgaacaccgagcgcgatctgatgccatttgattccaacaaccggtacatggcgaagttagcaaaatgtgtcgatggccaaacgagactatttgtcaaaggttcccctgataaaattctaccgttagtcgccacagcccatcctgattttgatcaagaccgctacttgaaactcaccagccagttcagtgtccaaggcaaacgggtcattgcagttgccgaaaaggtagtgccaaacgccacaaccgaaattacccctgaactgctcagcgaaggccttgattttctcggcatcaccgcgattatcgacccgccgcgtgagtctgtcatcacggccatcaaacaaatgcgccgcgctggcgtgaaggtgaaaatgattactggtgatcatccagaaactgccatcgcgattgccaaaaaactcggactggctgattccccagaagcggtcaccggtgcgcaattggcgggcctatcagatgaaaaacgtcgacaattgattcttaatgctgatgtttttgcccgaacgacccctaaagacaagctgaccatcgtctctgtgctgcaagaagcaggcaatgtcacggcaatggtcggtgatggtgtcaatgatgcgccagcccttaaaaaagccgatgtcggcgttgctatgggccagtctggtactgatgttgccaaggatgcagcggatatggtgctgactgatgatcgctttgctcgcatggaaactgccatcgcgcaagggcggcggatttaccagaatatcaaaaaaagtattctgttcctgctgccgacttcgtttgctgaaggtttggtcatcgtgttcacgattctgacgcaacaagaaatgccattgcgtgccagtcaactcctgtggatcaacatggtcagtgctattacgatccaatttgccttcattttcgaacctgcggaagccggcaccatggatcgaccaccacgtaagaagaacgccgcgatgatgcataaacacgatgttttccaaattgcttatgttgccatgttaattgcaggcatcggcttgtgggcgtttgactggttgatcgccaatcatctaaccgaccgcacgacggcaagtaccatgatggttaacatgattgttttaggtaaaattttctatctgtttaacattcgcaccaatacattggcactttcaaagaacctgttcagtaatcccatggcctttgccatcattggaatcatgctagcattgcaatgcttcctgacctatgtgccgtttatgcaagacatttttcaaaccgcaccgatgtcttggcgtgaatggggactggcgatacttgccggctcaatcattctcattgtgaccgaaattgacaaaatcattcggatccgccgtcagcgtatgcgcggccatggtgcctttcggtcagtaaccaaaacacaaggataatgtttggcctccctaaattttttcttccaattttggattgatcatggtaatactataagtaaggtttccctaacaaaccttatgcgtatttagaaggcctgacagccagatcgaccatcactcaagctgtcaggctttttgaataccttttttcttttaaataaaggcattatcagttgagtagtcccgaatcctacttagtcacatcactaaaaattatttcaggcttacctaatatttctcttttaaatatcatcataactgctatactaaaagtgaaaagaagaggagtgatcgttttgaaattgtatcaaagccttacccaagtccaaatcaacgaacaattcgctggtcaagctagcggctacaagctcaccacgacccttgataaaccgctgaactatgatccgacgattctctatcagtacttggacaccgtcctgaaaccgggcagtcgccacgacgaaaacaacttgcgctacgtgactgatccgggctatatcggcgaaaactttaattaccaaagcgtcccgtttacttcgcacatgaccgaattcgacgagaagatggccttcgcacgcaaactggtggccgaccttaatcgtcatttatctgtcaacatcaaaccagaagatgaaactatcgaactggtctttgttgactaaagcaaccgtgttaccctcctttcctagtcgcgatgcttctctcctgatcatttgcggctaagtacccagtcaagcatgcttagttgcaataaaacattctaagcttagtgatgaaccatgatccgacggggttgtgattcaccactaagcttttttggtacagtggtaacggagttgacatgtcggaggttattttggcgcaaagacgtcgcaaaaaaaactggcaacttcgcagattcatcaatgaactcgatcgaagagtgttggcgc

SEQ ID NO: 70 - DNA, 956 bp, Lactobacillus paracasei
aagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagactgaaagtctgacggaaacctgcaca

SEQ ID NO: 71 - DNA, 5243 bp, Lactobacillus paracasei
cgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctagggttgccaaacaatacaaggcaataatttcaatgcatcttaaaattgatacaggttttaatagattgggattgaagtctggaatcaacgttacaaaagagtttattgatgatgtggtggcactgtactcgttacctaatgttcatttcacgggtatttacacgcattttccagtagctgggtctgatcagccttctgatatatgctttcaataccggcagtatcagcagttcaatgaagtatgcatcttattacaaaacagagggttgcgccttggtttacgacattgctctaatagtaaagcgatgctctataatcctgaaatgaatttagatatggttcgtgttggcatctatctatatggattaggttcaaagatcgacaatagcaagcttaatgtgaagcctgctgcatctctaaatgccttggtaatccttgaaaaagaactacttccaggtgacacagttagttacggaagattgtttaaggcaaggagcagtcagaaaataggtatagtcgcacttgggtttgcagatggatattttcgatcattgggtaacaactcaggaactaaagtgtactgggaagcccgtggctttgaaataatcgggaagatttgcatggactacttgatgattctcctgcccgaggatttacgaatagtgggacagatggtcgaggtgatctctgacgactcaccagcgtatcttttaggaaagaaagtaaactccacagcaggagaaattctaacgtctattacggatcgtgttccaagaagatatgttgagggagatgtagataatgcttagaaaaattcagacattaaaccatatctatcaaacaggtttgatggctattgttcgtgttgaggctgaacgacgagccattgaaattgccgaagggtgtctaaatggcggcgtcgatgtgatggagataagcttcactaacaactctgcaggtgagacaatacgttttttgaaaaagacttatagaaacagattattggttggtgctgggactgttttggattcagaaacagcacgttatgccattctatgtggagcagattttgtgattgcacctaatataagtgaaaaggtcgctgagacctgtaatcgttatcaagtgccatatgcccctggctgtacgagttatacagaagcaatacgcgcattggaaattggagcttccttagttaaagcgtttccgatctcgaacttttatgggccaaaattaggcaagatctttacaacacctgttcctgaaatgccaattttagtttcgggtggtgtaagctttgacaacttaagtgaatggattgactctggtgtttgcgcagttggcgtaggcggattattaactcaaggttcacaaaatgaaattacacagaatgcgacacgcctaagtgagatcctaattacgagtcgtaacgaaagcaaatcagataccagtgaaggacaggagttgaatcaataacatgcaaaagtatatttggcgaggaaagattgttgataagaccgaagtgaatattgatcttcaggatcgtggatatcaatttggcgatggactgtatgaagtcgtgcacatgtacaacggtaatttttttacaattgacgaacatattaataggctctttcgaggagcaacacaaattttgcttaacatcaaaatgtcaaagaaaagcttaaaaaacctgttgaatactctagccaaagcaaataatcttaataatggctatatatatatgcaaatcacaagaggagataaaggaatccgcaaccatggttttaaaatgtatcaagaccaagaaccggttttgtccgcgtttacggtttcaacggttcgaagtccatcaaaatacgatacaggcgtcacaggcacgacagtaccagacaggcgctgggaaatgtgtgatgtaaagtcgcttaatttaattcctaacgtcttagccaagcacgaagctcagatgctgaaagtcagcaaggcaatatttgttcgagacggtgttgttacagaggagaaatccggtaacgtgttgatgatcaaaagcggaaaggtatactctcatccggatggatctcatattttatcagggataactaaagaggtgattaaaaatatttgcctagaaaattcgataccttatcttgagagacccttttcagaaatcgagcttttaggagctgacgaggtactggtgactgatacaaacagcgaatgtatgccagtggtagagattaatggtatgcggataggaactggtgaacctggagtggtttccaagcacattcaacggctatacgaacagaaaataattgagcaatgcggggccttgcaatagccgctcgtaatatcaaatcaaattatcctgatcttgcatattaaatgtaggcaggatttttatatagtaacagatgtcgacaataaaaattttcgtctgttactttttttgtgctcttaaattgttttattacgaaaatttggtgatattttgattgagcatatttcttgggttttccggtagttgagaatagaaaaaatagctatggcatagtgaccatagctatacatttaaacaatcttcgttcaacgctaagaaaaagagtgggtgattcgccgaagactcaaagtacatagaatactgacaatgtagcttttgatgacaaataaaaactagaaaacgtaatgccggaagcttagaattttgtttatttttccagattggtgattttctttcttcgtattacaaacgctaataaaagagagaaaactatacacatcaatcccattatgatggcataaataaacatcatatcaaagcctgcttttcctggatgtgtatcgaaccatccacctaccattgtatacatgaagacgtcaggcaaatatccgatggctgaaactatcccggacacacgaccagttttgtctacaggaataccagcgtcatcgataaccgcaaagtactggcttcgaatgacatatataaagaataagccaaaaaggaagttaataactactgccagcaataatgactttgatgcaggcaaaatcaaaaataatgcccatgaaattgtcagaagggcagaaccgccgataataactttgagtcttgatccgattttatcggctacaattcctccaataatgccaccacaggcttgtactaaataacgggttccccccaaggtggcgccgccagcaacagacaagccgtaaacatttattgcgtaagtgtttatatatcccaaaaggccatacatgctatatgcaaaaaagacaatccccacgagaatccaaactcttggcattttgagagaagagaggagacccataatattttttccaattggttcattttgagattctgtcttggtgtccttaataataaaccaatttaagataccaatgataataaccgtgatagcacatgttctgatggcccatgcagttccgagcactgtatcagcaaactgagtgtagacccaggtcatcaagaacactaatagtgcattggtcaggcctcgtaatccttcctgccaaccgaaaagccgtccttgttcagaactatcacccagcattcgagttgctttaatggcggctgaccaataggtgataatagtagatacgcccattaaaataaaaatgattcgactaatttgatatccagggaagaaagaaaaccataagcctaaaacccccgtgatcagaaaagaaaaagttaacaactttcgagcggaaaacttatcagctatgatgcctcccacaaagtaggagaacgttgcaacagttgcataaccagaagaaagtgtacccatttgagcattggtaagattcatagctttttgaatcggtacataaaatgtttctcgaatatatggcaactgaaatatgatgcccgctccggttgcgagcagaagtaatgtgccccatttttttatgaaagctctgttcatattgcccctcctagaattcaataaactgataacaagcccactcaataatgaaagtttatgcacattttgaaagcgttgtcaacttaattaattatttttggtatatgccaaaactagtgtactaatatttttgtaaaaattctttgacaaagtaaacgctttcaactaaccttgtatttgttccttgtcatattttacaagcattttttttggttgttgagttttggtggatacggaggaggaaatttagatggttagtcagactgaaatcattaagtccatgcagagcattgttggtacagcaggggtagtcacggacttaaaggatttacaggagagtagcgttgatcggtttcggaaatatgaagcgtataacaatgtcttcacacagcctattccgacagcaattgtgtatgcagaaaataccgatcaggttaagagagttttgctttatgccaataaaaatggtgtgaatgtaattccacgatcaggaaattctgcattggaacaaatgttggaatctgaaaaagaaaatcacattattcttgatgcgtctagaatgaacaaaattatcaaaattgataaattaaatatgcaagtcaccgcccaagcgggtgttcctttaggagatttagaagatgaagtcagaaaacttggtttaaccacaggccattcgcctcagtcaaaaccgttggcgcaaatgggaggattggttgcagttcgaagtattggacaattttcaacgttatatggcggaatcgaggacatgattgttggtatggaagccgtttttcctaatggggagattacaaggattaagaatgtacctcgtcgtgccgcggggcctgacattcgccatgtgatcgtaggcaatgaaggcacgctatgttttatcacagaagtaacagtaaagcttttcccttattacccacctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatc

SEQ ID NO: 72 - DNA, 1196 bp, Lactobacillus paracasei
cctgcttgcacgcttacttggttaagtcctcgaccgattagtactggtccgctccatgcatcgctgcacttccacttccagcctatctacctgatcatctctcaggggtcttacttccatataggaatgggaaatctcatctcgaggggggcttcacacttagatgctttcagcgtttatccctgccgttcatagctacccagcgatgcgcctggcggcacaactggtacaccagcggaacgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacttgtcagtctcgcagtcaagctcccttatacctttacactctgcgaatgatttccaaccattctgagggaacctttgggcgcctccgttacattttaggaggcgaccgccccagtcaaactgcctacctgacactgtctcccgccacgattagtggcgcgggttagagtgttcatacagctagggtagtatcccaccaacgcctccatcgaaactagcgttccgatctctacggctcctacctatcctgtacaagcggtacaaacactcaatatcaagctacagtaaagctccatggggtctttccgtcctgtcgcgggtaacccgcatcttcacgggtactataatttcaccgagtctctcgttgagacagtgcccaaatcattacgcctttcgtgcgggtcggaacttacccgacaaggaatttcgctaccttaggaccgttatagttacggccgccgtttactggggcttcaattctgggcttcgcttgcgctaactcatcctcttaaccttccagcaccgggcaggcgtcagcccctatacatcatcttacgatttagcagagacctgtgtttttgataaacagttgtttgggcctattcactgcggctgaccttgcggtcagcaccccttcttcc

SEQ ID NO: 73 - DNA, 37053 bp, Lactobacillus paracasei
  misc_feature (22276)..(22308): n is a, c, g, or t
gatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctagggtcgacgaacttcagttgaggagggaggatagcatttgtggtcacactgtctgatgtcgcgaaagaagccaatttttcaaaaatgaccgtgtcccgtgtcatcaatcatcctgagcaagtgacgcctgagttaaaacaactcgtcgaacaagcaatggcgattttgcattatcgacctaactctgcagcgaaggctttggccaataatcggactaacgttatcaagtttttgattcttgaagatgtggatacgaccgaaccttattacatgacgttgctattcggcattgcccgaggacttgatcgtcagcagtatgctttgcaattagtgacagatcgcgagcatcttgatttggatcacgccgatgggtacattattacgggtgcgcggtcgactgattgtcaatggattgatcagttagcgaaaccggttgttttatttggggaaaatcgtcatggttatgattttattgatacggacaataaattaggcgaacagcaagcaaccgaatatgcgctggccaagaattatcaatcgattatttttcttggcattgatgtgagagaaccgtttgaatattcgcgtgaagcagggtatatcaatactttgcagagacatcaaaaagtaccgcagattcatcgaatgggtaatcatagtcacgaatcgcaacattttatcagtgaaaattggcgaaagttcgcgcgaaatactgttttcatctgtgcaagtgatcgcctcgcgttaggtgcggtcagagcgattcaacaaaatggtgggcgaattccaaccgactttggcgtcatcggatttgatggcgtttttctggatcaagtctcaaatccaaaattaaccaccgtgaaacaaccggtggtgcaacttggtgaactattagcacggatgctcttgcaaaaaatcgcccagtcaggtgcacaacaaggtgaactactggtgccgccaaaattagtgctgcgcgggacgatacgcacttaggtgattatagaattccgatctggcaaaatgagtttgtctactgataggtcggggtaacattcacagttatcaaacaggccaacaattttccgctgggaaattgttggcttttcttcacttcattttgataacggtaacaaacgcagttaacttgtatcatgcgtgcgctttcactatgctagttggaaaaggggggcgggtcacatgagcacttggtataatcaggcgattatttatcaaatttatccgaagtcatttcaggacagtgatggcgatggtattggggatcttaacggcattcggcaacgcataccgtatctgcaggacttaggcatcaacgccgtttggctgaatcctgtgtttgtatcaccgcaagtcgataatgggtatgatgtcgccaactattacgcgattgatgagcgaatgggaacgatggccgatatgcaggctttgattcatgaacttcatgaagcgggtatccgtatcatcctggattttgttttgaaccacacatcagatcagcacccgtggtttcaagatgcaagccggaatgtaaaaagtatttatcgtgattattatattttttctggacatcatcataaaagaccaaataattggggaagcttcttcggcggctcggtttggtcgcctgatccagccggtaccggtcaatcctatttccatttatttgatcagcacatgccggatttgaattgggataatgccgaggttcggcgtgcaatgggggatgttgctgaattttggctaaacaagggaattgatgggttgcggcttgacgcgtttattcatattgccaaagttgatctggcgcaaaactatccaacgtcggaaagccaacaagagcctgtgattgcagaaccgttttttgctaatctgcccaatgttcagcggtggttgcggcccttctgtgctcagatcaaggcagattttccaaatacctttatacttggggaagcggcaagtgcaaatgtcaatcttgctgttgactacacgagccagcataacaaattgatggatagtgtgattactttccgatattttaccgaagatacgacgcaacttgacaccagcatcccagcgcagtatcagccgaaacctttggattttgcaaagtttaaacagacacaggttgtttggcagcaaacacttgctggtgtgtcgttgccgacgctttattggggcaatcatgatatggctcgtctggctacgcgcgttgcccattcagcgattcaggcgagaagtctggcagtgctgatgtatttacaacgcggtattccaatcatctattacggtgaagagctagggcttgaaaatctcacgttgcctgatgcgaaagctttttccgatccaagcgtcccgcgtttcattgcagcagctgtggacgcagggtatacccaggaggcggcgttagcgatggtcaatgcgacccataagttgccagcgagagggccgatgacgtgggatgcgacaaccaatagtggctttacgagcggcacgccttggttggttggcaagcgcagcagtcgcacgcatgttgtcgaacaacaacatgatccgcacagcagccttgcattttacaagcaattgattgctttaaagaaacggtcggtctttcaaacaggcagttttcgactgttgagtacggggccagacagctatgtgtatcttcgccagacagacaaggcgattgccgttgtggcggttgctttgagtgataaaacagtcaaccttagattgccagccggtgactatcaagcggtgctaatcgtcggtgacgcgacactgagcgaagaaacactgacactatcagccgattcagcagcagtattcattcaggaaaaggagcgtgctaagccatgaatttagcagctatgtctcatcgaccagaaagtgaagattgtttcttatataccaataaaaagctacgtttgcggttccatacggcacaaaacgatgtcgccaaggtggttgttttgtatggtgatccttactggcaagagcttgatcagcatcaacaatatcggttgagttatcagcgcaaaccgatgagtcagatagggacaggtcaagttgctgatcattggggagtgaccttggaggcgccttatcaacgtctgcagtacctgtttgaagtgaccggacaggacggtagcaaatggttatttggtgatcggggattgcgaaaagacacagagtccgcgcgaattgataccggtaattattttcgtgtgccgtattttcacgagattgatcgggtgaaaacgcctgattgggtgaaagaaaccgtttggtaccaaattttcccggaaagatttgccaacggtgatagcacaaatgatcctgttggcacgaaaccttggcgaccatctgatcatcctggacgtgatgattactatggtggtgatttacagggggtcttggatcacttagatgatttgcaagcattgggtgtcaatggtctgtacttttgtcctatctttaccgcgagttcaaaccataaatatgacaccattgattatttaacgattgatccggatttcggtgataagacactgtttgccaagttggttaatgaagcccataaacgcgggatgcgcgtcatgctggatgccgtgtttaaccacatgggctttgctagcatgcagtggcaggatgtcttagcaaatggcaaaaaatcacgctttgcttcgtggttccacattcatgattatccattgacgccatttcataatcccctgaaaggcgagggagcgccacaatacgatacatttgcgtttgagtcgcgaatgccaaagttagatacggccaatccagcggttcaggattatctactgcaagtggcaacttattggattcaagcatttgatattgatgcctggcgtttagatgtggcgaatgaagttgatcatcatttttggaaaagattttacagcgctgtcaccgccattaaaccggatttttatattttgggcgaggtttggcatagcagtcaaccttggttaaatggcgatgaattttccggtgttatgaattatgccttcacgcagcaaatagaggaccactttttgaccggtaagcagacagctgcggggatgaccgctttgttaacggaccaattgatgctttaccgcgatcagacgaatcaagtgatgttaaatatgttagattcgcacgatacaccgcggttgttaacggtagcaggtgatgacattgagctagcgttgcaagcattgacctttgcttttcttcagacaggtacgccatgtctttattatggaactgagatgggcatggatggggaaaatgatcctgatgatcgaaaaccaatggattggacaaaattaggtcagccaatttggcaacgggtggcgaagctcatcggctttcgtcgtgaacatgcggctacccttgggcgtggtacgaccaaattagaagtgacaccttctggattaattaaggttgtgcgccacggccgtgaaacgctgacggcatatttcaataccacagcgtcatcggttcctttgacggcggcacctgttttgcatcaagggtttgctcaaaatgagttagctccaaaaggatttgttgtagcagtaaactaattatgatagcggtaacattcattttgcgattgtacagcgctttcattcatttataataaagcgtgtcctttaagtggttgttgccatgactatcgtaaagaaaatggtcacaggggagaagtggagaagatgaaaagaacatttgcagtcgatccgtggatgattgcaacccatcagtttcatccagaggacaagcggcttcaagaaagtttgacggcaattggtaacggctacatgggcatgcgcgggaattttgaggaacagtactcgggggatcagctttcgggaacttatctcggtggtgtttggtttccggataaaacccgcgttggttggtggaaaaatggctatcctgcgtactttggcaaagcaatcaatgcacccagctttttgccaattcgcatcaaagtgaatgaacaaccggttgatttggccaaaaacagttttcgggatttctatttggcacttgatttacatcagggattgttaactcggcagtttatctatgaaggggatcaggttgaggttcggtttgagtttcaacgatttttgagcaatgtggtgaaggaagcagccttgattaacgtgaaagcaactgtgcttagcggtaaggcaacgatcacatttgatgctggacttgaaggtcgtgtcgctaatgaagatagcaactatgatgagcggttttgggaaccgcaagctgaggatcccactcaaaaaaccattcaattgcaaaccaagccaaatccttacgatgtaccgcaattcaccgttctattgaagcaacagttgcgtgtcaatcatcaaccggtcacaggcgttgtcacgactggcaacggctggttaaacgaacaaattgtggctgatgtggcaactggcgaaacttatcaactggaaaaggatgtcattgtggttactagccgcgatgttgcgccttctgatcagcagcaaacagccgcagctttgatgaccacattgcaaacacacagtttttccgaacaactggctgcccatacgcagctttgggcgcaacgctgggagcaaagtgatgtggtcattgaaggcgatccggccgcacaacaaggcattcggtttaatattgcgcaattgtttatgacgtactatggcgaagataagcgccttaacattgggcctaagggttttacaggtgaaaaatacggcggtgccacttactgggatactgaagcttatattgtaccaatgtatctggcagtgacgcccccagatgtgacgcgagcacttcttcaatatcgccacgatcaattacctggtgcgtatcataatgcacagcagcaaggactggccggtgctttgttcccaatggtgacctttaatggcatcgagtgtcacaacgagtgggagatcacatttgaagaaatccatcgtaatggtgcagttgcgttcgcgatttatcaatacacggcttataccggcgatgaaagttatgtcaaccgtgatggtattgaggtcttggtggggattgcccgtttctgggctgaccgggtgcattttagcaaacgtaccaatcagtatatgattcacggggtaaccggtcctaatgaatatgaaaacaatgttaacaacaactggtataccaacaccatggcatcgtggacgttaagttacacgttagcgcgcctggccaaggcgaatgccgacgtggtcgctaaacttgcggtgactgcagaagaaaaagctaagtggcaagatattattgatcggatgtactatcccgttgacgatgaattagggatctttgttcaacacgatacctttcttgataaagatttgcgacccgccagttcgattcctgctgaccagcggccgattaaccaacattggtcatgggaccggatcttaaggtcgccttttatcaaacaggctgacgtcttgcagggcatttattttctcaatgaccgcttcacccaagcacaaaaagaacgcaattttgatttctatgagccgatgacggttcacgagagttcattaagtgcgtccatccatgccatcctagcagctgaattagggaaaacggaaaaggccgtggcgttatatgcgcgaactgcgcgtctagatctggacaattataataacgacactgatgacgggcttcacattacgtccatgagcggcagttggttatcaatcgtccaaggctttgcggggatgcgctatgatcacgaccggttacgattcaagccatttttgccaaaagaatggcaccgcttcagctttaaaatcaattatcgtggccgtttgctggcagtggacgtgagtgaggaggtcaacgtgatcttgttagccggcccgtcaattgatattgaagtgaatggtgagctgcagcacttggaaaagggggatgaccatgcttaaaggcttcatttttgatcttgacggggtggtcaccgattcagctaagtatcatttagccgcctggggggagttggcaaaacaattagggattaccctgccagctacggcaaatgaggctttacgtggccgttcccgaatggactcgttagcgatcatcctcggttacggtgatcaacagaagcaatataccgaagttgagaaagaaaacttagcagatgaaaaaaatcgacgttatcttcaattgattgccaatatgacgccagccgatattctgccgggtatcagtcaacttttatcggacgccaaggcaaggcatttaaaattggcaatcgcatctgcttcaaaaaatgcaccgactattttgcgtcaattgaaattatttaatcaatttgatgcgattgttgatccagctagtctgcatcgcgggaagccagatcctgaaattttcatcaaagcgcagaacttgttgcaattgcaagcagatgaagtggtgagttttgaagatgcatctgctggtattgcagcaattaatgctgctggtcagttttcggtgggtatcggcgatgccaaggcgctcgcagctgctgattatttcgtggcaaacacaggcttattgcgattcaaatcaatcacgacagccttcacaaaatggcaaaacgcgttgaataagaaaggagatggatgatgtcatggttgagattgatttgaaccatctttataagaagtatccgaatgccgcacaagattctgtcaaagatttcgatctgcacattaagaataaggagttcattgtctttgtcgggctgtctggctgcggctgatattcttggcctgacagagtttttggcccacaaaccagcagacttgtctgacagccagcggtaacgggtggcattagggcgagctatggtcagagatgcaccgatttttctaattgatgagcgctttccaatctggcgtacaattgctccggctcggcactatgatctttaagtgatatcaggttaagtataagaaatgaaagagaaatggttttcaagttttgttaaaaatcatttctctttattttgtaaatataaatgcctctgaaatctctttttgtgtcttgaaaagtcaaaatgttttgacacttaaagagttggtattatactgaaggtgtcaaaagagtttgacattaaaggggcgattatcatgaagaaaatggatgagatggagcttaaattcagagatcaatcgattagatactcttgggctttcatgattttcacattattcatttacgaatttttccacgtgatgcattatggaaaatttgattttatttctgttgtggtaaacgttgcagtgggtgtccagattgctagttttttgtggcttaaacatcgagcagataagactgataaagaaccgagaagggtgttaattggcacgattgtcattgttgctgttgtgctaaccttaggcatgattggattgatgttccatggaaaataatatccacgtactcagaatgcgccaacaattaacccagcaagaactggctgacgcagtgaatgtaacccggcaaacgattaatgccatcgagaataataaatacgacccaacactctccttagccttcgcacttgcagaacgcttggagacgactgtggatcaactgtttcaacattagagaagctgaaaattatttaaggctacaaaaagaagagtgactttttccgatcaccgcatgtatgcggcggaaaagtcactcttctttcgttttactgtagatcaaaggtcatagtttaaagattccagtgccaaggcggagcaatcggaggccagatggggctcagccgtgcaaacaacacagcgaagggcttttgagctgatgttgttaggcgacttcgagaccggtttttgggctcgaagcgccgtcaccgcgttccagccccatctggccggagattgcggagtttggcacggcaggagtcgtttttgtctgacgcttgtgccaaatcatcccgcatctaacaaatcataagttctagatagaaactgaagaagcaactactgctgacgattactcctcttcatttaactcatcaaaatcatagtacaaatctctttcaggaagcaccacagcggcatttgtttgggtatccaaggcttcggcttcgcgttccggatggaagctatgccatggcacaatggttcgaggattgacttctttcgccaaagtaattaaatcctcacggctagcatgacccgaggcattcatgaactgcaaggggatgtgatgcgcttctagccagtctttgagttgcgcaaaccgcgggtcgtaatcgcctagtggctcgccgttactgtggatgtaggtcgtgatgggcatgtcagtcagtcgttccagatggtcaaaactattttgcaggacatagtgttggggatcacgggcaatgtccgtcagactgattgtttgaccaagaatagcatcgggtttttgatcggtcatggtggtcagcacagccgcgtcatcaggttcccacaccaattgacggccggcagtgtgtgcactggcctgaaaacccgccagacgctcgtaattgcggatgtaaggattgatgacgacaagcgtcgggctttccgccagcactgtctgaaattgcttctgcaggctcatttcggtcaatgggatgctggggtgatcctgatcttcaacaggggcagctgtgtcaaaagagaagctggtgccttccaacataaacaagcttagcttttcttggttaaatcgcttggcccaggcatgaacccgttcagcatgcgggccatttaaccggacatcaccggaatgggcatagcgtcgtgagccgtcattgactagaagcgccatgacgcctggctcgtcgtgatcactgtggaagcctgttacggtgaggtcaccaatggttatgggctgttcataggcaaggggatgcagatttgcaactggcttttcgatgcctagtttgattaacagttgatagagcttataggatggttccgaaagataaatcggaatcggtttctttaaatattgcaatgcacccatgtggtcaatgtgcagatgtgagataaagatggcctcatgtgtgtaaacgtctggttgatcaaaaaatagttccggcacatgcggcaatttaccattatcgatggcagagctgactgtttcgttgctgagatcagcagccacgccgaagtccatgataacgcggctggttttagttgcgaattcgacgatgttgccgccgatggtgtttaacccatttaaaaagcgaattgttgtcacagtgttacctccaattgtttcaatatcattttgagaacactaaagcgtaccccgccggctaccgaaaagcaaacaaaaaccgaatcagcacatagctgattcggcaaagatcaaggcggagcaaacaattacttgtttgtcttgatgatggtttcagtttgaccctgaagtgtcttcaaagcctgatctggtttttcatgcttagtcagcatcgcatcaaccgcattaagaagatcgttacgatattctgagaagccgatgaaagcggtggactggaagccaaagcccaaagaatcaactgcagcttggctagttgggttagcactcagatatttcttaaagtcagcagatttaacagcggacttacgcagtggcacataaccagtcaattgggcccacttggaagtttccttctcagaaagcaggtacttcatgaatgcccaagcgcctttttgcttatcgctagatgcggacttgaagaggacgatatcattaccggcaagttcggttgcctttttgcctttgtagcttggtagcggcattgtgccccacttgaagtctttcggtgcattttgcttcatgttggtgatcccggcacttgaaccagcataaaagagtgttttaccagcggtgaagttcttatcgccgtaaatgtcttcgccggcagtcttggcttcgccgctgttaaccatgtccataatgaagttagcagcagttaaggttttcttgctatccaagttagctttcagcggatcagctgaaactaacggattgccagcctgacgtgccagaccttcaaattccatatcaaaactcttatcgaaaccaatagcggcaataccgtctgccttcagcttatcggcatcttttttgatgtcttcccagctggttggcttggcaatattgtatttcttcatcagtgcttcattgtagaaaagaatacgtgtggacttggagaatggcacgctgtaatacttgccttgatacttggagctggacaagaaggctgggtagatatccttcaagtcgctgctgctcatcttgtcgtcgcctttgagcatgtattgatcaagcggggaaataaaaccatttttcacgtagtcaggaacagtggtgtaagttgtttgggcaatggttggcaggttgcgagattttgctgcagccatgatcttttgttgcaaggcggtgtagttaccttgcgcggtgccgacaactttatactgtttctgactcttattgaaatcattgatgatttgatcaagagccttttggtaaggaccgttcatgccgtgccaaaaagtgatcgtcacccgtttgcccgaatcactcttggtacttgaactcaatttgctgctgctgttactgccgcaagccgtcaaaacagcgacaagaacgacggtgaacattgcaagtaatgcttttacccaagtttgctttttcattttggtagattatcctttcaatccagctttagaaatcccagcaataatgtatttctgcaagaagatatacaaaacaaccattggaatgatgacgaatgtggaagcggccatcagaagttgatattgcgtgccggcatcggtcgtgaaggcctgcaagccgactggcaaggtacgcatcttgtcagagttcgtaacgatcaatggccacatgaaggcattccatgagccaatcacctgaagaacggtgaccgcggtaatcgttgacttgctcattgggacaagcacttgccacaaatatttccaatcggacgcaccatcgattttagcagcgtagtagatctgattcggtgttgattggaaagtctgacgcaaggtaaaaacggtgaagaagctggccaaccacggcagaatcaaagcgccgtaatggtcaatttgccctaagtgtgacaaggtcacgaagttagggatgatcaacatttcacctggaatcatcatggttccgaggaaaataatgaacaagaggttcttgccgtaaaacttcaatcgagcgaaagcaaaagcggcaagaatactggtaaagagctgcccgaccgttgtgataacagtgacgatcgtgctattaatgaaatactgtccaaacggtgcttcgttccacgccttgacatagttaccccattgtagaaccttagggatccagatcggtggaacggcaatcgtttccggtgccgttttaagtgatgtggagatcatccataagaaggggatcagcatggtgatcgcgcctaaaatgacaatcaggtaaagcagaattttactgatttttttagccatgtttttgcctcctccttagtaatgaacgtgcttgcgggaataccacaactgcacgagtgtcactagcaggatgaggaagaaaagcacgaccccagacgcagcagcaattggatacttgtactcggtataaaatttctggtacagatagtaaacaattgtcaaatcagctttacctggtccgggcgtgccttggaacaaggcgaagatttcatcgaacaccttgaagctgccgatgatcccgttaactgaaaccaagaaagtgattggtgatagcatcgggatcgtgatgttccaaaatcgctgacgcgcgttggcaccatcgatttcagcggcttcgtaatacccgtggtcaatgttgttgagaccgaccaagaaaagaatgatgttgaagcccagacttttccaaatactcataatgatcagcgccagcagtgcataatgcggatcagtcagccagttaatgggatggataccaaaccagcccataaagtagttgatcagcccatagttactgtggaacatccaattccaaaccatcgcaatcgccacagtactggtgacaaacggtaggaaatagacggttctgaagaaaccggagatgatcttcacctggtttagcaataaagcaatgatcaaggataaaatgacagtgatcggaaccacgccgacaacaaaaaccagcgtattccgcacagccaagtgaaaatcaggatcattccaaagataaacaaagttatcaaagccccaagcactgaccttatcagtataaaaatcatacttcgtgtacaaactcatcagaaatgagttaataatcggccagatattgaaggtgatggtaatcaccagcattggcagcaaatacagcgctgctttggcggtcgattttaggcttgctttttcattcagcatgactttcaccaccaaaaatcaaggcgccggattggtcaaaaagaaagaaacccgacttggtgagatagaaatccagatctggttgattagctgcgacaccagccatttctgttgacaacaggtgctcgccgttataagtaatatcggctgtagcttcccgcccatatttagaactttgcgtgatcttgccatgaagcttggctaggacattgtcgccggcatcataagggatgatggcttcactacggatccctgcggtgactgcctgcttcaaaatatcttctgacacagcgctagctagatcagttgtcaacgcttgtgctggcaaggtgttgatcacaggctcaccgataaacttagcaacgaacaaattgttcggtcgctcgtatagtttttgcggggaactgaactgttgtatcgaaccgtttgccaaaaccatgatgttatcagaaatgtgcaatgcttcatcttggtcatgggtcacgaaaatcgtggtaacaccggtttcgcgttgaattcggcgaatttcttcgcgcatctcaattcgaagccgggcgtcaaggtttgacaacggttcatctagcaacaataggctaggggacttggctaaggcacgtgcgatagcgacacgctgttgctggccgccagaaagtgcccctggtttcttatcaagctgatcctcaacatgaaccagtttggcaagatccttggctttggcgtgccgttcagccttgctgaccttggccattttcagtggaaaggcgatattgtccaacactgacaaatgcggatacagactgtagttctgaaataccatcccaactttacgcgctaaggcatcttttttagtcacatctgtatcaccaaaaaagatttgcccagcggtcggggacaacaacccggaaatgagattcagggtcgtggttttaccgccgccggaaggacccagcagggaaaccagcgtgccatcgggaatggtaaagttcagatccttcagggtatctgtcttgccatcgtaggacatcgtgacgtccttgaaagtaactttcaacccagtacgctccttcaaatagttttctgctcctcacctccgttcgtcggtctccagcaacaaaggctgtaagaacgcgcaaagagaaaatttggaacaagatattgtggttgcttcaccatgattagctacatctagagaaggcaaacacaactcttctcacattttaacccagattcactgaaaaatggactcattcgcccaaaaacattttgattatgtttaattgccatcacaacgcgaatgttcgccttttttgctataataggaagcatgcaaaaggcgcaacttgaaccaactgctttcgctgctgatgagtgtcagcaaattggcggttcattcagcgccaataaaagaggagcgatttttttgataatacgtccaagcaaaccggacgatgcgccgcaagtagcaccgttgatcgatattgtgtttacggagatggaaattcctcagttaatgaaggttcctaagaagaccctgtactcggttttggaacaagcctttttactgccaacttaccggtacggttacccgcaaatgttggtggctgatcatgacggtcagattgaagggattgctgttggctatttgcatgagcaggaagcccatatcgacgatgctttaaaaccgttgttgcctaagctgggattgaccccaaattcatcgcttttttcagacaccgaaacttatgccggcgagtggtatttagatacgctagcagtcgccgagacagcgcagggacatgggatcggaaccaaattattaaacgcagtcgatacggttgctcgggctcggcacgctaaagtggttagtctgaacgtggatcagcagaatccgcgggctaaaaagttatatgagcgcaatggttttcttaaacacggcgagttgatgattggcagtcatcgatacgatcatatgctgcggccggttgtgggcgaggaagtttaatgttagtcaataggttagcctaaagcccttagcccgccgaacgccgcaatctcaaccagatggggtttgcgacgcacagccagagtggagacggcacttcgagtccaaaaaccggtctcgaagttgcctaatcacatcggctccaaggacaggttgtacggctgaacgccatctggtctacgattgctgcgccttggcactaggatctctaaatagcaatgagaaataaagacgactggtattccatggaggaaaatcagtcgtctttatttcatagctaggaatgatggtcttagcttttcttttcgtttaatctgggaaatccagcccatattcataacgcttcaatggatcggccacacccacatggcgaaagcggtcgaggatagcagctaacaaaatggccgctggaatgtcgcggttattgggaatggtcaacttaacgattgctggtgcaatttcttcagcactgaagatcgttttgaccccatgaaacacttgataatggttattcaaaagattacccatggcgacccagttgagatctgagataaagatgaactgatgccagaccccaaacatttttttgacgctggcaaccttgcgattggcgatataaagatcatagcgcgggaaaacgctgaccgttttttgtcgaatggatccaagcggttcgccgcttaatgtattcagatcgaagccaccattaatcagtccgtgccgaccagttagaatgtaggccggcttgccgttatcggttttgaccacacttaaactactcgtgcttaaagcattgatatcaagatataacgccatcggccaacctcccttatggtgagcgtgaactggcgcggttagaaaccggagcataagcgggctcaagtgcgatgggcgggttttgcccattgtgcttgaggtccttatgagcaggtttctgcgtcagtgagcgcgttatggtgagcgtgaaccggcgcggcgcctgtgtttaaaaaattaaaatcagcaaactatcgctgcgccaatgattattagaattgagcgtttgatttttccgccttattaatgcgaatggctttgcgaattgcctgagcaacgccgttttcgctattagtggcagtactgccccatgcgagcttggtgatttcggggatggcgttccccatcgccatgccatatttggccattttgatcatgctggcgtcattcaagttatcgccgattgtcatgacctcatccatggtaataccgcgttgcttagcgaaagcttcaacagcataacctttttgcgctttgatgttgttgacctcaatgttattcgcagagcttgaggtgacacttaatttaccggtggcttcaaaaaccttcgctggtgctttcaaaatatcgcgttgctcgccagtaaacgcaatgattttcatcacttggatagtagggtcggctagcagttctttatagtcactaacgtaattaatgttcatgatttccagccgtgcagctgcgagcgcaaccgccagtttgtaggttgtatctgggttgagatcaaccaatagatcggcaacattttgaatacgtttgacgcggctgtccgagaagacgcctttgttggtgatgatttcaaaatagatgtcgtccttttgcaaggtctcgacaatgaaatcgcttaggtcactagcaattggaatcgtgaccaccaattcgccagcctcatcaaaaaccatggcgccgttgagtgtaatgaatgctggtttgagatcttgggcggcaagtaacggtgtagcttcggtgacgccgcggccagttgcgaccataaattcgataccagcggcttgcgcgtcacgaatggcttgggcgttttcgtccgaaacttccattttgtcgtttaaaagtgtgccatccatgtctgatgcgataagtttgatcatatttactgttccctccggtttgtcatggtgcggttacgcctccaattctagcatgaaaaagcgtttcccggtagcaaacccgcggtgattcttgtacactatttgcggaggtgcacgtcttgaaaacattaatacataatgactggcagacggtgctggaaccggtatttgaaagtcctgagtatgctcaactgcatgcgttcttaaaagaagaatacgcgacaaaaacgatttaccctgaaatgcaccatatttttcaggcattcgaatggacacctttccatgatgtgaaggtggtcattctaggccaggacccttaccacaatccgcggcaggcggttggtgcgagctttgcggtggcacccggtgtcgctttgccgccgtctttgcaaaacatttataaagagttgcaaagcgatttaggctatccaccggtccatcatggttatttgaaggcatgggcggaccaaggcgttctattgttgaatgccgttttgacggtacaagccggcgaagcctattcccatcagaatcatggctgggaagagttgacagatgctgccattgctgccttgtctgcacgcggcggcgttgtgttcatcctgtgggggaacgcggccaaaaaaaaggcggccgtgattgatacgagcaaaaacgcgattattgcatcggcgcacccaagcccgttatctgcatctcgtggcttctttggcagtcgcccgttttcgcgcaccaatgcggcactagaaaaaatgggcgaggccccgattaattggcagttaccagaaacggtgaaggcgaattaacctgaattgactagccttaagtagctcagacacactgtttttccattgtcttcggctagtcacgacccgataaaaacggtatgatgaacaagaataaagcgcttttatggagggataagatttggacctatttgaaagtttaaaagacaagattaatggcaaaaatttacggattgtatttccggagggcgaagatccgcgcgttttgggcgcagcagttcggctcgcagctgacgggttgatacaggccatcgtgctaggtaatcctgataagattcagacattggcagctgctaaaagctgggatctcagcaagttgacagttcgcgatccagccaacgatgacattcacgctaaaatggttgcgtcctttgttgagcgtcgcaaaggcaaggcaaccccagaacaggccgaaaaaattgttcaggatgccaattattttggtacgatgctggtttacatgaaggaagcagacggtatggtttcaggcgctgttcattcaacggctgacacagtccggcctgctttgcaaattatcaagacgcgtcctggcgtgcatttggtcagtggtgcgttcattatgcagcgtggccgtgacgaacgctacttattcgcggataacgccatcaacattgatccagatgctgatcagctggctgaaattgcggttgagtcagctaaaaccgctgccttgtttgatatcgaaccaccgcgcgtcgccttgctgtcattctcaaccaaaggcagtgccaagggaccgcaagtagataaggtagttgaagccactaagaaggctcatgaactggcacctgatttggccttagatggtgagttacaatttgatgctgcttttgtcccaaccgttgccaagcaaaaagcccctgattccaaagtggctggggaagcgaatgttttcattttccctgaattacaatccggtaatattggttataagattgcgcaacgattcggcgggtttgaagccattggcccaattttgcaaggcttgaatcagccagtttctgatttgagtcgtggggcaaatgaagaggatgtctataagttggccattattacagcggcccagaccttgctatgacaagtttgaaaagagacttcactagtgaggcagcactgcaatcctttgcggcttcactgggaccgcagttgcaagcgggagacgttttgctgctggatggtgacttgggtgctggtaaaactagtttcaccaagggcttggcaaaaggcttaggcatcaccgattacgtcaaaagtccaacatttacaattgttcgcgagtatcgtcatggccgattaccgctgtatcatatggatctgtatcgcttagaagacggtggggctgaggatctcggtcttgaagagtacttcgaaggtgatggggtgtctgtcgtggagtggccggattttttgggattaagtgaaccagagacctatctgatgattcattttcaaaaagatgacaatgaagatacaacgcggcatctcgaatttgtgccgtttggccaacactatgagaatttactcgaaagcctatgatagcaagcacgcaaagaacatttgcgtgcttttttgatttggtttggtaaagtggtgcagaacaaagaaaaggcggtgcgttatgaaatttggcgaacagttggccgctttgtttgttgggcttttcgttggcgaagtcacaatctgggcagttatccacacttttcgaagacaatggcgtgcatgagggtcacagaatttggtctggctactttcactaggacaataaatctacttttgataacacgttatactttgataaccaaagtatgcatggtagactattgacaacgtgagaaagtgagctaattcataacgtgaacaggcacgttggcaagctgagatattggtcttaggcgtgatgaccagttgtttgtcattgcttctgaggctcttaccatagaggcttgagcatctgtgagcgcgttttaagtaaaggagtagtggccatgctagaagtcaaggatcttgtgaagaccttcggcacgatgacggcggttgatcaggagagcttcaccgttaaaccaggtgaaatcatggggttgatcggccaaaacggggcggggaagacgacaacatttcggatgattttgaattttttgacaccagactctggtgccatcacttggaatggtcatccgttaacagctaaagattatgacaccattggatatttaccagaagaacgcggtttatatccaaagatgcgggttcaagatcaaattatttattttgcgcgattgcgcggtatgcgtacgtcagaaattaaagccaagattccagaatggatggaccgatttcaggttaaaggcaagcctaccgataaaatcaaagacttaagtaaggggaatcagcagaaagttcaggtcattgccacaatgattcatatgccaaagctggttattctagatgagcctttttcgggacttgatccggttaactcaagcctgttgatggctggcattcagatgctgaaagataatggcgctgcgattatctattccagtcatgatatggctaacgttgaggctgtttccgatcatctggtgatgctgaaacagggacggatggtcttaaacggagcggttggtgagattcgcgaaagttttggtcggaccaaactattcattgagtcagggttgactgccgatgacttgcgtgaatttgacggggtaacgaaaatcaagcagcatggtcaagaatttgagttgaccttagccgatccggcagttggtcaccagatttttgctaaagcaacggaaaatggctacataccagagttccgtcaacaaccaccgacacttgatgaaatcttccgtttgaaagcaggtgaagctgatgcataagttttgggtggttatgagtcaggtctataagaaaaatgccagaagtggttcatggatttttctagtattgtcaccgctatttttccttgcgattgcttttggaattgttttttatatttccaaaacgcaagcacctgctcaggtcgcagttgtcagtgacgttggcgttgtgcgccaagcattgagtaaacaaagtaccagtgatttacgctttaagccgtatacttctgctaaaaaagccaatgatgcactgaacaaagaagatcttgatggcattttaacggtgaatgccaaagatgacttcaagtcgcattatgttgctcgcgataacggtcagacagttgagacttcaacgctggtggcagcgctgagcggattgaaattgagcagcacggccgcggccatgaagctgacaccagctcaggttaaggctttaacggcaccgccgacagtgacatcgaagacggttgccattgaggatggcaagcaggtagctaaatccaatacggcacaacttatgaatcatggccttgcgctcgtttcgatggttttgattctgatggtcaccatggtgtatggttctattctggcacaggaaattgcaactgaaaaaggctcgcgaatcatggagatccttttgtcctctgtcagtgccacgacgcaattctttggcaagttggcgggtattttcgccttgttgctgacacaactggttatttacgtgattgccggtgttatcggctggcaatttttgaaaaatcaaacaatggttgccggcttgttaaagcaagtggatctgtcgatactagcttctgggacaaccgccatgattgcgcttttctttatcatcggcacactcacttattcggtcttggctgcattaaccggctcgcttgtttctaatcaggaacaagtccagcaagctgttatgccaattaccatgctggggatgatcggctacttcattacnnnnnnnnnnnnnnnnnnnnnnnnnnnnnnnnncccaagccaatgattcgacgctggcacaagtaacaagctacgtgcctttcttgaatgtttttgttatgccaacgcagatgtcgctaggccgagcaagtatgggtcaggcatgggtcagtgtcggtattagtgtcgtctttctcgccttgtttactttctttacggtcgcggtttatcggaataacgtcttggtctattccggttcgggattgtggcaatcaatgaagacctcctttagcatttggaaggcggaacgcggtgtggctaaaaaataaatataattagacaaaataggcaaaataaaaaggcgattcctcagcggagtcgcctttttgcatagcagatatattcagcagttaatgagcgcgcagtcgggtcaaacgttgagcggttgccagtcgtacctgaatcaacccgcttttgaaagcttcatcatgcttttaatccgggcttcgccaaagtgctcattttcggcgatcaaaattcgtgcgcaggcataactatccgccaaggcattgtggtgatgctcaagcggaatgtgcaaggcggcactgacagtatctaaccgatgattcggcaacttcggcaaaaattgtcgcgaggttttaaccgtgtcaatcacttgatagcgcggtgccgcaataccgtaacgatccagtgtcagtcgcataaccgaaacatcaaacggtgcattgtgagcggtcacgatccgacctggcgtatagaacatttgaatatgcggccaaacttgatcaaatgttggctgatcttgaaccatttcagggatgatgccatgaatgtgaatgttttgggcatcaaactgcatctgcggattaataagggtgtaaaaactgtcaaccactttattttgctggacgaccacgagcgccaatgaacacgctgaggctcgcttgcgattggcagtttcgaaatccatggcgataaagtccatcgtgttttctcctaaatcaagtcttttgtgacaagttcaactggacagtggtcactgcccataatgtcggtcagaatttttgcatcctgaatatatggtttgaagttgcggctgctgacaaagtagtcgatacgccaaccagcgttattagcgcgggcatggaatcgataactccaccatgagtaagtgacggtatctggatacaagttccggaatgtatcgataaagccgctatctaactgttttgtaaagtcagcccgttcttcatcggtaaagccggcgttgtggtgattggtcttgtcatttttaaggtcgatttcttggtgcgcgacatttaaatcgccgcagtaaacgagcggctttttgggcgcgagttggttcgtgtaggcaagaaaatctttgtcccattgctggcggtaatccagccgcttcagttcaccaccagagttcggcgtataaaccgtcatcaaatagaagtttggatactctaaggtaatgatccggccttcagtatcatgttcaggaacgcccatcccatacgtgacattgagcggttcatgtttggtgaaaatggccgtaccagaatagcctttgcgttcggcgtagttaaagtattgatgatagccaggcagatcgagttcaacttggcctgcctgcattttggtttcctgcaaacagaaccagtcggcgtctaattcattaaaaatagtcataaagtctttttttaaaacagctcgtaagccattcacgttccaagaaattaatttcatcaaatgattcactcctaacgatgcattgcggttccattctactagatttgacagatgattgcgatatgcagagcgcgaacaggcttctgcgcctgagaacgcgttttctacgagaagtcaaaacacagaagtatcattcaattcaatttctaagactgacagtaaagatctagggaaagctcttcacagccttcccgtgttcataacagcaattatctgctaaaatagcttagtagtatttgtgaaaggacctgatgttgtggtggatgcgccgcgtacgcttgaaggaattaccatgatgcatgatgaacctttgagtcattatacgtttacgaaaaccgggggaccggctgatttattggcgtttcccaaaaatgtggccgaagtgcgggcattagttgatgacgctcgtgaccaaggcttgcctttgacggtgattggaaatgccagcaatttaattgtccgggatggtggcattcgcggactggtgttgattttaaccgaaatgaaaaccatcacggccagtggcaatcaagtgacagctgaggcgggggcgcggttgattgatacaaccgaagcagcttaccgagcaggtttgactggtcttgagtttgctgctggcattcctggcagtgttggcggcgctgttttcatgaacgctggcgcttacgatggtgaagtctgcaacgtcatcagcagtgttgacgttttgacgcgagaaggcgaattaaagacgtatgatcaccgtgaactgaaattccgttatcggcacagttttgttcaggatacaggtgatgtcgtcttaagcgctacctttacgctcaaagcgggtgacaaaccagtcattcgagcaaaaatggatgagttgaatgcgcgtcgggcggctaaacaaccacttgaatatccttcttgcgggtcggtctttaaacggccaaaggggcattttgttggcccaatgatccaaaaagctggtctgcaaggtcatattatcggtggggcacaggtgtcaaagaaacatgctggcttcatcatcaacctcggcgatgcaaccgcaacggattacctagacatgattcatcttatacaaaaaacagtgaaagctaaatttgatgttgatctggaaaccgaggttcgaattatcggtgaacctggtcaaccaaaatagaccttaggaaggggcgacacaatgcatttagtcgaagccgttttgttcttgatggcacttgtcatcgtctcaaacgtgctcagtcactacattgtggctgtcccggtctccttgattcaagtcgcgctgggattaggcgcggctttgttttttcatttggagatcaatttagcgacagactggttcatgctgttgttcattgctccgctgctattttatgacgggcgtaattttccgcggcgcgagttgtgggaactgcgtggtccgattatcggaaacgcgatttttctggtatttgtcacgatgctggtcggtgggtatctgattcactttttgattccgccaatgccgttgcccgcaagttttgccttggcagcgattctcagcccgactgatccgatcgcggtgcagagtctagctaagcgagttcatctaccaaaaggtgtgctgcatttggtgagcggcgagagcttgatcaacgatgccagcgggctgatcggttttaaatatggcattgcggcgaccatgacaggtacatttgtccttggcaacgccgttcgggatttcttttatgtggcaattgtcggtgccttggctggactggtgttaatcagtttaatcaacctaagtcgcaaatggctgctgcagcaagggattaacgatgtcattttgcatactatcttgcaggtgctaacacctttcttcatctatctcgtggtggacgagttcatgcatgcgtcgggtgtcattgcagtcgttgtggcgggtttgcttagtaatactcgctacaaccgttacattgctgccttgccagaacttagaattgtttcggaacgtacttgggacattattgtctatacacttaacgggattatttttctcattctcggcattgaattgccggttgcgatgaccgacacgattgctgatcatgaggtcagcacgtttcaggcgctcggctttgtggttgtcgtttacctgggcattttaattgttcgaacgctatggatttacggttacatgctgctggcaaaacgttccaaagaaggcaaagcttcatggcgagcagctcttttgagtggtatttctggcgtgcgcggcgcgattacattagtcggggtgcttgccgtcccagcagctttgagcaacggtgatgcatttccggagcgtagtttaatgttgttcatcgcggctggtgtggtggtgctaagtttaatcgtcgccattatcgctttgccgttagttacccgttcagtggcaccactgcaaacgcgtggatccacgattgtaactgacgacagtggcgatcaagatgatgatgacagcaacgatattcgtatcatttcgctgagtcaggcacaaacctttgtctttcaaatggcggttcgccgagttgagtcggagcgccgtgagacgaatcaaaaagccgctttggacttgattgcggaatatcagtacctgattcgccggttagaactcgctgaagataccggtgctgccattccgccgctcattcaggatgaactggatctgcgaaaagtcggggttcaaggcgagctatatgctttagacgatctatggcgcgacaacaaaattatgtccaaaagttacgctaaagcccgcaaacaattgcaacaccgcctgaatgatctggactcaatggccaaacgctccggccgaccaactttccgcatgttgttcgaacgttccgccttacgcttatcgcattggtggtacaccgtggccagcgagcaaaatcgttcgcaccgattcttcaacgagcgcttatttattgaaaaagaaaccgcaaaaggcggacttaaatatttatcgcagtttttacgacaaaaggagaacaaagcccacaattataaccgccaagttatttatgctttgattgtccaatatcgaaatcgaattgcttcggtgaaggctttgaacacgcacaaatcaactcaatatgagcaggaactcgggcgcttgcgagctattgcgtttgcagctgaacgggccgctatccacgatctgacagaaaaagggtatatcacgatgacgatggcgcaaaaactgaatcaaaatgttaatttcactgaaaatgcggctaccttaacgtcacttgaagaggtttaagggccgctgcggacaagtcattcctgttctaaaagagcgtttggttgggtcaaatcagttggtttttgctttttaaaacagacgttaattgacaacggtatcgtccttgtctcgattgagactgggccggtaccgttttttttgatgtccatgacataggtatttgtcggcggtttgtgaggattcggcgaaacttttttgacgaattacaaatcaaatacttgtgttgttggttggcactcgtataataggcagagttagtaaacttaaagtttagtttaacgaaacccacaaaggcggtgtcttatggagattggcagtcgaattcgagacttgcgaatccggaaaaacttgacccaagaagagttaggcgagcgaacggatctaacaaagggctatatttcgcaggtggagcatgaccagagttcaccgtcacttgagactttttttgatattttgagtgttttgggtgaatctccggctgatttttttcgtgaggaaccaaaagattccttggtttatcacgaggatgatcaagtcacatatttggatgaagaaaaagggtaccgtttgaaatggctggtgcctgaaagcaatgaaaatgaaatggaaccggtcatgatcgattttgccgcgcacggcatttttaaaacgttcgagccttcaccggcagaaacctttgtttacgttgttagtggtcgtgtcaaattactgctgggtgaacaaacttatgttgcaaagaaaggcgagacaatttactttcacgcaaccaagcaacatcaattggtcaacgccgcgacgggtcgtagtaagtgcttgctagtcgcgacggcatcttatttataaggagttggggtcattgagcaacattatcgttgaactgaagcatgtcggtaagcggtacggcgacacgcaggtgttgaaggatatcaacattgagatcgaacaaggcaagttttacacgttgttgggaccatccggatcgggtaaaacaacgattttgcgtgcaattgcggggtttttggatgtctcagaaggtgaagtgctgtttgatggcaagcggatcaatgatgtgcctgccaaccagcgcaaggttaatacggttttccaagactatgccctattcccgcacctaaacgtttttgacaatgttgcattcgggttgcggttgcatcggatgagcaagcaggacattcagacaaaggttgaagatgccttaaaaatggttcgattacaaggttatgctgatcgggaaatttccgaattgtccggtggtcaacaacagcgagttgccattgctcgagcgattgtactcgagccgcaagtattgctgctagacgaaccgttatcagcacttgacgctaaattgcgtaaggatatgcaatatgaattgcgcgaattgcaggaacggttggggatcactttcctatttgtgacacacgatcaagaagaagcgttggccttgtcggacgaaatttttgtcatgaacgatggtgaagtgcaacaaagtggtacgccagttgatatttatgatgagccggtcaatcattttgtggcggatttcattggtgaaagtaacatcattcaagggcacatgattaaggacttcttagttgagttcaatggcaaacggtttgaatgtgccgatgccggaatgcgtccaaatgaaccagttgaagttgttttgcgcccagaagatttggacattaccccagcaaattcaggcaaggtcaatgttgaagtagacacccaactgttccgcggtgactactacgaaattgtgggttacgacgatctcaagaatgaatggttgattcactcaaccaatcccgccaaagacggcgaaacggttggcttgacgtttgaccctgaggatatccatgtcatgcggcttaacgaatctgaagaagatttcgacgctcggctggaaacctacgaaggggaataacgtcagtaaggatcagttggggcagtgtcatcgaagcgttttgacgattagatagacactggtcggcgctgatcgattttcgaactgaggagggtcatcgtgaaaaaatccaccacaaacgccgcattctacacaccttatgtgatgtggctggcattatttgtgatcgcaccgatggttttaatcgtttatcaaagtttctttaacatcagcggtcactttacccttgccaattatcagacctattttcaatcaggcacttatattatgatgacgatcaattccgtctggtatgcgttcttgatcacgttagcaactttgttaatcagctatccaacagcatatttgctgcattatgccaagcataaacagttatggttgttgctgattattctaccgacttggattaacttgctgctgaaagcatacgccttcatcgggatcttcagtcaggatggcgggattaatagtttcttgggaatgtttggcatcgcgccccagcaattcctgttcacggattttagtttcatctttgttgctgcttatattgaaatcccgttcatgatcttgccgattttcaatgcaatcgaagaattaccggaaaaccttgtcaatgctgcccaagatttaggggccaaaagctggcagaccttcaccaaggtgatctggccgttgacaatttccggcgtgaaatccggggttcaagctgttttcattccaagtttgagtttattcatgttgacgcgtctgatcggcgggaaccgggtcattactttggggacagccattgaagagcattttctgacaacgatgaactggggcatgggttcgacgatcggggttgtcctgatcgtcgccatgttcatcatcatgttcctgaccggcgaacgtaagaagaagggggcgcggcgtcatgaagcgtaaattcaaatggtccaacctttatctgatcttcgtcttcatctgtttgtatgtgccgatcttttatttggttatctactcgttttcaacgggagatcgcatgagcaattacagcggcttcacatggaaacattatgctgagctgtttgctgacacccggatgattcaaattgttctggatacgttgctagtcgcgctattatccagtttgatcgctacgattatcggtgcgttaggagcattagcaattgatcgtactagtcgacctgttgttaaaaacacggtcttatccctcaacaacattctcatggtgagtccagatgtcattatcggtgctagttttctgatcttctataccgcgttgaaagtgccattgggtttctggtccgtcttgatgagccatattgccttttctatcccgattgtcgtgttgatgatcctaccgcggcttcaggaaatgagccattctttactagatgctgctcgtgatttaggcgcgtccaactatcaagttttaacgcgcgtgatcgtgccttatattacgcctggtattttttccggctttttcatggcctttacgtattcactagatgattttgccgtgaccttctttgtcactggtaatggttttgaaacactggcagtcgaaatatacgctcgcgcacgacaaggcatcagtttggagatcaatgcgttgtcaggcgttatgtttatctttgctttactgctggtagtcggttactacttcattcaacaagcaggtcaaaatcggcgagccaaacaaaaacacaagcgagaaagcgaggcgttgatcaatgaaacgactcattagtattgcgattgccatcttagctgtttgtctcggattagcagtttggagtgaagggttacaaaaatcgcaaggtgacacgggtgaaaacacgttaaaccttttcaactggggcgattacatcgatccggcgctgatcagcaagtttgaaaaacaaactggctatcatgttaatcaagaaacctttgattcaaatgaagccatgttcaccaagattcaacaaggtggtacaagctacgatttgacagtaccatctgactacatgatcgaaaaaatgaaaaaggccaatctgttgctaccgctcgataaaagtaaattacgcgggatgcaaaacatggacccgcgtttaatcgataaagattttgatcgcaacaataaatacagcattccgtatttctggggaacgctggggattatttacaacgataagtttgtcaaagccagtgaagttcaacactgggatcaactatggaacccgaaattcaaagattcaatcatgttgattgattcggcccgcgacgtgtttgcaccagcgctcatttcgatgggcaagtcggttaatgaaaccaacccgcaaactttagcgctcgccaaggcaaaacttgatcagctgtcgcctaatgtgaaagctgttgttgctgatgaaatcaaaatgtacatggccgagaacgaggctaagattgccgttgactggtcaggtgaagccagtgagatgttggccaacaataaacatctgcactatgttgtcccgcgcgaaggcagcaatctctggtttgacaacttggtcatccctaagacggctaagcattttaaggccatctatgcctttctaaacttcatgatggaacccaaaaacgcggcccaaaatgccgaatatgtcggttatgcaacaccaaatgcagccgccaagaagcttctaccaaagagtgtgcaaaatgatcgccaattttatccagatgatgaaacaatgaaacatttggagatttattctgatctgccaccagctaaggttgggctttataatgatcttttcttggaattcaaaatgtatcgccgatgagaaggctcatcgcttacagtccgctatgattagctaaaaaagctaatttgcgggcttttttgggcgtcactttttcgattgcttcggtagtcttaaacgacaaggatttgactgatgatctcgcaaaaaataagccttgataacaaagagcgatgaggaaaaatggctttaaagatgagaacgttttctaaaatgcacatcacactagcaaaatctggtacgcttattgcaatgaaaaacatctgattgtgccccagcgtcattaactgacaaagggataaacggttttgcagtcgtcttggttacttgtttcagatacgatcactaagaggtgggcagcttgggaaagagaacttacaaaaatgaagagcgctgggtagacgttgtttgttgtcttagcctttggttggcatcttttagtttgatggcagccgctacggtactagatgtcaatcgtccattcttcattattatgctgtcattaacggcctgcgccattggcgaaacggtgacgttggttaggaaaaagcgctgaggcggatgataagattgtttaatgctatcacgcgtcacggtaaaatgggccagtattagctgtgtcttttcagtgattatttttgtgactaatcaaccaataaccgaccacgaaaaatacagttccaagtgttgcaattcctaaagcatcgagcaatatggaagcgataaagccattccgaatggcaaaccatacaactgcactgacaaacatcacgcaccatcctccaacaaaacttagaccaacaactttatttgtttgcatcaatttaacctccagtagtagtttaagttgccaatgagaatgctttctatcttatagcaaggataacatgaagttgaaaatgttggttacatttttcaacataggggcagtgatctttcagctttatggcgatttaatgcacgccacttcgcacacaataaaaagcgatccgcctattttgggacggatcgctttttgttcatattaaccgctattacctaatcaacaacatcgactttcttagcagccaatcggcgtcgattgagccacttgcgtccttcttcgatgaggaagagcggaattggaataatagccaagaagatccaatccgttggggcgagtgggccggtgtgaaagagttcctgtaagaatggggtatagctgagtagtgccaacaggaaaatttcaaaaacgatcccgaaccaaacgagtttgttagcaaaaagaccggctttgaaaacagaagcattttcggttcggcagttcatcgctgcggcaatctgacagaagatgatggcggccaaggtcatggtagtcgccatgacgtaagtgttgccactggttgccagacccttcaacggccagccattgagatggttgacgaagaagtaggcaccgcttgaaatgattgaggcaatcaggccataccaagcaaacgccttccagagaacggttttactcatgaggtgggcatcgcgtgctcgcggtggcttgtccatgatgccaggttccgctttctcagagccaagacctaaggctggcatcatgtcggtgccaagatcgacggtcaaaatttgcatgacagtcaacgggagcggaatcgcaccacgtgagaacaggaataaggctgaaggtaccgcttcaggcaagttagaattcaagatgtagatcaggaatttctgaatgttactgtaaacggttcgaccttcttcaatggcggcaacaattgaggcaaagttgtcatcggttaggatcatatcagcggcatccttggcgacatcggtgccggtaacgcccatggcaacaccaatgtcggcttttttcaaggctggggcatcattgacaccatcgccggtagaagcaacgatctcgcccatttcttgcaaggttgagacgattttgtatttctgctctggggcgacccgtgcgaaaatgatttcgccagcaagtgccttttttaaatcttctttactcattgaatcgagttcgccaccggtgacaacccgcgctttgtcagaagtgaggccgattttgaccgcgacggacttagctgttaaggaagagtcgccggtaaccataataattttgatgctggcacggtgacatttcttgatggcttcgtaaatttccggacgtggcggatcggacatgattgctaagccaacaaaggtcaaattggtttcggccgtgtcgattgtgaggccgtcgagttgtttttctttatctgtttcttgaggcacctcacgataagcggtggcaatggaacgcaggccgagggaagcatatttgcggttggcatcgtcaatcgcttttttatcgtcttcagtcagtggccgaactttgccattttcttggatagtgtcacaatgcggcagcaagtcgctcagcgagcctttggtgcaaattgataaggtgtgatcgtcatgttgatgaatggtggtcatacgcttccgatctgaatcaaacggcagctctttcaggcgtggatacttaatgctgtatgccttggtatcaatgccggacttttgggccaaaatgaccagtgaggcttcagtcggggtacctaggattttcggccgagcactgccttttgacggctcaacttcagtatcattattgaaggcaactaagcggatcagcaaatccagatcggcatcggtgccatatttaatgggtttcccgtctagttgaatctggccattattcacgaagccttggccagtaacggtgaaggaatgagcaggtgtccagatgtgatccacggtcatctgattttgggttaaggtgccggttttatctgaacagatcaccgtggtttcgcctaaggtttcaacgctattcagatcttttaacaacgcatgctttttggccatgcgttgaacgccttgagccaaggacaatgtgactgttggcaacaagccttcagggatgaaggctacgatcatacccaaggcgaaaatgaaactttgagccacagggtagtggacaaagaagattgccgaaacgaagaataccagaccaagaccgatggcaatcagtgaaatctgtttggttaaacgatttagctctaattgtaagggactcagacttggtttttgttgttgcgttaacgccgcaattcgaccaaactcggtattcatccccgtggcaaatgccacagccgttgccgtgccagcgccaacagtagtgccagcataaacaaggtttgattccgcgaactcaccttgaccagcatcaaaggcaactttttttgattcaggtaccgattcaccagttagggcactttgatcaacttgaaccgaagtggccttaatcaagcgcgcatcaaccggaaccgcattgcctgcctgaagattgaaaacatccccaggtaccattttggttgcattaatttgttgaagtttgccatcgcgataaacttgcgtataagccggtagcattttcattaacgagtcagttgctttttgagcttcatgttcttgccaatagctgaaaacaccgttgataatattgaccagccaaatggcaatccctaattcgagggtgcctgacaggatggcgacaaagccgctgacccacaacagaatggccatcacgcttgtgaaatttttgaggaaaatgagtaattgtgattgttgcttttcccgagtaatcacgttttccccatatttttctaggcggtcggtggcctccttctgcgttaatccagttgacgttgtgtgcaaatccgtcatcagatccgggacgggatccgttgcaaacttgcgccgcgtctccttttcatttttcatgacttaagcacgtctccttcataaagatgtttagcttcattctaacgttctgagcggcggaaaacacccaaagtgctgtttttaagcaattaaacttttcggcttaggcgcggagaccgcgttctaagaattcaaccgcttcgtgaacggcagtttcgagatcaaaagcggattgttcaccgataatgagtggtaataggtaactaagcacggttccaaaaatggctcgtaggactcggttaaatggccaatccaccaattgtccgttagcctgataagttgcataaaggcgcgcggcttttcccgataactcgcggttgaattgctcagcgagctcttgtcctaaggcagcatcacgaagaacagtggctgctaaaacccgtagctgggcttgattagcaatggcaaactgcatacgatcatgaacaatgaacgtcaaaaaagtgtgtaagtcgggcaaatcttgttcaccgacttcattaacaaactcggttaatacgtttggcatcacttggcgaatcataggggctagtagcgcctgaagaatcccatctttcgtcttgaactgcttgtaaactgtgccttcgctgacctgtgccgtttcagcaatttctttagtgctagtgcgatcaaagccttgactggcaaataacgctaaactggcctttaaaacggcttgctgtttagcggatagattgcttttggcgagtgaagcggaaaacaaatcggtaatattacgtgtgtgcatcgcgagatcgcttcccttcaataaaaattgctcgactttacacttgccggtatttccgcatcgtgagtaaatttaatccaagaaataataggaagaatcctaacaaggcaaccacatctggatagaagacggcaagcgactgacctttggcgataataccggttaaggcattagcaccatagtataaaggcatgatgtgagcgatgggttgcagccatccaagcatgtgatcaattcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttc

SEQ ID NO: 74 - DNA, 16087 bp, Lactobacillus paracasei
tcgatcgggtgacacgtttaatggcgacaactaagcttgaaaacttatcacaaaatgctgttctcaagggatttgcaagactgatggtggactttccgggtccggttcgatcagtgacggttgatcacggtaaagagttttcctgcgatcaggcgcttacaaagcgctatcggataccggcttacttttgccacgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggttagacattaattagaaaaaaacacgaaataattaggtgtttttttccgaacgtgttatactctgtacatggtaatacttgaacgggaaacatcatgttacgtgaatttcctttttaggattacggttgtctgttgttgttagttttgaaaaggagattcattttcatgcaaaaaggtacagttaaatggttcaatgctgataagggttacggcttcatcactggtgaagacggccaagacgtctttgtacatttcagcgccatcaatggcgaaggctacaagagtcttgacgaaggtcaggctgtttcctacgatgtagaacaatctgatcgtggccctcaggctgctaacgttaccaagctttaattcttggttcgttaaaggagatccaatcgggaaaccgattgggtctttttttatgagcgcaaacaggagcacctatattcaggcttttgcgactgcgacagtattattacggcgctggtccttgtagtagtccaagccacctgatttcattctaggcaggctctcacgcttgctgcttcaaggttaattgccacacactaacaagcacccaacaagcaaatggcatcgcagcgacaaacaagcctatgaagattaatcctggtgcatcgccactttcagcccatagatagctgaaggttaagctgatggcagcaatgatgatggttatgccgcctaggagccattgcaagcgacgaacgccgcgggtgaccttctgcggtgaacgtatgatttgccacaaagtgatggcgctggcggtgatcccgccaagtacaagccagccgccaagcaggacgagaattaatgaaacagttggttggacagttaacagcagtaaaatcgttgcccataaaccgatagcaaggaaaaccacactgcccagtagcaggctaagtgccaaaacaagatgatgtttgcggacccacaaagatgattttgacattttaataacctccaattagtccatacgctagcgcattgttgggttcaatagtcgagtgacagcgcttcttgacgaaaaaacaaagaaggtatcagcctaaacgccggtaccttctttattatctttgagaaaaagtcgtggccctgatgacttactcgcctagcgtcggctcgtctgtgaaatcatcaacgatgcggaagctgacattttcattttctttcaaaagtttggcaactgggcattcgtccagtgcctgggtgacaatcttttgtgcttcttcgcgggtgtggctcggcatcaagatttgtgcgtctacgatgaatttgtagccaatcttgtcacgggtgatgtccacacgagtacggagctgggaatcttcagcagtgccttcgcgatgctgcacgatgcggatggtcgcattaaaacaggtagacaaggcaaaagcaatgaactgctccgggttggtcccaggggcgtcaatcaaggagctagaaacacccaacgctaagccttgattaccttcgacataactttcaccgactaaaccattttcgttgcggacataggtatgatacaaagaacgttctgccatgctattcatcctttcttatagctatcaccgtgagtataacatggaaccgctttacatgggggcattgtgtctcggttgcaacgcctgaatcgctacgtaccaaggcgttttggaacggataacaaacattttcaatgggttttgttttgccacaaaaactaagcagttatcgctagtgtcgccataaaagttcagtcagtcatggttgcaggcgaatgatttttgtcgcaacttgctcgataaaatgctcatcgtgctcgacaaaaagcatcgtcggttgataatgcttgatggcggcgaccagctggtcttggttgtaagtgtccaaataattgagcggctcgtcccaaacgtacaaagctcccggggtggctagggatcgcgctagttcgacttttttctgttggcccatgctcagatgctcaatcgacgtgttaaagtcggctcgcggcatgccgagtttgcgcaagttgttaagcaaggtttcacggctaagctggtgctgtttggcaaagtcgactaatgtaccgcggttatcggtgtattgttggcgaacaagactaagactgacgggggccaaggtgaggtgtcctgattgcatcccggtaaattgcttcaacaaggcacggatcaaggtcgacttgccgctgccattgtcaccaacaatggcaatccgatcgccgcgggtcaaagtaaaagagatcggctggaaaagcggttgatcgaacccgacttggaccttttcagcgacgacaagttgatggtgatgggtcgatactggcagcatggtgagtggatcaaccttttctaggttcttcagaagactttccttctcatcgatttctttagtcatccggtgttcgagatttttactttttttcatcgtccgtgcagctcgagcgctaataaacccgcgaccagcattatgaccgctgtccttgatgtgcggattaccatagatactcttttctttattttccccccaaacttttttatcatgggccgttcgtttaagtcgggtaatttcagttttaagttgaccatttttggccagttcagtttgatcttgccgctctttttcggtcatgaaggtggagaaattgccttgataaagggtgatttgctgccgctggattgctagcgtatggtcggtgatgctgtccaaaaaatcacgatcatggctgacgacaataaagccgggtttttgttggagataggcggcgacttgtcggcggctgcgcaggtcgaggtgattggttggctcgtcaatgagtgcgaaaccattgtcttgaatgaacagtaaggcgagacgcacttttgtttgctcaccaccagataaatcgacaaatgggcgccagagaatgttaggatcagcgtggagcagatttagttcacgttcgagttgccattgcgcaacatcggtgatggcttgtgcggcagtcagcgtcagttgggtttcatccagcgtttgaggaaaatattgcaactgcaagggaacagtcaccgtgccactgtagggtagtgtttgttgtaaaattcgcaacaaagtggttttgcctcggccgttgcgaccgaccaatccgagatgccagttggtatcaaggtcaagggttgtgttcgtaaaaagcggtgcttgaccgtcataagcaaaattgagctgtttaatttgaatcgtagacatacagccacgtcctttcggggatgtgcctgtgtgatcagaacgtgaatcggtatgactttttatggctgaaaagtgttgaaaatttgcggcatcagccttgctattgggttatttggcagcataactgcgctggcttgtatgcaacaaaaaagccagtccaataacactttgggactgaccaaaataaacggggtgccgtccttgatcaagcccaattgtcaaaaagtccgtactaatcccgttgatgatgacaggacttggacattttcaacaattggcttacttcaatggacgaaacctcactttcgaatttaacttagctttaaattaccacgtgaagctactggcgtcaaacatgtaatgctttcacaatcgcttcattaccgcttgcaatcttcactgtgtctcgatggcgattgctgtctaaggctgccactaggacgtccgcgacatctgcgcgcgaaatagttgatggtcgttgcggctgcaaggtgatactgccttttgcaggatcgttggtgagcgcggttggctggacgatgacgtaatccagatccgtgttgtgaatgagccattcgtcagcgtagtacttggcgatgtaataatcgtgcaactggtctggccatttgtccggatcttcagcatcaagggcgctgagcatgatgaatcgactaatatcagcgcgttcagcagctttcatcgttttgacagcaccatctagatcaacgccaagaagatcttgaccgcgtgaccctgctgcgaagacaattgcgtcatgaccagcataaaggtcagctaagcgatcaaccggccatgaaagatcgagttccacggcgcgaaagtttttctcgggatcaggtgtctgagcgattggatcacgataaccgcctgtaactgtatcaccacgatcaagcagtttgtggaccagcaactggccgatttggccgtgggcaccgacaacaaagattttcaaaacaaatatcctttcatggaaaatgattgctattagtataacgttttttatgacagcaagaaagcagttgcaggcaggaatgctaaaaagtttagtgcggtgagtttctagaataacccggttacagtcgcagaaacccatgcatcagggatttaaagcagttctgtctgcggccataaaaaaacgcggctgcttgcatcaaccgcgctgttgccatcgttaaatcatttcaagtggaatatgatgccgcggggccgggaaagcttgatcgaacaacgccaattcgtctggtgaaaaagtaacatctgccgcggcgatattttccgccatgtggcttgcttcacctgaacgagggatcgtgagcacatcgccatgacgcagcacccatgcgagcatcagttgatgggttgaaatgtttttctctttggccaaagttcttagttccggtggcagtttaattgacttgccactgcctgacccaaatggcgagtaaccaatcgtggtaatgttggcctgcttttgctgtggtagaagatcatattcaataccgcgcgattgtaagttataaagcacttcattagccgcaatttggtcgccgcccggttcgagcgttaattgatccatgtcatcaacgtcaaagttcgacacaccatattgcttaattaaaccttctttttgcaaatcctgcaggccttcgagagtttctgctaacggggttgacccgcgccagtgaagcagatataggtcgagataatcagttctcaatcgtttaagactattttttagggctgttcgcatctgtcgcttgtctgcgtgtgacggatagaactttgagatcagatagatgttggcgcgatcataatcaccaagaaaactgccaatcagtgactcagccgccccgttgccatacatctccgcggtatcaatcacggtcaaaccatgattcagtccatactttaaggcagcagcttcctgttcactttctgccgcattgccttcgcctaagtaccaagtacccatacccatgatcgggacattgacgccaccaatcttgattgttttcatgatccgactcctttctttcaacacatctattatacaagttgtgaaaaaaatgaccgctttaaatagcgcctgtgaaagaagataaaaaaagcgtgttacctacgcatgaacgtgcatttttttgcaggtcacgagacagttttcacgcttctccatatcaattagttgctgaaatttgctattgccgattagctttaacaggttgcgtcgcaggctttcgacgttgatacaacaagtaatgcagcacgaccaaaccaagaaagacgacacctactaataatgaaacacttgtttctgggtttagtagcatgaaaaataaagtgaacgcgaggaaaataagtgtgagataattgctataaggcgcgaatggcattttgaaaggatggttggccatctgatcagcgtggactttgcgaaagcgaatttcgctgactaagatgacgatccacggcaccataccaggcaagacgctggaactataaactagcacgaaaacatttttcgcggctggggcaatgtaaggcagtaaggcattcaaaatgacgcccagtaaaatcccgccgcccacggcgatgaccggataaaaaggtaccccatgacgatttagtttggtgaaaattcgtggcagttgtttggcatcagctaaggtgtataacattcggctggctgagtaaatgccagaattggagccagataaggcagcggtaatcaccacaaaattaatgagtgaagcggcaaatgtgatgccaattttggcaaatgtctgaacaaatggcgaccctaatgtgctgagctgattccaagggtaaatggcgacgatcacgaaaatcgcaccaacgtagaaaatcagaattcgaccaatcgtgtctttcactgctttaacgatggtcggtcgcggattctcagcttcacctgctgtgataccaagcagctcaacgccttggtaggagccgaggacgattgacaaggcaaaacagaagcctttaaacccgccggtgaaaaacccgccgtgggtccagagattgctgataccaaccggatggccgccattaccaatcccaaataaaatgacgccaaggccagcaatgatcatcaaaacgatcgtcacgactttaatcaaggcaaaccagaattccaattcgccaaacattcgcaccgaaattagatttgctagtacaaggaaggtgatggccactaaccccggcagccaacccggcaacccgggccaccagaatttgaaatattcgccaattgcgatcatttcggacataccaacaacaacaaattggaaaatgttgctccaagcagtgagatagccaaaaatcggatgcatgtattcactggcaaacttggcaaatgaaccagttgccggatcaatataaagcatctcgcccaatgcacgcatgatcatgtaaaggaataagccggcaatgatgtaggcgatcagaacagatggccctgtccatttaatcgtggcgcctgctcccatgaaaaggccaacgccgatggtaccgccaagcgcaatcatttgcatgtgacggctgctgagttttcgttgcatggttattttcgcttctttcgtcttgagaaatacaagtaatgactatacaagaaaagtctaaccagcgcaaacaggtggctatgaaacgtagacatgaaataggcatcaccgttaacacgcttcttgacattcaagtcactatgtccgttatcggcttttgcggtaaactagtgacggatcattcaataaagtaggatatgaggaaatattttggataacaaaaacaaattcactgcatcattaaatgcctatatggcaaaacacaagttgaacaccaatgcgacatccgcagcgatgggtgtttccgtgccgactttgcgtaaagcactgcgcggccaaagcgtgagccgcaagaccgcggctaagattgaaagcatcattaagtctggcaaggtgccagcagaagctcacaaaaccgctacgaaggcgccagctaagaagacggcgcctaagaaaccagctgtaagtaaacaggttaaaccagccgcgacagcgaagcagccagctgcaaaagccaaacaaactaaatcggctgaacaagtgtcagcaagtaaatcagcgacaacaccaaaagcctcgcgtgttcaaactaagcgggcagccaatcagcagtcgcaagcaactagccaaacgccgactgcaccacaaactgaagcagcagcaagttcaaaaccggcacggcgcactgctaaacgggtgacgcgttcaactgtcacgtcacggcaaaaccagcgccccaacaatcagcaagagcacaacaacaacgagcaaacaccgaaacagacgcctgttcagaaaaaaattccgacgcggcagcatcgcttcacgattcgccagcagccggatgttgcgacacaggaagcagaagctgaggctaagaaacgtcagactgaagctaatcggtcatctgtatcggctagctcatcttcaagtcagcaatcgactgagcagcgtcacgacaatcagacagagcgtcacatcaagaagcggacagtaacggccccacggcgcaatgtgaataaaaccgatcacgaacctgcccggcgtgataatggctatacgcgcaacaatcgcaataagccaaatggtaatcgtcagcctaaccgcacgcgccaaaatcgattcgcagccaacgctgatcctcaaaactggcagccaatgactcagccggcggcatcaagtgcctcacagtcaatgacagccaaagcgtcgaccgacaatcgccatgtaccagcagtggttaatcacgttgaaacgcatacaccaagtgtgattcggtcaacttcaaatgaccgtaacggcaaatacaattcagctaatactgcaagcagcagtaccagcgatacgaccagtcaacaggcaacgaccggtaccaacatgcatactaattatggtactcatgatgaagcaccgttggtagctggcaaacagttgcaactctttattgatgaaagttttgaagagcaccgtccagatccgcgtaccatgcacatggggatcgcggctattttcccagaaggcgacgacgacagtctcattggcttccgtaatgcgctctatccctatggctgggaaccaggggatgaagttaaagcccgcggtaaacaggttgatgccttaacacagctgatcaaagcagccgaccatgaaaacatggggatgtataccgtcttttcacagaaaacgacgtatcctgatttcgccccgtcaatggaatatctgtatccatacatcggcgccacgattcacgtgttgcgtgatgttgacactacttttgatagtattgtgatcatgatcgatcatcggaatgaattggaaggtaatcagctggtgatgggcgctgatattgtgagtcgctacttgacgctttccttggaacgaccaatcaaggttcggtttgagtttgcagattctcgcgagcatctcggcttgcaactgtcagactttgttgccaatgctgctctgcggcttagtaatgacgaactgagcctcattgggatcacgccaatgcctgagttgggcgtttcgcaacacgatcaattagtccgattgacgttacttggcttgcaacaggttgtgatgggtgtgcgcgccgaacgagctgcaacaccatcaaaacattcacaacctgatcgcttcatgcaactgatctttgatgccacttacgccgattccgatcaggtacgcggtgcgttgccggttgtcaaaaatgcagtcgagcaactcatcgatgttttgccaaatgcccgggtcggtcaaatctccggtatgccaaaccaaagctggtatgacatgacagcgcggatggcaggactattacggtatatcaacaaggatccaaaaccatatggccgggtgcttgcaaagatcgaaagcgtgacgaagactgccgctgacgaactggaaatggcacttgattctgacgataaagccaagcattaattgggttttaaatgacaaaaagggtactgcaatttaaccgttgcagtacccttttttagattatcgagtgttgttacttagtgtgatctttttaagcaatgaaactattctggttttgtaggtacgtaatttcgtcaaaagtaatgcgtgtctgcaaccgttgcatgatctcccggttgagtttgccttcagcaaaagcagcttgaatgaactcaaattcagcatggaatgcttttaggaacatggcatatagcacatcaccatcgaaagaatccgtatgaacccggcgatgccgatcacgatagaagcggcgaacgatgttgatggcactacgattttgactattttcggcacttgccaagtacttcatcaccgcatcatagccggcctgctcgataggtaatagatcttcaccgtgctcagtaaattgccgtttccaaaaaatcggctcaaggttaagcggtgtagttaaaaaagcattttgcgcttcgtctagacctttatacatacgtcccatattaaaggtgaaccgtaagcggagaaaaagatttttccacgttcgctgatctgctgtgaaatcatttaaatcaataaagcgattgtaatagtgcgcttcgtcatgcgtgatggtcccattgacccgtaaagcttcaatggttcttttctcaacttttatggtggtatcaaagatatcccgttgcattcttcgcgaaggtttatcgttcagaatcatttcctgcgacaacgcgtctgcaacgatttgggcttcgctatgatgaacggattcatcccgcatggcatcaatgccagctgataacattcggcgcaaccaaacatattggcgattgcgttttggctgcttaggcacgcagaatggtagaaccagtaccggcacaatcagactgagtaaaatgacagttgccgcgatcagaatcaagccttgccggagcggaaaactgtggccattaacaatttgtggcattgaaaacgccaaagataaggtgatagtcccattcgcaccacccagcatcataatgacggcgttgcgccagcggtgttttttaccagtccgcagcaaggttcgactccatagtaggcgaaccagtgacttggctgcgtaaatgaaaatgccaatacccacaagcaaactgaacaagccagcttgtccgcgcaaggcgctaacgatgacattgggcagcgagaggccgagcaaaacgaagacgagtccggaaagaatggccgctaccatttcccagacattggcgctgacgatttgcatacgggcactggtcagtcgcaaacgatcgcgctctacaccttgcgcaatccccgaagcaacaaccgccagaatcccggacaggccaagttcttcggctagaaaataaaccaacaatggcgtcagtaactgaataccgaccatgatcaacggctcatcgtcgccgatatgaatcagccaggcccgcaaattcacgatcagcatacctaagactgccccgaccaggataccgccgaagaagacgaagagaaaatcgagcaaggcgtctgttggtgaaaattgtccggaaacataggcagtcagtgccagatcgaatgcgacaatgccggctgcatcgttgaacagactttcattggacaatagttgcatttggctgtcgctcaaaggattggtttgggcaacggcgctgaccgctgatgcatctgttggcgtgacgatagcaatgagcgcgaaggcaagacttagtggaatgattggaaacagcgcatgaacgccaaagcctaagataatgaccgaaaccagcacgaggccaactgccaacgacacgatattggttaaagagcggccaatttgaatacgtgaagcattttgaccttcgttaaacaacagcggggcaatgatcgcaaaggagaagaccgatggatcaagtgtgaaattacgaagagaaggcataacggctaatgccgccccaaggccgatcaagaagaatggcaacgggatcttaggaacgtgccgtgccaagatgttgcctaaaatgacgattgccaacatgatgccaaagataacaacctggttcaaaaatgatcacttccttgattgaccttatttgacctttctattttagcaccaatgcaaaaaaataaccgctcattggtctgagagcgcgagcaggagcgcttagaaactgtagtgtaagtggccttgaagtgaaagggacggtttttggtccttttgcttcaaggtccttacacggaagtttctgcgactgtgagcgcgttttctacaacggcgggtatgctgacaataaggatggcttgtaagtattctttttcattgggttgagcatctttattgctatgctaatgatgttggttccgatagcctgagctggctacgcggtgattcgggggtgacgaccgcggaactaccgggaacaacctaaccagaatagaataaccgacactttaaacagattatgcgttagtgacacaacgacaactcacttcttcaaccgcttttttaaaatgcgggtcatttttctagccgtcacgcgccaagagaggtatagcgcgatccaaatgaaggcgtagatgacgatgaacgaaatgatgaagctggttaaggcagagccaatcaagaattgccagcccatcaggtagttcgttgcaaggacgatcaaaaaggtgctgatgaaatgggtgccatatgcaactggtaaactgagccagtcaagatcgaaaatcgaagataggatgccaatgacggcactcatgatgaacagtcccgcgatagaacgcggtgttggattaatcgtgtctaaatgcaacattaaagtggtcagataaacggttgcgccgatcatgatgccaatgacggcctcggtcaataactgctttgcgattctcataagggccacctcacaatcctaataaacgtttcaagtcaggaagaaatttacgactgaccgtcaatttttgctgattactcatgaaggcggtcatattaccggaaaaagaagcttccagtgatgtcaaataattgatattcagaatggtacttttggctacctgaataaaaagctgaggatcaagcttagcgcgaatggcttttagctggccacgcgaagtatagaccttggtcatcgtgtggaccgtgagctcgtcaccgtagacttcgattgccacgatgtcattaacggccagtaccacaacgcggtcaccaacagttagcggaagggttggtcgattgtcggataattgttgaatttgttgcaaaagctgcaacacagccggtgaaagccgggcagccttgatgagcacctcaatatcatccggattcaagtcaggatcttgatcaaatgaaactttcataggctcagtctccttccgcatgatgccagcgtatcgcacgattacgtttcattatacgcgggcgagggcggcctttcgactgaatctggcaagaaggaaaataaggatgctcacaccaagcgtaaaaccaatcagaatcaggtaagtgtggctgctagaaagcaagccgttgacgtcaatgcgaacacccaacattttttcaaaactggcccttgcagcctcttgcttgccagtgaaggtcgtggctaacggctgttgcaacagaatctggcgataagcagcggcgttgtatgggaagggggtcattttcatcaaggcttgtgcgccgctgggaactgccccgattggcatgtaaaccccagcgaagaagcctgctgcagtaccgacaatggttgcaatgccgctcatggtggtcacgcgggaaacaaagctcaaaataagtaaattaaaacttgtccaaaccacactgctgaacaatgcgagagcaatgattttgccagttagttgccatggaataacgacatgatcaagcagggcgaaggcgcctgacatggcgccgaacatgagcagctgcatgatggtgccgatgatgacggcactggccagatagccaaattgaatgcgcagataagaagcttcggtcaacaggtagtcgcttaaattaccattctcacgatcaacaatcattcttgctaagccatcttgcgtggtcgtaactgccgtgatggtaagcgtgccgccgattagccagggatcaagcagcttttcaggatgactgatgggccacagtccggtcatattcttcttgagaaaaaccaaatagagaacgaaggcaatcagtgcgcccaaaactgaaaagaaaacgccggcgcgattgcgaaaaaacaacaatagattacgtttaataaaagctagcattagcgaatctcctttccggttaacgtgacgaagatcgtattcatatcagctggatggaactcaaagtcggtgatcgtatcggtgagttccgtcagtaaggcaatagcctgttgcggatgatggatattgacgtgcacctcgttggcaacgatattggcccgcaatccggcttgattggcgactgttttgacgcgatcggcagctgttgtttgaattgtcagttgatgagcagcatagcgatttttcaggtcaacaacagtatctgctgcaatgatttcgccacgatcaatgacgtaaacgaagtcagcattttccgtttcctccaaataatgggttgttaaaatgacggtcaattgcgtttggacgcgtaaagcagccagcgctgaccaaatcgtttggcgcgtctgaatatctaatccagttgacggttcgtctaaaaataaaatttggggatgattcaaaagggcgcgggcaatatcggttcggcgtcgctgaccacctgacaatgtcccatatgtctgattcaaaataggtgccaggtcaaattgcttaatcagttgatcgaaccaagcagtatctgggtgttgatacatgcgcgcccgcaatcgtagattttcattaactgttagttggcgatcaaggacactatcctgaaagacaaccccaatctgttgacgataggccacttgccccggtgtgtgatcggcgacggtaatggtgccactggtcggttgaatcaagcctgtcagcatgccgattgtcgtcgatttacctgccccgttaggacctaagaaggccacgaattgcccacggtcaaccgtcaaattaatgccgttcactgctactttcggaccaaatgttttggtcagactctttgcttcaagaatagccattgatgtcacctgctttcgatttgttggccttagcataacgacgattgcgccaagtgtcttgagaaaggcggtaagtggtgcaaaatgcttggcaagtggttgaaaatagcaaatgaaaaatagaattttttcttggcaatttacaaatgagttgggaatgcgattttatcgaggcaacaaaaaacagcttgtgagaatcaagccacaagctgcagatagtttttagctactcaggtaaataaaaagcgcaagatttcagcatccacataaggattttggtgcagcgtcgagtgataagcgccaactggtgtgccagtatagacaaagagggtggtggacaagccagccgccttaaatttggcggctaaacgtttgaccccagcaaggctgacggcccagtcaccttttgccccgaagacctgtccgccaatcactaagatatgcaatgttttcggtaacgcccgaatctgggtcgttggatcacgatagaactcgctcgcaaacgagacataattgatcacttgcggctgaagattggcatgcggtgtcgtcatgtaattaaagctcagattgctgcccattgaatgacctaccagattcacacgggtcacatgacgctggacgcgaagccagtgcagcaagccggtgagttgccggacttccttttgtggtgacttagcatcggcaaaaacaacgttgatgagcggatttttgccattgtagcggtcggctccagtgatcgtgcgtttgccgtcagcactgacatgaatcgtagtgacttgatcggatgccttatcctgcttgaagcgttgaaccattggcccgaaggtgaggctgttactgccataaccagggacaaaaactgtgacgatacccgtatgacgataggtttgctggtgaattgcgcggctgcccagttgccaccaaagccaatagccgccgctagcgagaagcaaaattaccagtaccgatatgcttactcgccgccagcgttttgctgatttagccatgaagagggtcatctcctgctgaacgcttcagttgcttgaaaacgcctcggaaaattggtcgccgattgatcgcttgcacatggcgattattcggttcaaaaaactgctgatagcgggcgacctgattcgaactcattgtgatctcggtttgctcaatgacataccaagtcacgccttcggttaacggcgggggggggggggag

SEQ ID NO: 75 - DNA, 837 bp, Lactobacillus paracasei
ccgaagcaattcaacgatgtcacgatagctgagactgaatctgaaatagtagccaacggctactaagatgatgtccttttgaaagtggcgtcccttaaagtgattcatgcgcgcaatccctcgtttcttggcacccagtatattaaaatcaagtcagcgaggaaaatttgcaccagaaccctttgatctgataatccttttctaaggcctgataattggcaaactctttaccatgatcaacagtaatggattttacttggggaccgaaggcccccataaactgggtctacactttctggtgttgagaaataatcaacactgaacgtataggccctttttggataacgcaaaaagacacctactcagtgtccatgctatgcttgttagcgtcgaaaccaaaagcaagtgaggttatgagtaaatgtcccaatacgatcctacactgtccgtccttggaatacccgaccataatatcaaagtagcctttgttcgtcatgaatatcgcggcaacggggtacgtcgccgccagtatcatgtgattgatgccgagctgacttaccggttaacccggtgcccactgtgtggctttgaggccttgcaccctaacgggttttacacggcccatgtgcgcgtcctcaacggggttgaaatgccgatagtcattgacttgcacaagcaacgatggcgctgtcataactgttaccacacagtcagtgccaagacgccactcgtgcaacccaaccacacgatcgccgctcacatgacagagcgaatcatgaagttagcgcatgaacggttgccagtcaaaaccatcgcccgtattatcggaatctcagc

SEQ ID NO: 76 - DNA, 361 bp, Lactobacillus paracasei
taacccttttagggagcgagccgtctaaggtgggacaaatgattagggtgaagtcgtaacaaggtagccgtaggagaacctgcggctggatcacctcctttctaaggaaacagactgaaagtctgacggaaacctgcacacacgaaactttgtttagttttgaggggatcaccctcaagcgccctaacgggtgcgactttgttctttgaaaactggatatcattgtattaattgttttaaattgccgagaacacagcgtatttgtatgagtttctgaaaaagaaattcgcatcgcataaccgctgacgcaagtcagtacaggttaagttacaaagggcgcacggtggatgccttggcacta

SEQ ID NO: 77 - DNA, 361 bp, Lactobacillus paracasei
ggcatgattccggtatgtcatcggggtcatgccgtttagtgtttcttggcggcgttcgttgttataccagttgattgccgcctcaatacgcttcatcatttctagttccgataagcagtgctcaaaggaaaatctctcgatcttgaggtgactccacaagctctccatcgggctgttatcacctggtgtcccgggtcgtgacatgctgtgcgtgataccttcgcccgccaggaacgtgttataggtgctacttgtgtaagccgtgccctgatcactgtgtacggtatcaggcttgataccatcgttattctcgatggccagtttcattgttttagtagccaaatcagccgtctctgtcggt

SEQ ID NO: 78 - DNA, 921 bp, Lactobacillus paracasei
cgcctgctagccaagcgaacccgccggtagcggtcctgagcggtggctgccgaatagctccgccagccgccgttacgtgcaatttcacggctgactgtactcttggaacgacctatctctttggcgatggtatcaagagttttgcctgtagagataccaagcagtatcgattcacggtctattaaggtaagatgggtgtacggactcatagtcgagttctccttgtagttggtcttgtggtgattccattttacaaggactcaggcgatgagtcttttctatttgactagtttgttgcacttgaattgtaaatccgtcgcataaaaatagcacctcaccgtttggcggagtgctcgtgtaaataaaaagacgccgaagcgtcaaagccaaataatatcaactttcccacccgaaatctctgggcattgatccccggccgagtctaaaaactcgggtagtttaattaccagaggaccattctttaaatcttccgttgattccgtctatcctcgcccccatccccatcttatgtgtattaactgattttcccgaatcgatttctgccacataatcttgcaatttgctttgaactataactatgtcactatatgttctaatctcgattttgttggtaatcgagatgaactccttagtgacggcatctggattcacacctggaggagtcatagtaaagaacttttgctcattttcctcaggcaagtactcacgttgaatataacctgcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacat

SEQ ID NO: 79 - DNA, 456 bp, Lactobacillus paracasei
aaccactgatttaacgaaaaatagtggctacgatggcggcaaaaagatttcagggattaagcgtcatatggcggttgatattaatggtttaccacaagccattctcgtgacacgagctaatgtatcagatcgttcaggtgcattggctatgtttagtttggctagccaaactttagagctcgttcagcatgtcatggttgatggtgactacactggcaatgactttgcggatcaggtgaagctcattttgaatgctaagacgacggtagctaaacgcaacgagttgcatatgttcacggtgctaccgcaacgatggatcgttgaacgttcatggagttggctagacaaatgtcggcgactttggaaaaactgtgaacgcgcccttaacagcagtcttcaaatggttgtattggccttcctgaagatagttcttaaaagatactagacaggttctta

SEQ ID NO: 80 - DNA, 1167 bp, Lactobacillus paracasei
tcaacctgcttgtcatcgactacgcctctcggcctcgccttagatcccgactaaccctgggaggacgagccttccccaggaaaccttagtcatacggtggatcagattctcactgatctttcgctactcatgccggcattctcacttctaagcgctccagccgtcctcacgatcgaccttcaacgcccttagaacgctctcctaccgcgcacccttacgggtgcacccacagtttcggtattatgcttagccccggtatattttcggcgcagtgccactcgactagtgagctattacgcactctttaaatggtggctgcttctgagccaacatcctagttgtctgtgcaacgccacatccttttccacttagcataaatttagggaccttaactggtgatctgggctgttcccctttcgacaatggaccttatcgctcactgtctgactcccggagtaagatcgatggtattcggagtttatctgaattcagtaacccttgatgggcccctagttcaaacagtgctctacctccatgatccatcctccgaggctaaccctaaagctatttcggagagaaccagctatctccaagttcgtttggaatttcaccgctacccacaactcatcccagcatttttcaacatacatgggttcggtcctccagtgtgtttcaccacaccttcaacctggtcatgggtaggtcacttggtttcgggtctacatctgcttactcattcgccctgttcagactcgctttcgctacggctccgacttttcatcttaacctcgcaagcaaacgtaactcgccggttcattctacaaaaggcacgccattacccattaacgggctttgactaattgtaggcacacggtttcaggaactgtttcactccccttccggggtgcttttcacctttccctcacggtactggttcactatcggtcactagggagtatttagccttgggagatggtcctcccggattccgacggaatttcacgtgttccgccgtactcaggatcctggacggagggttcgacgtttcgcttacagggctttcaccttctgtggcgcagctttccagctgacttcgactacgtcggactttggtaactccaatgtccagtcctacaaccccgagaagcaagcttctcggtttgggct

SEQ ID NO: 81 - DNA, 4081 bp, Lactobacillus paracasei
taatagcgaatcagctgtcgggtctggtttatctcgccacatatcgtaatagcggtagacagtgtgccattccgggaaatcgtgcggtaattcacgccattgacaccctgtagtaagcgagtaaaggatggcattgaatacgtcataaagatcataacgacgcggtcttgtatgcttgcgaaagttttctaaatcaggttgtattaacgcaaattgcgctcgagaaatattgcttggataatctggcatgacaaactcctcagtcggttttccacaattctaccagattcagcagatactagacaggttctcagaggcatttcaccatactaacaagaaaaccaaaaattcccagatcattaatttaacatatcgtatcaaaccacgcctggaatattatctaggcgtttttttagtgtcatggtattttctggcagaaaggttgcattattgtgactacagttgtaaactaataagtgttaagagactacaaacgtaaacttagaattcaattaatggaggaagccaattgaaggatgcaaagaatgtaaccatcaccgattctgaatggatggttatgagagcaatttggacaatgggacatgcgactagtcgtgaactaatcgatgctatgaacgaattagaaggctggtcagcttcaacaaccaaaacgctacttcacaggttgattcaaaaacaggcggttgcgcagcatgccggcagtcgaccattcacgtataagccggttgttggcgagaaggaatcaatggcggcagcggcagatgatttgtttgaccatatgtgtgcgatgcgggctggttcaacaattgccggcgttattcagtcaagggaactctcacgggcggatattgcgaacttacaggcgattctagctgaaaaggccaaaacagcgcccgaggaagttcagtgtaactgcttgccgggtgatcaaacgtgttaagactgtggtgttctgtttacttttaggattgctgcacaaaaatccagaatctgggatttctgatggcggaaacttatgaatttttgtcgtaattctcattcatatagtggcatggtgctccgcaaagcagaagcctaaatataagagcctggtggaaaaatcccgagcccggggatttccacacaaggaacttatattccggattctaaccgctttgctacgcacacttatttttagggggtcgataatcatggcaaataaagaggaccatatgaacatgaaaaacatgagtgctaagaatatggaaaataatgaatcaaatatgagtcatatggatcatgatgacatgaaaatggatcacgatatgaccgaaacggatcataatcaaatgaacatggaccacgatatggccgaaatggatcatggtcaaatgaacatggatcacagccaaatgaacatgaatcacgaaactatgaatatgagtgggatgaatcacggtgatatggatatggctgggaccgacatgatgatgcacggtggctcaatgatgcatatgggaaatttgaaagttaaattttgggtctccgttgtcttagcgattccagttttactgttagcaccaatcatgggtttaaacgtttccatccttagtttcagttcaccgctaattgttggcattatcatcgttttgtttgatacagcactttacttttatggcggaatgccatttttaaagggggctaaagcggaaattcaggataaatctcctgaaatgatgacgctagtaacccttggaatttccgtttcgtatttctacagtttgtacgcatttattgccaacaacttcttgaacccggcaaatcatgtaatggatttttcgttcgaacttgcaaccctgattttaattatgcttctaggacactggattgaaatgaatgcattgatgggggctggggaagccttacaaaagatggcggccctgttgcctaagacggcccatctagttacagataatggtgaaacaaaagaagtgccagtatctgatttaaaagttggtcaagctttccaagtgcgttcaggtgagagtattccagccgatggtgttattacggctggggagtcgaccgtgaatgaagcactggtaaccggtgaatctgctgccgttaccaagaacgttggcgataaggtcattggtggtgcaaccaacaataacgggacgctaacggttaaaattagtggtactggtgactccggctatctttctcaagtaatgaaaatggttcaaaatgcccagcaagctaaatctaaagcagaagataaagctgatttagttgccaagtatctattttacgcggcatttggtgttgggattattgctttctttgcctggttaccccagggattggcgactgcaatgacgatcatggtgaccgtcttcgtgattgcttgcccgcatgcattaggattagcgattccattagtggtttctcgttctactacgattggcgctcaaaatgggctattagttcgaaatcgccaagccattgaagcaagtcaacatgttagccacgttctcttggataaaactggcacgttaacagaaggtaaatttacggtgaatgcattgattccaaatgatgggattgacgaaacaacgttattaagccgactggccgcccttgaaaataattcgactcatccgctggcccaagcaatcattactgaagcccaagcgaaggacattgaagtcgttgcggctgaaaagtctcaaaatattccgggcgttggtatttccggtaatgttgatggcactgactatacgattgttaatggtaactatttaacgaagcaaggtatcaggtttgacgaggccgctgctgataaatgggctgctaagggtaattccgtcagcttcctattgcagggcacccaagttcaaggaatggttgctgaaggcgacaccatcaaagcgggtgctaaggaattaattagtggtcttcagaggcgaggaattacccccgtaatgctcactggcgataatccaaaagccgcggaacacgttgctaacttactaggattgacggaattccatgcaggcctattaccagatgataagcaaaagattattgctgattatcaagcaaagggcaatcacgtcatcatggttggtgacggcgtaaatgacgcaccaagtcttgccgcggccgatattggaattgcaattggcgccggaaccgatgttgccattgattccgctgatgttgtgttggttaaatcagaacccagcgatattttacattttcttgatttggctaaaatcacaaatcggaaaatggttcaaaatctctggtggggagcaggctacaatattgtcgcaattccactcgctgccggtgtgttgtcatttattggaatcattctagacccagccgttggtgctgcggtcatggcgatgtcgacaattatcgtggcaattaatgcgatgggattgactggtgaaaagattaaaaacgtgtaattaagtgatgacaaaaagaggagaaagatcagctggtagtctggtctttctcctctttatgatcatcatgttaattacttatctggttgctcagttaatttcgccaatttttgatgcagcctaatgtcatattgcctggtaattggcattaacaccgcgaccaccccgcaaatggcagcaccgattcctgcaatcacaaataggcgttcaatgccaatcacatcagctaggggaccggcaaaaattaagccaattggtccagctagattcaacaaagaattcaaaacgcctagaatccgccctaactcttctgctggataactttgttgaatcattgccattaaaagcgttgtaaaaaatggggtcgcaattccttcaatgatgtttaaagctgcgaaccatgttcgggccgatcggccctatgcaaagcgataggaagcaacagtttttttaaaagcctttctaatagcgaatcagctgtcgggtctggtttatctcgccacatatcgtaatagcggtagacagtgtgccattccgggaaatcgtgcggtaattcacgccattgacaccctgtagtaagcgagtaaaggatggcattgaat

SEQ ID NO: 82 - DNA, 2429 bp, Lactobacillus paracasei
aaaacggcttagaacgcttatatttgcgttctaagccgtttttgatgtaaagagcattaattgtacccgtcagagtaagaaacgctagcacgggccctttagcgctttttaaaactcactgttttgataaccaatcctcaacgatatttgatttggtcactctgacatggtacttagccagatccggattttgattcacttcctgttgcttttttgcgaccagctgatccaattttgcaatcgcctgatcggtcaaggtgaacatgacccggtgagtttcgtcttgtttcgtcatctcaaaaacctcctgaatggtgatgatgaacggtcgtctggcaaaccaacacgacgttaaaattgcgtcacgttgccgggcgatttttggcaaacagttgcaacgaccctggtcaaaacgtgactgtttttctccagggaaaagatcaaaataaattgagttgcgatccaatccatctcaaaaatcggttcggctggatcgtccactttttgaggccatttggaacgcttctaaaatcaagcaagagcataaggcaaaactgaccccaaaattggggtaaaccgcagtgcggtttggtttgtcgtgatagcacgctggggtcaaaatgttgaatattgacgcgaaatgcgacactggcaaaatgggcgatgttggattttagaagaaaatccaacatttgccaataggggctacccccaagcgcaagttggggtacagaattcagtgtcgtatttttttgaaaaatccaacatttagcgaaaatggcacctgtccgatcgaatgagcacgtttttggcgttgcagcgtacacaactctatagtggattggctgcaacattagatgcgtatagcaggttactcgaactgagacatagatgttgcattaacggagactatcgagatgcttatgacgcaacaaaaaattgaattaaccgtagctttaaagttgcacaaatagcaactgagctgtttctcaaatgcaactcatatattacacgatgttcaacttgaacgaaactctcaatgcaagtatatgtaaacaccacgtgtaacatcgtgcgaaggtcagcaaaaagatgtcgtcaggtgctgtttgaattttagttttgaaggggtgactcactcctccttcaaaataacagggggattgggggcgtgctccccaaacaaaattgacgctcagtgcagctgagatttggtcaatttttcgcaagtggacgtccacttgcaaatctcgcgacagtagaaaatcgtcaaaaaagcaaaatcggtaaattgctgatgttgctctttgtttaggcctcagcttcaaagctgcaacgctaaaacataacgatttcatgaaacatggtgcgagtagtttattgcaatctaggaattatgcaatttaggagttaaaggctatattagaaataaactaaaggagattaactcatggaaataaaacttataaatacttgcaagattaaggatactgtaacgttaagcgatgacacaaaattaacatatattttggaggctgagccaagggaaaacggtaaatttatcgttaaattgaatatcattgaaactgataatccagaattagaaaaagtcaaggaatcaggccagaatataatctttgctttcggaactgacgggactgacgaatctgacagttaccagcttaaagatggggaagatagattggtcatggaaaatatatcttcttttaacggatctggtgcaaacagtgtgagagatgaccatctaaccagctattgatcctatgttgaaggttatgcagctaacaatgcttctaattcgtccacgactgagaacccgatgagacttaactctcgtcgggttcttttgcggattgcgtgaacaatttccacaccgctcaacgttgcactagcggttcgaatgctttgaaagcttgctgagcggacacgatgacgtttaatgaatcggtggtcctgttcaatcaaattatttcgatatttggaacattggtgggttgatttgctcaaatagtcttgctttatcaggtgcttcactgctttcagtgttgcccgatattgatcagtgactaatcgatcaggccgaccattggtcgtcaagagacgcttcaaaaagtgataggatgcggtataatcgcggtgttttcgtagctcaaaatccatggtcaaaccgttactgtcaatagcgcgatacaaataggcccaacggcctttaactcgaatataggtcccatcgattcgccaacttttagcgtgagctgtttgatgccgacgccatagagccttaaagatggggccatagtgatgaacccaacgcatgaccgtggtgtgatgaacagtgataccccgatcccgaagcaattcaacgatgtcacgatagctgagactgaatctgaaatagtagccaacgg

SEQ ID NO: 83 - DNA, 11922 bp, Lactobacillus paracasei
cgggcacaaaaaccgccacgacacaaagcgcaccaatggccgattgatggacaaaatggagctccgccaccgttttctcagcaacgatatgctccgctggcacgtgaaaatgggcctgcacaaaagtccaagtggtttcattaatccgagtcgttccttggccagcgagccgaatggtgacctggtcatcaatttcttgatcggtcatccatggtgtgagaatcgtcatgtcagtgtcggcagtggttgtcgcttgacgaagatcaatcggtgattgctggaagccgaaaccatttggccacgaagactgcttggcataattcaaaattgacatcgtgacaatcctttcaaaaaatgaattggcggtgggcagtcgaaactcctgctgttaaaaacgaaatgcaccagaagtcatttagcagacagagactaagaaaatcaaaactagagatgaacttttctctagagccaattttgctcagcaaatcctactgacttctggcgcacatgatgggcagttattcggctgaagaagggatgctttttagttgagaaatttcacagccgtgccatatgcaacaacactttgcatgtcaccgccaattgatccggagtcaaaccgcatcatgacaactgcatcgccaccagctttttgggcttcgtcacgtaaccgctcgatcgccttttcccgtgattcatgcagcatatcactgtaggctttgatttcaccgccgacaatgttcttcaagcctgcaccaatgttgctgataacattctttgactgtgttgttaagccgaaaacttcgccgatcacttcatattttttgccgggaatgttttcggtggttgtgattaagatttcttgtgccatgagagaatctccttcataaaagttgacgtaacaaatcagtggcgagctatcttgctgcttatcagactaccaccggcttatggtgacaacaagctaaaacgcttagcgtgacaaaaccgttagctagtgtcatcaggtcaacatttttagaaaaaaccggagcactagtttgcctcttaaagaagtttttcccgttagctgcccgtgctagaaaacagacgcgatcaggacgttacttgaatcacaattcggccttcatgcggctcatccagcaattggtggccttttacaaagccttcgcgggtaaaaggcaatacatagccgactttgacggttaatttgccttgagacataagattaatcaagactttaagtgcttggccgacttcggagccgccaagcggtcgggtatgaatgaaacggatgctgcggttgaggagcggttcgtgatgactgacagatacgatcagcccattgtccttggccatggcgacatcatcatcaccaccgatcccgtccatggcggcattaatcacgacgtcggcggttttggcaagttccttgacaggattcccgcggtcataagcgacaaaatgttcaaccccgagttgattcacatcaacttcatggcggctggcggcgataccaatcaccgaagcaccgcgggcaacggctaattggatggctgcggaaccgacaccgccagaggcgcctttcacgatgacggtgtcgccatcgtgaatatgcccaagttcgaccattcgataaccggtcacgccgggggtgatcagagccacaccgttttcaggcgtgatggactcaggcagtaacacactcatgtcagctgcggccgtcacaagttctgcgtaagcactggtggtgcgcgcaacgacgcgatcaccaagtgcaaattgcgttacctgatcgccgacagcactgacaatgccagcaacatcataacccggcaccgttaagccactgccacccatttgacgagcaatgcgatcacgattattcagaccgatcgcttgggacttgatttgaatttcctgtggtcctggcgctggtgtggccaagtcgatcgcatcaatcacttctggcccgccagcatgactaaaaccatatccaagcatcttgttccctcctcattaacgtgctcaccagcgcagttgcctgcacctgaggcagcttacacgccggtttcttttgcgttggttcacgttaagcctctatatatcggcattttacccatgataagaaagaaaaaacaattaaaacgacctagccgcttaggggtggaaacctcttacgcagctaggtcgctatgaaggtgacacatggtggaaatgaacgaaccggccatcagtagattaccgattttctcttcgcggctggggatcaaaaccatgtaactggcctttaaattcatcaggattttgactgacataagtaccgcgggcccaactggcagcgacagtttcatcaactggttcatcgtgttcgctgtaatccagccccattttttcagcagcaggggagacccgaatgctgacgaattgtttgagaactacagtgattagactgaccatagcaccaactaagacgatcacgatggcggtgccgacaagctggattaggagcagctgccatccaccgccataagccaagccagcgtgcgcaatgtcgggggcgacctgtttgctggcgaacacaccagtcaaaatactgccgacaatcccagcgaccccatggcagccaaaggcgtctaaagtatcatcaatgcctagccgtggcttgattttgctgataaaccagtagcttgtcaacgttgccgcaacgccaatgcatgctgccccaaaactcgtgacatagccagtggccggagtgattccgacaagcccacacaaggcaccggtacaagttccgatcagcgttggatggccggtttgccagatgtccagacacatccatgtgaccaatgccgcggcggcgccaaccgaagtcgttaatgctgccgtcatcgccgcttgattaacaccgagtgcagagccggcgttgaatccataccagccgatccataaaatggccgtgcctagaagcacccaaggccgattataaggtgtgatatgttcatccgtgcggcgacctagaaaggcggatagcgtcaaggcggtaatgccagcattgatgtggatcactgtgccgcctgcaaaatcaagcacacccagaccggccaataaaccgtgcggactccagatcaagtggacaagcgggtaataaaccagcaatgaccacaagacgataaaacaagtcagaaacttaaaatgcatccgaccaacgacagcgccaacaaacaaggccggcgtgatgatggcaaacatcatttggaacagcacatacacgccggttggaattttcgccgtggtcaccgcgccaagcgaaagatcactcaaaaagaaatgatgaacctgaccgatgacaccgaaaagatcgccattaaaactgagctcatagccgacagcgacccaaagtaggatcgcaatcccggtgatgtagaaaaccgacagcatcgtattaatcacgttgcgtttggaaaccagtccaccatagaaaaaagccagtcccggcgtcataaaccagactaatgtactcgcaataattacaaacccagtatcagctaaattcatctctgccacctcatgactattaatggcggtattgtagcatgatatttttaccatatcagtcaaccagttgcgttattggcctagatcaaaccgaaaactggaaggataaggcttgcaactaaaggctttaaggggtgtcaaaaaaactgattctgcgtcagcttatgtcacatgaaaacttgacgatttctgaagaaggtccaaattcagtcaattggtctatgcggagagctagatttattgatggataaaagtcagccatacataaaaagacaccgggaaaaggcggctactgataacgcgctgccaagccgcaggtgacggttttggcagcgtgccatgtagcagttttctcggtgtctctctgatcaagcaactttatttaaagttcgccttccgcaattttgcctaacacagatttggacggaatgaagaacaattcgccggtttctggtgtggaaaagtccaacagccgatcggagttgtcaaacatgccttgcaacatgcgcttggtaaccatccaatgacgggcatagccgatgaagtaggtcccgttttcgtttttggccggattactgaaggggacgttcatgcgcacaattttatgttcaacgccgccgtcattatcttgagaaactacattgtgggcatttggcagcttcttttcgtcagccaactcaatatcgttgaacttcttgcgaccgatcgctttttcctggtcctcagtcgtcaagtcgttccacgcctgcatattatgctggtacttttgagcaaaagcgtaggagccattttcgaaggtgggatcttcatcgccgatcacagcatactctggcgtgtcgagcgcactaggattttccgtgccgtcgacaaagccgataattgcgcggccttcaaaatagcggaagccatgggtctcatccagcgttacagtctgatcgccaatgatggtcatgatctctgacatgagttcgaacggcacagctgaattctgcgagcgaatgtggaagaacagatcagccggggtcgccactgcggtatactttggcccgacaactggttggaattcctccaactctttaggcaccggtgctgctgggaaaagataatcccaagcttttcgcgacaagccaaatgcaaccgccaattttgcatctggatagcgaatgttcatgctattggtgaatgctggtaagtgctctgctaagtcggcaatcatggctttgtcggcggccgcatcttcgcgcttaaggtcaagcgtagcaaaaataatgtcagacccggcatccttatagacatcctgtacatcacgtaaatttatggtcatcgttacgcctccaaattagaataattctaacctactatagtctaccatagcggtggctgattgcaacgatttcgcgatgtttttaacctaggcattcggtggtaaagtaagaacaaaggttgtgattgtttgataatttcagtagcagatcaagccgaacttgtcattcgactggtggtggctgcactttgcggctttgccattggttatgaacgcaagaatcgcttcaaaaatgccggtatccgcacacatatgattgtggcgttgggtgcggccttgattatgattgtttcaaaatacggtttttttgatattttagatttgaaaaatatggcattggatccttcacgtgtcgcggctcagattgttagtggcgtcagctttttaggcgctggagccattctggttcgccacaataacgtgaatggtttaacgacagccgccggggtttggacgacagcggctgtggggatggcaattggggcgaagctgtacctcatcggcttggccgcaactgtcttagtgctctgcattcaagtcctgctccatcatcactatcgctggctgcccagcggtgataacggcattttgacaattcgggtccgcagcgaaggctttgacatggtacatttacgcgaaacattaggcaagtaccatatcaaggtcctgaatgtgtccattaaacatgaaggcgacgaagttaaaatgaacctgcatgtggagagcaaagccaatgaagacatgcggcgcctgctgacgttttatgccgacaatccgaatattatttcgattgaattctaggcaatcgctagttaagttggctagtaccatctgcatagttgagggtcacaccaggctgaacgttgaagatgtagacattaaaatgaatcgtgttgtcgccgatactttgcgcacgcatcgccacaccgcgtggtaacagttcatcaccgcgaaagatcggggtgacttcataacgaataaaatgttggcgtgactgtttcaaataatgtgccatatcatcttcatgggcctgcatcaacggcgaatttaactgccgggtcccagtcatcaaattttttggattattattttcaccggaaagctgaaaaccaattaaatggctgcggttgtacagccattcgccatgcactttcttgttgtgccacccagttggattccaagtcagcggctcgcgcttggcagttggcatgatggcttgattcagtaaagcattggcagtaccagcacggttgagactatcgagattgctaaatgttgtccacgggcctttatcactggcaagttctgctttcgtaaaaccaggctcgttattgttgacggtaatctcggcagtgttgttgtaattgagctgcgtcagttgcgtgaccggctggcgagaggtggcatccgttgccggcacactgttgctaactgaacttgattgcggcggtgtccccagcagtgaagtgtgttgctgcgtgtaggcataaccgccgctggctaagccaaacaacagcaaggtcgtcgccaaccgccgattcgcccgccgttgccgctttgtgccttttcgcagcaaaagcagaaccatgccagcgagaatgagaatgaatgtgatcaggttattcataatgtcctccaagtgactgatggatgtatgtattgggcgagaaaaagtttagtccactgatgttatgaaaagtataatgctcagtgctaacgtagtattttcaaagggtagagtcagagcggttagaaatcggtacgtttggtgagcaggattggatgtatcaggaaaaattaatatgctctgaggtctgataaggtgaacgtatttttcaactaaatcattcaggtgacagatacagttcttgcgagcctttaataacagaatacgccaatgatagagaaacagttttttgaaccgactacttttgagattgctgacttagttatatagccaccgtcctagtgaatgatgttttgtcctttatcagtgaatactacaccaacggacaaaatatgaaccgtttcagaaactatacagtaaatcgcttttctaacaacggtgataaaattgaatcagatgctcgaagcattctaattcctgagggtacattggctgaagatgctgcatatggagcagccttaaatgcctttaaagttaactttaaggtttcatattcaattgatcaggcaactttagcagcaaacgtgtacaggaatatgattcaaggtcatttagaaaactgatgcgcgatccgatactatacgaaatcttatcgctatcttgcgcaatgacgctgagaaaaaggagtgaatctgacgacttattggaagtatttgcacacaatcgttgtgttagccgtacttttccttatatcacttgtatttgctagtcacacaatgattcagacacttcttggtgtggggtcgcttgcttggtttttgctttttcttattagagaaatctatatgaacagtaaacaaacgaagcgaacgaaatttcaagttcgtctatctcatgtcttgattatttttgggttacttttgttcaatgcaagtgtgcaccaaacttttatctctacatttggacaaagcgacatagaccaattttggggtgagcatgaagcagcaatccacatgaatggtaaagcttaccatttgatatggacaaaaagatcatttctaagtaccacgtatttttataacttgtatgaacgacgaggattgttcttttaccgtgtcaactctaacgtcatctcgtatgtaacacatccatccagtcaagctgattacggagccatcgagacatttcttcatcacagtaaaaagtaaggggaaaagtgatttcatacacggatgagtccgggtcatcattaaaaaaataggcctacactttctggtgttgaggattaatcaacactgaaggtgtagacccgtttttgatagcataaaaagactcctactcagtgtccatgctatgtttgttaacatcgaaaccaaataattatattagcgtgacgtattctttaaccagctctagtctttccgcgtctgttcggtagaattctgtttgttgtgccaatgcgattgctaagaacttatagccattgtgctttaattgctcaatagtggttttaatcaactcatcaatggttttccctgacgaaatcacttttatattcgtcttagtcatgattgcccccctcggcggcatatagaaacaagaagtagaacgttaatgctcttgatttaggattagagtcccttagtcttaggattcaatcgaaagaagaacactgtatgcaagtaaggaagcctttttcaattttgtctaaacaaagcttacttgcttaggtcttgctgtcaagaaacaaccactgtatgtatcttataggatagttggctcagttatatagccaccgtcctagtgaatgatgttctgtccttttgtttttcgaagattccagctaatatttgatacattgaaaaatcacttttctctctgaatcttatcggcaacttaatttagagaagaaagtggaaccttttttattaacaagaaaacaggcattgccaccaagaactttttcagttctcggcggtggtgcctgttgtttgagagcgcttatggcgcagtctcatgaaagccggtcgattctgctttgcaaaaggaggggcggctgtacaaagttcggacataaatataagagaattgttttaacatgtatgacttaactgcatgaattcggcgtactgccggaatcgtagggaccacatggttgcggtggggacgggattacaatcgccattgtgacagttataccaatctatagcgctacttaaccaattaccgccgccggtcactttttgcagttcagttgcacttagttctttaaattcatccatggttttgctccacataagatgcgttggagctctaaagaaactggaacaaagtattttgatttcctgtagacttcaaacatgttcttaagacttatcagattagtgcaaataatcgtgcaccaaatcaatctaggttatttttttaagaacgcaagtacgttcttcttatctgttttcatacttcccgccaagaacgcaactatgactgcaataacagaaagcacaaattccaataatgaccacttaaaaactaatgttaaaactaacggtacaaggacggcaactaacaaaattccatctctggggcctaaattaagataagggtacatcatcatggggtatcacttctttcgttacctagcttaggtagttctaattctatcatcagttttaatcgccattgcgtccacctccaataatctgggtgagctctttggtgaaccaataatgtttgcaaaagtctacgtattggcgagataggcatcaattggaggcggaattgtatctggatcagaatttaatcgcggctcggaaacagggacaaaaggagaagaggcgccttctgatatcgtcactaaatcagtgggtgttgatgattgtccatagttcaacagcatcatgctcgtctccttgtagctttgcaaaaggaatatgttaaagaatgacatttacggaagagaaaacactgatatcacatatggcaagcgcttactaagttatccaaataaagtactacgcccttgtcttttctctgtcaagaaaagacactttgaacgtcaaggtggaaactgatactactgattaagcaagcaatggttggctgctctttaagattgctgtagttacgatttatttaacagttgatctttcaggaagttccagtaagtcttcttgccagtgataatggagaattctccagctagaccataacgtaagatgcgggcttgttttgacgtgatgttgacttgggcggtgactttaaagacattcgtgtctttcgtcacagccgggccgctatcaatttgggtgatcttgccattgagaacgagaggaactggagcgtgacgggcaatctttaatcgaacgttctgcccctttttaaaaactggaaatgtcattagttaacatcaagagggtcaacgctaccttcttttgaggatgggcaaatcgttgaggttgaccctgagatcgctggctttggcgtaataaggcaattgcttcaagttgttgcccggtcggtggaaggcaagattgatcgtttcttcatgactaaattgggactcgcgtagcttcgctttgacggccaatgatttggtgtaagcactcacggacatgcccaagggcgcaaccattttcgaagcttctcgtattggtcaggggtaagccgaaaattaatttgaggacgctggggatcatgaaaaccagctcacctctctgtgaggacgcattcctccatatgcggccgacttccagccggaaaagtgtagaattgaaggttcgatttgctgccaccagtctaagactctcattttgggtggtattggttcatttgctagacaaatcgggtatcgctgcgctccccaattgtcagtaaatggcttgtaagaagggagctgcgctcccctcttaactccccacaaaaatagccgattacctattcggtaacggctatgaaaaccggtcaattctgttttgcaaaacgaccataagagatgttccttatcgtagcaaagaaattaaaagcctaatctgtatttaacaaaacagacatggagtgggtttaactatctttcgccggaacatcaattggatatggtaaaaggtggaaaaagtaactgggttcaccttcctcagccggaacgaaagaagtacccccgacaatatttgcaagttcagcagatgttagtggtaaaaattgacttaggagcatggtattacctcccttgagtattcaaacatgacaggttaattgaagaatgaactgacaaattataagacgagaagaaaatggatgtgctgttcgcgggctaagaaaacgcttttttatctgttgaacaaagtttactcgcataagtcttcctgtcaagaaacgaccactttacttaagtggattgatatcatgagtttttaaaccaagctttttatgctgtctataaagaaatataaatgctagtatgccaccaactaatcccccaaaaaaatgaacataggccgttattgtgaaccattggccccaaatgaaatttaagattaaagatagaattccgataaaggatacaaatatgagggcgcttagtctaaattttttctgaggtaggtttttggaagttttgaatacgaaaataatgagagcgaagatgtacaaacccgttatggatgttgaaagcccaacaattccatgagagtatccaaatgtagttaaaaaggaccaatagttgccgtcagagtttactaaagaaacaatcaaaacgtctgctaacagatttcctaatacgcccgataaaagtaggagtgataaatataaggccttgctaattataggagaaacaacccaagtcaatataatcaacaaaaacatattagaaattaagtgagtgattcctgtgtgaagaaataaagatgttagcagtctataatattgaccagacagtgatagtgaaggaaagtttgtggcaaagtcacttattaaaaaataattggataagtcgctattttctagaaaaaagatgctggaacaaatagtaataatccagaacaatgggcttagagctatgcgtttcattaaccttattacttgattcattctagctctcctccaacaagtctctgaaatgctgttgtaaatgaaaagcagaattatcgtattctgctcacatagatgataattttgctttagtttatttcacaatctatggaataagcgggtagcgtaagcttcctccgacaaatggcaggtgatgaaggatgttatcgagccaaccaccacgtcccgtcccaaaattgtgcgggttgaatatcaccggaaatacgttgagtatcggaagtattcagattaggaaattcattaatactcttcatatttttttatcaaaacttaattatttgccagatggttgttacttaatttaaaa

SEQ ID NO: 84 - DNA, 442 bp, Lactobacillus paracasei
ccttcatcggctcctagtgccaaggcatccaccgtgcgccctttgtaacttaacctgtactgacttgcgtcagcggttatgcgatgcgaatttctttttcagaaactcatacaaatacgctgtgttctcggcaatttaaaacaattaatacaatgatatccagttttcaaagaacaaagtagccgactttcgtcggtcattggcctttcggccaatggaggataacgggatcgaaccgatgacctcctgcttgcaaagcaggcgctctcccagctgagctaatcccccataagggttgttcaattaacaagcgtacgcttgatgggcctagatggacttgaaccatcgacctcacgcttatcaagcgtgcgctctaaccaactgagctataggcccgataggcgtgaagaggttatcctctcaaaactaaacaaagtttcgt

SEQ ID NO: 85 - DNA, 9401 bp, Lactobacillus paracasei
atgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggttaataatgaattcatttcattttcctctttcccagttagcccacgcccatattgaagcaactgcgatgagcaagatgacggcaatcattgctttgcttccagcctacgtccgcacatcggacaataattgattgcaatcggttcatcaacctcagcattatcaaatccgactgcggtgcaggtgtgtattgccgcaccatttattttttcaggatgaactccgtcccaacagttcccaccagacatacctattcgcagaaaactaccatcttctgcttcaataggtttatgcggctcttggcaatactgacagcttttctgtttcttggttaagggggtcgaattcgactccctttccactttattagccatgttatgtctccttacgcaagtcctgtcacgtgcttgctaaattttacaagcttctcactaaggtattcggcaacaagatcaattgctgtgttccgccacgcatcaccgtcagcactaaagagcgccaattttggaccttcatgcatccgaaagacaaaatcactttcctgttgctcaacttccagaaatgtacgatatggccgtagtgagattggattcgggacaactaccttgccaacggatgccacaccactgcgtgcggttgcaacttggcttacaccgtcatcaaccatcgtctgtgcagattcgtctttaagattaccaacaaatttaagcaacactttgccatcctcagtggtcatgaactgtgcctgcagtgcgatgatgaatgattccgaatccagccattgaccgtatgggtagcagggatgcattgccttggccttgatcaagacttcccggttgccaaaatcatcgagctctcctaatacgaatacgctgttctcatcgactacttgcacaattaagggactggcagaacgttcgctgaccttcccgatataatcgacaactgcagtcaatgtgtgaacttgtaacgcttcgtttgctccatcatttggtctaaattcccttatatcaccgttaccattaatcaaaaattgacgattttttgtttcgataattcgtttaccatttgcagtaactgcctgttctgctgtgaatttaagtgcatctgcttctgttgtcatattagttggcctccttggcgttcttgatttttcggaaatcaatcggtgcgtctgttaccttatcgtctttaattgggatacctttgtcgtcttttagcgtactatcatctgggtcgaagtattcctgccctcgtgtacctgactttaactcgttcatttccatatatccgtcctcgccacgtccaagcaatacattggtggtgacactgatgtctggtactagcgttgttttgacatcggttgtaagcttaacgactccgctatcgtcaggcttaaagttaagcgcaatggtaacttttcgtgctttgctctgatcagtattaggatcaagaatgttattggtaacctgggccaatgcctttgtcaacttttctttaatggccccatcagccagttcgttcagattcaaatttaatttatccatagtatttcctcctactttttctttgctaaattcaagcttgttctcctcaaaatagctttccgtctcgtgactccaatgccttgataactccaaatatccttaaacagtcatctagcgcgttgtgagtacggtttactggtatgcctagaacattcgccagtccttgcagcggaggcgtagcattaaagctataccgcttttcaacgatgtctgcgatgtcgataaacttccagttcttggggatgccatgtgacccctttttaaatgtttctctgatgcggcccgcatcgccttcaatcgaccagcccacaatgtcaatcgtagttctcatccaggccacgtagtcacgcactgtttgctgcaggcttggtaaagctaaatagtcgctgtatcgcatgttacttgtcctaatgatgtgaagctgatcaaatttatctggtgatggaatgaatcggttgaactgatctgcaatgtgcagaccgtctcgaattctgactgctgatatttgaattgctcgattactggttgagttaaactccgtgtccataatcacgtattctttcatcaaggcaacgcctcttttcgctgatctaggattcctttaacgccaaagctatttccttggccgtgcttggccatacgggacatagttcgctcgccgtacctcttattcagatcttgtccgtgcaaattggttgtcacgatagttgctttgtcttcccgcattctgaaaacatcatcagccgtctggcgttcaaaatcactaccacgctcggagcctagatcatcgatcacaaccacatcagccttgccaatctcatgcataattttttcgttcttcattcgcacatcttgtgcattagcactcatgccagacttgagtctctgcattaaagcgttccagtcaataaaaaggcatgttttgcgataaccggtcttggcctgagtatcaattaatatgccgttagcaatatgtgacttgccaactcctgtgtcaccgataatcaatgcgtgtacaacctcgttacggcatattttgttagacaaaccgacagcgaagagtttcaactgctgctgtccaaggctgccatctgtatggaagttgttgaaatcctttgcaataatcgcgtctgtactaaataccgaataagctaggtagtatccaacggtgcggttcttgcgggcctctttttccatatctggcgtgacgtttttaggctccgtgggtggctgtttatagccacaattcatgcacactccggccatttttttaccggttactttgctcaatcccttcgggcgatacaagaggctgccacaatcgggacaacgttcagcaaatgtttcgatcgctgctaaacgtccttgattagtttcaagattgctcatcacacgcctcttctctaccaaggtaagtcttcatcttggacatccccttggttttgataaacgtctgtagatgcttgccgtgacgttgattttgacttttggcgttgtgttcgttgggcttcataggccgtcactgcctctaaactagtaagccttaaggattcccaattttttaaaatggcattgacatagctataacgacgcacgttattgtcaattgcgttgctcatggcctgtttgactacctgaactgcctgctcgtcagttgagccaatcttcttgaaatcatctacccagtacatgaggtcttcacggttctttgggctgataaaaccaaaaccgtttttctcccaaaaattaatgagctccggttcccctaatgttgttgtattattaatacttgtattattttctggacagttttctgaccgggggtgggtcaattttctgaccgaggggggtaagttttctgaccgaggggctaaactaataaatctttgttcaacctccttacttccacttttatatttgatgactctgcggatatatgaattgtcttcgagacactttagccaacttttgatagtgccgatgctaaccgaatagagctttgcgaaatagtcattcgatgcccagcagtaaccgttcttattggtgagtgccgtgatctcgccatacaagagcttggctccttgtggcagctgtttgtcatagcgcacacctgctgggatgattgcatagtaaccaggcttctcattcatgatcgacaccgccttcatgaaagcattgatcggcaatgttttggcgaacatccattaagtctgcttcgaatttgatcatatcgagtgatgtttgacccaagatatccatgtattttttaaagttgtcttttaggaacagccggtcttgaatcttctcaccatcggtcatgtgaggatcatcatccctgaatagatcgcacttggtttctgcccattctctcaaataatccaaaaggtactgatcagttcttactttgtatgcaagtgattcaagacggtcaggttgcttgccaatttctctggccattgttttacctcatttctttctgtgatataatgaggtcaatcaatgtgaaacctcatttttggccgttaagtgtgctagcgcttagcggtttttgttttgccaattatttcgttgattaagctgtgaatagagcatattgtttgctcccttttgtgcgataatcacgaagaggtgattagaatgaataaatacgaactcttttccagcgtcgtacaagctctgacttcgatagtggctgttgttctatcaacaattgctttaatacgaagttctaaatcagaacgtgatgcaaacaagccgtacatcgtttcttttcttaaagttgtcagatcttcgcaaactacaataatttacctaatgatcaagaactttggccgaacaggagcaacaatcttatcagtcaaggctgatccggctattgacagtgggcaactaaagtttgaaaacaacccttttgaattattttctaatcagctgatagcacccgaccagacctatgcagccgttatttcagtcaaaaactcagaaattgagttaaaaaccagaaagttttctttgtccataacttattcagatgagtttggtaaaaaagaaacaaaagactttttgcttaacgctgatgtggccacgtccttcgaccacatcacgccggtaccaacaaaaacagatgaagtagcgaaatccatttacataacgagcgcggaaagactatttaatcagttttaattcagcgtattgatcaagatctatcaagtctaaaattgcttttgcttccgcaagattgctcgtatgcctactcaaagtcgcgacaataccatcaactgccatttgaacatcattggccgaaacactaataccatcgccaaatattggagaatattttttgttcaatttggtctccgggctattcaatccacttcctccaatttccgctgtggcctaagcagtggccaacgatcacgccgaagccaccagcaattagtaaataaccaatcattatttacccttctctctaagcgaccttgaaatctctgggaaccatttgtctaagaagtcgagccatggtttcggatgaaacagatacccctttttgccaggcggtggatatgaaaccacggtatcttgcaagaacttgtggaagcgtgggacgttcaagatattgttaactacccacgtgttgttatgtccttcgacatagcttgttgcggtggtgagcgtccacatgcctcgtgctgctagcttgcgttttaactcttggttctcctcaatcatctttgccagttcttcttcttcaaccgctaaatactttttgcttgaaatctgatcatcttcaacaacctgcaacaacggcatggcattttctcctttcctgtgatcgcctcctgacggataatgaaaccgaaaggaggtgaatcttcatggtgcaagtcccttattatgacaatccgggcggagctctagctgttacagtcgaacttccgcacgctgcgaacgtttacttggtggatcaagcaaacttcaacgctcaccaacgtggtgaccactttacatatttcggaggtcactatgatgagtccccagttacaattcgggtttctggagctggccgttggtatctgattgccgaaaatgggtcaggcgaacaataccgttacacctggtctaaatagttgcgttgttctgatagtgagacttcacacgtgctacaactgattcaaagttggcaaatgtgaagcctttttgtttgagaagatcaatgaccattccagttacttagtcttcaacatctttgtcctgtactttaacgacattggttaacttttcctttgggcgttcattcatttagatagccttctgttgttggtcctccaataatgaaatctcgcgtgctttcatgagagttgctgttgatggcgtccaattctggataaagtcatcagccttatcgaagtctttcttacgtaactgtgtacgtgtcttgattccgatgtagtcatttagtccgtggttaatatctcgataaaagaggctgcgctgttttgcgttgagtttgcagtgatgtacgtccacataatttgcaacagctcgattgacttgtttgctgatgtagttatattcacctggtgccagcaaagccttctcttccagatcagttacacgaccatcaagcttttcaatccgttttacagttcgagtagcaacttccatggttaaagcaagcttttcttctggcgtctgtggaagccgtgttttcggattaaagtagttctcctccagactgtcgaacatatcccaagcctgatctgtaccaagcatttttgagtgacgtgcggcgccgcggcgagtccagagatatagagcacttgcatttttcccaacgaacccacaatttgtcggttcgttcttgaatgcccgaagttgctcccctttcagcttgaagaagtgctttccttcaatgaacttattcgagtttcgtttaaagttcatttgaacgactccaacagtcgttccgtacaattctgcaagttgttcggtggtcagtacacgctggccgttttgttcaattggttgtggttcattcaatgcgtttccttctttcatgaattttcatagtttgctgccctccgtcagtgggataatagttcataaggagggaatgtaatgtccaaaccaattgatgccgtagctgttgaaaatatatctaaaatcttgggagaatatacgactgggcccaaaatcaccaaaatgttttctttgcttggatttttcgattatgatcttcaaagacaaactgacaatcaatggttcaaagcgtctaccaaatggcgtcgtttagacgaaacaattaggcacgagtgtaatgcttcacacaatagtcgccccttttttagagccatccagtacattgctcgacctcaagactttatttcaaagccagaagaatggggccgcctacgatatgagataaatgaatgccttattttttatggttattgtttggatgacagtggaagaatcgcatcagcaaaaaccgcgactacgttttctgaagcccagctacgcttaaaaactcttagcgctcgacttacagaactcaatgttcaccctctagtgatgaaattctgcaacgaacaatttcttcaaggcgactactttcacgccatcttcgaagcaagcaagggtgtcgttaatcgaattcagcaactttcaggcatacaaaaagatggcaatagtttggtaagcaccgtgttttcggacaagcaaccaatactcgttattaagggcaacatgcttgcaacggaaaccgacagagacatatattccggattacgtaaccttcttagaaccgtaatatttctttatcgaaatcccaaagcccacacccctaagatttacgatccctccagtgtcgatgatgctgtccaagcgtttgttatcatgtccgcagcacagacaatgcttgattcagttgttaatgtcagagacttcctctagccttgttgccaccagaaggcccaataccgccatcccaaggatgctaacttggaatgtggcttttgggtttcttttttgtagttcttgactaacagcagactcaaatagatctaacgttttggacgtaaccactggaagctcattgcgaattgcatcaatcggcttgatcatttatcttcctccctattccacatgaagtttgattagcccgttcataccgtcatcttcttttgctgtgactgcttatatttgacgtattcaatagctcgcttccaacggtctttgtcgatctgattagcagttaatccctgaccgtcagtcatctttttaaccagaattgccattacctgatcactgataccgagaaatttcgcaatgtcgagctgtgacaaattcaaatgtaataagtagcctttccagtcattacgattagcagtccaattgagctgaacgtttaccatgtactcacctcccttacatttaaagaatcaatcaagttgttgcattaatttatcacgagtggtaaattaatggcatagcaaataagacagatgatctacttatccaccgttatcgccaaagacatggatggattagcttgttgatgtttgcttaattacttgatgaattcatagtaaaccacacgtgataaattgtaaaccacttgtgataaataattcgtcatgaccgggagaactcgtctcatgagtacttacgacagaataaaaacactagcttcaaatcgagggtggtcactccaaaaattagctctgaaagcaggtataggcattaacagcatctatcgatggaaaaagatgaccccatctaccgagaatgttcagaaagttgctgatgttcttcaagtttctgtggattatttacttggcaatacggataaccccaatcctgacaatgaaggttctaaacctgttgatctgtcaggaacaaacatctttacctatcaaggacagcctgttcgccaagacgattgggaaatcattcaagctattttggaacgacgcaataatagcagcaaaaagcgtgatcgtcatgaatgatcatatagaggacttgttgaatcaggtgattgactatgcttgggatcacaatataggctgctcgactatccccttacacgaggaccaaggccctttggttgatacagaagctcgcctaattattcttaacaacaaatggccgaatgcaaatgagttgccatttcaagcagctcatgaatgtgcacatattctcaacggggataacggtaagcttcgatacacaaatcaatacactaaaagccgtacagagaatggagccaaccaacgtgcgctatcaattatcgttccaatgtatttcgcagacattccagaagaatcagcaaacattgaccaattcatgaatgatttagcgataccgcaatggttagaggattctgccgttcaatgcattgaacggttttatgaaaactactgactgttcattgttgaattagcttgcaaccaactggtaaaagcagatgatatcagtataattggaaaagtcattaattcctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttc

SEQ ID NO: 86 - DNA, 343138 bp, Lactobacillus paracasei
  misc_feature (228015)..(228092): n is a, c, g, or t
gggttaaccgcctcatcaagtcactcaaacgatcctgttttggcttcaagaatcagctgaacttcttcaaacgaatctaccaaatcacggcataacatgacaaagacggctccccaaatggagaaccgcctcaaatgataaatttattcttcaacaccagttgacgcagagccaaaataacccttatcttcttgatgaaatcaagcttagataagggctgttttaattatgctttttgctttgacggacttcagagtatatacccgcttagattattaagttctttctacctgcttaatagactcacttaactgttcgactattcgctgatagttgacctgttgaaaatcacttacatcgactttcagaagatcgccgatgtaaaacttgtcatattttcgtttgcgaagacgtttctgaaattgctcaaatgtagacatgccatcaagcttagctgtgccttttgcttgatcttcaagatgataggcattctgcaggtgtcccggatgtcggtgatcaaacaaatcacggtggcgttggcgctcatacaagacttgatccggcgcttctaatcgaactgttatgacatgataactatagtcggcagcgattttttcaatatcatcacgttgcttatcactgaacggataatcagaaataatcggtttttcccaaatcattaggcgtctcatagcacgaataaaacgtaattgtgcttccttatttagagatttcttttgttctatatcatcgaatccgatctcatcccaaatatcttccttaaacctatccagtgttaaggttcttaaagcaggaaatgcttgcctaatgatgttcacactatgcgtcttgccggttcccggggctcctgcgactaaaattaatattttatccttcacagtcgtatcaacctccaaattcccgatacagtttagttttgccttaggaaaccacagactggttttcaacgttcataaatagttcactcttatgccgcacaatattataaactgccgtattacaaggcagaatattgttgcgtaaagaactattcacttcagttttgccaaacatttcttttgcaacgcgtgtccaattcaccaaaagctcggtgccaacattaaacttacgaaagccgttgttggttaatcgatgatagtcgtcctcatcaacgcctgttccgccgtggatgaccatcggtgttgaaattttggcatgtaacatctcaatcagcggccagttaagtttcgtctttgatttaaactgtccatggtgtgtcccaatgccaaccgccagtgcatccacgtcaacattttctaaaaatgtcagagcttgagctggatctgtgtatttcccttcagctattgtgacgccttcttcagttccgccgattgttccaatttcacattccacagacacctgccgagcatgggcatagtcgacaacgcgttgtgcccgctccatattttctcgcagcgacaacgccgagccatcaaacatcactgaactgtatccagcatcgatagctgacttaatggcatcaaaggatttagcatgatcaagatgcaggcctacatcaactaaaaggtcatcggccatcgatcgacaaattgcgacaaagttcttcatgccaacatactcagcggtgccaacacttgtttgaataataataggtgcgccagcgtcctttgcggcagtgatcatcgcaggtaccatctctaaattatgcgcattgaaggcaccaactgtataattcagcgcttgtgcaccacgtaacatttcccctaaatttttatacatatattcagatcctcctgacctgctaatccatccattccccaccgacaagattgattgattgaccagtcaaatagcttgagttatcagtcaaaaggaacacagcggcattgatgacatcttcaatattcacaagccgatgcatcggaatattcttcttaaagtaatccattacttgatctggctgcaaacttctctttttggcgtactggtacttcaaatcttcccacatttctgtaggaacaatccctggacaaatcgaattgacgcgaatacgttggtcagcgaattcctttgcaattgattgggttagtccctgtacgccaaacttgctggcacaatagacagtctgccaagagctcggctttttccctgaaagcgatgacatatttaaaatttctccaccaccgtttactaacatatgggtaatggctacttggcaacaaagaaaagtagctttgagattgacagctatcgtcttgtcccacaaagcctcactgctttcaagaaatggaaccatctttgaaacaccggctgaattaacccaagaggtcagcttgccaaactgctgttcaactttttgcgtagcagtctcaatggctgctttatttgttacatctatttgataataagcaaacgactggcttccaatagattgttccaataaagctgcttttttgctatcaagatcaaaaactgcaacttttgctccccgctgtatgaaatcggtagccatagctgcacccataccgcttgcaccaccagtaatcacaacgactttgttatccattcgatccttcacttcttcgccaccctgtctttatagatattttgtaatgtcagtcggcttatccttaggcatcacttgaacaaaaacctttacacctttattaactaattcttgaaaggtcattctttcctcaggactcgctgaaatgtttttatatagcacgctacggttattacgactccccataccgcccacatcaattttttcgatatgaatgccagcatcaaccaagtagttcaatgcctctggccccttaacaagtaaaatcgtaggctcagaaagcggtcttgaaaagaagcgcacgccatcctctttagtaaaaattccaatggcaatctcttctggaattgccatctccagaacctcaatcatatagtcatcattagccgttccgtcgtctacaatcacgacttgtgttgcttttcgttctttaatccaagccgtcattacctgaccatgaattagacgatcgtcaattctcgttaacactaagttttgcatgtctatcccgccttttcgtttcaaaagtctcaattttaaaaccaagtgtttctggattctgtgcctttttaaccaagtcgcttaatgaagcgccacaactttgttcaagcgccaaggtcagaaccactggcaagttcattcctgctatcactttcatcttaaaatcacgtgcaagatataatgcactttggtatggcgttccacctgcgatatcggtcaaaaccaagacctcatcatccttctttgtcacagacaataatatttgatgcagactttcacgatagttttcaggcgtaacaccgggcagtagaggcaacgtttggataccaaaatcatcaccgccaaccattttaagcgtatcaaggagtccctcacacatttggccatgactaatcaaaatcattgttaccatatcgacacctcacattttggctgaaaagcccaagattcccagataatagccaactattccgataataaatatcaaaacaataattaacgttgtgtttaccttcttccgcagcaagaacaggatccccaacgtaatgctcagcggaatcaatccaggcgctagtgaatcaagcactttttggagcttggtcgccccatcgccaattttaaaggctagtggcgtatcaactgtcactcgagttgccgccatagctccaacaaccatcagaccaacgatactaaaggagttgataatcttatcaatcgtgccattttttaaaattcgtaaaagtgatgtttttccttgcttatatccggtcataaacatgaagtatccacaaccaaagatcagtaattcaaaaaccaccgttgctaaaattggtcccagatagcttcgatctagtgccatggaacaaccaataccaaagaggatcgggtataaaataccttgcatgatggtgtcgccaatcccggcaactggccccattagtccagttcgaacagcattaatatcttctgcgctgacatctgcatcatttgcccgtgcttcttccatagagcaggcaatcccgtttacaataggcccaatcgtaaaaacttcagagttatagaaaaccatgtatttctttaactcccgaacctgatcttctttgctactatacagtttacgaataggtgtaatcattaaattagcgatacctagggcctgcaaacgttcgtagttataggctgcttcagtactagttgtccaaagccaggtttgaattaaagtccgttttgataatttcttagcatatttaggttctacacttgctatcggtgtcactgatggtgtcattgatgctgatccatctgttgtcgacatctcaactgattggtcaactgacaaccggcgaacacctttacgcttattagcagtctttttattttgattatttgagttccgatcacgaatatagagcaggattgcaataatcgcagagaaaatcgaaattgccatcaaactaactcctgaataaacagttaaaaagaagccggcaaagaaccaaggaattaaactacgcttccctaaataattcagtaacatggcgattcctaacgctggcatgatgccacccacaacttcaagtgcactaaccacactctttggaacagcattaattagatcctttgcccacccttgaccagaaataactaataaaaaggcaggaacaccatatagaatggcagcaatgacaaaggatgggacaaagttcatcaatctcacgccacgaatattgcctttatctagcaagcgatcagcctgatgaatccaagcagcattcacagtcatataaatattgttcaataaaagaccaaacatgctaaatggaatagcaaaagtaacggccattgtcgggttagctcccgatagaatcgtcatggctgtgccaaaaataccggcaacaattgtattacttggcattgtcccaccagcggaaatgtagcctagatatataagctggatatttgcgcccgctagcattcctgtcataggatcgcccatgaagagtccaactaaaacaccggtggttaacggataaactaaacatttagtgataggtccaaaaaaccaccattgacccatagtggctaatagagctactaaaatcgctgatattaccattttgctcctcctaagtttttagagatcaatgttcaccactaagacgaatcatcaccttaccgttgcgcaagttttcttgagttgcgagttcttttcctgcgtcagcaagctcgatttcggcactaataatttggcgagtatcaattttccctctttccaataaactcactgctcgtgcagatgtatgtggattcaagaatgaagtataaatgctcagttcttttgtataggcttcaaattgattaaatttaataggctggtctggatcacctaatccaaataacatgactttcgcgtttttaccggcaatctgaatagcttgttccatggttgagcgtaaaccaatacattcatacacataatcaatatttttattttttgcgactgcttcaatttcctgatctgtaattgcctccgtcgctcccaaccgtagcgctaatgcccgttttttcgcctctctttccacaacaatgatattgctttgcccagtttccttaacgagctgcagaattagtgatccaacagctcctagtccatacaagaccgttgtcatccccgaagccatctgcatcaaatcaacgccatgaatagcacaggacaagggttccgtaaaagcagcatcttctaaatcaagtgaatcagagatatgataaacattttgctctggtgggaaaacataatcagccagccctttggcaaccccatgccgcactaagcaaaaattggggaaccccctttgacaccaaatgcactttccacaaccgtagcttggatcacatgcaactcgatcacctggtttaaaatagacaacttcaggtccaaccgactcaacgatgccagaacattcatggcctaaaataatgggtggtatgacgacactggcaccatttttcccctgaaatttatgcacgtccgttccacagatgccgcaccatgcaacccgaatcttcacttcatctttttgaggctcccgatcaggaacctcgcgaacttcataagtgtagtcaccgacataaaacccagctttcaatacaaagcacctcccaattcacttaggtaacattgtgattctgattcaactatgatagacactaaggtaacgacccttgatgattactaggttaacctataaagcgctttcaaagttgactcacaagcgaaaatgctttcacaaaagagactggattagcaaatatctgaaaatgtttacaaataaaacaaaaattcaaaataatggtctaggagcgtaatgatgatcatacaattaaatcaggaaatctttaattcactttcggcttcagaacataaggtcattgacttcatcaacaacaacgctgatgctgttcaaactatgtccattacaaatattgcccggaaaactttcacttctgttgcaacggtgtcacgagcgattcaaaaggccggacttaacggtatagccgaactaagatatcaaattagtcatcaaattaaacatgccaacgaatctgaatccccgtataaagtcaatacgattcttctaaagtcattccgggaagctaaaaaaacgattgatagcatttcaataagtgggattctccagactgtcaattatataaataaggcagatcgtattttaatttatgctcgtggtttcacagcattaattgctgaagagtttcaacaagatttacaattactgggatacaacgcaatcattatgaaagatgtcatgtggattaaacaaacaagaagatttatttccaaacgggatgtagccgtgatttttacagtgcgaaatagcacgcctgaaattttggaatcagcagaaaccattcatgcgattggcgcaaagttagttacctgttgttgcatcgcaccaaccaaattggcagactactcagatgtgctaatatcaggacactccgaattaatcatgcgaacacacggtttagaagtttactcaaaagtccctttgttcatcattgcacgtactttgatcgaatacattgcaaacacgcaatccaagtaatagtcatgacctcaaccccgctacttacattcaaaagatttaaaatacagtattatgatgaagctgtgccttagatgagttcattctccatacaactagcccgttgatcagtacacgaaatactgtactagggttcaaaatttagagtcaaagctactgtgcctcttttgatccatactcattcgcgtcctaatcaggaaatatcattgtgaatcgttgctcatttgtttgaccacgactaccatccgggtttacaattcggtcgagtttgaaatgtatccgttttcttaactgcagttcatcactttcaatgtttgagttggaagaaggtatgaccatgaaagccttatacaaagggcgccctgcctacgtttgggagatcagcaaaaccggtgagcggcccgactggatagaagaagctttatcaaagaacaatatttattggttagataatcgcgtccgtattctcatgaccgcattaaggccaccagtggttaaaaagctaaagatgggcgaaggtggcacgattggtggtggcgttgacgcacttggtgtctacgcatatggctacgtgggcgattttttggatgcaactaaccagcgcgtagtatcgaaagaaagatttctgaaacattatcaagttctaggggtataaatactgaactgttgcgctatctcactatcatcatcactttcaatgtttgagttggaagaaggtatgaccatgaaagccttatacaaaggcaatccagctgacgtttgggagatcaacaaaactggtgcgcgtcctgactgggtcaaagaggcttttgacgagaattatctatattggctagacgatcatcttcggattttaatgagtggcttgaatccttcattggcgacaaatttgaaaataggcgctgtgggaacaattggcggcggctttgctggctatggtatgtatgcaataggttatccaggcgacttcttagatgtgaccaaccaccgtgtcgtttctaagaaaaagtttctgaaacattatcaagttcaggaaccctaaaaattgagcagcgccacattcaacgtcaaaacgatcgcatcaccagtcttgtgctagtatgatgcgatcgttttctattcttgtgttttggtttgttggtaacaaatgaagcaggttgctgtctccataaaaaacgccttgtacctagtaggctttaaggttcaaacccggagaagatgcaagactttttcagtatgcaaaccacctattaattttcatcagcctttttttacagcatgtgccatcagcagataaattagttcgcacagtatgacgattaaaacagctgcaccaaggacagcgagtgctgctaatcgcgaacgaccggtttcaacgtacccactgccatcaacgcggcgaatgagaatcatgaccgctattggcactgcaaataaggcaagtaaaccattgatgagccagatgcctttatgtttcatatgaacagcccccttgcatagattaagttgggcgactgcgaatctttttgatcagtgcagtgcccgctatgggaatcagcaatgtaacggcggcagccaaataaattaactgcagaccaaagtccattttgaacaaattcaaccctgcagcaacgataaaggtaactgccaataaactgcatgcccaccttatcgttcgtaggtgcatgtatcgctgccaccagctaacgagtaaccacgccagcgcgatgaccacaacgtcggaaagcaccagcatctcaggtagcgcgacaaatccaagccgccccatcaatatgatggctaatgctgggccgagccaagtgatcggtcgttgatcatcagcgcatgggactgattgctgatgaaggaggtcatctaccgttagctgataataactggccaatcgacaaatcgtctgcaagtctggctggttacgcccagtttcccagctagatactgttttacgtgaaacaaacaaatcgtcagctaactgtgattgcgtcatgccacgcgctttccgcagttgcttaagtcggctgcctaagcttaaatcgctcattgctgtttcctcctttaacgtaagccatcagttaaaaaaagcctagctattatctctagcatccttgatatagcggggtccttcacaaaaatacctcagccctgctctcagacttgaaccggcgatcatggtctggcagacgatcctttaattggtggtgttggaaggatcccgcttaatctgttcaaccttggttctcaatacttgtcgtgcttgatacttctgctcgttagtttatttttttgtcatatggaaataccgttgttttgagatgctaacgcttgtaatgccctgatttgttgtttagtctctgcatgatgtggatatattttgttaagttcattgattttttcagtaatcatgattgcgttgtctcaataggcctattcagcatgatattcagccgctattgtttttgactggatcttagttacaatcatcgctcgtttcacagccttttccactgcagcttcaataacgtaatacatgataaatgcaaagataatcaaaagaaaaaattgactgacatggctttatttcctcaatttgtttgcacaacggtatagtcacttctaatgcttagataacttcattttccatgattgtcaattcatgtgcaacgctttgtggcaaatccttgctagtgatctaactcatatgcccaattcacggtatacaaatagccgccacgcaatgacaatctcatttgcgtggcggctattcttcaattaaaaatccaactatcgtctaacttcacactgtcgcgccgctgccttgttctaccaatgctcgcatatccatagcttcctcaaaccggttagtaatcaagccggtgacgtaaggtgcagcaaacagtttcttcattttcagaggatcgtcaatggtccaaacacgctgggccttgttgaggcgcgaattgtaatgttcgatgtgtacggcttctaagtatgctggcagtgatgcccccctgaggacacgactagtgagccaagctgttttcatttttggcgccaaggtgtggatcacattaatgctgtcatgattgaaggaggaataaatgacgcgatcctgcatgttgaattgttcaacatagtcttgtgtcaacgcttcgatacccggatagcggattttgccggttttgaactcaatattgaccatgacgtcatagtggctaagcacggtgagcgcctcgcgcagtgacggaatgtgttcaccattggcgagtcgcatccccttgagttgtgtgcgggtcaaatctgcgatccagccactgccatcagttgtacggtcgacgcgttcatcgtgcattatcacaagatgcccatcagcgctcatctgaacgtcggtctcaatcccatcgatgccatgttcacaggcgtattcaaagccttgtagactattttccggaaaacgggcaggatacccgcgatgcccaaaaattgctactgtcatgttaaccctccaatttgttcattcatttgcctcataaaaggctattatctggtaaaagacgccatttctagctgacgaacttttgcttcgatcgcgtcacggacctcgcgaaacgcttgcaatacctcagcttctgaacctgttgcttgggcaggatcaggcaacggccagtgcaggtgctgaacgtttggcggcgtgaccgggcaacgatcgcgtgcatctccgcagagagtgaccactaaatcggcgtgcattagataatccggatcaatcacttttgatcgttgttgcgagatatcaatccctttttccgccatgacttgcacagcgagcggattcaagccgtgtgcttcaatgccggcgctggcgatttgccaatcagaaccgagtagtttcttggcgaacccttctgccatttggcttcggcaggcattacccgtgcataagaagtaaacttgcggcatttgttgtgcctcccttagtctgaaaagacgagctaaccaccgttctttaaactgtcttgatcatacgcgggtgaggttgaaacggcaatgaaatggtttaagtagtttgttgcatctgggccgccaaaacatgttagtagtcgcagaaaccgcggtgactcacacgctaccgcttataattcaggaggtttccactaacttcatttgtcttctgaatcgctgtattcgtgtcagtttcggcttcgttcagcgcttttttaacatcggcaccgctgtagatttgttgcatagcgagttcaacgttttggcgttcctcttggatgttgctgaagaaggcgccggccgttgcggcattgatatttccttggttaagttgtttgattggcacggccaaagctggattctttttgatcgcggcagccaaggtttggatttggttagctttctgattgactgcgaaatagccagtgccgagttgccaagtggcttgagactgcggtgtcattagaaatttcatgaattgccaagcgccttcttgaacagcggcaggcttatttttagtgatccacaagctagcaccaccaatggccacgccgtttgccttggtgccatctggatgtggtgtgaaagttacaccatacttgaacttcgcattcttttgcagctgacctaacattgctgagctttgcatgaaaatgccgaccttttgcgctaaaaatgctgcactttggttgttcgcagcggcagaaccagtgccaaagttttcaaacgcattttgcttaataacgtcttgcaaccaggtcatgctcttttgcatttcaggcgaattgagggttgctgcagtggccatggctttgcggccgttgtcatgattaacaaccaatgagttctgattagccaccatttcttctggcagccagccgtaaatttgcatcgtcatgcctttgacggcacctttactctttttggtcaaagcgacggctgccttagtaacgtcactgtatgttggtgacaacggtaaatctgcaacgccgtatttcttaaacaagctttcgttgtagtacatcaccgaacttgaagagttgaatggcatggaggcaagcttcccgttaattttataagcggcagttacgccaggatacagctgactcaagtcgtaatgatcacggtcgacaaatttttgaaccggcacggttgcgtttagaccaatcatcatggattggtttgcttgatcgctttgaactaaatcaggcgagacattgctgccaaccgtattcgcgtatttcataattgacagttcataactaccaacgtaaattggtttaatcgtatatttcgtctggcttttattaaattgattaaccaagttctccaatacctgttcatttgggccattcattgaatgccagaacgtaatagtcgtgcgaccagtgccattgtcagcagcctcagtatgttgttggtgcgtgaagaagaagccaaggcctaaaatgacgatcaacgcggcaacaattgcgatcatttttttgtatgtggttttcaccccttagtcccccctgcattcaaattccgcttgaagaatttctgaccaatcagtagcaatgccagcgttggcagcaacacaatgatggctgttgccataaccatgccccagttggcaaatgtatcttcagattgcaactgcttcaagcccacctgcacggggcggaaatcatcggagaaggtcgtaatcaacggccacagatactgattccaatgagtcagaaatgtgtacaaggcaaaggtgattaacatgctgcgactataaggcaccgcaattttccacagaaactgcaagcgaccaagcccgagatagttgccaaaatcgactagatcagccggaatctgaagaaaagcctggcgtagcatgaaaaccccgaacgcggaagtgaagaatggaatggttaggccagcataattgtccaaccagccaaatgccttaaccgtttgaaagtttggaataatttgcgcttcaaaaggcaacatcattgtgaccaaaaaggcgaagaacaattgctttttatagcggaagtttatgaacgcaaacgcataagctgctaatgtacacaacaccagttggccaatggtaatcagaccagcagtgacaaaggagttgatcatgtagcggataatcggcgtggtcacaaatgcttgccagtaattgttaagtgaaatgttggtcgacaggaagttgcctgccgcaatgtctttagttggcaacaaggaagcccatatacctaataaaatcgggaacaacaatgccactgcaaccacggttaataaaagataccgcgaaccatttttgatgtgggtcatgcgtaatacaccttccgttccgtgtaatgaaattgaatccaagttgctaaggcaatgatcaccgtcagcacaattgattcagcacttgcggtcccaaagttgtggaaggtaaacgcgtcttgatagatcttataagccaagaaattggtagcattgtttggcccgccgccagtaatcaaatctatctgcgcgaacattttgaacccgtcaataatttcaacaacaaacaggaagaataaagtcggtgaaatcatcggcaccgtgattttcaaggtctgtttgtattgcgaccaaccagcaatgtcggctacttcataatattccggtggcacgctttgaaaggcgctaagcaaaatcaggaaagcaaaccccaacgccatccaaacgctggccagcacgatgacaatcatggcgccagttgggtcaaccaataagttggcattcgtcatgcccattgctttcaaagcaaagctagcaagaccaacagacgggttaaaaagaaacagccagagaatggaagctgccgcagcactcgttcccatcgtgccggcaaaagctgtttggaaccaactgattcgccgtagcttcatggttgccaaccgtgccaagacaacgccagcaacaatcgtaatggcagcaaaggcaacaacatagactaaggtgcccgcgagactcttcaagaataagggatcttgaaaaatcgagaagtaattccccaaaccaacgaatttcgccgcttctccgcgaatattggtcgcaaagaaactattgtaaacggtcatgatcatcggatagaacgtgaataaggttaaaatcaataaagacggcattaaaaaccaaaaggccggtttattgttttctttgatcgtcgctgcaagtttacttttggattcagttgcggttttgttgagttctttgttaagctccatatttaaccgcctcccgtgctggcgcagcagcggtgattcgcaccccattgttgctgtcaaaaagatgccattcatcagcatttgccggcaacagtagattcaggtcggcgccaacagcgatagtaaattgctcgggtactcgactgactaatgtctgtccatcaaagtcacagaaaatcaaggtgtcattgccaagctgttgcaggcttttcacctttgccgtaattgtatctggattagcgatggacactggcaccaatttttctggccgaataccaaggtggtaagaaccagctggcaaatcaaatggtaggacaaacgcattatcagtccagaaggtgtcgccgatactgaagcgatcgccatcgtcattaatggtaattggcatgagattcatctcaggtgagccaataaacttcgcgacaaactcgtttgccggatgattgtaaagatctaggggtgtgccaagttgttgaattttttcatcgtccaatacgagaatccgatcacccatcgtcatggcttccacctgatcatgcgtcacgtagatcagtgtcatcccaatctcgcgatgaagtcgcgcaatctcttcacgcatttccgtacgcaactgcgcatccaagttggacagtggttcatccatcagcacgaccggcgccttggttgctaacgcgcgcgccaagctgacccgctgttgctggccgcctgacaactcttttggcttacgatcccgtaagtcgctgaggtgcaccagatccaatgcccaatcgactcgcttgcttttttcatcatcattcaggtcctgattttcaagcccgaacctgatattttgcgctacattcataaatggcaacaaagcataattctgaaagaccattgccaacttacgatcttttggcggcaagtccgtgacatcgcgatcgttaaaataaatacgtccgtctgttacgctggtcaaaccagcgatcattcgtaaaagcgtacttttgccggaaccagaaggcccgaccatgacgaaaaactcaccgggttcgatctctacggaaacatcggatagcaccttagtattgccaaaatctttggacacgttcgctaatcgaatactcacttctcctcaactccttaccttaatgctaaggttaacggtcatttgtaaaaaaccgcggcaagaggctgtattgtttctgtaagttttctgtaaagctagctatttatgccggaaaacagagatttttttcagaaatagtttaatttttgcgataaaaaaagagcacacctgcttcacaaccaccagttatcagcaagaatggtggttttggagcaggtgtgctttttaacgttcgttcattaactatcaagccacattaatttccatgatgaaccgcaatcaatttctgttgcatctcagccaacttcggcgtgagataaaccgggtaaaaatcaggattaacaagccgctgggtggcttctggcaaggccgctaaagtttcgcgggtatatttttggatcgcgaaaacatcagttggtacatcagcagtgtggccaggtgcgaacaccggttgcaacaatggcttggccgtgaaatcagcaagcgtgacccgtgtctgggttgccaaaggattagcattaacgacggcgattgtttccggtaaaatttcgtctgccaaagcaatgacatcagcaaaagcacgatgactgtcacggtggtataagcgataaacttgtttatggcctggcaatgtcgtcttttcgcgactagcgctgactttgatcttcggctgccattgaccatccgtttgcagagccgccattttgtagaccccactcaaaacaggcgacgaggcactagtgatcagcttttcgccaatgccgaagttgtcaatcggtgctccttcttttagcaacgattggatcacagtttcatctagggcatttgaagcggtgattttggcatcctgaaaacctgccgcatccagcatcactcgcgcttgtttagctaactgggtgatatcgcccgaatcaattcggatacccacaggctgatgccctgttgcacgcagctccttgaagatcgtgatcgcatttggcaccccggacttcagaacatcataagtatcgaccagcaaggcactattatctggatacaccttagcccatgcgcgaaaagccgtcagctcgtcactaaacgattcaacccaactgtgtgccattgtgcccgcagccggaatatggaatagctgggctgccaaaacattcgacgtgctggcacagccgccaatgacagctgcccgcgcgccatatactgaagcatctgggccttgtgcccggcgcgcgccaaactccatcacaggacgaccttctgccgccgcggtaatccgccgcgccttcgtggcaatcagtgactgatgattcaccaaatttagcaaaagcgtctccagcaattgcacctgcatcagtggcccttctacagtaagcagcggttcccgtggaaaaaccggcgtgccttctggtaaagcagtcaccctgcaagcaagtttcatcgtcgcaagctcatttagaaaagtctctgagtaaagattcaaggaacgcaagtagtcgatatcagcatcgtcaaaatgaaacgcctgcaaagcttccactacctgttgcagcccagcggcgatgacaaaactaccgtgatccggaaccgtgcgacaaaaaatatcaaaaacagcctgatctgtatgcggcaaggtcgcacaataaccgttggccattgaaaactcgtataaatcagttaacatggcatgattcatattcattttaataaaaccttcttttatgacgtctcaacactaatcgataacggttgctcccagcacatgggcaaaatgatcaagtgcccaatcttgcccagctggtgtcaatgcagcgactgccttctgatgaacaactatctggtaattcaggttgtaggcatccactgcagtatgcaacacacaaatatccgtgcaaacgccaactaaatgaacagtcgcaattttccgttcgcgcaggcgcaaatctaggggcgtcccggcaaaagcagaatatcgggtcttatcaaacatattgacatgatcttcggcttgatgcgcgtcgtaccaaggcgccagcgaaccataaaaagcacgtccccacgtaccgcgaacattatgcggcggaaacagtttgctttctggatgatagggatcatgcggcgtgtgaacatccgttggcaaatacacccagccatcttgctgtagaaattcatcggccaaagcaacaatttgtggtgctagcacttgaccagccttgccacaggtcaaggccccttcgtcagccacaaaatcattggtgtaatcaatgatcagcagcgcttcatttgtgtgtgccataattagtatcctttcttaataaaagtattttttacttaaacttgcattcgataaaagtagatccgacttttatttgctctctacgatacgcggtcacatcggatttttcaactctgccagcttgaaaagcttcggtggccggccactacgcgtgcgatcatgagcagtgccgacttcgataaacagctgttggtgggttttcttaaaattagaattatcaatcgcatttgcagtcgtcattaaaaatggtgcatacacttcgcgcgcctctttcaacgtaaacgtcgtccccaaaacttgaagaatcgtaggctgatagtctagtcggttacgaatacggcgaatggccaccgtcaaaatccgggcatgatcaaacgctagctcagatgtcgatgtgcctagcggaaaaatcgttcgcccattttgcagttgataccctgcttcatcagcagcactaaaagcaaaccagcgtgcatcggtagcaccgtaacccggttgcagcttcggcatcgttggcaagtaagtcatgtaagtcaacgccagtgcgcgctccccgggggtccgcgtcggatcggtaaatgtcgcaagttgctctgtcgatccacgattaacgtgaattccgatcttatcgcgaatcaatcgaatcgccgctgtgtctgcactttcccgttcacgcaaagtggtttccggcaatgcccagaaaccggcaaacggtgccccggcacgatgaatcaaaagcacctgcaactggtgggttgtcggcgaaaaactccaaataacgttcgtaatcgtgatcaaaggatgcgcaagaaattcgtcagccatgaaatcatactttctttataacaattgtgttcagttgtgattatagcaaaacagaggcgggaatgcggataagtaagaacgtgaatgtaatgagatacatatgaattatttcaaaaaaaatacctgctgtcattcaactgctgctcattacttgagtattcgaagaacaacgccagttattgatatgccgtcataagtttttaatttaatcatctcagtagcaatatatttatacttcatgaaaaataatctatgaaactataaatcacttgcaaataatcgctcatttatggttgagatagtgcattgaatgcggttacaattcctttgactggtaccaaccactaggcctatggcgggtgtcggtctatgaaaaagttttaggagggtttttcaatgcataatggctcaagcacccgtaagtatcgtgtgccacgctctttgttatacagcagcgcaatcctatcactaaccgcagcgacagtatatgctgccagtgcctttgatgtcgcggcagccaaacaacctgttcaagcaacaacaactagagcagccaaaagcatgctcaatatcgtgaacgtaagcaagcaagatcattattttgaagtgacctattcaaatgacctgaaggcgcgtctctttatcttggccgacaatcagttccgcttttacgttgacccttcagaaaaattcgcggcaccggcccaatcgggagaagggttgaatgccaagatttttaccaaatcaatcaatgcgtcttcggtaaaagactttgcgtctgctgccttgactagtactagtgacggctggtcgattaaaactggttcgctcgccattaatctaaacaagactgccgctaccttgcaagttaaacgcggcgcaaaggttattatggccgaaagtcagccacttagtatcacagcagacgatactacccaaacgcttaagcataacaacgatcaatacttcggcggcggtacgcaaaacggtaactttacgttaactggcgaaaagatcaaaattgtgaataccaacaattgggtagacggcggcgttgcatcgccaaatccgttctattggtcaacggctggttatggcgtcatccgcaacaccttcacgccagggacctatgactttgatgccgcaaataatggtgaaattaaaacgacgcatcaagaaaagcggttcgatgccgtctatttcttcgatgacaaaccgtacaacttgctaaaagactactacgatttaaccggtgcgccagcgatgatgccacggtatggcttctatgaggcccatctgaacgcttataatcgtgacacttgggttgaagttcctgaaggcaccagtggcggaatcagattcgaagacggcaaattttataaagaataccagccaggaaaagtacccgctggtcaaagcggcacaaaggaatcactgaatggcgaactgaacaactatcaattcagtgcccgtgcggtgattgatcgttacaaaaaaaacgatatgccactgggatggtttcttcctaatgacggttacggcgccggttatggtcaaactaatacgctggctggcaacctaaaaaacctcaaagattttgcggattatgccggtaaggaaggtatcgaagtcggtttatggacacagcaaaatctgtcgccagttgacccaaataaacctaagccagatgatcgcgatttttcaaaagaagtcgctaatggtgttaaagctttgaagaccgatgttgcttgggtcggtgacggttattcttttgggctggatgggcttgaaaaagccgacaacatgatgaaaaaagtcaaaggcgatgacttacggccttttggcatcacattagacggttgggctggcacacagcgttatgctggtatttggactggtgatcaaactggtggccagtgggaatacattcgtttccacattccaacctacatcggcaccggtttgtcgggccagccatacgttggttccgatatggacggcatctttggcggcggaaattcaattgtcaatgctcgtgactttcaatggaaggccttcacgccaattcaactcaacatggatggctggggcagtaatccaaaaaccccattttcttttgatcaacatacgactgatatcaaccgagcctataccaagcaaaagacgatgctcatgccatataactataccgcctctgcccaaagcgtttttgatggcaagccgatggttcgcggtttattccttgactacccaaatatgcctgaagcttacacggacttggttaagtacgaatacttatggggtgacaacttcttggttgcaccaatttaccaaaataccgcttcagacgatcaaggcaatgatgtccgcaatggcatctatttaccggacaaggatcaggtatggatcgactattacactggtaaggaataccgcggcggtcaggtcttgaacaattttgaagctcccttgtggaaactgcctgttttcgtaaaaaaaggtgctatcattccgactacaccggcacataacacgcctaaggaaatggatcaaaccaagcgacaattccaaattttcccaatggctggcaaacaagactttaccgtctatgaagatgacggtatctctcgaaaatatctaaagggtgcctacgcggaaaccaaagtgacaagcaacctgcaagagggtcagcttgaggtcaatgtggcgcccctgtcaggtgattacacaggtttgaaatccgaacgaacaaccgaatttgctattcgcacgagtggcaatcccagcaatgtcattgcaactgttggcagtcagcaagtcgctttaaaagcagtcaccaatcagaaagactatgatgccggcgaaaatgtttactttgtgaatagcgagtaccacaccaatcagtatctcgaaaagttgaccgacaagaaggctattgaccaaaccttcctccaagtcaaacttgccaaaacaaacgcggcaaccaatgggatcaagttaactgtctctggtattgatgctaaagatgatccgtcaaccgacgatctgccagtgaatgacgaattggcgatcccaagcacaatcaaacaagatgaaaagacgacaacagacaccgcggttggcatcaactggtcgcctgtaacagacgcattaagttacgacgtcaaagctgacggcgtggtttatcgcagtctcaaaaaaccagcattcgttttgtcaccggttaaagaacaaactaagcactcgttccaagtacgaacggtcacaaaggatgccgtgtcgaaatggagtgataaacaaacctttagctctgatgaaaatccgttgcgcttagcactgaaaatgaccaacttgaaagtcgattcaaccattaaggatgtcccagtatggcaaggcaaacaaacggtcgataaactttttgatcaagacttaaccaccgaagcccacaccaactggtttaccagcggcgagaagcagtcgacaacgccgatgacgattaccgctgacctagacggtgtctatgatctcgatcatctcacctacgtaccgcgagaaaatggcggcaatggtaatctatcagcattgaaagttgaaaccagtctcgatggtattcattggcatgaagctggtgaaggcaaagggtggacatttgatgctcaagaaaaaacaatttcttttggccaaaaggaaaaagcccagcacatacggctcaccatccctaaggcatcaacgctaggcgactttgtttcaggcaaagaatttctgctatttaagcgtgacggtaccaacaaacaagtattaggcgatattaccaacgatggcgcgattaccggtgatgatcagatgtcgctcgtgaactatgctggtttgacagctaatatcgacagtgacttcaatggttacgttcaaaatggcgatttaaaccaaaacggtgtgattgatgcatttgatatcaactatgtgatgaccaaactcggcaaaacaccagtatccaaaccagatgagaagattccaagcggcaccctagccttgcagtctgataaaaccacttatgcccctggcgaaaccatcacgctcaatttgattggcaaggatctgacaaacgttaatagcttattcgcccggttgccattaaccaacccaaatgttgatttaattcaggtcgaacccactgctgcaaccgcaggtatggtcaacttcagcaaagtccgcacgcattcgaatagcagtcgcgacctatatctcattttcgcaaatgaaggggaacaaaagcggctcactggcaatgaaaaactggcaacgatcacacttaaagcaaaaacacagttaacgaaagccgatctaagctttgctttgactgatccaatgcttaccaaccagtggggaccagaggctttgccggaagccccagcaccaattgtgctgcgtcctgaagacaattcagagcataatcatgctaaagagcagctagcggcattgattgatgctgtgcatgccctcgatccgaagctattcaccgccaccagttggcaacctgtccttgcagccagtgaaaaagccagccagttgctcaaagatgacgctgtgtccccatctgatcttacagctgcctacactgatctcaaaaccgcattgggcaaactggaagcagatcgcggtgtcaatcaagaccaactgaaagcactgatcacagcagctgcaacactaaaggcagaccgttacacgcccgaaagttatgccaacttgcaaaccgaaataaccgctgtaaagaccgttagcactgatgccggtgcctcacagaaacagattcaggaggccattcaatcacttagtcgtgcttggtttgcattagtcctcacgcagacacagccgcaatccgacttagcacagtgggtaagagttgcagaagccttaaatcctgaccaatacacgcctgccagctttgacaagttgaccgcagctctagcagaagcaaaaaaagcgcttgctgatacagcaacgtctgctgatacagctcaaaccttgtcaactcaactacaagccgccatcgatgctcttgtgccgcgcggaaataaacaacaactggccgatttgctaaacaccgccgagaaactaaaggcaaatgattatacccctggctcctttgcaaaattgacggaggttttacagccaacccgcaacgttttgaacgatgtcgatgcaactcaagatgcagtgacgaaggcaacagatgccttgagcaaagcgcttcagcaacttatcaagcagccgaacaaggctgaactcgtcaacgtgatcaccaaagcagcagaactaaaggagacagactatacacctgccagttttgctgatctaaaaaaggcattgacgtatgcccgagaagtgaacaaagatccagagacttctggggaaacagttgcaaaggcagtaactgacttaaagactgcgctcgacaaactggtcaaacaaacaccggctcccactcctgataaagaaaagccaagcaataactcgcctaaatcaggcggcttccaaggtgacaccacgattaaaaaggaccagacaaaagatccaatcaagaccgatcatgccagcaacatccccgatactggcgaacatacccaatcaatcctggcactactgggcgcgaccatcatcggcgtactgggttacttgaagctacgacaacctaaaaaagacaaatagctactccatgactcatctcagaaagtgaaacagcttcatgagattgggatagtcttcatagccacaaaaagaacgaatgagttttctcaaataggggaaacttattcgttctttcttatatataaatgaataggatttaaagattccagtaccaaggcggagcaatcgtaggcctgatggggctcagccgtgcaaacaacacagcgacgggccttggagctgatgttgttaggcgacttcgagaccgttttttgggctcgaagcgccgtctccgctctagcttcgcgtcgccaccccagctggccggagattgcggagtttggcacggcaaagaaaatcctgtctaacatcttttgtatcccgcgtaaaattgtccttccaaaatcattaacacctttataaatcactcaacctcacaaaaaccgatcccgtttctcctgaaaagcttgcacaataaggtgcccaacctgttgactaaattgcatagccgtctgccgatcataatcaaattgtgtcagcaccaccgcatacaagcgctcaccttcagcggcaaaacaggccgcatcatgttcgcaatgaggcaactcgccagttttgccggctagccaaccgacgaagttttccatggtcggcgctaacagcagcttggtgcggttttgctgatgccgcagggcttgggcacagatatccgctgccggttcgttgccgtccgacattaacaaagcgcgcaaaagttgccaggcagcgcttgcggtgatcatattatcgccatcaaaggttgattgcatcaagggtcgccgtagttggacgccaggataatgccgagttagccacgctgcaatggtcggcagcccatacgtggttaatagcgcattggtagccagattatccgataccgtgagcatcaacgtcagcaaatcacgcacgcgccaagcttgtggtgacatgaaacgtaaaatacctgccccgccgaccgattccggaagcgtcacttgccgctcgagttggctgggatcatctgccgctttttcctttacaaaggcggcaatgcccagtttgatcaaactagcagcgggaaatggttgatcaacctgcgcgccaaacagcacatgccgggtatcagcaaccaacaaggcgtgtttttcgtcaaagttctgattcacttgatcaagccgtgtcacgagtttatcaggcgtcatgcataggatctccaattgtaagctgtggtccgttcgtttgaatgcctgcttgctgctttttgaccatgtagaccgcgtccaaatctgtgaacgtaacattatcatgaaccgcggcaaacgcgatcgccggcaccagactcaggttactttcgatcatacacccaaccatggtcgtcacgccaaaagacgcgcaagctgcatcgatcttcgcagcctccgccaaaccgcctgttttcattagtttgatattgatgtgattgactgcgtggcgactgagtaatgccagcgcatcttgaaacccaaagacactctcatccgccatgattggtaactgtcgcatagcagtcaacgttgccaagccttcgtgattgcgcgcagcaactggctgttcaataaaatctatcggtaactgcaaagccgccagttctgtcaccgcaaccttggcttgatcagttgtccatgcttgattggcatcgagacgcaggcgaatatcagggcctgcagctttggcaatcgttttgacgcgctccaaatcatctgccaatcgaccaccaccgactttgatttttaaagccttaaagcctcgggaaacaaatgccttcgcttcgctcaccatatcgggcagcgcttgaatcccaatcgtcatgtcagtcgtgaccgttcgctgttgaccaccgagcaacgctgtcagcgggatgctaacctgctttgcacgcaaatcataaagtgccaattcaaccgctgcaatggcgggttgctccgatgtgctggcatgaagccgcgtcagcaaactattccagtctcgaatgtcacggccaatgagtgccggtatcacctgtgtctgcaagttttcctgcaaggtcgacatcgtatcacctgtcaccaccgcgttgggggtgccggcgccatgaccaactgtgccattggtcagcaaaacgtcaacttgaaccgcatccgctgccgtcacggtatgcatcgctgttgtgaaaggccgcaccagcggtaaactgatcggccgtaactgtattttttgaataattggttctaatccggccatgaagtcgccacctcgaaaaattgggttaataactggcgcctaaccgccaaccatgcacgattggcgcggctaggatagattcgattggtcaaacagacaaatccgcgctgggtatcacgatcaaatgctattgatgtccctgtaaacccagtgtgccagtattgatgacgtccttgcgcccaacagcgccagccgagtgtccgaccgcctttacaaaagcggtcaagcagcgcaaacgccgctggtggcagaacttgatcgccatttatcacgggcagaccagccaacaaccgtgtgaaaatagtcagatccgcaagcgtggcgaacaaccctgcatgaccactaaccccatctagtaaaaaggctttgtggtcgtgaactgtcccacgaatgatgccaccgcgagccggcacgttttcggttggcacaaaatcggctgcagccacatgttgcggttgataaccggtcgcatgcatgcccagtggtgcaaaaatatgttgcgtcaggcttgttgccaaatcaccatcgagtgcagcaatcgcccaaccgagtatgatgtagttcaaatccgaataaatcgtctcagtgtctggtgcagcgacagcagccattgttttgacggcatgaatcagccccacttgatcgagcgcatgggcatcagggacatctgctggcaagccactgcgatgcagcatgagttgttcaatcgtcagttgtgggtagcgcaaaccgctgaccaacgagccaatgggttgggttaattctaacttgccggctataagcaactgcagcagtcgggtggtcgtgccgacaacttttgtcaacgacgccagatcataccgcgcttgcggcaacaacggcagccggtcacccccggcaccttggtagccgatcacatgcaaggcattttcttgcgggccaagcagactatacgacacgccgaaaaccgcgccatcagttatcgcttggttaaccgttggcagcaaagctgtctgcttatttgtgcccatgcttggcctcccaagccgccaaaactgcactgataacaccatcatgatccgccaagacctgcgttgcatcggcggcatccagctcggttttagccatcacaattgcgactgggaccttatatcccgctgctttcagcaaggttgcagcttggatttgatcaacgccggttgtggccgcaataatgcgttctgcgcgatcaaccaacttggcattggttggcaaaacatcaaccattaagttttcaaaaaccttcccggcgcgaatcatgacccctgtcgacaacatattcagaaccatcttttgcgcagtcccagctttcatgcgtgttgatccggtaatcacttccgggccaacaactggggcaatggcgatatccgcatgttgtgccaagacactgtcagggacacaggccaccgaaatcgcaagcgctttggtttgttgcgcaaatgctaaagctccgatcgcatacggcgtccggccagatgcggcaatcccgataaccgtgtcattggcgttcaaattcagtcttttgagatcatgctcggctagctccgcagaatcttccgcgccttcaaccgacttgaacatggccgacatgccaccagcaattagcccgactgcccgctctggcggaataccataagttggtacgagttcagctgcatccaaaactcccaaacgaccagaggtgcccgccccggcataaatcaaccggccgccacgattatatcgttgcccagcagcatcgattgccgcggcaatgtggctattttctttggcgattgctggtgcaatttttgcatcttcagcattaatcaacgccaccaaatcaggcgttgtcattgtgtcgatgtgtgtgctggccggatttctttgctcggtcattaagtctgcgattgacatatttttcccctcgaatctttaactcacttgtcaattgtgacgttgcgcgataattctgctcagtttttttgatctcaccttgaacgaccccaagaaaaagaatgttcgcgacataagtctccgtgaacattgaggtcaccgcaccgattcgcaacaacggttctgtcggcggcaaggcaatcacgcaacttgccgcttcacgcaacggactcggctcgtgtcgtgtcactgcaattaccggcgtttggtttcgccgcgcttgctgagccgccaatacgacctctttagtcaaaccgctgtaggaaaaaacgaccatggcatcggccggtgtcgtataataagcgcgctccactgccgtgtgggtgtcgtggtcaaaaatggccacgtacccagcgcgaatcaatttcaaataaagatcctgagcaactagggcggaagcactgactcccaccagataaatatgacgtgcctgtcgcagcgttgtaatggctgactgcacggcagattgatccaactcatcaggcaaatcacgcactgcggcaatcgcagtctggcttaatttatgcatcatggtcgacaagtcgtcgtcatcctgaaccagcggatcaagtggcatcacctctgcaggtaacgtcttttcccgtgcgagagctagtttaaacgactgcaggtcggcaaactcaaattgacgaacaaaccgaatgacagatgcggccgataccccgcttgcgtgggcaatctgcgctgttgtctgtgcgataaaagtctcaggatcggttataacatgacgagccaaagcttgattcaccggacttaattgcgacagacgcgactgcaacgtctctaagattgtcttcattcggccttatcaataaaagttgcgatggacgttgcactttcgttgggaaccatttgcgcagtgatggtgactccctgtttcaataagcgccgaataatcgcaatatcgtctggtgatacggcaacggaaggcttgattttcttagtgcctggtttttccgacaagttgccaacgttaaaggccttgattggtacgccgccatcaatcaacttcgccatatcgggaatatttcgagtaatgacaaagacttgatcatctgcaaatttgccattctgcaaattctcgatggctttggcaacggagctaattgctagttttttccctgctggtcgggcgattttcaaaccttgaatcgccatctcatcgcgtaccacctcatcgttaaccaccattaagcggttagcgccgactgtgttcgtccagaccatcgctacttggccgtgaatcatccgttcgtcaacacgtgctgccacaattgtcattagaatcttcctttcaaacaacacgggccgatatcatcgcgcccgtgtttttcgcctatcatgattttaaactaaactaccgatccagccgaagatggcgcccagattgcccaacaccatcccgatcagaatcaggacaaaaattagtcgcgttgagttcatatgcttgcgacccagaatccagtatgagaacaaggcaattgctagtggaatcagtgctggcatgattttatcaagcatgtcttgcacattcatcgtgaccttgccgactttgtaggtcaggtcaagcttgtagttgataaccgccggaatcatcgcgccaacaaccgttaacccaaggatagaagcaccttccgtgaaagtcgccatgctatcagcaaaggttgttgccagccgagtcccttgtgacaagccaacttgaaacaatttccagcgaacccataaaatgaccaagcaaccaatgaccggaatgagtaacccgattggttgattcgacaaagccagatatgcggtgatcgaatagataatcgcattgtaaattgccacgaaaatcgtatcaccgacgccagcgaacggacccatcaagccagttttcagaccagtgatcgctttttcattctcatcgttcattcccaactgatcctgcaaagcaacatccgcgccgacaattaagtgtgccatttgcggcgtggtgttgaagaagcccatttccatgttcagggcttgtttcattttcttaggatcgtctttatacaaccgtttcaaagctggcatgacagagtaggcatagccaagaccttgcattttttcgtagttccatcccaattgcagacccaacacgttttgaatgaaaatctgcttgagatcttttttagttatcttatttaatttcagttcagacatcgatctcgacctcctcatcggaatcatcgccgccgttgctgccgccattgttatggttgcttgggccgtggttattcgattcgttgcgcttgcggtcgttggcatctaaaacatgtagtgccgcgaagacgaagccaaccagcgctgtgcccagcaaggagaatgttttcgtgaaataagccattaagacaaatccaagaatgaaatatggaaaatagcgtttgagtggcagataccgcatcaggatcgcgatccccatcgctggtaagataatcccggctgttttcaaaccaaccatcaaccatgctgggatccaagcgttgatcgctttaacaaccgcggaaccgaagaacaaaccaacgaaaaccggtagcattcgtgaaactgtccacggaataatcccgtaaaggttattgcgctcaacccctttatagtcgcctttttcagctaagcggtcagcgtgatgttggaaaatcgtgttcgtcatccgcgccaaaatatccatttgtgtcagcagtaagccgattggaatcgccaagccaattccataagccgcgccccgacctgacatgattgcaaaggcactgcccatgatggatccagaaagaaagtcaggaacggttgcaccgccatacgttgcaacccccaatgtggctaattgcagcgttgcgccgacaatcaagccggttttgagatcacccataactagaccagttaccgccccgccaaacactggcgagaataatccgatcttaacagacaatgcatcaagttgtgcaatgcccacatagatcgtcaagaaaataagtgcaaaagcagatattgacatgatctttcccctccctaataggatgtcatgaatcaagtcaattatgccgccatatgaaactgtatttcaagtatttgagtaagaataattgacattgaaattcagtttcttaaaaaacagcgtcaatacgggtgtaccatttttgacgcaaaagctggcgtcacatgagaaacaccagttattctctgtgctacaacagacgcttcaataagcttgttccttcaaaattattttttgaatttaattcttataatgatgccgattagtccactttgcgcagtttggcgacaagagtccgagacataattctcagtcggcaaaataaaagcgaacaattttccacttaaaggaaatttgttcgcttttgcttgctcatggattatttattgcgattttaaagatcgtagtgccaaggcggagcaatcgtaggtcagatggggctcagccgtgcaaacaacacagtgaccgggcttggcgctgatgttgttaggcgacttcgagaccgcgggctttgcgggctcgaagcgccgtcacagcgttccagccccagctggccggagattgcggagtttggcacggcaagaaagttttagcctagcatcttcctgcgattattcggaatttagtgaatcacaagtccgatgtgagaattatggttcacccccagtgaagtctgttattgcagttggaactttaacactaccggattgtgatcggaatattgaaaacccgtagaaacgacatgcacactttcagctttaatattaggcgaaagaatatagccatcgattaacgtcacaaaacttttacccggttgatacggttgatccaaggctcgaactgacggcacggcagccttggccaagcccatggtcgggatatgaaaacctgcagggagtttggacttcgggaaaagatgggtccacgtttcatcaagatcttttgtgtggaagatttcagcggtattttttaacaagcgatgattgtagtcgccagcaaccatcacataattaccttgctgatacgcttgttcgatatatttaaacaacttggtgaactgtgcctgctgaatcttgacgttcggtgtgaatgctgacatatgaatgttgaccatgacgaattgtttaccattcgccaccgtggttttggttgccgtaaaagctcggtccagatcaatgattttgttaaaatcattgtccactggcaaactgtagcgccgggagctatcgaccttggctttacttaacgttataataccggacttcgctttgccgatcggttgggtgaacgggtagaacaagtaagccgaatcataattctgaccatatacattggcgtattgttgctgcgccccagtgaccatcttcacttcattcacatgttgtgatcgatcaccatccggatcaatttcctgatagaaagcaacatcaggattttgcgcctgcgtggttttgatcacaccattaatgctggtacgcacggactttttactgtaggctcgcgaatatttgccgccatccatgaaaaaactataacttggcgggtaggaaccatacccgatattgtaagtcatcgccgtataagtctggcccggtttaaactgcgtactttgttggttcttcacttttagcgcctgatcatcaggcacgcgataataagtggtgaataaataaatcaaatatccgccggcggccaacaacaagacaccgagaatgccgccaacccatttcaaaattcgtttcaccgtcgttcctcccaaaatagttgttttgcttattatagcagttgtcttttcctctgagaccagtactatgaggatagacttttttataaaaaggggatcgccatgtcgactgaaactgacagcattttagctgctttcgaaaaattcaacaccattattatccatcgtcatattaatcctgaccctgatgcgattggctcacaaaccggattggccttgctgctgcgtgccgcttatcctgccaaaaccatctacacagcgggaccggccgcccccgatttagcttggatcggaacgcaacaacaagtgtccgctgaagcttacactggtgcgctcgtcgttgtgattgatacttctaatcgcgaacgcattgccggtgatcattttgatcagggagcgatgctgatcaaaattgaccatcatctggatgaagatcagcttggcaccatcaactgggttgacacccatgcttccagtgcatcagagatggtgtgggacttagtacgtcacagcccacagctgcaactcaccaaagcagccgccacagcactctacgcaggcattattggtgacactggccgttttctgtatgatttaacaaccgcccgcacccaccaagctgctgctgacctacttgcaaccggcatcgatgccgccgcaataggccgtcaagaagaccagttcccggaaaatgttggccgcttgattggttgggccttagaaaatgtcaaaatcactgacactggcgccggatcactcctcatcacaaaggccctgctcgcccaatttggccttgcgtatggcgaagaacagcgcgcagtcggcaatatcggcaagctagccagcattgatcgctgggtggtcttcaccgaacgaactgatggcagctatcgggttgaactccgcggcaaaaccaaagaaatcaatacgctggccgttcaacacggtggtggctgccatcctctggcaagcggcgccgtggcagataatgctgctgaacttcatgctattgaagaggaactagcatcgttataaggtatcatgaagaatggtaatggcccggacgaatgatctaaaccccaaagccagagcgttgcctcatttctaatggatagctgttgtgataaagactggtagacttggttttcaaaaaatacggtaaaatattagaatcgaggaaaagttgacacgtactttggcctgtcaaatcttgtcaacctctatatttatgatatgctgatagcactttcaagaaatctttcatggttatatcaaaatagccgtttcccctgctagggaaacggctatttttcaccactgcgataagtcgtaggcggtatgcgcgtgggttataaccaaatgaacagttcttcgaacgtgaggactgtcttcatttcagtctaagacttttgattgtttgcttccgaatgagtacgagaagttagtctaacggattcctgccagacgaaacctcgcaatctcccttataatcaactttttctctcgaatctcttcgcaaaaggaagcatgtacttaccagcaagatcacgattcgcaattgcttgccaccaacttttagggacagcatcctgatcagccgcagctagcaaagacgcagtaatagtcgcgactgtatccgtatcctcgccaagactgactgcagtcatcatgccatttttgaaatcaggtgcgttgcctgccacccaaatggcagcttccaaggtatcaacaacatacccgcttgacttgatggccgacctcggaaggctgataaagtcacgcgcaaacaatcgccgataaactggtagttccgcttgttcggccgccggtaaggcttcaatcgaaaaattaacggccattaacgcctgtgctagggttttaccatgtaacagttgccacaaagtttccagataaatgatgcttccgagcactgcccggggatggcgatgcgtcatctgggtgtaagcccgataacttttcgctcgcgtgacaaaccgcgattcagtatacaaggcaattgccaaaggtgctaacctcattaatgcaccgttgccattcgcaaattcagatggatccccacacatgatcggggcggcacgctcaatgacatatttacgaatcgcttttgcacacgtattgccaatgtcgaacaactttccgttcggtgtataggcaccatcttccatataggccacaaatctgtccatcagatctgtataagaatcaccttcatttagatgatcaatcagtgcaagtgtgaaagacgtatcatccgaccaggtgccagccgcctgctcccaaaaaccgccgccgatcatcataggttcaacgatataagtgtctcggtgtttaaattcataaggaacgccaaaagcatcaccgacaatcgcagcctgaagcattcgcaaaatccggtctggcatcatccttttcacctccaattcatgtgttaagtctatcacgtcattgcgatcattttagctcattcgccgctcgtcactttaatcccaatgatcccaatcacaagcagtgcaatgaagaaccaagtcgctggttgcagttgatctttaaacaagaccacaccaacaataatcgatccgacagcgccgatcccggtccaaaccgggtatgccaagcttaatggcagatgtttaacagcaagggccaagaaccaaaagcttaaaaccatcccggccaaagttgctaacgtaaatcccaaacgactaaaaccatgcgacattttcataaaagttgcccaaacgacttcaaatccacctgctaaaactaaatagaaccactgcatgaatgtgtcctcctcgtatcattttgcagcctcaaaacaaaaaggcgacagtatacgcaaccgctgcattgacctaatgcggttgcgatactgtcacccggtagtgactgctatttaaataaatgttgatgttattttttcacatattgacaacggcgtcaaggaaattgctaaaagttccgcgcaatgacccacaaaatgatgagttgcgcaaatgcgaacgaccaagtaaaagccagcgcccatttgctatgttcaacaaccatgagatgcccggcaagattgccaatcaccaccaatgccattacaagccacaacaacgctcttgtacgatggtcgattggtccctttgaagtgcgcatgatccagaaaataatcattgatgtgattgaaacacccaaaagaaccccgatgatgtgtaccataacgctaccccatttcgagcgcataccttagttattttgcaaaacattctatccgtatttcttaaccatatcatgtctccacttgatccaaggcaccattttaaacagctttgccaatcatcagctctgtccatcccagcacaaaacccgctctaatcgcaacattcattgattgcacatgggagaattgggtcccataaagtggcaagacatcttggcgtcgaagctggatttcagcggttagttgctgtactaaccggctggcaatgccttggtgacggaaggcagggtcaagcagctcaacgccgatctcccaacagtacctgccattttgactggcgcctgctacggccacgaggtctccgtctagttcgtagccaatcccaaggcgatccggtgccgccggatcataaccaaacgccattttgatcgcatgattggcttggtatttcggaatcgcatccgcttcaatcaaatgcatgcccgcggttaattggcgacttagctggttactcggcacgaagaaaggtgccatattggtcacttttaacccaaaattccgaagcaattcggtgagttgctctacggttttcatttcaaggaaccacgccccgtctgcctgtccaaaagcatctgctaaggcagctgtgacctctggcttcgttgtgcgcacccatagtcgtcctttgcgaatgacaatgtcaccaacatcacgcgcccaactgcgggcagtcggcacaggcggtctagtcacgaaaagatttcctgtattttgcagccgcgatgctggcacttgcaaatccagtgctaattgtttcgtgataagtgacatctcatcctccagatttaaaatgttgggcgttacttttcaagggtcttgcttaaccatgacacgttcgcgaatcgtcccaaacttggtcgtatcttccataatctgatctgtcacgctaaagccaaaatgctgatagaatttctgcgcagatacattattatccaaaacacgaatataaaactggtcaaatttctcatgcaggcgttgtaatgcccgcgtcatcatgacaccaccaacacctgtatgttgaaactgcggcagcacataaattgaataaagctcaccccagccgttaaaatccggcaaccgcgctggaccaaagctgcaaacaccaacaattttatctttgtcatcaactgctaacagcgtgtcttgccagcgccgttccgggtgccaactggccggtgagaggtgcgccaaaaagtcatctgatatgagtccgtggtatgcgtcctgccacgtcacgtagtaaacctgccgaatagcatcaaaatcagagctagctgtggcttcaataaccttcactttagcagtcattctcttcgcctcatttaccgttaccttgctgagccaaaatccaagtcgcagcatccgccaaactggcacattcaacaaacgaacccgccacctcttgataacctgcatctccacgccctgttgcgacatgaatccccaagatgccagcattaatggcacattgcatatcagccagataactatcaccaacgatcacagcatcacgattcgcaaaacgatagcgaagatgtgcttgtgcaatcagaccggtcttaggttttcgacatggacatccagcgttctcagcatgtggacaaataaaggcatcagaacatcccatttcaagtaacgagatgcgcaacgcggcttcgtccaactgcccagcagcaatttttgtctgattcgtcagcgcaaaaacttgcaacccagccattcgcaaagatcggatggccgccacactgccgggataaggttcgaattgctgaatcgccgtaaaatgaccgtctccgcctatggtgccatcgcgatcaatgaaaactgtcttgatgaccaagtgtgaggctcctttcagtcgtatcaaacaactaattccattgaattgctttcattatatgtcagtgatgcgtttccaaccatccgaacatttccgtagatcaatatcatccccacatggttcatggcgtgtttttttaagcgacaccttgataattgactttaaaatgcaagtgctctatattccttgttattggttcaaaaaaataaaccattagtcgaggaatatatcatgaccaaaaccatgcaggctgcgcttatcacgcattataaacaggctgtgcctgaaattcaaaatgtccctttacccactgtgcgaccaaatgatgttttggtgcgcattgtggcagcaagcattaatccaattgatctcaaaacgaaagacggcaagctgcgactactattaaaataccagatgccattgattcttggcagcgatttttcaggtatcgtcacaaaagtcggaaccaacgtgactcgttttaaagtcggcgatgccgtttttggccgaccacaaaaagaccggatcggaacatttgcagattttcttgcgattgatcaacacgatattgctttgaaacccagtcggctgacatttgaagaagctgccgccttaccccttgtcagtctcaccagttatcaagcgctacacgacttgatgcacttgacaccaggtcaaaaaattctgattcaagcaggtgcaggtggtgtcggcactgtggccatccaacttgctaaagcccttggtgcagaggtcgccaccaccacaagtagtcagaatatcgcttttgttaaatcactaggcgccgatcacgtcattgattatcaccgtgagccatttcaggatgttctgtcagactatgacggcgtttttgacacactcggcggcaccagtcttgcgaatgcgttccaaatcgtcaaacccggcggcatgattgtcagcgtctccggcatccctgatgaaaagtttagcgatgcttataacgtccctatttggaaaaaagtagcctttcgcttggcaaatcaccgtatcagcaagctcgctcggaaaaccggcgtcacctatcgtttcctcttcatgcatcccagcggttcagaactggaaaaaataggcgaactcgtcgaaaatgacaaacttcgccctattgttgatcgcgttctcccatttgctcagcttcctgaggcatttgcctattcacaggctggtcacgccaaaggaaaaatcattttaaagctggtcgataaccctagctcacttttgcaggtataaatcgcgaaattgcgcaatctcacctgctgatagcttaagtccttcgcgcaagtattgctgaaatgacccaaattgctgatcaattacttgaaaataacgcctcagataatccgcatcaactttcagggcttctccgattgattttaactgttgatcagtaaaaccccgttctttgagtccagcaagaatctcttcattggcgactgtgcgctcagcattggtctgaagataatcggccatgatgtcttgctcgctcacgtccagtattttcaaaatcaatgcggcgccaacgccagtgcggtctttgcctgcaaaacaatggaaaatggtgggttcgtttgggcgcaacaaaccttgaataaactggcgatacccagtcttggccgaatcactcagcgctaactgctcataagtcgtcagcatattttcgtgaacattgcccttctcggtaatcatgcgcccaaggctggcattattggcggtcgcatccttgagaatgtccaacacggcatagtccgccccttcccacaccgtgtccggaaattccgtccgctcgtcgtcactgcgcatatccacaatgtgcttaattcctagcgtctgaccaaggtactggctttgatcatcctctaattcaaaaagttgtccagaacggaaaatcaatccatccttcaccatttgaccgtgggcgttctggtacccgcctagtgaccggaaatttgtaatctttttcaacgtcacgatgccccttcctgttgatgcgacgaagacgatgatgccgtttgctgatgtggaaatttttctagccgataaagctgttcttcgtccaccgtttcgtgaccttttttaaaggtataacccatgtgtcggtaaaaatttacagcagtgattgacgccggaatctcaacacgctccgcctgtcgaaaatagacatcatgctccaacgtgtgaatgataagctctcctattccgcgtttttgatacgttggcaacacaaaaatatcaaaaagactatattcagttgtactgccccagtacgacccaatcgcaccagtaccaacgatgcgattaccgtcatgaacaatataaaaatgagtctgctcggctttgtctaagaaaaattgcggcgacattcgcttaatcgtagcttcaagataagctgatgaataatcttggctattggaaatgtttaatgtggtggcaacaacttgcgcgacttctgctgcatccgctggtcgaaatcggcgaatttgaatcataactgatcacctcacgaaacaattttggctttatcaagttgtgactaatttatcacacttattcatccattagggaaatatcgttatgtttcaccgtggttgttgccagaccagcacgtcttctaattgtccagttgtctcatcccgatcttgctttaaaagcgtaaagccatgtcgacggtagaaacgagctgcgcctatgttcttctgataaaccgctaacgtcagcttaggataggtctgttgcagtttggccatcaacgctgcccccacgcctcttccgcgggcctgctcatcaacaaagaaaccagcaatgtagttatcttgcaggccacaaaaagcaatgatgtcatgatcacgctgatcctgaacaagccaaagtgtggccttgctaatctgatcacgcaccagcggcacatttccagtccaatagtccgctgggataaaatcatgggcctgcaaattaccttgtagccagatcgccataattcgatcaagttgcgggggtgttggctgggttactagttgaatcgtataagttgtcatcttaacctctgaattcactgttttcatgtgaaactttagctgcatcgtaacttcaagccatcagtgccgcttttaaccaattgctgtcacattcgcaccttttttcccattaagcagttgcgaaaagatgtcgtaccgatgaaggcgcggtgttctcgaatcgtactgtagcccatcgccttaaaaaacggctgagcggtgatcgaaacataagctgtatactgcgatgacacgactcgttgctcaagtgccgccactagtcgtttgccgaccccttcacgctgatgcgtcgcactgacgtaaagccgatccaagtagccatcagacgccatgtcagcaaacccaatgattatctcggcttcatccactgcaaccaacgccacgtgttttatgaagctggcatgccaggctgcaagcgatcgctcatggccagcccaaacggcaatctgatcagcggtatagtctttcgcgttgattttttgaacggtgtctctaaaaagcgccaaggtaggtgcagcgtcacttggctggtaggatctgattatcaacaaacgactcctttttgataggcactttggagcggtgtggcggctggcaagccgattgcctgcttagcttgggcgaaaaatgtttctggtgtcatgctcaaaaccccgtttcttcttgtcaatatcaaatccagctgattggcttactcggctgtcaactaaaaaccagtcaatgatcctcattgttgtccctatttatggtatggactgccaatattaatcataaaggcccgataaatctgttccatcaagactaagcgcatcaattggtgcggcatggtcaacttgccaaaactcaaagtatcattggcacgtttcatgactgcaggcgacaagcccagcgacccaccgatcacgaaagtaatgtcggaatgcccataggttccaagatcggcgatttctttcgcgaaaacttcggatggccgctgcttgccttcaatcgccaaagcaataacccattccttatccttaattttgcctaagatgcggtcgccttctttagctttcacatcagccatctcagcctcggagagattctctggggctttttcatcggcaacttcaacgatcttaaccttagcgaacttatccatgcgctttaggtattcagcaatgccgtcgcgaaaatacttttcctttaatttacctacgccaatgatcttaatgttcatgttggtatgatctcccatagtctcgttgtttgaccgattttttctgtttcaagtataccagacgttctgggtcgaccagcaatgcatccaacaacaaactggttgggatcgttgagagctgatgtagggacgcccaacaaaaacaaaacggctaagccgctcgcgtgtagtcgcttcaaaacgcgttcgcaggcccagaaacctgcacataagggcctcccaaagcccagccatttaggcttgaggccgcttatgctccggtttctaaccgggcctgttcacgctctgcctgtttgcctattgtcaacgttcggattatggcgcaaaatagtctggttgaggtttttttaatgaggtaaattgatgattgttattcagcgtctgatcaaagatcgggtcctgcagatcaccgccttgttggtcgtcataagtctgttcattggccggccaaaagcaagcgacataagttttgccacattatggtcaattctcgccatgatgacggtgattcaaatcttcgagcacctacatattcttgattactgggcctatcgactgacttcccgggcgaaaaacacgcgacagttaacgtggtggtttctttttcttgcgatttttgccagcatgtttctttcaaatgacgtgaccgtcttgaccttggtgccgctctatctgcgggttgccaagaagtatcagttacccgagattctcccggtaaccttgattggcatggccgccaactttggaagcgccttcacaccatttggcaatacccacaatatctttctgatgcaccaatttcaaattgacttgcgccagttcttcggctggtcaattccgttacttgccgttagctttttagtgttagtattgctaagccttttcttgcgtaatgtgcctgtcccgaatgtcccagctgagcacatccatattcaaatgcggccgaccatgtttgccattgccgttgcgtgtgtcgtcttcgctggggtcattggtcttgttcctgcttggttaggggctgttttggcgattgccttatccttagcactggaccctaaagatatgcgagacgttgattacgcggtggtcttaacgtttgctggctttttcattattgtcagcgtcgttggccagattccatgggtaatacacttccttgctggtttagaaaactcagaggaatctgtttatcttagtggtgttttcaccagtcaggttatttccaacgtcccgtctacagtgctgctggcacgctttacaggttatgtcgaggctttattttatggatcgaacatcggcggtgttgggacactcgttggttcaatggctaacttacttgtcttcaagcaatacatgatttatggtaaccggccccatactcgtttttttgtcggctttacgatttttaacttaattggtttgattttgttgggttgtgccggttactggttgacggttcgttaagcagcaataacctacctcgaaaaagtcagccaattcgacatgcttcgttaaaatcaggtcatgacagtagtcaaatattacataacatcggtaatgtatgcgttttcattgcttttctccggcaacgtgctagaattaggatttgctaaaaggaacagcgacattcgaagcgaaccaccgcgacaggctatttatggacctgtcgcactttgtttgtacatcagttgagctgttctataatgcgtctgccaatgaagcaagctgtctatctgcctcctgatgtgatgatcaattttaatcatcacatcaggaggtgttggcaccttgtctgctaaagatattggttgacgctcgctcttaggaggaagtatttatgaagcgcaggacgttgttttcgatcatcgtcatcacgctgaccgcaggattttttaccttgttttacggtatgcatagtacttggacagatacccggtcagcgcaggccgttcaagccgctaccgaccaagtcaatgatttgttcaaggatcaatcgcatcaattaccttcagaccagctaaataagcaggctatagcagctgccgagaccaaattacaacaggctcgtcagaaggccaatgatgcagaccacgctgccgcacttgccagcgcacaagccgatgttgatgccgctaaacatatgctgattgttaaagatgctgtcactcaaaattcaacaaaactggatgagctaaaaacgttgtcagatgagtcgcagcaagcattaaccgagcttgccaaacagaaaccgacatttgtccaaacctatcaggaacgggtggcacaactgtctgatcaagaagcggctgtcgcgaaaatcgccagtctttttagtgataccgattttaaaacgcctaagccaaatctgaattcggcgcaagtacaggccgcattaactgctgttgaaaatttggacaataaacaattcgccgcccaagtcatgccgctgatcagtactgctcaaaatgccacttccagcgatgacagtcgtgaccccgaaccgtcagcatcatcagcgctgcctagttcggccgacagcagcccgtcaaccgttgccagcagcagtgatcaagccagttcagcaaatgctagcggcagtgaatcggagcaaagtcaggcatctagctcaacctcgacagcaacttcttcatctagccagaatccgtaattttttggatcactaaccgatactcaggcacgcgttgcctgtcaaaaaaatgacgataccgcacacatgcaaacttgtgcggatcgtcactttttattggccaccgctaaaagtcagtgccaattaatttgctgttttcgtcttggccaattgcggcactaactgggtcaaatagtcgataaagcccaagtaatcagcaatgaccacattttcgttgggaccatgggcggcagaatgggcattgccaatgccgcatgaaataatcggtgcgtgattgatatcataaaagtacttcatcggtccgctgcctggagagttcagctcaacttgaacatcatcatccccataagtcgtacgcgccagttgcaaagccgtctgaacacgtggatcgtcaggatcggttctaaatggcggctcgcctaggaagtcagacaccatcacatcgtcataaccgccagccgtcaacgcttctttgactagccggacggtctctgccggtgtctgatctggcaccaagcgcagatcaagcttcgccagcgcggtgtgcggcaaaatggtcttgccaatgccgggaccctcatagccgctggataacctgttgatggtcatacttggccgattataaagggccgccttaatgtcatcggctggcaccgttgccgggcgggtaatgccgtagttcttagcaaacgctgcatagtcaaaggcggcgtcttgaattaacagcttttgagtagctgtcagcggcttgacgacatcaagaaaatgcggaatcgtaatctcattctttgcatttttcaatgttgctagagcctgaaccaaccgccatgccggattttctgtgatcgcccctaaactggaatgaagatcaaaatctgccgttttaacgctcagctgaaacgcgacgccacctttcacacccagcgagatttgaaacttgccttgctcatttcgaccgccagattcccataggcagaagtcagcggctaacagatcagcatattgcgctaacaggtagtctagattcggactgccttgttcttctgccccttcaaccaagaacttaatggtacaaggaagactgccttgcgcttgcaggcgctgaagtgctgccaagcgtgccgccagttcgcctttatcatcatttattccccgggcatacagatgagtgtcggtcattttcaactgaaatggatcactttgccataaggctagcggttcagctggttgaacatcgtaatgattgtagaacaagattgtgggggcatctgctgtctgcgccggaaaaaccgcgtacacagctgggttggtgcggtctgtgtgcaagatgcggcttgttgttgcgcccagcttggtaaactgggttcgtagaaattcggcggtttctggaatttcattttcctctgctaaagagacggaatgaaactgtaaatacttcgttagaaaatcctgcatgggtattgtcatttttcgacctgctttcttttgtcactatttgaagtaagcgtgccggtattccgccggttgtaacatgctgtagtgaagcccgccaaccttagtattgatcagccgactattagcactttggaaaacgggaatgtaccccgcaacatcaataacccgcgcattagcggccaattcttcctgataacgtgccttcgcgctttggccattggtgttatttactttagccatcaaggcagtgaactggctatcactgaacttagaaaagtttgaaatgttagtggctgtggcggtattgagatagtcggatgggtcttgaatcgttgagttccagctcatcagtacggcatcaaacttaccatcaagtgagcgttgaattcgggtcatttttggcaagctgctgacggtaacttttaactgcggtagaaccttggtgagctgactttggatgtactcgccgacttgtttatcggtgtcaacatctgaggtcataatcgcaaaactgatgctgtcggtatgcaattctttcaaggccgctttgagataagccttggctttggttggtgaataagtcagtggtgtgtcagcatctgcggtgaaatctttgccagttgatggattcgtggctaagccttgcggaacaaaggccttagcaggtttggagccatcctgcaacactttagttgtcatggcttgacgatctaacgccgcagagacagctcgccgcaaattaacattgttgagctgtgggttcttggtattgaattgcagataattcatgttggccgccactgttttggtcaacgcaggatttttggcttctttttggattaagttgcccgacaacggtgcatcatcgagcttgcccgttgcaaaaaggttatcgatcgtgctggaatccttcaaaaccgtcacatgaactttagcgattttgacagcctttttggcaaaatattcgggatctttcacatagtcccagctatcactcgtggtattaaagtttttaattttatatgcgccattggtcacgattttgtccgcgctcgttccgaattgcttgccataccgtttcacagcggcttcattagtcggataatagccagtcatctgactagcaaaatagggggttggctggctgagctgaattttgagtacatatttgcttggtgccgaaacacctaatgtatcaggggatttcttgccagcaacaatgtcctgatagttagcaatcgcatcgtattgatatgcaaattcggttttcgtcttaggatcaacgatgcgcttcaaggagtaaacaaaatctttggctgttaccggggtaccatcactccacttcacatctttgcgcagtgtcaatgtatatgtttttccgccatcagttggtttgacaacctttgtcgccatcgccggaatgatcttcccgtccttatcatggtcgtaaagcggcgtcataatttgttccaaaataccgccgctggttgcatcaacggcatgcgccggatcaagtgaactggcctctgtgctgacggcaacgtttagcgtacgctgggtcgttgcagccttggcttgctgtccgcatgcagcaagtagtgcggtgatcccgaataagcctaaacccaagaaaacatgctttttcatttttgtgcacctcgtttggttgatttgtgtcgcgtgctgccatcaagcatgttttgcttgatggactagcttccataacgcgcttgccagcccagaaaccgggctgactcgcgctcacaaaaaaagccgtccataacaaacatcttgttaaggacggtttcccgcggtgccaccttagtttgatcaaagagactgcgcctgtgtgatggtagcatctggcagtgtttgatcacgcttagcccggggccaacaccccggcgacaactgacgtatgtcaacacgtttccccgtactcgaaaaactttcgggggaaccctcagtggtccatttactgacctgcgttcggccggactcgcagcatcgccggctctctgtgcgtgcacaatcagcttgatctccacttcaaaggtttgcatgaacggttatttgattgactcaaacactaaccgaatacctgcatggttgtcaagcatcccacgattaaataacaggaaatgcttcgcgaagctcataaaataacggctttctatttcctcaaaaagtgtagccatgctgatccagcaaattttggcatcaagagcattcagttcggattatcaggaaaaaaactaaacagtatgaaaaaaggtgcaagttcattctcatttttgaatgaacttgcacctttttagtaaaccccttatattacaaatacattaatgtgtaacaaaaagaagttgtttcgtgacctgtttgcaatggtcttgttaagtccggcccgtaccattaggatattggaggtgccatcaatgaagcgaaaacatattttccaaatcttgatcgtaaccctgcttgcaggttacttaaccgttttttacgggatgcggaatacgatcgatacctcatttgaacaacacgccgtccaagcggcaacgcaacaaatcagccaactatactcgtcatccaagcgaactttccctgcgaaacacttatcacgatccatggtgaccgcagctcaggccaaggtcaaccaattagttcataacgtggaaaatcgcgatcaaaagaaaattgtcgccaaggacaaacgggatgctgacgctgccagtaacatgctaacgattcaagaggcaactaacgcccagagtagtaatctggcgcagatcgaatcggaaggtacccgggccagtgcagcctataaggccattgtcgcaatcaaaccggcatttgcagctgactatcagcaagctgtgacacaactttacaagaaatctttagcgattacgcagatcaaaaaactttataacgaccagaatttacagcacccaaaggccgatctgagcagcagtaacattgacctagccatcaacgccattgaaaatgtcgaaaatcaggactttgccaaaaacgtgttgccattggtccaagtagcgaagaaatcacaagctaacaatgatacggccgtggcaatggaatcgacagacacatcttcaaccaagcaaaccgcaactactggtcggcaaaatcagcaagacactggtgaaccagctagcggcgtgtctgggaatcacgcgacaactgcaggtcaagcttctgatcaaacaagtcaaccgagccagaaagctccgagtcaaccgactacttcaccgagtgggacaagttcaagcaccgacaataacgctggtgcaagtgcttcctcgtcaatatcagcttcggccaacaaagcagagcccatgacggccgttttgagcggcggtttgtataaaacctatgacgatgcagttgcatccatcaaaatccaaggcaaagccgttgatgacatgaagatcaggtctgtcacaatgagcgacggttcctttcagtggacttggggaccaaacggcgacagtggtagcagtagttcaaaaccaagttcctctgcgccatcttcttccaatcccacaggacaagatgcaaacaaaaacagtcaaccgcagcattagacctttgctactttcgaaaatcgctgataatggcctcttctcccaccatcatcagcgtttcgctacgttatcatatgattcaaacaacttttaagtctcacaaaagacccgcatcagttcgacagctacgtcgaattgatgcgggtctttgggttttctactagttgatctgctgaatctgttcacgttcagcagttgcccggacaggatccacaagtgcctgccgatgcaagccattgcgcgctcgcagagcatagagaatcgtcacggtatcgacaacttcttgcagcattgcgccaataattgttggaatgacaccgaagctggcgattaacatcaaacctgtacaaatcgcaatgccgatgaggaccgcttgcttggcaatgaccatggtttccttagcaattaaagtggccgcagcaactttcgccaaatcgtcgcgcagaaccacggcatcagccgattcgcttgccgcggttgccccatgtgcacccattgcaatgccgacatcagcaatcgccaatgaaggtgcatcattgacaccatcaccaaccatcacaactggccggccatccttagggacgttatccaaaacttcaatcttctgttgtggcaattgttccgcatagacttggtcaatgccgacctgtgctgccactttatcagcgattgactgctgatcgccagaaatcataatcagcttagcatcatttaattcgtgcagtttcgtcatcgtttcttttgcttctggacgaatctgatcggaaaatgtaatcgcacccgcatactggccatcaacattcacatacacagcggtcgtatcaaccgtagccttcgtcccagcaaactcggctttaccgaccttgactttgcggccatccaccgttgcattaacgccaaagctagtggtttccgacacatctgtcgcaggcagtcggtcagctgtcggcacagcatccgtcagtgaacgcgccaaaatatgagtcgattgaccttccgcacttgcggctagcttcaaaatctgatcctgtgagaaaccggcttgtggcaaaatcgttgcaacttttaaaatacctcgtgtcacggtgccggttttatcaaaggcaaaggttttagcatcacttaacttttctagcgtagtccctgacttgacaatgatcccgttgcggctattacgactcatgccggagaccatcgcaattggcgcggccagaatcagcggacaaggcgaggccacaaccaatacctgtgcaaagcgaactgggtcgccagagaagaaccagctaagacccgcaatcacataagcaatcaacgtaaacggtaccgcataacgatcagccatccgaacaaaatgtgctggccgcgcttcggattccttaaccagtttaataatcccttgatactgactatcttcagcccgttgcgtgaccttaacagttagggcagcgtcaccattgacggtcccagacataatgtcactacctgcgtttttggcaaccggtttagattcacccgttaaactggcttcatccaccaaactctcacctgccaaaaccgtaccatcaactggcacgacttcctgcggcttaaccaaaatcgtttcgccaacttggacggcctcaacttcaacatcttcaacgtgtccatcaaccatacgatgcgcggttgtcggtgcattttcgagtaattgctttaattcactgcttgcttttgttgctgcgtagctttcaagcgcatcgccaccagtcagcatcaataacacgatcatcgcagcccaatactggccaaccgccaaggtggcaacaaccgccgtaatggcaagcaagtcaacgccgaagttaccagaacgaattgtcttcaccatgccccagaacataattaaagcaatgattgaccccatcaccgtgatcagcccttgcgcgatcaatggttgctttaaaccgaaagcaaagactagcgcaatggcacttacagcaagcaccatcattaattgccagttctttttcatcactgccactccctttttctaagtaccccaattataaccattacaatctgaaagcacaaccttttttagaacgaatataatctgtcccacttagatgctcgacattcatggtttctattaattgagtcatggctaaactcttctaccgaaaattaactcaagtgtccatcatccccaaccagtacgcttaaaccggcaatgattgaccccgttaattttatggctccctaatattcacttcatattatacgcttttcatatgataaggctcacataacttgcttttttaacaaaataaaagaccgcaccattaaaatcggtacggtctctcgtatataaatgaagctaggcaaataattcgtagatcaatcaatgttgatctgatgattgcccttttggtcgcttgtcatttttggcagatcgatcgtcaggacaccatcattgaccttggcgctgatctgaccttcattgacatttggcagccgataactacgactcatgcggccatagctacgttctgacattaacatgttaccgtcgttgtcagcatgatcagcctgctcctcatgtttaacggcaatgctgagcacatcacgatcgtaactcagactgatattttgcttctcaatgccaggcacatcaactttcacaacatacgcctgatcgttttcctgaatatcagtctttagaacccgactgcgatcaacatttgctggtgtcaagctgtcaaaaagatgacgacccaaatcgttaaagaaaggatcgctcagccaatcattacgacgcatcaaatcattagccatattcgaatacttcctttcatatcgaaggcatttcatgtcttccctacaacacctttagtataccacaagaattagcactcgcaaacgtcgagtgctaattttgtggtcctattcaatgactggttgatgcaaaaagtgacttaatagcccagagctaccttagcaaattttgccgcccagttttgtcatgtcatcccgacgttgtgcatcattttgtggtaaggcggcgtccttattcaaggtcacagccccatcaagaatgccgctgtcatcacgcagagccaacgatgcgtttttgaaatcaagtgtcagaccactgccgaaataatccgtttctgggtcacccgttgtcagtttgaaaccagcttcgttgtccagtggcagcgcataatcttgatcatcctcatcggcaaccactaactgatatttatttccaatggcacaagaaccgccaagtttggaatatttgcttgagccgtcatccagtgccaagaataaccgttgatcctgattgacatgatccttcaagtaagtgactgctgctggtttgattgagatttgcatccgaaccatcctctctattgagttgtgcacaaccttttaccgtctttatcgtactcacatttccaaatgaagtcaaattccgagtttttcgcaacgaccaacaggttatccacacgtcttatccacatgttcataacttcatacgccaaatatagtattaagtattcgaattgacaccaaataggcgatttaaaaaattcaagcaaaaaatttttaaaaagaagtcatccacagtttttgatcgttcgatttcacaaacttcagctcacgcatcccgttccagccgctgggaacaaacgttttgtcacaagttaaaaaagtttatccacaggttatccccaagtcagtgaataacttagtcacaccccagaatcttagttatgaacagtatccacagagttatccacaggtaaagcatcaattttagataaaagttacccactcttgacaaatctttttcttgaacttttccacaggttggccccttgaattttcggataaaagctcaaaactgcagagaaaccgcttgccactaacttcgcaagtgcatcaaaaaatcctcgagccagaaacgaacattttctgactcaaggattatctatttgtgtgatttagttcttaaggtcgcttgtcgtttgcgacagcttcacagagactgtctgctgttctccggcacgatacaaagttaatttaatcgtgtcgccaaccttgtgtttgtatagctgtgtatgcaaggctgctgtgtttgaggtgcttaccccatcaagggccgtgatcacatcatactgcttcaaaccagcagatttagcactgctaccactggtaaagccagcaaccacaacaccatccgtcacactagcaggcaacttcagaaccgatttctgctgtgttgcagaaacagtggataagtcacgaacttcgatgccaagcgctggtcgaaccactttcccgttggcaacgagttgattgatgattgaaacgacttcatcacttggaattgcgaagcccatgccttcaatggtggcattactgccagagttgccggataatttcatagagttaataccgacgacttgccctgaaagattaatcagcggcccaccggaattcccagaattaatcgctgcatccgtttgaataactgttgcctgtccggttgtgttgccactatcatccgtgacatccactgttcgactcttcgcactgacaatcccttgcgtcacacttgtcgcgtactgggaccccagcggtgaaccaattgctaagacagtctgtccagtcgcgatcttgctagaatctccgaaactggccacggtattgaccttgctaccatcgatggtcagcactgccaagtcagacgtcgaatccgtgccaacaagactggccgttagtttcgtgccatcactcaaaatgacttccaacttatctgaaccactaacaacatggttattcgtcacgatataagccttgccatctttcttctgataaatgacacccgatccttcgcttgcctcttgaagactggacgaactgctttgcgaactactactgctttgactgtcttgtccaaaaataccttcgagaccgccaaatgtgtctaggccgtcactgttgctctcggctttttgcatattcacaacggaaacgacagcgcctttaaccttcgcaaaggcttgttccgatgcactgctttcattaacagaaacgttggaaatcttggtcgtaccggctttccctgacgtatcggttacaccgagactttgactgtggttgattgccaaataggcagtcccgccgccaacaccgccacctatcaaggctgccacaacagcaacaatcgcaatctgcttccagccactattcttaggcttttttggtgcccgctgtggctgttgctcgttttgtggtgtctcttgaaagttatgacttccattatccataacggaattcctcctttaaacgcgctcgtttgcccagaaactgactcataagacctagccgtttggctgaggccgctgatacattggtttttacctggactagttcgcgctctatgggcagttctaactcgccctgattacatttataattgtaaggggcgattttgacgaaattatgaacaacctcgggattttttaatacagtctcagacccgcggtatcgcgatattagttcgtggggttgcttattttttgcaccatcaataaaaaatgaaaggcagtgaatatgcgaccggatttttggtcgggatattcactgccttgggtagcgttggatgacggaaaatgcataagatgccaccgctgttgctgtggaaacgcgctcgcaatggccaaagcccagccatcacgcctgaggccacttacattccggttcctaagcgctcctgctcgcgctttgctttataccacaaacagcggatctgcaactgcaggatcggtgtcatagatacgaaagtcgtgatcgacggctaggccttgttgagctagtagtgaagccacggttaggtgtgcgagtggtttattattgttgtgcggagaaaggtgtcctaaataaatgcgcttggttcgcagcccgataacatccatcaaggcatcagcgccgtcctcattggaaagatggccttggtcgcctaaaatacgctgttttagtggccatggataaggccccgttcgtaacatctcaagatcatggttacattccatgacataggcatctgcatcacgaatggtgcctgcaacacggtcagaaacataccctgtatccgttagaatcgtgaaggttttcccgtcatgatggaactgatagaactgcggcgccgcagcatcgtgtgaaacgccgaaactctcaacatccaaatcacctaatgtcaacgttgcgcccatgtcaaaaagccgcaattggtcttctggaattttgccaacacttttgggcagtgccgcaaaggtttttgcattcgcatacacactcagtttcggataccgtcgtgctaaaacaccgacaccacggacatgatcactgtgttcatgggtgatgaagacactatcgacatctgtcaggtcgcgcccgatgctttgcatcagcgtctcgatctttttgccggacaagccggcgtcgaccagcaccttatgacccggcgtttcaatataggttgcgttgcctgaactgctgctggcaaggacactgacacgcatcccaaaatcttcgcccacgatcaacatctcccatcttctaccatttaactgatgaacaaattgatcatccagttgttatttcattacattctaacactaattgtcattacgattcttcataacggttcgggtaatggcatttacgcgtttaaccgtcacattgccggttgcacggtttttaacaccgatataccacgctggcacgtaaaccgtgctcccctttgcatctaacaagtaactataggccaatttagtagatacaatcgcggaattgttcggaatatcgttatctcgatacaacgtaatcaccgcatcctgttcactcattaaatttaagcggtcgcgcaaaacacttaactttgcaaggtaagtttggctataactgaccaaccgatcgtcaactacatgcaaggtcactgcagcccgccgatcatagatcaagccagccttggggtgctgagcaaagacaacacgttcatcactggaaagcgccggcgcatattcgtattcgctgccatggtaaatactgtctttcacaaatgtcgtcagttggcgtatttgctgactctttttcaaagtgatcggcgtgtctaagcttgcctgcaactcttggtaatcaccttcactgatgctgacctgttgcttcaccaacttgctgtgcgcagcacttaacgctgtgttcgcctgacttgcaagataatcgccttctggtgtttgcttgctcaaatgcggcagcttaatctggtcacgcgtaatgtcggtgatcgtggcggcatctccacttttggttgttgccaaatcgacctgctgcgcctgaaaaaagctaatgcctaagaaaatattcagaccgacaaacacgactagaaaaatccattcaatgcgtcgaaaatccacaagatcgcctccctcagcgtgcccgaagctgcgttgttacgctgttaacatgacttattgcgactgacttgaacctgatgtgctgacactcgcgcttgctgcatcattactcggtgtagccgtgctggcagctgtttgttcactagcagcattagcctgctgatctgtttggtgattgatccaactctgataatcgcggtattcgcctttcatctcaatataatacgtcggctgcaaatcgaccacttgttgatcattgctgctgcccgtccattgatagccaatcaaaatatccgtaatttgattggcgcgatagccagcggcttctaattgactcaggatcgtcgcagttgctggcaaggtctgggcagcttgatcggttgggatcgggacggtcaaattggtgtttgagaaattaatctcttcagatgtctgggtatagcgcaccgtaacatcccctttttgatagccattaaaaatcggaaagccctgaacaaaggtcttatagataacagcactgcgacttgcgtcatattgaaaataacgcatgctggccagattggtcatctgcaaatcactaagcccttcaaacgtcgcatggaagaaattagctaacccagtactaggaaaattggccgcataattttcaaactcgattgccccagtggatgaatcagctgtcatccgccgagttgatccggcggtgtataacgtactatcgccaatttctcgtgaatccacgttgctggcggttttcgatggcattaacagcgaaacatagtaattagcactctgttgatccatcagataggcatatggctgcaacttaattggacgggtgaagaaagcgacttcgctattgcccaagcgtctctcctcgaccggaaaggcccctgtagcttgtttagccaccgcatcgcgtaacttgttggttgtaacgttagccattttggcctcgtaaaccgttcttgtcgcgtcattgataaaaatcagtttattgcctgatccatctaaatcaaacaggatccggttaaaatgaaaatcagctgattttagattaggctgcttgttaaagaaccatcgttcaaaatgattaaaactcatcacgtcttggtaaactaattgcagactgccattttgagtcaaaaagttctcatagttattctgcgaaacttttccaatggttttgatctgttgcatatgccaactcgccatctcttgatggacacgcgatcccatactggcatttgcctgaaagagcatttgcttctggtcgccatgcgtgtagtacacgcgactaggaagataaaccgttgcttccatctttttaacattgggatcattttcagttgtgacctgcatgcttgaagtgctgcgccgttcctgacgcgatggattacgccaaattaaggatgtgaaaataaaactcaagatcaccatggcgatcaggctgattcttaagatccaattactaagcttcatcccaatcatcacctccgtctgtgatcggttcatacggcagtgagatatagaaggtgctgccgcggccttcttgcgaatcgacccaaattcggccatgcaaggcttcaacaacttccttcgagattgccaatcctaagccggtaccgccttgcttgcgtgatcgtgccttgtcgacccgatagaagcgatcgaaaattttacccagatcttgacgtggaatgccaaggccttgatcactaatcgataggatcacgtggtcatgcgtctggaacagccgcgccgtgatggtcccgccatccggactgtatttaatcgcgttgttcataatattatcaatcacttgcataaatttatcggtatcaatttcgacccataagtcctgatcagtaatctcgcgcttaatcgagtaccgtttcttttgaccatctggctgtggcagcggttgggccgttttggcttcacccgtgtgttcattatcggtttttaacatcatgtcaaaacgatcaagcacataattgaagaattcgttgagattaacggtttccaaattgaacttgctggtgccggaatcaagtcgtgacaagctcaagagatcattaatcatccgaatcatccgatccgtttcttcttgggtcacgttgagaaaacgtggcgccagctttggatctttccacgcaccatcactcaaagcttcaatgtaactgcgaactgatgtgaggggcgtccgcaattcatgtgacacattggaaacaaattctttgcgatcacgatcaatcttttgttgttcggtaacatcgtgcaaaacagcgaccaaaccggaaataaacccggtttcccgctggatcagactaaaatcgacacgtagaatcaattcatgatccagttgctccgaaaagtccaacaacagttctgtttgatgttccagcagatcgcgcaacgtataatccttagcgatgttcaacagctttagaattgaaacaccgatgacatcttcattcttggtgttcaggaaattcagtgccgtctggttgatgatgataacattcccacgccgatcagtcgcgataacaccgtccgtcatgtgagccagcacactatccaaccgccgacgttccgcttcagacgcctcttgtgcttcttcaacgcgaacactgaggttgttaacggcaactgccaactgacccagctcgtcttgtccataaatccgaacctgtccagaataatcgccgcgcgccatgcgaatcgcttgcttcttcatttcatcaattggacgagtaatagcccggctgatgacaatcgatagtaaagtgcccagtaagccagctactaaacttgagattaggaaaatgcccacgattttattgatgctatcgtaggcctgttccatagatgccgaaatggcaatggcgccgatcactgaattgttgtcgcctgtcgcattcggatttttgatcgggatcactttataataagttgatcccgttcgatcacggtattcataaccttcgtattgctggccagaatacaatgtgtttttaatgctggagttagctgatttttgccccacattggtttgcgcattaatatcactgtcgccgcgaatagtgcccttcgcatcaaccacttgtaaatccgccgagttggcaatatctgcctggctcaacgtgcttttaatatcatcattggcgccttctgtatcagtccgcaacaaatccgcggccagcttatcttgaatatagctgtccacgttcacactggtcttaaactgctcaatgttttgctgctcaagggtcttaacaaagtaagccccaattaactccaacgtcacgactagcaagagaataaagacgatcgcaattttgaagtggattgactgaaagaagcgaatctttttattcaacagtggtgctcctaattattcagcatcgggattccgcagatagtaaccgacaccgcgtcgagtcaccagccattcagggtgagacgggttgtcttcgattttttcacgcagacggcggacggtcacatcgacggtgcggacatcaccaaagtaatcgtagccccaaacggtttgcagcagatgctcacgggtcatgacctgcccaaggtgtcgggcaaggtagtgcagcagctcaaattcacggtgggttaattcgatgttttcaccgcgtttagagactgtataggcatcggggtgaatcgttagatctccgacttctaattccttgtttgcttcgtcttcttcattgctggctgcgttggatgatgcggttcggcgcaagttagctttgacacgtgccaccagttcacgattggaaaatggtttggtgacgtaatcgtcagcaccgagttccagcccgagcactttatcaatttctgagtccttagctgtcagcataataattggggtgtcatgttctttacgaatttgtcgggcgacttcaagcccatcaatttttggtaacatcagatcaagtaaaattaagtcgggtgactctgcttcgacttttttcaaggcttcttcgccatcataagcggttacgacatcgtaaccttctttatccaaattaaacttgacgatatcagagataggcttctcatcgtcaacgaccaggatttttttcgccatcattggccctccttggtttaagatacactactatagtataacggttttagggaaagagcgcgaggggcccagtttgaaaccgaagcataagcggccttaagcctaaatggcaggacttagttcatttaagcttgaggttcttatatgcaggtttctgggaccgcgagcgcattttctacaagcacgttaggtcgcacttcgatagattccggcttgcattaaatgctgctgcaagctggctccgcggcgattgggctggaacgcactgggcacgacttttagccaacgcgcaagcccggcgcgccgtctaaaagctcggccttttcctaaagcgggaaaaccacccgcttaaggaaaatttcagtgctgagcccatcgccgctccgccagcttgcctttctatccaatgtcccaatatcacatcatttcaaatcagtgctgttaattcataagcaagcttgaaagggtcagttaataaacacttcgctattcacctcgtcttcacactaaacgcgcatcgctattccggtgcttgccgacatttaatcacccaattatgaattttggaggctgctaatatgttcttttatcatgatcagctcaggctttactatcaacggcgcggttcgggaccagtgatcgtgttgttgcatgggaatggtgaggaccatacgatttttgctaacctgattgagcaattggcaccgctgtatacggtgattgcagtggatagtcgcgatcatggtcagagttcgcggacgaatcgcttgagttatgatgcgatgacggcagatttagcggccctgatcactggcttggagcttgagcagccgattttacttggcttttctgatggcgcgattgtggcattgcagttggcgattcgtcaaccccagttagccggcgctttaattcttgctggggcgaatctgaccccgcaaggcttacgctggtattcgcgagttgcttttcgggttgctgctggttaccatccatcacctaaaatggcgatgatgctccatgaaccgcaaatcacaccggccatgttgcatcgggtagccataccaacattggtccttgcaggcagtcgtgacttgattgcacgaaaagaaacgctcaccattgcgactaatattcaaaacgccgagctgcatattcttcccggtgaaaatcacaattcgtacatcaaagacaacgcgaaactctggcaattgattcggccttttcttgctggtttaaacagaacagactaaagtttagtctgtattttttttgcatatttaacattttacttgcatattcatataaatgagtatatattcaatccataatcacaaatgaggagtgaaacatatgcggggaatcaaacattgggccatggccttcattgcgctggtggctatgctcgtcggcttcgctgcaaatcagccggtaccaacggcggcagcaagcgaggatctgacggcaattcaaaaacgtggttacttggttgttggtctgtcagccgattacgcaccacttgagttccatgccaccctcaatggggccgataccattgttggtgcagatatctccatgtcaaaacagatcgccaaagacatgggcgtgaaactgcagatcaaggaaatgaacttcaccgccttaattggtgccttgaaaaccggcaaaattgatttgatcgtctccggtatgtcaaaaacccctgaacgtgaaaaagaagtcaatttttcaacgccttacctatatgagacacaggttatggtgattcggaaggctgataaagccaagtataaatcgatcgctgatttttccggcaaaaaggtcggggctcaaaagcaaacgacgcaggagcagcttgctaaaacgcaactcccaggtgccaaaatttcaagtctcgacaaggccaatgatgtcattgctcaagtctcctataacaagctggatggtgccgttttagccagcaccatcgctgattcttatgtggcgcggacaccaagcttaatggtactcaatccgcattttgctacccccaaagcaccaacggccattgccgtcagcaaacaaaattcagccctgctcgctcaggtcaacaagacaatcagtaaggtcaaaggcgccaaatacaagacctatctgcaagccgcttataaactacaggatcaaaaccaaagtttctgggctaaatatggcaactacttccttcgtggcgcactctacactctgatctttgcggttctaactgttttcttcgggactgtgattggcacgctgctcgccttgatgaaactaagccacagttggtttgccaaggcaatcgcgaacgtctacatcgaattcattcgcggtaccccattactggtgcaggctttcatcgtcttcttcggaacgcaaattctcggtctcgatcttagcgcattcgttgccggtgccatcgccatggccatcaactcaggcgcttatgttgccgaaatcattcgtggcgggatcaactccgtcccgatcggtcaaaccgaggccgctcgttcactcggactccatcaaggtcaggccatgcgttatgtcatcctgccgcaagcaacaaagaatatttggccagcgttgggtaatgaattcgtcaccgatatcaaggaaagttccgtcttgtccgtgatcggtgccactgaattgatgtttgaaggaaccgtcgttcaaggtgcttcattcaaaccattcttaccgctagtcgttgtggcaattctctacttcatcatgaccttcaccctttcacgcctgctgcgactgattgaaaaacgctttaattaagatcaaagtaacgctcaaatagcacctcaaaactaaggaggatttttaactcatgacagaaaaaatcgtactggcatattcaggcggcttggacacttcggttgccatcccgtggttaaaagacaaaggctatgaagtgattgcggtggtattaaatgtcggccagccaaacgccgactttgacgccattcagcaaaaagcactgaacgtcggtgcactcgattcgattgtggttgacgcccaagatgaatttgccgatcactatgttgccccggtcattaaagctaatgccttgtacgaaggcgactatccgctggtttccgccttatctcggccattgatcattgaacatctggtgaaaattgcccacgcgcaaaatgccacagcgattgcccatggttcaaccggtaaaggcaatgaccaagttcgctttgaagccgcgatccacgccttggacccggaaatgaaaatcgaagccccgatccgtgattttcactggtcccgtgaggaagaaattgattacgccaaggagcataacgtcccggtaccaattggtaaaaaatctccttattccattgatgccaacctctggggccgtgcaaatgaagccggcattcttgaaaatccttggaatcaggcaccagatgatgcttggggaatgaccgtttcgcctgaagccgctcctgatgacccaactttcattgatctcaccttcaagcaaggcgttccggtggcgttaaatgatgaacccatggcactggcaacgatgatcaaggggctaaacaagctggctggcgacaatggcattggccggattgataaaatcgaaaatcggctagttggcatcaagtcgcgtgaagtctatgaagcaccagccgctgctgtcattatggcagcccaccacgatctagaaaacctgacgcttgaacgtgacgttcagcattttaaaccaaccatcgaagataaaatcaccaacatgatctatgaagcgcagtggatctcaccgttgtttgatgccttgatggcgttcatcgacaagactcaggctgtcgttaatggcacagtgaaaatgaagctttacaaaggcaacgccacagccgttgctcgcaaatccgcccacaactcgctttatgatgaagatctcgcgacttacacgagcgctgattccttcgatcaagaagcagcagctggctttatcaaactctggaccttgccgacaaccgttttcgagcaagtcaaccatgtgcactccgaggaaaaacaacatgactgataagttatggggcggtcggtttaccgaaaaagcggcacactgggttgatgcttttggagcctccatcggttttgatcagcaaatggcccaagaagatttggaggggtcgcttgcacatgtcaagatgctgggcaaaaccggcatcatcccccaagccgatgccgacacgatcacggcgggtttgcagcatctgcagaaggaattggctgctggcaaactgcacttcacggttgaaaatgaggatatccatcttaatatggaagccctgttgaccgctgaaatcggccccgttgctggcaaactgcacactgcccgctcgcgcaatgatcaagtcgcaaccgatctgcacctctggctgaaacatcgcctaccaacaatcaaagaagctttgaccaacctgcaaaccgtgttggttggtcaagccaaggtccacgcagcaacaatcatgcccggttatacccatatgcaacacgcccagccgatcacttatggtcattatttgttggcgtatttcgaaatgttccagcgcgattgggaacgttttgactttacccaaaagcacaccgacattttgccattaggggcagccgccctcgctggtacgaccttcccgattgaccggacgctggttgctcaagagctgggatttgaccaaatttatcacaacagcctcgatgctgtctcagaccgcgactttgcgcttgagtttctcagcaatagtgccattttgatgcagcacttgagtcgcatggcagaagagctcattctttggtccacttacgagtttaattacattgaactcggcgatgatttttcaaccggtagctcaattatgccgcaaaaaaagaatcctgattttgcggaacttattcgtggcaaaactggccgtgtttatggcgccttaatgggcttgttgacaacgatgaaggcaatcccgttggcttacaacaaagatatgcaagaagataaagaacccattttcgatgcttataacactattcttggctctttgcacattttcactggcatgttaagcgacctgaccgttcacgaaaaacggatggcagaggcaaccacgcatgacttcagcaatgcaacggagttagcggattacctcgcgacaaagggtgtgccattccggcaggcacatgccattgttggtgagttggtactcaaggggatcaaaaccaacactgccttgcaggaaatgccgttaagcgagttgcaagcagccgcaccgcaaattcagcaggatgtttacgctgaattaacgtcaaaggccgccgtagatcgacggacttcgttaggtggtactgcggttagcaatgtgttgaaagaagttgctcgcgatgaggaaatgattgcttctcactagcggtacgtgatcaccttggcattcacgaaataattgaggttggaatatcgttttacaggcactaaaagacgactggtttccctactacgtggagaaatcagtcgtctttagttttttgataaatagctcgtaggaagtcaaagatcccagtgacaaggcggcgcaatcgtaggccagatggggctcagttgcgcaaacaacacagcgaccgggctttgtcgctgatgttgttaggcgacttcgagaccggtctttgggctcgaagtgccatcaccgctctagctatgcgtcgccaccccatctggccggagattgcggagtttggcacggcaaagaatctttagcctaacctattaagcattcgttttttcaagaacaaatgttgaccacgggcgaataagatccagaaagcctagatcatcatcactgacttggccaattttattgcgctgaccgtcatcggcaaatggcgttagcacaatttgaagctcgcctttgtaacggccataagcatcattcacaacaaggatatcgccgcgttcaaaggactggtgattgtcatgcggcgcaatgctttctttgccatacttcacccgcggttgtgtatcgcgcagtaagtaggctgaggcatcgccacggtagagatgcggcgcttcaaaggcaatcttcgcctcaattggcaacatccccggcagcatatcagcatgcaaaatcggatatggtgccacgaagttagcagccacctgttgcaactcagcttcactagcaaaggcattgccgatgatgacatcatcaatcaaaccggtcatgactaagtggctggtttggctggcgatgcttcgatggcgatcgctttccattgttggcagaccatcattgaccgcccatggaccgatcttgccggttggcgaagagacaaacgccgctgtgtgcagcccataatcacgatattgctgagagtactcagcaaaaatctgatcacttaatcccgtaaaggcttgtggataaaagttatgacagccgagcaggttgtcacggtccggttcataggccatgatactagccaaataattggttccgcgactcatattcagctcaatcttcagcccgtatggattacgcgtcatgcgcgcttcttcagcaccggtgaaaccttcatctagtcgcagtccccaaacattgagctttttgaaaaagctcagatcgtcatagctgatctttagctctttgaacaaggccggattgatatcgacaatcgtttggaagcccagtcgattagcataatcaatggtttggctgaaagcagcgaacagatcctctccgtcacccccatacatctgcaataacgaggtgaagatgcgggtataaccatattgatgcgccatttcgagataggccttgttctgatcaaaactgctttgatccggatagagcgatattcctagtcgtttcattgaaaatcctttctaagccgtgtattgtgccgccatctggcgagacatctttttgaaccggtgcttacgctgccagttgagtaaaaagccggctgtgcgattgttagctttgcctttcgcggttttgccttcaatcgtttccgtgtaatgtaaagccgttttgttgtcaccagcgtcgcttagctgatagtcaaccgtatagtggtcacgatcagtatccagttcgtaagcataacgttggttggcaatggcatgggttatcgtgagtgtcccagtcatgccattagcccatttcttcttgtaagagaaaccattgagactgccagttaacacctcgcggccggtatgggccttgatgtcttcctgcgcggatcgaatgagttggccatacataaatgctgcaggcaccttaaatgtcatttggatttccaagtgaaagccacctttctaaaaacgttgttcagcccaaaaccagcgtgatgggatgttagtcgagttcagtcggtttgatcttattggctgccttaacaaatggcacatagatcaggaaaccgatcaccatgttgattaattgtagcacggcagcacgccagtccatcgttgcaaccaaggcgttcaagaacggtggcattgaccaaacaatctggtttttaactggcccaacaagaccgttcacaacggcaccataagcaatggaaaccatgacaaccggtgccaaaacaaacgggatgaagtaaatcggatcaagcacaattggcatcccaaacatgactggttcgttaacgttgaagaagcccggtgcaatcgataatttagcaaccgcccgctgatcatcacgttttgagaagatcagaattgcaatcaacaaaagcaaggttgagcccgcgccaccgatccaagcgtacagatcaaaagagttacgcgtccaaaggtatggcagtgcctgacctttttggaaagcattgatgttcgctaactgcgcagtcaaccagatgccgtccaaaatcggtgccaaaacattggtgccatgaattccgaagaaccagaaaacctgtaccaaaatcgtcatcagcagaacggccccataaccttgactcagattcaacaatggatcttgtaagactctggcaataaattcaataaccgtcgtgccatattgggtgaataggtagttaatgataccgactgcgtatagcgcaacagcagcagggacaatcccagtaaacgcattagcaactgctggcggtaccgaatcaggcattttgatggtgatgtgtttcttcatcagccagatatagatggtagcagcaatggcccccatcagcatgacggtgaagaaaccatatgcgccaaagaacttaccaaaattgaagaagccccacatgctgacatccttgccggtaactgctgccccagcatcggtcagtgacttgatcgctgctttacccaagccggttttaaccgtcatggtgaagttttgcggcaagctcatgatgaaggtaccaagcgtcacgatccccgccgtgactggttcgaccttatactgaactgccagttggtacccaaaagtgaacgagaagatcaggcctaaaattgccaatgtccctgtccagacaacggcgttaataccgatcagccattgcatggaattaacaaagcccgtccagccaaactggttcgggatatcacgaatcaaagcgttcagcaccgtcgagacagcaccagccatcatggctggcatgatggcaataaaagcatcacgcaacgcaaccagccaacgaattgagccaattctggcagcgattgggacaacatgtttattgagccaattaataagtccgttcatttttataacactcctttttaagtgggcgcgagcaggcacggcgtgaaatcaagacgtagctagctttgacggtcatgatctgcttttgatcattgtttttaagctgacagcgtcagattccggcaactgcaaacgcgcgagctattaatttgaactgaggtccccgcctcattggtccaaatcaatgttggtcgtgtggtaatacagtgtgagacctggataaacaaaataagttcgagaaaagttgaagactttgccgctggctagatagttaatcccatccagacataaaagatcgccttttccggatgtggtcatcaggtcagcatattcagctggcagcggccgagactgaatataattttcggttgtgcttccaaccatgtcataggtgttgcgcaaataggtaaagattgaccccgcagcaatttctgccgagagatgcggcacaatgatttgtggaaagtatgattcttccaagtcgtacaactgcccttttaaatagcgcagacgcacaacctgataaaccggatcgccaactgctacgttgccgcggcgggccaatgccgcagttgctggtatcaaagcaaatttgacgactttcgatttaagcggaccgcctttgaccatcgcggtttgatcaaacccgattgacatattcaagacggcgcttgattgttccgaatgatcaatgacgtagtagccactgccctgcactctgcgcacgagtccgtgggcaaaaatgacatccagcgccttacgtatagtgttgcggctggcttgatagcgattcatcagcacttgctcggtcggcaacttcactggatacttaccagccagaatatcttgaatcaattgctctgcaatatcgtgatacatttatgaccccctccaaaggtgtggttttgaaaacgcttgtaaaatttgtacctacgaattataatagcacaagaaacagaaaacgattacatttttttaaaaaggagccgaaaaaaatggcagagaaaaagattatgttggtctgcgccgctggtatgtcaacaagtatgctggttgcacgcatgcaaaaagccgccgaaaaagatggtattgaggtcaatatttttgcaaccgccgcttccgatgcagacaacaaattagctgaggaaaaaccagatgttctgatgttaggacctcaagtccgctatcttgaaggtcaattcaaaaaggatctcgatattccggttgatgtgattaacatgcaggattacggcttgatgaacggcgaaaaagtcctcaaggcgtccttgaaggcaattgcagatggtaaacaaggagaagaagcataatgagtgaagaagatcagaacctcgaaactgtcatgggcttgatcatgaatggtggcaacgccaagagttctgcctttgaagctattcacgcagccaaagcaggcgattttgaaaaggccgacgaaaagcttaaagagtccgaccacttcctgaccgaagcccacaacgttcaaacaggcatgttaaccgctgaagcccaaggcgatcatgccgaggttaccttgttaatggttcacagtcaggatcatctgatgaatgccatcaccttccgcgatttagctggtgaaatggttgatttgtacaaacgattaagcgagaaagaagcctaggcaaacaaataagccttcgccacgcgatgacgcatgaaggcttatttgcagtggccattgtgaataaacggctgttatgaaatcccaaataatcgcaccaaaaaggcgactcagcaaatgagccgcctttttaatactatatgttattttttctggcgacctgcctgccattcttcccgcagaatgccatacttaacagagtcccagtaacgatcttgataataacgaacttgtcggacacgcgcttcctcctgcatgccaactgctttagccaaaccgatcatccgatcattgcctgaccaggtggtgatacctaaatgcggcaagttgacgagtccgaagatgcgatcaatccactgatccagcgcatcttgcccataaccttttccccaatcagccgagtcatagataacgatgccaagatccagccaccgctgcagatcgccatcttcataatgggcagagacgagcccaatcaaaacgccgtttgaccaaatgccgttgacaaacggattggcaacccattgaaagccagtttgattggcctgattttcctgcagttcttgtagtgtcggtacttcttggttaaaatacggtccgtcccactgatgccattcagcctttggatcagaaaaagccaccttccacagtgtttctagatcttcagattgaaaatgttttagcgtcactgtcatgcgttcaccgctcctttgatgtttgttaacaacataccacaattattgcccaggaaataatgcaatcgtcaactatgttaatgtcagtatagcggtaaacgattcgagttaatcttagataaggagtgaatctcatagtggcagattatattaaagatatccggacaaaggttggtcatgcgcccttgattatggctggcgtgattggcatcctgaccgatcaggctgggcgcgttctactccaacaacgcagcgattttaccggtgaatggggcttgattagcgggacgatcgaatacggtgaaacccctgcccagacgatggtgcgtgaattcaaagaagaaaccaatctggaggttgaagttgtccggttgcttggcgttaatggcaatctcaccctcacctatccaaatggcgatgttgcccaatggttgtgcccggtgtttcttgtgaaacaattaagcggtgtgttaaatagtgacaacagtgagactgaagccttaaaattttgggatccagcagccgctcctgacctgtttaatcaacaacatcgggaagtcttggcgcactttatcgcaaatgaaacggggtattttgattgaatcgattgatcattctgcgtggcaattcaggcagtggtaaaaccaccaccgcaaccgccttgcgtacccaactggccaatacgctgctagtatctcaagacgtcgtgcgccgtgacatgctcgccgaaaaagacaaaccgggcaatcccacaattgaactaattgaaacgattggtcgctttggattgcagcatcagcgaactgtcatccttgaggggattctgtcggcagcacgctatggcgacatgttgaaaacactcattgcagaagctgatcaaagtctggtttactactatgacctctcgtttgatgagactttgcgccgccatgcccatcgcgcaaaagccaaggaattcggagccgacgtcatgcgtgactggtatttgcctcatgatcgtttaaatgtgccgactgagcagctcatttctgccgattggtcgcaaaccatggtcgtcaaccacatcttgaccgatctggctggattgaacaatacagaatctgttaaacccattcactgacaaaagacagcaactcgcgggctcttttccaaactgatttgatagcgtcttcttgtccttaacggcgggcaaaatcagcattggcataatcgggcaaaatattattgttttcatgggtttcggactagaatgggttcgtaaaggttagttcattattagtaatggctataacgcgctcgcagtcgcagaagcctgcacatacggaccttgaaccagaatggccaagttcgagccattctggttcaagcccacttatgctccggcttttaagcgctcctgctcacgctcggttcataacgcgctcgtcagcacagcagcttgcatgtaaggaccctgctcgcaatggtcaaagtacgaccatcacgaacaggcccacttacactccggttgctaaccgtgctgactcacgctcactaaaaggagtgattttttatgacaagttatccacgccgtgacccggttactgaccggctgctcaccccggaaaattctgctttgattctgattgactaccaaccgacacaaattgaatccatcggttccatgaaccatcacgctttgatccaaaatgttgtgatgacggccaagttggctaaaacgtacaatgtgccaattgttctctctactgttaacgttaaaagcggacgcaataaagacaccatccccgatttaaaaaaggccctcggcgatataccaagtattgatcgctcttcgattaatgcttggcaagataaagagtttgtcgaagcagtcaaggcaactggccgtaagaacttggttatcgcggccttatggacagaagcctgcctaaccttcccaacaattgatgctttgtctgaaggctatcatgtttatcctgtcgtggatgctgttggcggcacctcacaaattgctcatgaaactgctttacgccgcgttgaacaagcaggtgcacaattgaccacaaatgcccaactggcttgcgaatggcagcgcgactggaaccgaaccgacactgtaccggattttgttaaactgctgctgggtgcaggcgactttatcaatttaggcgactagctttttaacaatatgacatgaacggggctgattaaagcagccccgtttcgtttcttatcgcttatgatgtgtacctgcccatgacatcgcatgatgccatgaacaggtaccttattttattggtgagcgtgagccagagcgattagtcaccgaagcgtaagcggcctctggcgtgatggccggtctttggccattgcgactgaggtccttacgcgcaggtgactgctctggcgaacgcgttatggttagggggattcaacatgcaacgttctgaaacggcaccaaaacgttggtggctactggtcgcgctgggcttttttgccttcatgaccaatctcgacggttcaattgtggatattgccgtgccaattatggccaaggatctcaaagtccccgccagtcagatggaatggaccgtctcgctgtatttaatcgttttaagtgcgctgctattgccctttggtaaacttggcgaccgcatcggtaagcagcggatttttaaatggggcaccggtacatttgtcttaggttccttgatggctgggattaatctcggctttaattttttgatgttagcccggatgatccaggcacttggcggggcgatgactttggcgaatacgtacgggatcgtcacctcgactttcgcacttgctgaacgtggccgggcaatgggggttgtgagtaccttcgtcgcattgggtggtgtcgctggtccaagtctaggcggtttgattttggcccatttcagttggccaatgatttttctcatcaacgttcctatcggtttaatcgcattgggtgtctccttgtggtctatgaacaatggcatcccacaacgcggtacgtacgatggttgggggatgattttgcaggcaacagcgattgcaagcggtttttggggactgaatcttgctcagcaaagcggttttgacgatccagttgtcctcagcacccttgcattggcagtcgttgctctcatcgcctttatcgtctttgagcaacggcaacaagcaccattgcttcctttgcgtattttccgtgtccgtattttcacactcggtgtggtcactgtcttcttcatctttatggtgcagtttttcagcacagtgctgatgccgttctaccttgaagatgctcgtggcctgacaccaggtacggctggcacgctattatcgctttatccactgatgatggtcttcttcgccccgtttggcggttggctggccgataaatggaacgtcccagcagttgctttgctcggcagcatttttatcgctgtcggcagtcttatcggtgccacattgaaattaaacgcaccgttgaccatttacatcatcagtacactccttgtcggcatcggcagcggtctttttcaatccccaattggcgatgtggtcatgtcagttgttccgaaaaatcagcttggcatcgctggcagtttcaatgcgctcgcacgcaatcttgggatggtcagcggcacggcggttgcgacaacagtgctctttggcacgatgagtcaacttgctggcagccgcgtaacgaactatccaacagcacatcccgaattctttatcagcggtttacaagttgccatgattgtcgctgctgtgctcgctattctcggagccatcgccatcggcctgacaatcaaaccgtggcaggcacacgaaaaaaactagtgtcagttttcatgacagttcatccgtcagaacacctcattttccaatgaaagcagacgattgtttcgccggtaaatcaacgttcgtgcaacaagtccacttttcccttcggctcaaaaagtgctagcataaaagtattgtgtccgcttgcacagcgtcagcagacgtgcttaggaagcataaactgaatggccgagttttgactatttatgactggcatgcttacatgtatgttgctgcgactgtgggcgtattctaatgacggaggaaaacagccatgaaaaagaaccacacctcgacagcctggttgacttggggcatcatgctggtcggtgccaatctgcggctgcccatcacgatgatcccaccgttgctgccgacaattaagcaaacactcggcctgcctgcatccatggcaggtatgctgacaaccatcccattgctcatgttcgcgctggcctcaccgttaatcgccaaaatgggtaatcgtcgtggtaatgagtggagcttgctggtagcgctggttatcttgttggctggtagcctgctgcgaatcatttccagcttgacagccttaattgctggtactttgctcatcggatttggtatttctggcggtaacgtccttttaccggcaatcatcaaggaccaatttccccacgctatcggtgctaaaaccagtctttataccgtgacgatgggacttattgcgtccctcggtactggactcgcaggattgctaaatcagcaattcaacatgcagatcaccttggcagctttttcgttagtcggcgtctttggattactcgtctgggcgttggccttccgcacactaccaaagaaagcagcccggcaagacgtccagcgcaaaaatatcgccgtttcgcgatctatgctagcgtggtggatcgctttattcttcggcctgcaaagctttctctactattctttgctgacttggctgccaagtctttggcaagcgaccggtttctcccaaatcgcggcaggtaatctggctaccatttttcagctgagcgggatgccggcaacattatccatcccattcattgctgagaagcgccacggcctcttatatagtgtctggggcatcatgctaggctttgtactaggtgctttgggtattcttatccctggggcgaactttggcttaaacgttgtctacgcgctgctcatgggcgttgcttctggggccgcttttgccatctgcattgtctttttccagaagaaaaccgccgatgcttatgaaacagctagtctctctggctttgctcaaagtgtcggctacttatttgcggcagttggtccagtattatatggcttcatccaaacggctacaggttcgtgggatttattgttgtggctgacagtcgggctaacgctgctgatgtttgtggcagggctgatcatcaatgcgaaccatcggatttttccatcaaaggcgaatagatagcgcttgcaagtttctattactttttttacactaagcatgaatggctaaggaggtcacaaaatggcaatgacaacgacaattggtaaaagtacagtcacaaccgggaaactaggtttaggcaccaataaagtcggcggccacaacttgttccctaatctgcatgacgaagatggcatcgccgtcgtgaaagccgcgcttgaccacggcattgacatgctcgataccgcttatatgtatggtttagggcagtcggaaaaattaatcggtgaagccacacaaggctatgatcgcagcaaaattattctagcaaccaaggcagcacaggatccgcacaatgatctcaaaccaaataacgatcccaaatttttaacgcaggcaattgatgatgctttgttacgccttaaaaccgattaccttgatattttctatattcattttcctgatgacaaaactgacaaagcggaggcggtcaatgccattgccaatgcccgcaaggccggcaaggttcgggcgatcggcgtttctaacttctcattagaccaaatcaaagaggccaaccaagacaatcaggttgatgtcgttgaagacaattacagtttggtacatcgcgatgctgagcaaaacctgttcccgtatttgaatgaacaccagatcagtttcgtcccatactttccactcgcatccggcttgttaactggtaagtatggccttaatgatgctgacaagtttagtcgacgtttctcggcagatcagttcaagaccattcttgccgctttgcgagaagtcgatggcatcgctgatgcccatcaggcaaccttggctcaggttttcttggcttggtacatgaagaatccggccattgcggttgtgattcccggtgcccgcctacctgaacaagctacaagcaatgctaaagctttagacgtcaatttacgcgatgctgaatatgcatctattgacgagttgttcaaaaaattccgtactgaataatcgcgcattgttctaggctacagacttcgcacaatccaaaaagcagcccgcttccagcatgtcacacatgcggaaacgagctgcttctttttattatcaaaaaacggatggtgagcaggcatcactcactttttgcgtctaaacgcccgtttgataacctgccaaaacgtcagtgattgtacaattttatctgccgggaaatgatttctgatggcgcgcaaaacgcgtttcggatctcttgccgcgaaggtatatgtcccatttttcttcgttttgattgcaaaccgtgggatccatttgcctttaaagatcaccgacgcaatgaccaaatcaatctcattccacgggatctgatagaaatcgcgcacgtttttttcgttgaaaaattcaaaccctttatcgccgatcatgatcttgccatatgtcggcatccccatgaaggccgtgccttcgaccactaattcggacttcgtgttgatcgattgaaccattttccgccatccttttaaactcatcttgaacgattttttactgatggagacgactcggtctgttctccaaacgcgatcacaggcccagaaacctgcatataaggacctcaggcttaaatggccaaagccaagccatttaagcctaaggccacttatgctccggtttctaaccgggcctgctcacgctctaaacgcgatcacagtcgcagaaatctccgtgtaaggacctcagacataaatggccaaaaccccagccatttatgtctgaggccacttacactacgatttctaaccgctcctgttcacgctctccattataaaacaaaagcccagactttgcgcctgagcttccgtgattctttgttcgttttaacggttgatattacatcaagccgacaacgtggaagacaaccccgacaacgaacaggccaaggataatcacaattggagaaaccttcttcttcagtaaccacatgcagaacaaggtcagcagtaagcccatcaaaccaggaatcaagctatccaagttatcttgcagcgttaagaccttattcttggtcagtgacagaccttgagattgtaattccaaagccttctgaatacccttggatccacttggtagtgaactccagtcgatgtaagcacccttttggttaggtacgtctgatacgactggtgtgaatttgacagaaacccaacggttaaccagcgaccctaagataaacatcccaagaatcgtggcacccttcgtaacttcttgcaacagaccaccggaaaggtcttcggtaatcttgctcccagctttgtagccaaattcctgcgtgtaccacaggaaagccatacgaattgcattccaaagcacgaagtacaagattggtcccatgatattgccggccattgccaaggatgcagctaaggcaccaataattggcttaaccgtgaaccagaacactggatcgccgacaccagccagcggacccatcatcccaactttgacaccctgaatcgccttgtcatcaattggcgccccattggcacgttcttcttccagtgccatagtaacaccaataattggtgatgccagatatggatgcgtgttaaagaattctagatgccgtttcaaagcagcggaacggtcttccttggtatgatacaaacgtttcagtgccggaatcagggtgtaagcccagccaccgttctgcatacgttcgtagttccaagaaccttgaatgaaggttgaccgccaccaaaccttgattcggtcgcttttagttaaatgaacttcttcagccatgtttgtcaacctccttcttagtagttgtcaatgatgtcgccgacaggatcaccggcaccactattcgagctgccgcctttgcttgagccgccgcccattttggacagagccaagtaaatcaacgccagagagatcccgatggcaccaaggccgatcagggtaatctctttaactgttgccaaaacaaaaccaagcgcaaagaatggccatacttcacgggtcgccatcatgttaataaccatggcatacccaacggcaacaaccatgcccccgccaatgccaaggccagcggtcaaccagtcaggcattctttcaagcaatgcccgaacaggaccagcaccaacggctagaatcaagccagctggaatggcaatacgcaggccttgcatgcagatcgcaatccattgccacatatcaatcttccggaaactgccttcttcagcagctgcatccataaagtgaacaatcgcggttgccaaggtacgtaccaaagtggtcagcaacaaaccggcaacagccagtggaaccgcaatcgcgatcgctgaactgataccttttgtgccctgaccgccaagaaccagaataatagcagatgcaacagatgccaaagcggcatcaggtgcgacagcagcgccaatgttggcccaacctaaggcaatcatttccaattggccgcctagaatcaagcaaggtgccaaattgccggtcacaagtccgatcaacgtgcacgcgataactggctgatggaaatgaaattcatccaaaataccttccataccagcaaggaatgacacgatgaggaccagaatgacttgaataaagtttaaagtcataagtcttcttcctccgtttcaaaaaaattacttctgtgcattcagttcgtcttgggctttcttcaaaattgcatccatgttttcggcatggtctgcaggcaccttgcgaacatcaaatttgacaccgtctttttccaattgatggaaagtgtcgatatctttttgatcaaaggccaacaccttgttcggctgaaccttaccaactgaatgggacatggaaccaatgttaagttccttgagtggaacgccgccttcgattgctcgaagtgcatcctcaggtgtttcaaataatagcaatgcacgttgcccgccgaaatgcttatcgtctttagcgatcttaatcatctgatcgataggaataacatgcgccttaacgcccgctggtgcagcttccttaatcagattctttcgcaagtcgtctttagcaactgaatcagagacaacaatgatgcgtgtcgggttggttgtcttggtccaggttgtggcaacctgaccatgtagcaaccgagaatcaacccgcgccagaacatactcaagtgagcctggctgaccagcattcgaagtagttggtgctgcttgggcagctggcttcgtcactttgtccagtgattctggcttgatcttgataccttcacgtccagcatcgagcagatgtgctgcaatatcctgtgcagaatccatcgaaagtcgtgaaccatacgcttcaatcagcatcggtaaattcagtccggtcacgattgcccatttatccttatgcgcctcataaatcgagttcgcttggttaaatggtgagccgccccataagtcgatcaagaaaagcacttcatcgtctgggtcgaacttagcgatcgcatcttcgaggtgcttgtgtaagtcatctggaccttcatcgggcatgaaggtcacagcttcgactttttcttgctcaccgaagatcatttgaccggattgcttgatgccagcagcgaattggccgtgactagcaagaataattccgaccatttttacgcctcctaaaaatttgtggttgccttgaaaataatatctgcaataaacgaaaataatctaaaaaacaaggcttcccaatagaatagtatgacgtccttcgcacagctatgcaagcattttcacttgaaaagggtgcataaaaagaagcgcatacattctctatgcacttctgaaaagcgatttcgctgaattggtctattggtaagtaccaattttgcctatgttggattaagccttttgcgaatattgatcggaatcggtaaagactgggtccaaaattttagtgctcatccaaatcaaaaccaaaaataatcctgtcgccaaccctgccataacgatccaactaacatgagcactagcaaggttcgcaatcgtgaagaaaatcacttgtcctactggcatgccgatcaatgctgccaggttgaccacccctgctgtcgtacccatctgctgttcaggcacttgccgcatcatcacggtggctaaacgtggattgattttgcccatcagatatgctgtcacaaagctgaaccccagtgccgccacgatcgaatggagcaggaaaaagctgctgcttaaacccactatggccgccatcagcaaacttagcaatttgaacgtgctcaagcgctgcaaaccatccttggcaaataaagctccaaagataaggccgacagaaaacacaacattgatgattgcaacggtggttccaaagtcgctcagccataagtctggctcctgcacaagcgtgatattcatcaacccgtcaacggatgagccaagcgtattgactaacatcgcgaagagaataaccgcgaataggaattgattgccagcaagaaacttaagaactgcccggatgttaccgataactggctgtgacttgcccgttgtcactggcggttctgcttgcttcaattgcttttttcggaagacaagcgtcatagcggctagtaaaaaggtcaacgcattgagcaagccaaaaagtgcgtaattgtgattcaataacacgatcaaactggctccaagcccttgaaaaaccagttgcacggttgaactcgttgcactttggaaacttaaggcagtgttaagctcttttgcgggaatcaagcgatggaggagcggcagcgtcaaaccattgccgtactgacctaacgaatcggaaacaatattgattaaaagtaatgatagaaatagcggaaaactggccggtagtaaaatcatgaccgctaaacttaggaacaacaacatttgtcccaaacgggttgccaccatgtgccaagttttagcatgtgtccgatctgccagactcccagttaaaagtgacagcatggtcggcacgctggttgccatggcggctaacgtcaccgccagacttttgaatggcatagttgcggcataaatgatgaacacaatattatagaggctatcaccaataccacttaacaaactggcatttaaaatcgcacgatacccgcgattggtaagatattcatgcatctcaatcttcctcctcaaggtgcttactggtttctagacacgcctatgagttttcaaaacgcgttcactgccgcagaaacctgctcataaggaccgcaaccttaaaaatggccaaaaccctgccatttaaggttgcgcccgcttatgttccggtttctaaacgcgccagttcacgctctgcttatttgtatctagagtgtacgcagggtaaaatcggattgaggtgaaattccactatggtagaaaaaacaaaggccacagatggtgcggtttttcggcagttgcgacataatcatcagctaaccttagcgcaagtggcagacgaccataattcgattgcttttatcagtaaatttgagcaaggcaagtctaatatcagcttttcgcgtttaacccatttgctgcatcgcattaatatctctgtcgaagaatttgtctttatccgtgatcttcaatccggcgttgtgccgacatcgaatgatcctaattttgtgtacaacaccttaacgcatcgcgcctttgtcgaagtgcttgactatcaggatcgcttttcaactcaggaaccgacaccagcagactatgcttatttcctcaaaaaggagcaggaatggcaagctcgttatgcccaagaccacaaccgccaaacccgcttcgagctgatcagcattcaactttttcggctaaccatgattgatcgggttaaacaattaaaccaaccatctccattcaaaagtgtcgctgacgctatggcccagcttcaggccttggcaaagccagtcgtgagttatctttattcggtcgaaatatggaactactttgaactctattggtttcgccatctcatggtcgctttaccgacagccacgattcaaaacttactgccacttgccatcaaacgttcggaaaagtatcgtgcttttaaccagattcgcaatatccgaatcaggacactttttgcggccttctccgtttttattaatgatcggcagctcaccgatgcgaaaaaagcgctcgatactgccaagactttattgcatgacagtgacgatttgaccaacgctgctatgttactttttttacacggttggtatcacgtcattgccgatcagcctgaaattggctgggagttgtgccatcaggctattagcttggcacacatccttgaccagcctaaacaagaacaacagttgcgttattcattagaatttattcatcaaaatgtcaacaatccggaaaaaagtgctttcttcctttaaacttatttatcggcagttgaagtttcacgtggaacttttgagcatttacaaaacacgcttctggcaatcctctcactaatggcgtcaaaaatcggtactggaaagtgttttttctcagtactgatttttgcctgcatgattgctggcgcggatctttaagcttcttggctacacccttttgctgctgcaagtcgttcaattgcaggaagccacgtcgccgtccatgctggtgcccccaattgcgccagcattttttttaattgcaaaaactcttgccgtccttgtaacgccaccactttgtcggatgaataaatcataagtaatcgtttcacacaagcaatctgaaactcaatgcctagatcaccaacagttgcttgcccgataagattcaaagcatttcgtgcctcagtcaatttacccgctgccacatagcgaagcacagccgctagaaacatgcggttagcaagattaaaatgatcctgcggcgtgttaggacgttgtatctgatttgaaaaagcagctatcagttgactcagctcatccaggtcaataattttagccaattggacagcaatcagtcgtaatagtaacgaccagtcagccgtcgtcatcagcaatgactgcgcttgtgattgctcatgcggtaaaattgaaaagcgttccggcgcgtcattatgtaaggtcaaatgcaacaacaggcgttgattaacattggcgagtggcaattgacgtaaaatgctggccaattcctgaacgtcagcgtgacgcgcagccgccaaataacgttgtaaaaaaggttgcttatccctagaacgaggttttgcaaacacatcccaatctaaattcaactgatccaacaacaaaaagaaacgatcagcagctaactgtgaggtaccattttcaaactttgacaaacttgacaccgataaaatgccatgcgctgccatttttaaagtcagtcctcgttccctacgtaataacttaaattgtctaccaatcgtcatctcgcagccccctcctccttaagaaaccgctgccaactagttgttaacaattgagcaaaaaatggtgactctaataaccgcaaactggctaacagttgctcaaccgctgccgttgctgctcgatgcttaccgcgatggtacaccaataattgctgctgataccgaagcatcaatcgggaatagagatcatccggcggcactggcatactggtcgcaatggttagcaagcgaactgcttcactaaactcacgccgatggatcagtaacgcaatgctattcgtgagaatcgcccacaaatattgatcgcgcgtccggtgactctcggtttttggcatatccagtaacatccctgccactaaactaaccaactgtttactgtcgaaaagcaccaacgtcgccgcaaaaagatctagctcataaagtccccagtgcttaattcgttttaagtaacgcataacgtcagtcttcatggctggtgttgtttgaaaactcgggtcactgaacccgttgtgcgccatgatgttaatctgattaagtcggtaaaaaataagccccgtttcccgccataaccgatactgtcgcttagccaatgccagtagcgccggtttcccagcaacagtcgcccggttcacctgctggaaaaagttatcctgattcaaggcgcggtatccttgttggatggattcaacgtcttgatcaaaccgtgttaataattttaaaacaactgccgcactcagttgcgtctccccacgttcaaaccgcgacaaagttgcagctgtcgtaatcccagctgcaatttcttctaatgaatcattttcctcgagacgtaaagcccgcaaatatgccccgattttgacatgttcttctggcatcagcacccgacccttttatgagaactttattagacaaacttaacacgttttgccattttttcaaaatatcttactacttattgcacctcaaatttgaatatttttgtttttaaacgctgcctaaacatgggttgctagtcccaagaattttttacgcatttttctgatagacatcaggcagtagcgaaaattcaatggacgcggccataccagcgccttagccttggcgatcgctactccgaattttcacaaaaccagttcagactatcgaagcctgcccaacaagcatcagaagagcgaatccttctactgtgccatctaaaacgtgtgagcagacgtagaaactgtacttgctcacgcgctgccattataaattgacatccatccctgactccgctaaactcaattttgacatttaaatacaccaccaagaaatagaggttgcggtgggcaacgaaaactggggagtgccgtatcatgttgaaccagttgtaagtgccaccgccgaaatgttgcacgatattcggatcgtgcgcattgggccatgggtgcataacccatggactgtcgaagcactcgcttcggggcgctatgattctggtttatgactaaaatcgatggaatcgacctttattgcggtatcacaacacaataaggtcgattttttgtttccagctctatttcccactacaagaagggagaaatgtcagttatgaaaaagcattgggttgcacgtttaggcgtgctggggttcgccttgagcctcttactaggcagttttgctgccaccccggtcaatgctgctagtgatagcggcacgtttaaagtcggcatggaggctggctatgcgccgttcaactggacgcaaaccaccagcgctaacaacgccgtcaagattcaaggtagtcaggaatacgctaacggctacgatgtgcagattgcacgtaaggttgccaaagccttacacaaaaaggtagtcgtcgtcaaaacatcttgggacggattgccaccagctctaacttcaggcaaaatcgatgccatcatcgccggcatgtcaccgacacctgatcgtcgcaagaccatcgatttcagtaatccctactacatctccaacttgacgatggttgttcgcaaagacagcaagtatgccaaagccaagagcattgcggattttaagggtgctaaaatcaccgcgcagctcagcacctatcattatcaggcgatcaatcaaatcaagggtgtcgtcaaggaaccggctatgaacgattttccagctatgcgtgtggccttggaatccggaaccattgatggttatgtttccgaagtgcctgaagggatcacggcagagcgtgctaatcctaacttgatgtatatccattttgcaaaaggtcagggttttaaaaccgatgccagtgacacgaatctggcgattggcttgcgcaagaatgatccgaataaagcaaaaatcaatgaactacttgccacgatttcaagtaaagaacgagcacagctgatgaatgaagctgtcgataaccagccatcaactgaaagcaatggcaactggttcatcgcgattatgaaacaatatggtccaatgctgttacgcgggacaggcatgaccttactgatttcccttgttggcacaatcgtcggctttatcatcgggttgttagtcgggattatccggacaactcctaagccgaaaaaactcgggcagcgcggcttacgcgccgtaatcaactggctgctgtcgttgtacatcgaagttttccgtggcacgccaatgattgttcaggccgcggtcctatattatggtgccgcgcaagcttggcatttgaacatggaccggaccaccgctgccttattgattgtttcgatcaacactggggcctatatttccgaaattatccgtggtgggattatctcggttgacgaaggtcaattcgaggctgccaacgctctgggaatgacccatctgcaaaccatgatgaaggtcattttgcctcaagccgtgcgcaactcactgccagctgtgaccaacgaatttattgtcaacatcaaggatacgtccgttctgtccgttatctctgtctccgaattgttcttcagtggtgagacaattgccggacaaagcttccaattcttccacacctatctgattgtcagcgccatctatctcatcatgaccttcacaattagtcgcctattccgattaattgaaaaacatctcgacgggccaaaagattacaacgtcatgaccaaccagatgcaggtcgaaaccccgaaaactcgtacggcaaaggagggctaatccatggcaaacgaacctttaatccaagtcaaaaatttaaaaaaggcctttggcaatcacgaagttttgaccaacatcaatctggacgtgaatgccggtgaagtcgtttcgatcattggccgtagcggctctgggaaatcaacacttttgcgaaatatcaaccttttggaaaccccaactggcggggatatccttttccacggaaaaagtattttaagcgatgaagagaaactaagcacttatcgcgccaaagttgggatggtcttccagagtttcaatctgttcaacaacatgacggtgttgcaaaatgtgatggttccgcaacaaacggttttaaagcgcgatgctgccacagctaaagcgcacgccctcgacttgttgaagcaggtcgggatggatccattcatcgctgcaaaaccggaccaattatctggcggtcaagaacaacgtgtcgccatcgcgcgggctgaggcgatggatccagaagtgttgctcttcgacgaaccaaccagtgcacttgatccggaaatggtcgatgatgtcttaaacacgatgactgctttggcacatactggtttaaccatgatcattgtgacccacgaaatggccttcgcgcgcgaagtgtccgatcgggtcgtcttcatgaacaatggcgttattgccgaagcaggcacaccggatcagatcttcggcgatccacagcaacctgaaacaaaagagttcttgaaacggtacttgaaccgaatctaaacctatggctcgattcttgggcaacaaaaaaggcgtatcgacgattgtcgatgcgcctttttgttgtcactttacttttttgactgctgctcacgcttctgcttgcggtgttcgctccacgtatccaagctcaccacaataagaaacaggaaaaagccgccaacgcccgattctagtgtcaaaatcaaataacgcatggccaagtagcccttaccgcctgtgacatcccgatagccgacgtagccaaatgtcatgagaatagccagtcctaaaaccagcaacgtgtacatcagcgttcgttttaaaatgcgtttgaatgtcgtcatgcggtgacctgctttctaatgagtcttacttattatctttcaaaatcgtatcagcttgcttctgcaaattcgtcagtactgttttgggctcagcatttttcgaaacggtttggtccacagcatcaagcaagttattgcggtacgtattgtaaccaataaatggcgttgaggaaaacgcatcgtcataagcatccactgctgcctgataggtcggattctctttcaagtaggcttgataagcgctggactgagttgcggtcttcacaaccggcacataaccgctagccttagcccattgcgtttgaatcttggtgctcatcaggaatttcatgaaggtaaccgcacctttaatctgatcagctgaagcgcctttgaaaacggaaatcccattgttgcccagtacagaactggccttgccagcaaagcttggcatcacagcggttccccagtgcatggacttcggcgctgttgctgcaatttgctgaatagtcgcactagagccaaacccggcaaaaattttaccttgaacaaatggcacgttaaaataattgtccaagccggcagtgactgccgtcttatcttttaacatggtcgtgatagcggtcatagccttgatgctggccgatgtgtcaatttttgcctgatacttcggcgtgatcaggcgattaccagcatcataggccaaggtttcaaattcaaaatcataacttttgttgaatgcgaccccagtaatgccgtcgtctttgagctgctgactcattttagtcagttcttcccaagtcttgggcacgctgagatggtacttatccaaaatatccttgttatagaacatcaatcgtgtcccagtggcaaatggaatttggtaatatttaccttcatacttcaagtttgtcgcaatgcccggataaatggctttgagctcatttgcggaaaattgtgacttcacctgactgtcaatgttaactaacatcccgtcatgcacgtattcaggaataatcgtatcagttacctgcccaatggttggcaacgtgcgagatttcgctgaagccagatactttttttgtaggttatcataagacccttgcgaagtagcaacaactttgtactgcttttgactgctgttgaacgtcttgatataaccttcaagtgccttgttataatttcctgtcatgcggtgccagaatgtaatcgtcactggccccttcgtactcttttgcgctgaactgccgctaccgcaagcaaccagcaggactgccatcaacactgtcgcaaacccaagcaaccaacgtctcttcatcattttccctccattatcgcggtttgtcgtgaacagagacaacttgacctatccctattcggatataagtgcgttgtcgtcaaccacgaatagtataccaatacttaccggctcaaggggaactaaagtcaaaaaaaagaaagcgtatgccttcttttttagcatgaagctatgagatgatgtcaggcttgttcttcggtcaattttagatagaaattagccagtgtcatcgtgcgatatggtatgacccaaattgacgctaagccaaacgtaatcatttccaacaaccaccaacctaggaaactgaggagcaaaacgaagaactcccacttatggccgtacatcaattgacggctgcgcgtgacagcctcggtatagccaattggctggccagcatcaatggcatcacgataaatcaactgggcttgtgaataagccaatcctttgacaatcccgggaacaaccaataacaacatccacaggctgacccaaacgacttgcagcaaaccaatcagcaagctgccgagaaaatattcgccacgttcaaaaattttgaacatctgcgtccagctaaaccggtgatccgaccgaccacgcaacccgtcaatcatggcgaagctgacaccgatcatgagcagcgctgtcagcaaaccgataaatgtcactgctgtctgccacattgcgatgttgttccaataaccatttgtcatcatccgccggctgccatgagccacgacacggataccagctcgatgcatattttcattaagcgggaatggcaccagcgccacaaaggctgtcaataataatgccggtaaactaatccgtaaataatagctaaagttgggattcagctcagccttggcgtgatcttttaaagaagtacgatccatagatattccccctctaactgtgacaagtcatcacaatccttggggttatcataacagaaaaagacggttgagttatacaaacttcaaccggacattgggatcaagttgcggttcaccgggaacaatagcaaagtgatcaccgctgactgttaattctgtttctgctttaaaaaacccactcgtataacttttgatcaataccggccccaccggcgaatcaaggtgtgcatcatacacatcgggcacattggtacgcggtagaatcaataaattgaatttcgcctgtcctgatgtttttgatggccgtgaataaggaccaataccgtcattaatatcaaggattagcgccttatcagcatgtaacatcggcgccaatcgtgaggcggccacagcagatacattaagctccatattttgcccccaaaagtaaaataatccttgtcaccaatattatggcgcccgaccgatcaagatacaactctcttgtaaaaatttcaccaaatgcctaaaattgggttaaactgaatttaacccgatgtgattttattcagctaggacgaggtgtgccatgaatatttattcggctttaaagtttatccaaatcgatcatgagccagtcaatcacctgcaagttgtcatcactgatcaaagcggcaagcctgatgccggcatgaccgacttattggctgactgcttgaacaaaattgacattttcgttgaccttagcacaaccgatcgggtcagcgatgtgattgatgacctcaatctgctcaccccgctgccctatgatgtccttgaagaatatcaaaaaattcttgagcagccgatcaccggcgtcaatattgcgatgaaaaagcagttgatcgagttgatttacgcaccaatggtttaggtttgtttattttatcataatcgcgcggccatttttaccggtgtcttatcccggcgaagatgacgcgctttttatgtgcctgcggaatcccttctttagtgaaaaatcttgcctgattcttgttgtaacagtttcacttaggtctattttctgctattctgacgaaaacggaggcgaggaaatggaacaaacgggacaagcgctaccagcaaccattcaacgaatttggcgggcaagtgcggcgttgtgggcgctagtgctcatgatcatcggtttgggactcattgccgcttggtttttctggcattggtccttttggcttgggttgggtcttattggcattgcgattattcaactgctgttccgattagcacttgtgccgtatcgctatcgtttttggcgctacaacatcacgccaaccgcggttttcttgcaaaaaggctttttcttccgaaaaaatgaagccattccgatttcgcggattcaaaatgtcacgttagaagccggtcctttacttcagtggcagacactgcaacaagtcaacatcgaaaccgccagcaccgcccacgtgattgatggtgtgacgcgaccagtggccgaccaattgcgcaatcaaatcctccaattggctcaggaggcgcgcgatgaagactgaccaaccgcaacgactcgcgcctgtcgcgctactaattatttggatcagaggctttatttcgtggtggccgttatttgttggcggagggctttcaatactgcgcgcaaacatgagcttcaatcaatttctattgtggggcggcctaattgttggcgttttggtactcaccctcatctggtcaatcctgcattatttgcgatttacctatcttgttgccccgaacggtctgaccatcaacagtggtgtgttgattcgtaaagtcaatcacatcccttatgaccgtattcagacggtacaacggcaacaatggttttttctaaagccactcggtctcgaacaggttaccatcgaaacagctggcaaagaatctaaaaaagccgaaggaatgctctcggccgtgccagtagccgtagctgatgccatcaaccgctaccgtcaaggaaacgttcagccagtgacacctgatgcgactgataatcaggccatccctgctgcacccgatcaaacaagcaccaccgccgcaccagccgcgcctgtggcagatgcggcctataaaatcaacggccatgatcttaatcaatacgcgctcacttcactaggcttcatccccatcatttccgggattctttggttaacacaaaaagctcaagaatacctgccagatagctggtacaagaatgctgagcatgccatctctggcttagcggtttaccttattatcggtctgacacttattattctcattctaggtttcctgatctcctatttgaatattattcaaaaatactaccacttcactttggaccgaaccggtgacgaactacgaaccagccgcggcttttttcaaaccaatacggtcagtgcccgactgtcacgcttgcaggcggttcgctttaagcagagcattttgcggcaatggctgcatcttagcaccgttcaggcgttattagcctcaagcgccgctgatgaccagcaaaataatgatctggtcctgatgccggttatcccagaacggcaagcactcagcagcatgcgggcattcgtcagctggctgccggaaacatcaccgaaactacagccaattccagttagcaaccgctggtactacatgcgcaacatggtcctaggtcatctgacactattggtgttgccggttgtgctcgcaagtgtgttttggttgcacgtcagttggtggctgtggctggtactggctggcctgatttggttagtcgtcatggcgttgcaaggtcaatatgcggcaaccacagccgccattgctattgcgccacctaagcaacttatcattcaagtcggtgaaatgtggacaaggcaacgttattttgtccgtaaaaaagacattcaagccatgacgatcaaacaatctatctggatgaaggcgcgtgacgttgcccatttagaggtgcatattcgcaaaggcaacagcgatcagacagtcaactcccgctatatggccgttgatttggccaagcagattatgacttggtatcagccattaccatcagtgccgcaagaaggagacaatcatgctgcttaatcgtatccagtacaccccgccaaaatcaaaaaccgcgtatccattcaacttgccttggcaagcttcctttcgtgacctgacattgtcgcaacccgtcacgattttgacaggcgacaatggtagtggcaagtctactttgctgaatgctattgctgctaattacaatgcaatcctcatgagtggggcttcccttgatgaggacccggaatatcaaaatagccgtgccttagcccgttgtctcaagttgacttggcaatatcggacgaaggcaggctttttctttcgggcagacgattttatctcattcattcgcgcaacccgtggccggatcaaatacgcgcagacacagcttgagcaactggcacccgatagtttggaacgcttgccttatctcaatacactcagtgccattcaccatctttatcaagttgatctcgacaagctttcccatggtcaggcgttccttgctttatttcgtgctcgactgcgtccaaatgcactttacctgctagatgaaccagaatcaccgctcacgccggaaaatcagctcagtctattagccttactacatgatgcggtagaaaatggctcgcagtttatcattagtacacattcgccgattctcatggcctatccgaatgcgcaactactggcgttgggtgacacactagcacccactcaatatgatcaaatcgaacatgtcgcttttctacgtcactttttagatgatccgcaacgatttatttatcacctgttaaacgactgacccgttgcaatcacgcacctggctgttctaaggtgggggcgagcgatctccagcgcgggtaactacgctggagatcgcgttcatgaggaggaataatatgctgacttcatcttggatcaaacaattaccgctgaccgccatcacgcaagtcaccccggttggtggcggtgacgtcaatcaggcataccggatcgatacggcgacaaagccttactttttgctggttcaaccgggttatcctgctgatttttatgctggcgaaatagctggcttaaaagcatttgacgaggcacaaatcttagcaccgcgtgtcattgctaatggtcaaattgaaggcgatggttttctgctactcagtttccttaccagcggcaatgggtcgcaacgcgatttagggcgattagtcgcgcatttgcatcaacatcatgaaccaaatggccgattcggctttgactacccttatgcgggcaccagcgtctcatttaccaacacctggaccgattcatgggcagatctattcattcaccaacgcttggacaaactcgccgcacacctgcttaaaaaggagctgtggcaagccgacgatgaagcaaccttccaacaggtgcgcaccatcatcagcaaaacactggcccatcatcacagcgatgcttccctgctgcacggtgacttatggggtggcaactacatgtttactgccgatggtcagccagctctgattgatcctgcagcagtatatggtgatcgcgaactcgatatcggggtaacgacagtttttggcggattcacccaagacttttacactggctatcaagaagtctacccacttgatgctggttatcacttccgccttgacttttaccggctgtattatctgatggttcatcttgataagttcggcatgggttacgctggcagtgtggccgcagtgatgaatcaaattctcgatcatggcttagctgaataaatcgcttcgctatgtattttcgaaacgaaaactatttcccaggaaattaaaacagcaaaacggccaacccactagttgatggattggccgttttgctatcttctaaaaatcaatatttaagcgttcagcaccttgttcaggaagctcttggtccgttcttcctttggatgctcgaaaatgtcttcaggcgtgccttgttcaaggatagtgccattgtcaaagaagacaacccgatcagccacttctttggcgaagcccatttcatgagtcacgatgaccatcgtcatgccttgcttggccagccgccgcataacacctagcacatcgccgaccatttctggatccaacgcactggtcggttcatcaaacagcatgatatcaggatgcatcgccaacgcccgcgcaatcgccacacgttgctgttgcccaccagaaagctgagctggcatcgcatctgccttgtccgtcaaaccaacaacttccaacatggcttttgcctgcttgatggcttcctccttgctggcgattcccagctcggttggcgccaaggtcacattacccatcactgacatgttcgggaacagattaaaatgctggaacaccatcccgattttttcacgaactttgttgatgttggtgcctttatgggcaatatcttcaccatcaatcaagatctcaccgcttgtgacggtttcaagaccgttgatcatgcgcaagacggtacttttccccgcaccggatgctccgatcataacgaccacttcattgttcgccacattcagattgacacccttgaccacatcattgtcaccgtaactcttgtgcacatttttcatttcaacgcgataatcgctcatgccttcaccttcttctgaacccagttactcagccaggtcaataacgtaataataatcaagtaaatcaaggcgaccatcgtccagatcttgaacccttccatgttgcgggcaatgatgatcttcccggtttgggtcagttccagcaagccgatgatcgacaggattgaggtatccttcaatgtaataataaattggttgatgaaacttggaatcatgattttgattccttgcggcaaaataaccttccgcatcgctttaccaaatggtaggcctagacttcgcgccgcttccatctggcccggatcaaccgcctgaataccgcccttgacgaaggccgctgtgtacgccccttcgttcaaggtcaaagttacgatcccagcaatgaatgctggtacttttgatccaatcaggcttggcaccccggtatagataaacagagccaaaaccatcagtggaagaccgcggaaaatgtaaatgaaggtcgtcgcgaccccttgtgcaaatttatttggcaaaacgcctaacaatccaacaagaatcccaaccaaggtagcgaagaaaatggcgacaaccgtgagaaccattgtctcttccaggccgctcattaaggtgccccagttagccttcaacaaaccgaagaaagaacgatcagttgtttgcgcattgccagcggcagttttttgggactttgcactgccgttgccaagataacgttcaatgatcttatcgtattggccgtttgcccgaagtttcttcaagccagcgttaaacttcgtgatgagcgcccgattattcttcgaagctgcaaagccgtatgaaccttcacgggctggcttaccgataattttcaaggccatgccattgttgatcccgtattgcatcaccggttgatcttcaaaacaagcagctgaattacctgtgatgacgtcctgatacatattgttcgaatcatcaaatgtcaccgttgaaaaaccgtatttgtctttaatactgttggcataatccgcagaatcagtcccggtcttaaccgcaactcgcttaccgcgcaaatcttttagcgacttgatagtccctttttttgccaccgccatgaccacgcctgatttgtagtaaggatcactcatcaaaaacttttgttgccgctcaggtgtaatcgacatgccagcaatgacaccatcgatttgcttagcttcaagtgcttgaaccgccgcattgaatcccagcggcttgatctcaactttaaaaccttccgttttggcaattgccttaatgagatcaaggtcaataccgacgtacttgttatcctggttcgcaaactcaaacggtgcaaaggtcacatccgtcccgattgtatatgttttttgtgccgctgccactgacttgccgggtaataaagctcccagcattaaaggcagggcgattagcagccctagcagccattttcgtttcaaccctaacaccacgctttctatgatatccgattgcaaactcgtttagcttgcaacaaatgcgctttctgcccacgatcaggctgacttaagcgaccttaattaaaaaaactactttttatgctagcggaaagcaacagtcgctgtccagtcctgatgttagattaattgacatttgtcacattattttacgccaacggtctaggcctccatacgccgttgaacccaattactgagccaagttaatagcgtaataatgatcaagtaaatcaaagcaaccatggtccaaatcttaaagccttccatgttgcgcgcaatgataattttcccagtttgggtcaattcaagaataccaatgattgagagaatggacgtatctttaagggtaataatgaattggttgatgaagctcggaatcataattttgatcccttgtggcaaaatcacacgccgcatcgcttttccaaaaggcaatcccagactgcgtgcggcttccatttgaccatcatcaaccgcctgaatcccacctttgacgaaggccgcggtgtacgcaccttcgtttaaggtcaaggtgatgatcccagccacgaatgccggaatttttgaaccgattagacttggcacgcctgtgtaaatgaataaggccaataccagcagcggtaatccgcggaaaatgtagataaatgtcgtggctacaccgcgagcaaactgatttggcaaaacgccaagcaagcccacaagaatcccgacaacggttgcgaagaagatcgcgacaatcgtcacaatcatggtttctttcaagccacccatcaaggttccccagttttcgcgcaataatccgagaaaactgcgatcactatcttgagtcttggcactggtttgtttttgggcggcttgtgtgccattgcctaaatacttggcaacgattttggcatatgtaccgtcagctttgacctttttgagtccggcattgaatcgttgatcaagatgatcgctacgatccttttgtgttgcaaaaccgtaataactggccttactttctggaccagccagcttgagcttcaaccctgtggcgatggcatattgcagaaccggtttatcatcaaaacaagcgaccgaattgccagtgatgacatcctgatacatattgttggaatcatcgaaggtcaccgtggtaaaaccatactttgccttcaaacttaaagcatagtctgcagctgccgtcccagttttcaaggccacacgtttgccgcgtaaatccttcaaacttttgacttcgctattttgccccacggccatggcaaccgccgttttgtaataaggatcactcatggcaaacttttgctgccgctcaggagtaatctgcataccagcaatgacaccatcaatctgattagcttccaaggcctgcacagctgcattgaaccccaaaggtttgatatcaaccttgaaaccctcggcctttgcaattgcctgcatcaggtcaatatcgatcccgacatactgattatttttatccgcaaactcaaacggggcatacgtgacatctgtgccgatcacataagttttctcggccgcctgcgttgacaccggtgagcctagcacgaccgccagcatcaacgccatgaccccagcaacgcaccacttccaaactcgtctcatgaaaacaccatctttctcatttagttcctgtttctttcaaaaattgctaatgacgcatgctacttcaattcatgtgttttgagacctgtaaacccagctcccattcacagcttacaagtgtaccgatttttctaaaggttgtctacgcgcaagaaaagcaagattgctttatactaagagaaacttaaagaaaaatgtggtgaccttatgtttagctacctaatcgactatgatttgaaactttccctaccgcgaccggaaatcgacggtccccttttattcgaacaaattgagactagccgcgattcgttggctgcctacttgccttgggtcgtaacgacactgactgccgacgacgaaatcaactttttaaatacaacactcaagctttttggtgcaaggactgccttgcatctgaccatttatcaagccgatgctccagttggcatgatcagtttgaacacgatcgacaccttggttcgccataaagccgacattggttactggctaaccattcccgaacgcggcaaaggcattatgcacaaatccattgaagcattggccgatattgccttccacgattacgacctaaataagctaaccatcaatgccgctgtggcaaaccgcgcgagcaatgccgttgccgaaaaagccggctttcatctcgatggcactttgcgtcaagacgatcaacgagctgacggcaccttcttagatgtgaatacttattcgctgttgcgttcggagtgggcttaattgtttcatgcgaaacaattgtcacctccagctcaccacgccatatgaaaaccccgcttgcaaaatcagcatgcggggtttatttttgcgccctatttctaattaggtcaatgtacaagcagtcgcagcaacgctggcgtcacaaagccttcgattaaggcagcaacggcaatcatcggaatgatgatgcaaacatactgtagtgcaatagccttcacatctaacgacgactttcgataatatggatcggcaaaaaaacgcttgattgactggcgaagggccttgttgacttgagcagcgagcgcgacgccgataatcaaagcactcatctccagaataccatgtggcaaaatgcctaagacaaacgctgccaaagcaccaccgatacccagcttagcggcataaatgcctagcaccaagccgacagaagcacaggtgagataatacgaaatccagtatagaaaaggaatcggaatcataccaatgatcatgaggcaaaaggcaacgcgttcgttattcactaaaatggcccaaaatgcactgagactgtcgtgattattagcaaacttgccagagaggccagtaaaaataccacgaacaaagttggggttcgcgcccatgaccagatatgtcaccagaccaacaaaaatggtgacaccaaagaaaatgagccaaccgatcaatagataatggccaataacattcaaattgtatccgagccgtttcttcataggttgcccctctttcctaataacagatgctagggtaagtatactccagggtggaaagggtggctattttgagggtttggcggtatgtatcatttttctcctaatcaggccttctcctattatccaagcttagtttccatcagttctcactagccgttacttatccaacatcgtgccacgaactgggacgtttggcgtcgcctattttcttgttctgccttagcactaaaattgagatgacgctctgaataaatgcctttataaactataaacagcgtttcacatctttcgccatgccagccgtcagttcgcatgcttgctgtttagctttttttcgtgaataatgacggcatggaggtgtcatgatggaagtcaatgaagcacaagccatttttgatgcagcgcgggatcaagtagcgacgattgtggtgggcaaatctatgccgatcacattgactttcaccgccttacttgcaggtggtcatgtgttgttcgaggatattcccggtgttgggaaaaccaccctcgttcaagcgatggcaaaaaccttagcggtgccattttcccgcattcaattcacacctgatatgctgccaagtgatgttcttggcacatcaatctttaatcgggccactaatcaattcgaatttcaaaaaggacctatttttaccagtattttattagcagatgaaatcaatcgcgccacgccacgaacacaggccgccttgttagaagccatgggtgaaggacgggttacaacggatggtcatacctatcagctagcccctgacttttttgtcatggcaactgagaacccgactgattatgcagggacttacccgctccctgaagcacagttggaccggttcatgcttcgcctctcacttggctacccagatgctgacgcggaaaaaagtttgctgctaacgcctgatcgtaaaacgatgattgctcaattaacacctagactagacgcatcgttactagctgaagccaaaaaactcgtggctaacgtgacggtcagcgatgcaatcgccagttatgttctcgcgctagtacaggcaacccgacacgacaaccgtgttcggctaggtatcagcccgcgtggtggcattgccttggtcactgccgccaaagccttcgctacgcttaacggacgtacttacgttgatccaagcgatattcaaacgctactcgatcctgtttttggtcatcggctcattgccaaggatccgacactttcgacggcaacgatcttagcagatattctgcaaaacaccgccgttccgattcgggggtgagcacatgaactggcgcaacttttttatcaatgctggcattttgcttgtgctcagcctgctgatcgtttttggcgtggcatttaactcatctaccagctggtttgccagtgactttgctatcctgatactactacttgcgataccgctattgtggccattgaaaaacacactgcgtttcacagcagataatcctgacatgatcgccgatagaccggtaacgcgccttttcacgctgactcatggcagatggctacctaatctttttctgcttgacagtgccaaaacacatacatggcatttgccaatcggacaacggacagccaaaatcagtttaactttacagcgcggcatttatgatcagttaccgatgaccgtcaccgtgactgatttattcggctggtttcgtaaaacactacccttgcgtttagccacaccgatcactgttggccccgcacgcagaccagaagctgccgcacgaattgcagatgacttttcgcaaaaaatgtccgctgctgacgctggcttgcccagtgaccgcattaaaaatttccgcgattatttcccgggtgataatattcaacaaatcgcttggaaagtcagtgcacatgccgatacgctgattgttcatgacgatgagcatgaaggtcaggccagctggacattgctgttgctaatcacaccaacgctgtcactcgagcctgccttgagcttattcgcaagtctcatggacacaggcatcttcagcgggaacggctatctgctagacagtcggttaacctccgtcatacaaggacggcaaaacacatcgctagccaactttgagcctgacggtaccgccacgcctcattctttagctgctttgaccaccccacaacatcagcatcgcgcctatcttattttaactgctgatacacaggccgcagtgcctttcacacatgcactggctccggctgctacaacactagtcgacttgtctggaggtgatgaccatgcctaaatggctacaacgtctccttaccattttgctgatatggtggttattggcactttttgtacagcctttctcggtgattaatccgatagcacatcctcgtgaactcgcaggctatgttgtcatcatcagcttaattagttatcttgccgcattatggccacgggcttggccaatttggctaaccactgctttcttgagcatgatcgttggcctttgggcaatactgccgcttaaacagcattttggtattacctggtttaacacttatgtccaaaccttcaataccgcgactaggcggtttttgcaagttggtggcgtggatgtccctgcgaccctcagcatgacgttgattgtagctcttgtcgcctttctactattaataaccgttgttctccaactttatcctggcgcagtggccattgtgctcagttatttacttgctgtacatgttttcaatggcagcgacctgacgacacaatttttccagctcgctgttgttaccgggttgttggctgttttgcacctttatcacacccgctggcgagcgtttttaattggcagtcttagtattgttggcttaacccttggactcatgtggctcagcaccagcactccgttgaatgactggttaactaatatctctgttcctgcgcgcgaacgactcaatcagcgaggcttctatgccagccttgaagcttacgctaacggctcaggccgcacaggattcaccgaaaacagtcgtgttttaggcggtccggtatatgatgatcccacaccagtattcaccgccaccagtcgtgaagctcattattatcgcgtcgaggttgactcattttatacaggaacgggttggcgaccatctacatttcagacgcaagctgctcctttagacggtgctattatgcgtgatccatcggctcgagtcgattatggtcaagcaacgtcagtgaaactagtttttaacggcggtaaaacctttttgccattaccatatgggcaattaacttttactggcggtaaaccagaccccacgaccgattttttgcttaactcagccacacaaaggataactgcgagcgatgatcaacgcttcgaacgcctcgatattcaggtgcagcaaaaacagtttaccgatacgcaactcgaaactgctacgagttcaactcagttaatttcatctagttatttacggcttcctagttcactaccgcaacgagttagaacactggcaaaaagaatcacagctgatgccaaaacaccttatgaaaaagtcatcgccattcaaacttacttgcgctcagatccgcgcttcacctattcaaaaacagatgcacagcaaacaccggcaaatcgtgactatgttgattactttctgttcgattcacctattggttactgtgataatttttccagtgctatggttgtcctatgccgcagcattaacctgccagcacgatgggccaaaggatttaatactggtacttttgaaggcggaagtggcgcgaacaaacaatacatcattcgcaatagcaatgcacactcttggccggaaatttatttcaacaatttaggctgggttcccttcgaaccaacaccaggattcagcaatccggccacccctgatgatcctgcaatgccttccgcggcaagcaatacagtctcacaatcagccagcagttcagcagtcagctcagcagtatcttcgtcagaatcgcgttccattgtgagcgcctcatctactcaaccgaaaccgtcttctcgatcgtctctcggcagctttcattggacagctatcattgttttgactgtcgtcttgactttatgcattgtcttaatctggcaactaccagcactggtggcgttcaccattagtttcaatttgacacagagaaactttccccgccgttatcgtttgttactttggtcattacggcgcgtgacacgacgccagtcaagtcaaccattgacagtctatgcacaccgtattgatacacgattaggcgatcaacgacacttcaccacgctcacgcatgcttacgaagcttggacttttggacatgtcgcaattcatcctgacccgctcacaacatccctaaaatccttgagcacgcagcttgcccaatacgcacgacgcaaattccacgtgaaacaaaattaactttacgcaataatcgttccacatgaaacacagcagcatctctgctgtgttttttgagtgtttaacaaaaatactcgctttttacataccactaatgccggtactatttccaaaaaagtttcccttactttcctagaaattctcgttaaattattcatccctattcattgtcataagcaccatctgaaggtttcacatgaaacataacacctattattcatggaaatatcacaattcattcttttccggctcgtctaccccgtgagaaccttgctataccaacatttaacagaaaatccttgcacttactaataaaaagcgagtatgataatacaaacagtttctgagtagaccttagaaattgtttggcccctgctgctattcttttagcagccgtgccttttcgactggactctgcagttagatcgtgacgtactcagaagaaaggggggagccgctgactttagcggcgaacacttatgaaagttatgatcgtacttgaaaacatcgtcatggacggtgttaaacgcgcatcaactgttttaggaaatgatctcgttaaacactatgatgtcagtttctatagtttagcagatgcccctgcatattttgaattggacgccccgctgcttattgccccgcgtccgacagatcccaagctgcttaacttctttgggagcgacccatatacacattatcgtgatcaaattaatgacttgattatgacgattcgtgaccagcattttcaggctgtgattttgcctgctggtttgacgaccagcttcgcaccgctcatcaagcaggcattaccagatgtcaatctgattggctggatgcacaataactacgcaacgtacatggaagattactacgttcaaatgcaagctgagtttgaaggcggcttgcaagctgttgataccttggtcaccctcactgaaagtgacctaaattcttacaagcgtttcaatccgaacacggttaaaatttacaatcccctcaccctcgtcccaactggtgaggcaaatcttgacgcacaccggatcgccttcactgggcgcattgcgattgcccacaaaggtatcgacttcttactcgaagccgccgcatctttaccagatgactggcaaattgcgattgccggctcaggcactgatgaagatatgaaaaatttctacgatttgattgactatttccatgtggccgacaagttaatctaccaaggcccactgaaagaccaagccttacgcgatcattatcgtaatgcttcaatctttgtatcgacctctcgttgggaaggtatgccgttagttatcggtgaagccatggcttctggcttacctatcgtagcaatggaaaatactggctcacgcgaatatcttggcaacaatgactacggtttactcacaaaggcacaagacgtccctgatttcgttgataatctcaaaaagatgatgtcacagccagctttacggcatcattatgcccatcaaagtctcgaacgtgccagtcactttagccccgaaaccattgtgagtcaatggatgccgattatcgaacatcaaccaacccgtgtttcagttactggttaaccaagccccgatgcaagcgcctgttgcatcggcttttttgtgagcgcgttatgatgatgcacgcacaatcccgattaaaaatcggcccataacgactgtagtttggtcatgacagccaagattcggtacaatgagcttatcttaagtatggaggctctaaccaatatggaatcaatgaagcaaagaatgcttggtggcaaactgtataaagcaaacgatccagaaatcagcgttgagagtcagcgaggcagtgatctcgtctggcagtttaatcacttagcccctgataaaaaagcagaacgagctgcggttttaaaacaattatttcatgcatttggagacaataactacattgagcctcctttctacgttgactacggtgctcacacgtcaatcggtgatcatttttatgccaacacagattgtgttttcttggataccgcgccaattaccattggcaaccgggtttatttagcgcctaaagtgagtttatttacagccggccacccaattgatgccgctatccgcggtgaagatttagaatatggtaagcctatcaaaattggcgatgatgtctggattggcggcggcgtcattattaatccaggtgtgaccatcggcagcgatgttgttatcggttctggatcggtggtcacaaaagacgttcctgatcatgttatcgttgctggcaatcctgctcgcatgattcggcggattactgataaagatcatgcccagtggcaacaacaaaaagatgagttcttaacctggcagcaacaggctgatgaaagccaacaatcaaagcagtcttaactgaccattaacggagagaacaatgttcaaattaatagcaacagacatggatggcacctttttgagagacgatatgacctatgatcgcgacttttttgcgacgttacatgaaaaaatgcaagcgcaaggcattcagtgggtggtggccagtggtaatcaatactttcagctgacttccttttttgaagctttccctgatacgatttatgttgctgaaaacggcgcctacattcgcgatgctaacaaagtgtatgctttaagttcttttgaaaacggtgccattcaaccaattctggctaaactatctagcatacctgatctcaaaattcttgtctgtggtcaatcaagcgcctatgccctgaaaagtactgatgctgcccatatcgcaacggcacgacaatactacaagcaattacgtttagttgacacttttgacaatctcgatgatcgcattttaaaatttgccattagttgtcctccagaaaaaaccgcggctattgttgccgaaatgcgccaactgttggttggcttgggagaaccgacaagcagcggccacggcgacatcgatatcattcaacccgggatgaacaaagctgccggattggcaacacttggtcggcatttaaacattcaacttgctgacatgtgcgcttttggcgatggcggcaacgatttagaaatgctacgggaagttggtcttggtgtggcgatggcaaatgcaacgccagcagtactggcagtcgccgacacaaccactaagagcaatcaggaacaaggtgtcttgcagtttatgcatcatctgttatctgaaccctgaagccttgttggaagaagccactaaaaaggaggccgcatgcatctcgattttgcgatgcatgcggcctccttttttgtgttccacgtgaaactcactcgaatacgcggacgtttcacgtggaactaggcttaacaaatccctacttttcagcaattgataagtctggcactgtttcttgattcgtcatgaccatcggcgaaaacaatcgcgcgatcatcgcagccgacagcttatgttccgagcgcaacaagtcaggaatagcaacgtgctgcttcatgctgtgctgaatcaatctagccgtcgcctcataaccaagatacgggcttaaaactgtggcactgatagccgaatggtgaaccgcggtttcacactgctcacgattaaccgtcagcccagccacacagtttgacgttaaggttgcaatgccgcgagccaagtaccgctccccttgcaacaaatcacggaaaataatcggctcaaaagcattcagttcaagctgtccggcttcggctgccatactgatcgtgacatcttggccaatcacctgaaaggcaatttgattaacgacttctggaatgacaggattgacctttcctggcataatcgatgaaccagcctgttttgctggtaaatgtaactcattaagtcccgcctgtggaccactgcttaacaagcgaagatcattggctacttttgacaagtcagtggcaagtcccttcatagcaccagagaaggccaccaaaacgtcgcagttctgcgttgcatcaataaaatcctcagctggcttcaattgcagatcaatcaattgattaacctgacgaataatatgactacggtaataaggcgacgcattcaacccagttccaatcgccgtaccgcctaagttaaccgcctgtaaatcggccgcagcccgtgtcaatcgggctaagtctcgacggaacaagctggcatacgcgtgaaaactgtgtccatatgttgtaggaacagcgtcttgcagttgcgtgcggcccactttaacaacatccgcaaactcatgtgctttagcgtccaaggttttgatcaaaaacgttaatgcttgtttcagcggtggcaatgcctgtaatgctgccatctttccggctgttggataagtatcattggtcgactggctctgattaacatcatcatttggatgaacgcgaatcgttttgagctcagcgctggccaaattggcgacgacttcattgacgttcatattcacggaagtcccagcgctgccttgaatcgcaggcgccaccaacgcatcttgatgttcccccatcagcaagctgttgcacgcagcaacaatcgcccgcgactttcgaacatctaacgtacctgcagctgcattcacttgtgcagctgcttttttaatgatgatcagacttttgaaaagtagcggatcagttcgctctgtactgatcgggaaattcgttagcgcacgggtcgtgtgaattccatataagacatcctcatcaattgccaacttaccaatacaatcttcctcgatacgcattgtgaacttcctttcatataccaatatttactttatcagtataatcaggtaaaaacgtgcgtcaacgtttgttgttaggtagtctgacaacacctataaaaagtataccaatttaaaaaatcactgtgatgaagcttaaatgcgttaaacgtattcatttaacaggtaaccgtccgccgtcacgccattgcccgatcatttgctgtgcttgacaggcgttagcaaactttgtcagccgttgacgaaataatttaggctggtgacttttgatttgaatcgtgtcacaacggactcgttgatacaaaggcggacacgactgaaaatactgccacgcacccggacgacgtttaagtgctcgaataattctgggatcaaacttgaaatgacgcgggttcatatcaggcaaaacagcatacccagctgccgtcatcttccctaagtgaatcatgcggcgacatcgttctttattcaattccgaccacgcgctccccacttttcttggtacaaagcgctgcgatgctggttgatcaggtgccaactttttgtaggtactgtcgatccagccaaaacacatggcttcttccacggcgtcaacataccaaaacgtgtcatcctgtttcggtacaccacgcttaacgtctacccaacattccgaggcgtcttgatagtgagctgttaaccaactacgaaattggtggcgatttgctaccgttagatgattgacgatttttctagtcaataaatctgcctcctcacataacaactttcaatggtcattttacaaaaaaaatctacgcgacgtatttatccgcgtagatttttcacctaatttattgatgctgaattgcccatcaatgtccctgatgtttttctaaacgtttcgcctgcttcttcaagcgaacctcacaagcgtgctggtctttcagttgcttgcgtcgttgctttttcacctgcaaatttcgcttgtgtgctagcttcaaaaaagttgttgcttgggtccttttagcgttacggacttcttttcgagcctgacgactacgcctttttggacttattgtcatctgtaacttggggagaataacatcctgtgcggctacccaatgtaggtcttcccatcgttgttgaattaaatgtaacaactcacttgctgtcggggcttgtgtcccaaatgtgactttagcaacacgatacgtgtctcccattgtttgttcgaacaatccgcgataaaaaggtcgttcaaaataaactgttagcttgccttgaattgtcaaactaacacctcctttaagattttcacgcaatctggacatccaaggaggaaggatactgacagcctaagccgcgtctggactaccaaccagactgtgtttttgatagcgcaatgttattgtctgactttgataaaggtcctgtcaagccaagctagtgtatgacaatatcaatgtctcttaccaagtgcatataagtccgtttagcctcactactacataggtacttagtcagctgtggactgccttgttaaccatcgataagtcactacttccgtaaaaataagcagtagtatcccaataaccagaatgaatcctttcatagatatcaattcatgtccagcatgtagcctcgtcatggtgacaaggccgcccaacaaaagcaaatgcacgggaaataatctccgatattttttttgaaaacttcatttttatgcaacaactcgtcagcttttaagatttttgctgtcaccctataggaccgacatgccaagatttcgagtcatttcttcacctcctgcagcatctagtgtaacggacgacacgcatgataacgtcagaaaaaaataaacgttctgctttctatgattaacgtcaatattcaaaaaacctccccactaagttgacccttgccaaccttgtcaggaggtttcaatattgcttttaagcttctgcttttgcttctgccgcgtgccggacactttccgccacgacttccgcaacatccccatcaaaagcattaggaataatgttggtggtcgaaagctctgcatccggaattaagcttgcaatgcctttcgccgcagcgatttgcatgtcaatggtgatcttgcgtgcgcgtgcatccaaagcgccacggaaaatgcctgggaaagcaagcacattattgatctgattggcaaagtcgctccgcccagtaccgacaatataagcacctgctgccaatgcctcatctgggaaaatttccggctctggattagccatcgcaaagataatcggcttgtcggccattgttttgatccattctggcttcaaaacatgcggcgcggatacccctacgaaaacatctgcaccttgcagcgcatcttccaaggtgccagtccgattttcatgattcgtgattttcgcaatggcggcatggtgtggcggtagttgatcggcattcttttcagctaagataccaaccttgtcgaccaccatgatatgcttaacgccagcggccaagaagcgccgggcaacagatagtccagcagaaccgccaccgttgacaacgaccctgatatcgccaatatcctttccagagactttcagtgcattgtatagcgcggcaagaaccacaatggcagttccatgctgatcgtcatggaataccggaatatctagctcctcgatcaatcgcgcctcaatttcaaagcaacgcggcgcactgatgtcctcaaggttaattccgccaaacgttggggccactgccttaactgctgcaataatctcttcagtatcttgcgtatcaagcacaatcggaattgaatcaacttttgcaaaccgcttgaacagcgcggccttgccttccatgactggcatagcagcttcagcaccgatgtttcccaaacctaatactgctgaaccgtcgctaataactgccactgtgtttttcttggtcgtcaagtcataaaccaaagacttgtcttttgcaattgccgaggaaaccgcaccaactcccggtgtataagcaatactgagatcatcccgcgtctcaatcgggacctttgagacaacactgagtttgccgccaaattcttttgcctgatccagtgccagttgattaaaatctttctttgccatgattcttttcccccttgtttaaagtgcgctcccaagtcctgaaactggactggtccacgctccacctaaacgcgatcgctggccctgaaacctgcgtgtaaggaccttggtcgcaatggtcaaagcccgaccatcacgccctaggccacttactctccggtttctaaccgggccgactcacgctctatctaattatgaaagcatccgtagaatcgcggtcattgagataacagtgatggcaccacccaagcgtgttgcgacctgcgcaaatggcatgaggttcatgcggttggcggtactcagaatcgccacgtcgccggtcccgcccatgccgctttgacaggctgtcacgatggccgtttcaatcggattcatattcaagaaccgagccacgaagaagccggttgaaacaaccgtcaacacaacactgatcacgacgataaaatattgccaacttagcataccaaccacatcttttagcggaatgtataagagaccaagtcccgccatcaatgggaaagtgaagttactggaaataaatttatacaattgcttagcgccacgttgcgtttctcctgggataacgttgagatatttcaaaattgcagcagcaacaatcatcagcactggtcctgggaagcctgtgatggactgaagcaacatgcccaagatgaataaagtacaggcggtcaagacgccagcgcccatcattttcaaatcaatttcgccggtatcgtctttcatcgcatcggcgagatcatcttcggccccgtttaatcgaaccagctgcccttggcctgacaactctggccgcttttcccctaatcgattcaataaacctgaacacataatcgcgaaaaagtttccaataatcgtcgccggaataagctgagcgacaagcgcgccgctggtcgtgcctgtgatcgtgctgtatcctagagatagcggtaaaataccttcaccaataccgcctgccaatactggcgtgacgatgaagaacatcgtgtgtttccattccaaacctagtaatacgccaaccagtgtcccgacacccattgcaagaatcatgccgagcatcattggaataatcatccgcatcaatccttgaatcagaattttacggttcattcccaaaatactgccgcagacaagacaggcaatatagaaataaagaaagtttgcttgtttcatgagcatgtctgcagcttttaacacattcggattcatcgcattgtagaaaacgagaatcgaaggtaccaacagcgataaaatcgccggaccgccaaagttcttcacaatcggaatattggctccgatcgtacctaataaccaacccaacgtcagaatgaccgcaaacccgccgagcatgttaactggcagttgctgcatcacaccggcaaggacgatgatcgctgccatcacgatataaactggcaatggtaccgaccctaccttgaagtccatccactttttctgcggactcgttgatttgttgggtgtaaccgtcttgttctccatgtttccttacccccaatcttttgttacttacagcatattgtaagcgcttcatcaggggaagattatttaacttattaaaccataaacccatttatttaagcgattgttttactattcacaagatggtttcttttctgaacaggagtatgatcatgaaaataaaaggatggcggctatggggctggctctcattaatttttacttccaccttgttattaacggttctaactgtttatggtttgaccatgctggaaaaccgtcagcaatttgaaagccgtgaaggtcaattgttgatctcaattggccgtcagttagcaaaggatccccgtgtaaccgccgcacttgaaacaaacaaggctgattcagccacgcgcacctacgcagggactgtcgagaaaaattttgatttagattttgttgtcatcatgaatatgcaaggcattcgcctgacgcatcccgatcccaaacaaatcaatcgacattttcaaggtggtgatgaagtgactgccttgcgcggtcatgagcatgtttcggttcggcgcggaaccttgggccgctcactgcgcggattcgtcccagtgtatcgccaaggcaaagagatcggtgttgtggcactaggcattaaggtcacctcactgcaaacactcatcaagacctcgcaagatggcttccggctggcgctattcgccggtacgatcatgggcctgttgacagcgtttttagtcgcctactatattaagcatcagcttcatgaccttgagcccaaagaaattgctaggctgcttgaagaacgcaatgcaatgcttgaagaaaccaaggatcctgtcattgtgattgatttgcaccaattcatcatgctcatcaacaaagccgctgccaagctgcaaaatcaccttatcaccgaaagcgcctttattggccagccattgacgaccctgattgccaaccctgaacgtgtcaatctgaatgtcaaaaccgagcagttttatcaacaggatggccaggattatcttttctctgctgcacctatcatggtgaaaaaacaaaaaataggttacgttatctttctacgaaacgctaccgaagcgatctttgtcgccgatcagttggccaacaccaccgcctatgccaacgcactgcaaagccagtcacatgaattcatgaataagctgcacgtgatttacggcttggtggcaataaaacaatatgacgaattggccatctacttgcaagatttgttaaaaccagagcaggaatttgcaaatcgcttggccttgctggtcaaaaatccactcgttgccggcttcatgattggtgaacgcgaaaagtttgccgagcgcaaaacgaccctcgactttgaaatttcccccgaactaccacctaatcctaatacccaagaaaccaaaacgctgttaacattaagccgctatctacatttcgggctactgcagcacgatttgccggacaccattttgatccagctagagtacgcacagaatcgtctcacgatcgcctatcatttagacgaaccagccaaacgaacggactttatctcgcttattcatcaagactacttccaacaactgctgacggagttgaacggctcagtcaccgttagctcaaccgatccgctgacactaacattaaccgtggactaccacgaggaggctcaaaatgacgaacatcctaatcgttgaagatgatccaatggtgcaatttatccaccgcaattatttagaaaaaatcggtacttttgacaccatctactcttcagaaaccatcgctgaagccaaaaaactcttagccagccgatccatccaacttgttttacttgatatccgcctcaaagacggcaacggcattgattttttaaccgacctgcgccgcaccaaacaaaccgttgatgtgatcctcatcaccgcagcaaacgaggtcaacattgtcaatgatgccttgcacttaggcgtgattgactacctcatcaaacccttcacgttggaacgcttcgaaaaaagtattcaacgttacagaaccaagcatcaagcattggtaactgatcagcttgatcaaagtcaactcgacacgtatttcgaaccacaaacaaccatcgctccgacagtcgatctagacaaaggcctgagcaaagccacgttgcaactcattcaaggcgccattaaacaactcccgcaaccatttaccgtcgcacaattaacgacagaaaccggtctctcgcatgtttctgtccggaaatatttaagttttttagaggatcatcattttctgaaaggcgatacgatttatcgcaagacaggccgaccttataaaacttatcagatggtcacggcaccacatgcgctgtcgtaaacatcattcaaatctttaaaaaggcagtgatcttaaatactaagatcactgcctttttgttattaatgattaaggttgcttacatacaatgaacgctgatactgtatttcctaaattagataagtttcacgtggaactcctcagaaaattaagacctacatttggttccacgtgaaactcgctgccactttccacaaaaaccggttcacacacccgttaaagatgtctgaaacagtccattggcaccgtttctcctattttttcgacgcttcaggcaaagccgtatttttgttcgtgatatcaataaactgtgcttcacctgctactgaatcaacggctttttgtagacgacgcatggcggcgcttgcaattggcaaatctacaaagtccttggtcgcattgtctagttcgacttcatcggctacggaatcttttagcggccgcggattgctttcatctaaagcgcggattacaactggcttcaatggacccatctggagcaagtcgagtgttgtttggtagtcaatatcataggcatcggctaagtcaagtgtctcacgaatgccggcctctgctgccatgatggcaacattcgtgatcaatttcagtttcgcaccatttccctgctcaccgacatattttacagtgccaaacgttttcaagataggtgtaacatcagcaaccgcctgtttgtcgccagcggcaatcagaaccaagccagcttcacgtgcatacttcacgccaccaatcattggcacatctagtagatgggtcctggtcggcatgacggcttgaatcgcagtaatcttacgcgggtccaaagtcgaagtcacaatcagcgtactccccggctgcaaataatgcacaatacccggagtttcagtggtcccaatatgaagtgctggcacatcgtctgacatgaccgatgtgataatgaccttggacgctgtcacagcatcttccaatgaagttgcagtgcgaacgtgatcgcccgctactgccgccatcttggcgggcactttatcccaaactgtgacgtcatagccagccttggccaaatgtggcaccatatgactgcccatatcgccaacaccaataaatgttattttcatgttcttcttccttcccgatcgaaaatattcacctaggcaatagatacttaaaaaacaagtctttttcttgaagaagcattttatcaagaaattcattgccagctaaattcgattaaaacaggatcaataacacctgtaaccattaacttagcatgattgaaaaacgatttcaataacacagctcggcacgagtcattgtcgtcttttttccctccgccttacctgtttgatgccaacaaaaagtgttcctaataggtttacagtactaattttttccatttacgaattttcggtcgaaaatttgtaaacggcgcaacactattgatgtgaatccacttccataacggccattgcgccttggtcgtagcccacctccgaacgcctgcatcgaaaagctccgattgtgataacgtctcgatccaagtacacaactccttgaccagcagatcaagcgcagcaagttggtcttgaaggctttgttgaccatactgctcataaaaagattgatacaaaccacctaggttattccatttataggccggtgcgggcgtttcaacctcaataccagcaacctcatcgcgatcccagctcagcaacaagttgagccaacccaattggtatgacagcatttctgacggtgtcttatcaaccccttcaaccagcaactcgcgcttttcttcggggatatcggtaaattccgccctaaatttcgcatagcgctcttcgatcgtgtccagcaaggcttgtttatcggcgtatgttttcaacttgatcagctcctttagctaaagcgtaccaagtcacgttaagaggtgccactctatttgaaaagtagagggagggatgcggcacatatgcaactttgcttgagaaccatgataccggccctcacactgaaaatgttaaatgttatgacattatcgattgggggcatgggaacatggatgaatcgaaagaactagaacaacttggccagttctttcatgattttcgagttggccgcggcctaacgctcaaagaagccgctggtaactggtcagcagctaccttatcgcgttttgagcacggaaaagtcgatatcagtactgaaaaggcagcagggtaattcatcgaatcggtatggagccaatggatttgctcctatatcctgaaccagccagtgcatttccgatgcggattcaaaaactaattgaaatcaatgatatagatgcattaacaaaacgtaaaaatgctttttttgccgctaataaaaaggaaacaagtatgacaaaattggctaacattcttttcgatacggccattcattggccagaaggaaaataccatctcgatgctgccgcggaacaataccttgctgatcgattaaccatgcctgaaaatctaagcccttttgattcagagcttcaaacggccattggagcgcccgcaagccacgaactattagtactgttctggcatcgaaccaaacaaatgcaacacgatctacctaagaatagactatggatcatactcgcaaaactttggcttggtgcgctaatggatcgtgacttagactttttagatcgctttcgaacagacttggaaagcgaatttgtcaagtataatcaattagttgatgcttcagattgtcaagaagtttggccgttcacccgcctgttagagcaatgggttttggcacccagccttcacaacgaacaaaagattgatgaaatgattgccgatacgcaagctatgggatgcatcagtcaagccaagtacttcaccttagcatttgcccgaacaagacagggccagcctcatcataatcctgcattagtggatcatcaagaatctgtcaacgtgaggaaaacaggtagttttatctttcgtagacgcacttatttgggtttgagcttatctgacattgaacttaacagagataggtctaccctcaggcgattcgaggaagggaagacgcaactttccttcagctcattagttaaactaagtgaacaaatggctgttttagtgccaaccttactcattgatatgtattttaaaaaacagggacaaagccaaaatatcacgctcgggacaagttggcgttcgctagtaatggcaaaagatcaacgctggcccaagtcaaagttacaaagcgtcattgatcaatcaatggcatcaatgaaaaatattgcaccgtctttacgccaagctcaactttttgtgttgcagcgtgcagccatggaaataggtatgaccgacgtcgacacagtagcgcattattcgctagctcatgatcttctacctcaaatattaaaatccaatcactggggcttatttgagtatctgatcttgcgttacatttgtcctttgctgtcatttgatgagttatccatgttattccaacaaggaaaacgaatgatgcagaaacatattaactatgacggtgccacttttgcttatgaagcaatgtccgctgtgtttgtcgatgctgttaatgcattaccgcctgacaaagccacagattttttgcatcagttcaagtggttatacagtgttgatgtagccaaacgctcccgctggcaagcaatcggaggtttaaagacagcgcttgatttaactcagcgaacaactgctacaagagcgtcagttcagcagttcattacgtgttgcaaaagcaccggacacggaacggttttggcggatctgagagcgcaatggcacaatttagtacctgaaggatattttgaaatctaatgatgaacttgttattcaacaaggttaacaatttgtgattgaacgcaaaaaagaagcggagccccaaccccgcttctttgaatctcctccacttgggattacccagtcctacctcgctaacccatgactcattatgggtgccgaactgagtacatcccagtaaatttgcatatttgcctcttttttatttataagtcaggacaaaattattaataaagttttcgggcagctgtttcacccataattttttaaggttatcaatagcatctgggtgccccacgcgcagagacgcatggacataacgctcaacgagtattttattagctgtcgttggttcaatcagataattagccagataccaagtcccggccgcttgccatcgcatcggtgttgcatcatgtatcgttaatacccatttaaattgggttaaaaatgatcgccccactttcggcgaatattgatcaacgacgcgcgcaattgcctgattcaaaccactaaaataataatcaatgccaatggtcatcggatgattgagaatcacgcgtcgcccttgctcatatagcatcactagttgatctggggttaaccaatcagccaactcttcagaagcatgagtttccagcgacccccaatgattcatttgcaacaaccgagctaagatgagagatgcctgtttatgcattgccacatccgcatcagacgtaaaacctgctgtgacggtgagtacaaagcgctgtgtggccacgagacttgcaggcatatctggaaattgcgtcgtaaatcgttgaattaaggtaagtatgtctgcctcacttttcccaaaagttttgtgctgcttaatttgcctaaacacagcacgcaaactaatttcgccaggggtgtgttcatcaatctgattaggtaaagtgagaatttgtgaaggtacaagtgccaactcaccacaaagctgtaacatacttgatgcagaaagttgtgtctgaccattttcaaaacggcgcagcgaggttacgcttgcgtctatgacaagatccgcccgactgacaccgagatactcccgctgaaacttcacaacttctcccgctgtatgcgcgacagtgagctgtttgggatgatctttaagttttagattatggtgtacccgcccttcgtttgtatgagccaacatcaactcaaaccagcgtgcatcaacctcaacacccattctgcgcaattcatcaataatctgctgaattttgttcttatttgacgatgatggatggcggagccagtgagctgtacttcggccaaattgccaatttggcataaactcaactaatcttgtccgaccttgctgcggcatgaaccagttcttcagctcatcttccaagccattcaccagatccatatctcgatccatcaacgcgccaagccacagcatcagttcaatgacttcacgaaactgccaccaatctttttgaaggccttgtgctcgttgccacagcaaaattagtaattcatgactggctggtccaacaatggctttgtatagctccaattctagtactgaaaaacgctcaggcaccgctaatcgatccgctagtatttgttcatcttcatcagaaaagcggaattcagcatctggccagtgttgcgccgcttcaaataagattctggcgagttcagtcattgaatttcgttttggatgggctgcaaaaaaacccgctttacgccgttccaactcaccaacgtcattcagttgcgtcaaatcctgtaactgcaggggaaaattgaccggattagcttcgtaaaactccaataaatcgagctcatcaatgccaattctggtcatcaattcaagcattttttgcgtgctgatatctagctccccacgctcaaacctcgataaagttgctgccgaccattccccactaacttcttgaagcgttaatccccggccaacccgacgctcatggaaaaagcgacctaagtctaataagttgtcgctggtatgcttcattgtcatctgtgacaacctccccaattaaatatcatcacactaaatatcatacatcatgatgattagtaacacttggatgaacttagctataggtaactgtttcaattatgcaaggttttcttttctattttaagccagaatggtttcgctttcgaaaatttgtctgaatgataagcttcaatcaaaaactaacggattaagagtccgttggtgatctagttttggcattcttagaaaatagaagattaatatactcgccagatacaaaaaactcacttaaacctcacagatccgattaatgggttattccgccgaaagaagacgccgagcatccgcttgtttgtctggatgaaaagctctttgtcctgcatggtgatgtcatcaagccgttgaacatgcggcaaggcagtgtgaaaaaagtagattatgaatacacgcgtcatggctattgcgccatcaccagtttaatcgaagctttgaccgggaaacagtccacagatgtgcgccgacatcgaacggctataaactttgccgacatcatcgaatatttagttgaagtcttatatccgaagaccaagaaaatcatgttagtcatggacaatctgaacacccatcggccaggatcactataaaagcgtttcccgccagagagccaaacgttactggataaactggagattcactacacgcctaaacacggcagttggcttaacatcgcggaaattggcttgaatctattaactaagcagtgtttacagaggtgacggataccagaagtggccgtgcttaagtgtgagttagaaacttggtgtgatgaaagaaaacaactcaggctggctgtgaactggcagtttacgactcaggatgcgcggattaaactgagcttgccttatcctaaattgatgtaatttattattattttcatgacggctacggtacactagattacatgttctttcttgagaacaagtggcacaaattggcacccaaagcactgcgaagattacgccacagcaaaataaaacgattactcaaacagttctggcgctggtgcgatacgagtgatgccttaccgaagagtagtttcggaaaaaccatcaaatatgctcaggatcaacgatcctacttaaacgcaatcctacaatatgacgccatcgcctggagtaataacgcaaccgagcgcaacatgaaaagttacgtcatgggacgcaagaactttttgttcagcagtgtgccataaggcgcaaaagccaacgcgattttgatgaccatgattgagaccgccaaagcaaacggccttgatcctatgacttatattggttctctcttagatgaactggcacaatttcctgagtggcgaaaatcgttagacttgggagactatttgccatggaattaccccaaattgatggctatccgggacaaagcttgaagaaacgaacaaaaacaaggaatgattccgggagacatctgactgtccctagagatcactccttatttttttggtcaatacgtcatttggaagtgtgcttactccgacccaacactccatagtaattaaaaatgcagctagatcgatactgatctaaccgcaaacggaacatgatgccgtttttgatgagatgtcaatatcgcatcatttggtgattactaggttatacacgacgcttgcgctgcgaatagccaaacatgcctaagatggcaacaacgactagaccaaaaacgctcaagccactcgttctttgttcaccagcttgcggtaaacttgcagttccatgcagacgtgtcattcgactatccaccgaaacgtcattattaaatgaggtctttttaactgatgccttggttgcaacacgcgcgatgacgttgccgtacatatcaaccatttgcccattgataactgtccagccagcaaccggcttaccgccgtagtcgacaacgcgcccgccgacgatccgataaccgtctaccttagcctttgcttccgaatcaagccgatgttgttgccgagaaacattttctgctaagctttcggcaacttgagcaatcttcagagcttgtttagaagcttctaaatgcgcttgcgcatcggctaagttagcatttgctgctgctaaagctacttccgccttggtcgtaacatcttgagcagtcgttaagtcagcttgccgtattgacaaagtcttctctgcttggtcgactgcagtctgggcagttgctaaggctgcctccgccttagcttgtgcgtcttttgccgctgccaaaacatcttgcgaatgattcagtctatataaattggcctctgcataagtaaccgcttgtttagcagatgtcagtttgttcttggccgcttgcaaagctgcttggtctttgtctcgctgagctttggcgtcagtgactgcagtatctgcttcagtctgtttagtttgggcagttgccaagttcttctcagccgccgactgagctgctctggctgcattgagtttcgcttgcttgaccgtgagatcttgttgactttcctccaaaactttttgtgcagctgcaagagtagtctctgctttggtcaatgtagtctctgctgttgcaagtgcgttatcggcgtagctcttcgcgtttactgcggtctgttgaacgatcaccgctttgctataggcggcctgcgcatcagcgtgcctagcagctgcctgatcatacaccgattgtgcagcagcttgtttgctttgaaccgttgttaaagcgttttgtgctgatgtgagtttaatctttgcgtctgcgagtgcagtttcaagtgctggaatgttagcacttgaggtataggtagcgtcattgtttactgtggctatatcgatactcaagaatagtaacggaccgccactctgaaaagatatcttatccgctaaaactttagttgcttctttagttttactaaatcccaaaataggttgaagtacagaagctgcatacacgccttgaaaaccatcagtatcattgctggtaagggtttgtagaacgctataattaattaggttatccttaaggagagccatgttataggtcgttattggattagcaggaactctgtcaagccatttgatattaccatcattttgttttgctggataaaaagctcgagcatataacgtaaacccacctgcagtatcagtcgggcctacagctgcaacttttgttgttccattgacggtatcagcgctaataatccctggcatacctaactgcgtacgaatactattgatgactgcaagataaatatcttcaaaatgcgttttctgagcatcactgagtgttttaaaggcatcaacatactcaattgagctaacaccaatcgtttggcccttataagacttagtagtatcagtatagtttagattctgtgaccaatctgcagccgttggtttataagtgattttgagtccacgagcaatggcaacaagattctcggaaagaaacttcgaattattggcattaccagtcaataaacttgccgctgcggcttttgcagcatcagagacagtaacgctgattccctcggccgcaagattaacggtagaagtatttttcgcattatcaagcactttttgcgcgttcgcaaccccaacctgcgctgttgttaaattggattgagcgttggcagtgtcagccttggttttgtccaaatcggactttactgcattaatgttagctgttgttttatttagattggcctttgcattatcggctgtctgactagcattggctttgtcggctgcagccttgtcagctaccgtctgcgcttcggtgacagtggatttagcagtactaacgtcggattgggctttatcaacatcggccttcgcgcccgctatatccatcgacttttcagcggctgcggttgcctgtttggcagcggcgactttggcttccgcatcggcggtagactgggctgctgacgttgcttgtgaatgcaactcgcttacactttgttgatccttattgacttgatcttgcactttatcaacaacagattgtgcaacttcttggtcagctttcgcatcgctgacttgaccagccgcttcagatttggctagatcggttgcggcatcggcagttttttgtgcctcaactgtattaattgccgctgaactgacagcggcggatttttggtcagcatcggctttagcttggtctactgcctttttagctacattggcttgcgcttgagccgcagcctgctgggtcgcggcatcaactgcagctttagcagcggcatctctgtccttttgagcctgatcaacccccccttggcccttgaccacgctagcctgcgcttgttcgactgatgtttgagttgtttgattcgtagtagagatattagcagactttgaaacaacagctgcttctgatggtgcgacaggtgcttgggcgtcagcatgaaccgttttgacaccgcctgccacggcgagcgctgctgcagttgctgcaacggtatttaatacagattttttcataaacaagtctcctcctcagatttcgtgtaaattcttttaaccttcttatacttactttccccaaccagaaagttaactaaccggatacatgttaactatgcaagcgttcttccctgatgtgaaggatatttgcatatatgcatatcggagttgaatacgttcttttttcgtcatgatcatttgtaatacgattcagtatatctttttacattaaagaaagtgagaccttcaacgcactccttgattctcgtccatttagtgttaatcagtccggctttgctaatcttagttacattatgggtggtggaatatcgccaaccaacccaacttgcttttttcaacttcattctctataagccgtaacacaatcattaataaagttctctggaacccgttttagccataacttttttagatgatcaatggcatctgggtgtccaacgcgtaaagatgcatgcacataacgctcaacgagatttttatttgctgtcgtgggcgcaagtacatagttagcaagataccacgttcctgcagcttgccaacgcatcggagtcggatcaggtattgtcagcacccacttaaactgggccaacatagtccgtcccacatttggcgaatagtggtcgacaacttgcgcaatcgccttacttaggccgctaaaataatagtcaataccgactgtcagcggatgtttgaggataacgcgctttcctttttcaaacaacatcgttaattgctctggcgataaccatgtagttagttcctcagttgcgtgcgtctccaaagcaccccagttattcatttgcaacagccgaactagtatctgtagtgcttgttgacgcatttcttcatccgaatttggttcaacgccagctgctgatctcagaacaaagttttgtataacgacgatacttttgggcataccaggcagctgagttgtgaattgatgaatcaagttcaaaatatcatcgttatttcccccaaaagtttgaatttgtgttacctgcctgaacactgaccgcaaactgatttcaccgggtatatgttcgtctattcgattaggcagtgtcagaatctgtgaaggtaacagtgcaagatctccgcagagttgcaacatgctggcagcagacaactgagttctaccattctcaaatcgtcccaatgaactttcacttactgccacggcaacgtcagaacgactaacaccaagatactgacggcgatttcgcacaacttcacctgctgtgcgagccaacttcaattgtttgggatgatcaatcagatttaaattatgaaatatttgacttccgcgggtacgggctaacatcagttcaaaccaacgagcatctgtctcgacacccatcgtgcgcaaatccgcaatgatatgatggactttgttctcattatgcaccgttggatgacgaagccaacgtgccacaacatgaccgtattgccagtttggcataaattcaaccatccgcgtgttcattcgataattagtgaaccacacatctaagtcggtctctaatctgtcaaccagcgtcatatcatgatccattatggctccaagccagagtagcaacacctgcatttcacgatgctgccaccagtctttttttaaccgctgcgttcggtgccaaagcaaagttaataattcatgactagctggtccgacaatagccttaaatatttctaattccagaattgagaagtgctcaggaacagctaatcgatctgctaaaatctgctcgtctttctcactaaaacgataattagggtcaggccaatgctgtccagcttcaaataaaatacgggcaagctcggtcattgaattttgtcttggatgggcggcagtaaaccccagcttacggcgttccaactcaccaacattattcatttgaatcaattcctgcaactccagggggaagttacttggattagcttcatagaactccaagaaatcgagttcatcaatcccgactctcgtcatcagctcaagcattttttgggtactgatatccaactcaccacgctcaaatcttgataatgttgccgctgaccattcaccactaacctcttgaagcgttaagccccgaccaacccgaattttttgaaaaaaacgccccaagtttagcaaattgtcgcggttcttttttcctgtcattcgtgacagcctcctccaaataacacctcgtgatgctagttttgtctttcgttagctatttcttgtgatgcccgtttatcaactagttgaggcaatgctaactgtaccaaaagaagcggagcccaacccccgcttctttgaatctcatccacttgaattacccaatcctattcgctaccccacggcttattatgggtgatgccacgagtgtgaccaagcaaatttgcatatttgtccctttattatttataagccagaacaaaattcttaataaagctctcagggagtatgattaaccatagctttttaaggttatcaattgcatctgggtgccccaagcgcagagacgcatctacataacgctcaacgagtttgtttgttggttatcgttggtttaagcagacaattagcgagatgccgagtccctgccgcttgctacctcatcggctttacattagatatcgtcaatacccattgttatcggatgattgagaatcacacgccggccttgctcatatagcatcactgattgatctggtgttaaccaattagccaactcttcagaagcatgagtttccagcatcctccaatgattcatttgcaacaaacgggctaagattaaggttgcctgtttaggtattgccgcatcagacgtaaaccctgcgctgactgcgagcacaaagcgttgcgtcgtgaatcgctggattaacgcgaaaatgtcctcctcactttttcaaaaaattttgtgctgcttaattttcctaaacgctgcacgcaaaccaatctcgctaggaatgtgttcatcttcatcagaaaagcggaattcagcatctggccagtgttgcgcagcgtcaaatcctgtaactgcaagggaaaattgaccggattagcttcataaaactccaataaatcgagttcatcaatgccaattctggtcatcaattcaagcattttttgcgtgctgatatctagctccccacgctcaaacctcgataaagttgctgccgaccattccccactaacttcttgaagcgttaagcctcggccaacccgacgttcatggaaaaagcgtcctaagtctaataagttgtcgctggtatgcttcattgtcatctgtgacaacctccccaattaaatatcatcacactaaatatcatacatcatgatgattagaaacacttggatgaacgtagctttaggtaactgtttcaatcatgcaaggttctcttttctattttaagtcagaatggttccgctttcgaaaatttgcgtgaatgataagcttcaatcaaaaaccaacggattaagagtccgttggtgacctagttttggcattcctaaaaattcttttgaaaatagaagattactatactcgccagatacaaaaaaagcctttcatttttcgtcaaagaataaaaggcaattgtttaaactttttacgccggcgcatttccagaaactcgcgtcaaactaaccgtcaacacattgtcagctgttgtattgtaatcggctaacatccctttgaccgttccgcgtgatgacccatgcgtactggtactttcttcgtaattttgaatccatgtgctgaccgcattgaacccgaactcgaaaccttcaaaaacttgcatgtaagcggatgagcgcggatttgttgtcacaattgtgatttttaaaacccgactatcagcaatctgcatggttagcttgatcaaaccatcatcaacgaacgtaacgtcgccatctactgttacccgtggcagtttataagccgctaatcgcatattttcgttataaactcgttgtacataatcgtaactgcccaagtcgctttgcattcttattcaagacccttctgttaaaatatggcttatcattcaccatttaaaaatacacgccaggattttttaaaatatcatgtttggcctccatagtgtaccgttgaatgctgaaaataagaattaaatagctcaccagtgtcttgcctaacgactaaagcgctcacgaaaacaacgagggagtgactacgatgcgaaaaccatccgggcgtcaccgcggtacgaacaagaccttatcctttgcaagtgtgatactacttggcatcaatggcatcatcggatctggtatcttcttactgccgggtacactttatcaagaggctggcgttggtagtgtcagcgccattgttttggctggcctcagtacaacgctaattgcgctgagttacgccatgctggcctccaaaatagatgatgatggcggtgcgtgggtctattcgaatcgcgcatttggcgcttttgtcggctttcaaacaggttggtttgggtggtttctcggggtgattaccattgcggctgaattggctgcttttctaaccgcattgggtggactggtaccagcagttaagcaacgggatgtctacatcagtgtggcattagtgatcattgctgctttaatcatcattaatctgaccggcccgaatatcctcacatttatcgataatatctctagcgctcttaagatcatcattctcattgcggtaatcgcagctggtggctattttatcagtacccatggcctgcacctgaaccagcctcgagccgcctccacagattttcgcacggctttctcgacagcattttatatgtttaccggcttttcattcctgccagttgcggctaacaaaatgagaaatccggagaaaaccctgccgcgcgccctcatgttggtcatgttagtcgttattgccatttatggattggcgcaaataacgacgattgttattctagggacgagtttgactgctgaagctttgccagtcgcagcagcattcgccgcgattgtcggtcccatcggaaaaactgtggtgattttagggatgctcatctccattttaggtgtcgcggtcgctgtttcctttgacacacccattgaaatggcttcgttggcaaccgaaaaagctttgctgccagcggtattcgggcgaaccaacaaaagtggcgcgccttttgtcgctatctggttgacacttgggattgccgcattgctggtagtgtcgggcagctacctgttttttgtcaacctgatcgtgtttagcgcctttcttcaatacatcacgaccatcctagcatggttcaaattgcgccatgatccaaccttgcccacaggtatccacttgccaatggcgccgtttttcatgggatttgccttgcttctgattggctatttgatcactagtgccacatggctgacttggttgattgccgtgatcgttgcattgatcggcagcgtcatctacgccaccgacacccgcagacgaagtgaatgacgcagcctgctagattgactaatcttaggaagtttctaggctaagctatccttgccgtgccaaactccgcaatctccggccagaaggggtggcgacgcgaagctagagcggagacggctgagccccatctggcctacgattgctccgccttggcactacggtctttaaaaatcgcagtaaataatccatgagtaactaaaaaggaacgatttttctttcactgcggaaaatcgtttcttttattcatttggctcagagctatgtcccagcctttattttaacaacatacgactatcgttaccgattaatggatctcgccatcctttgaatagtgtggcgttcgccgcgaatcgccttactgacagcatacaagttatcgataggtgattcgaatccccatgcagaatcgcccacatgctgcatatcaacgccacagattttatttcgaatcgccatctcctgcaacacatgactgccgctgccttcttgactcgtgccaatcgcactcatcaccaaaccacccaagcgatgaacaactttcacaaccgccttcaagtcagcttcatcaaatcccggaattgatccaaccgccggcgccaaaatcacatctgcacctgcttcaataaactttttcgcggtctcttccgtcatgagcggttcgtcaacaccagaagcatgcattttccctgcaataattaggccggtaaaatacttcttggctaacgcaatactgcgaatggtcgcttcatttgtaacgccagtacccggattaccggtcagcaccatgaactgaaaacccatttcttcggcttttttgatgaccgcctcactggcagtgcatcctggcaaaatggcaatttgattttccatcattttgggattgtcgccaatcggttcaatattaattccaattggtcggccaaccagttttcgcagtctcgtgatgctctctttgccgtcatgcttaggcgcgctgtataaatctctttcaccaggatataggccaaaaattttgggatcatcaacatcaaggcgattgcaaagaatcatatcagcgccaaatgctgcagcaatttcggctgtggtaatactgtccaaattctcttgcgtcacgatattttcgctaacgataatccgcccttcgctagccttgatgctttccttaagctgctgcccatcaaacgtcatgacctcgcttgtactggcacttagtagtcgtttcaccattttgttcattgcctcctattggttgtcttttaattaatagtagcaccttgcttattgaatcatgctacttctgctgctgcctttcttaaataagatttgaatggactgctttttaaactggtcgaaatcgaccagtttaaaacacgaactttgttagaataccgaagaacgacaaaaaagcccgaaaacgcttaaacctcaacgttttcggaccaaatgtctttatattctgggtggtcaggggatcgaaccctggacccacggattaagagtccgttgctctgccagctgagctaaccacccatgctgcttatgtctgtcgcgcttcacgacttaaatataatatcatgtaccccttactggcgcaagtgttttgcaaatcttttttcaaagaatgtgacaaaaagctgactgctgcattgtgtcatcaagcggttaggcagcgatttcgtcggttactggcaatttgctgatggtcatttgatgagtggttgttcacgctcttatttcgtgataatgtgctcgcagtcgccttgcatgtaaagaccttgaagtcgaatgaccaaaacttggccatttggcttcaaggccacttacgctccggtttaaatgcgctcctgctcgcgctcacaaaaaaagacggccatcgccgcctttttttcactaacctattctagaataaaacgtgaatggattgattgctgttgatcagtttgatcgccttgccaagcattggaccgaccgagatctgatctaagccttcgaatttgtgcttaggatcgagcttaatggtatcagtgatgacgacccgcttgagtcccagatgcttgatgcgatcaacagcgccacgggagaatacgccgtgggtggctgccgcgtagacatcaagtgcacctgcttcactcagggctttgtaagagtccacgatgcgatcgccggtatcgattaggtcatcaatcacgatggcgtgcatgccggcaacgtccccgataaccccgatgtgctcttgatcgcgcttatcaacaattgcaattggcgtatgtaattcttcagccaatgcccgcgcttgtttggtgccactgtgatcaggcgcgatgacaacgacattatcgccaagatctagcttcttgaagtaatcaccgatcaagtggtgggccttgagatggtcaactgggatatcgaaaaagccttgaatctgatccgcatgcagttcaacagcaatgatccgattaacgccatccatctccagcatgttagcaacaagtttggctgtgattggctcacgggagcgcgccttgcgatcagcccgtgcgtagccataataaggaatcacgacattaatatggtgagcactcgcccgccgcaacgcatcaaccatgatcataagttccatgaagttctcattaaccggatcagagaccgactggatcacatatacatcagcgccacgaacactttccggtagttcaatttgaacttccccatcagcaaaatgattcactcgagctggcgacagcggtagcccgacctcttccgcaatcttttcagctaatggccggttcccattaagactgaataattttaattcgtgcatcgatttctccctttttcgtatttaacggtctgcaccgtcattatacgagaaaaggcaagaaattgcgactgattatccaatgcggtaaagtaatatcataacatttgcagattcataagcagcgctccagcaggcggcaccccggtctccgccgtgctttgccctgactgcaagacttggaaatgggaggcactgagtcatgaaacaaagccatttgatcggccttgcaaccccactgttattatcggctggcacgttagcgaccgccgaaagcttttatcaatatgcatttcgccgcattaactatattccagacgcgcggcgttcgatgcaaaagtatgcggcttcatattatcgccatgtccactgggtagaaagtcaggccaatattgaggcatggcatatgacagccccggataatcaacgacttgaagctctttggttgccgcatcccggcagtaaaaaagcggtgattgtgggccacggttacaaaggtactgggattacgatgagcaactttgcccacatgttttacgatctaggtttcaatgttctgctaccggatgatcgcgggcatggtgaatcggatggccaatacattagtttcggctggctggatcggctggattatttgggttggctgcaacgtatcattgatcgaatcggtgcagacagtcaactgctgttgtttggtaccagcatgggtggtgccacagtttcgttggtggcaggcgaacccagtttgccaaaacaagtgaaggctgtcattgaagactgcggctacaccgatgttgaaaccgagttggcctacttactgaaaaagcagtttcacctgccaccaatgccgttggtgccactggcaagttttcttaactatcgccggttaggttatcctttacgcgttgtcaacgtccgccaagcactcactcgcaaccacttgccactattggttattcacggtgcggaagatgtctatgtgccaacgaaaatgggtcggcaaaattatgcggcttctgcgggtcctaaagccctctggatcgttccgggggctgcgcacgcggaaagctactggatcaacccggaagcttatcaagcacacgtcaaacgttttctagatatctttttctaactgccgctttgtaaccatcacaaaaatggatcgtctgaatgatcaccaccattcaaacggtccattttaatgtctaatcaaaaaagcgcagcacagtctagaggtcgtcctcttcatctgcttcagcctcatcgcgttgtttactgagcacatcgaattgacgcaacatggccaaatttgtctcgatactttccggccattcccaatgttgaacattaaaaacgtgcttgaggtgcggaccggcgctggctggccacaatttggtcgtataggtcaccttatcggcagcaaacacttctagcaaagcctgactttgcaaatagaagctgtcattttggccgccaatcagcatgaatggcggcaacttgaggtctttggcaacttgagaaaagttaaggtggtcagccaatgcagcatcgccaccgctcagcttatcaagataaaaagcggccatatcgctcatatcaccagcggcttctggcagtttgccaggttcagcgactgggcacaccaaggccaccaaagtgaaattgaaattaacccgatcaacgccaaaaagttcttgtagctcttcgctttgctgaatgcaggccactagtgacgctagatggccgcctgccgagtcaccggtcaatagaacatgatcgagattaaagccgcgctgcgggccaaaatgcgacaaccaacgtaagctagcaaagatgtcttgaatctgcccgcgcacatcgacatctggcagcaagcgataccccatgcccatcacagcataaccttgactcgccaaatagcggcaataatttcggttgagattgcgatcgccataaaaccagccgccgccatgaacatcaatcacagttggcaacgtcgcattgcggcgttttgccggataatataagttcaaggtctgctgcgggtcagcagagttttcataccggtattccgtttcccagtggacatcctctggcacccgttcatccgcatagcgtgccttatcgcgcgctgccgtctgcgcccagcctgcctgaatttttgctaaaatgtcatcatctgccattaccaaggcctccatttcaccatgttcaaatcgcattaaaagattaatcccatcttaacgcaaaaagactgccagtgagtcaactgacagtctaatcgtatgaattaaccttatctcttaacgatctttggacttaacgctagcttcgacttcatcaatcaagccagcatctttcaaaccggtcacttctttgatgacatccaccagcggctgatccttcagcatcgcttgcaacttcacagcttcggcatcattaggttcaacataatggaacatcatgccaacggtgtccatcaaaacgctgtaattcaaaccgcgttccttcaattcgcgaattgggcgaataaagcgttcgtcgtaacctagtttgcggattggtgtccgggcaactcgagaaatatcatctgagatgtacggattctggaaacgttgcaacacccgattttgatagttttcgaggtctttttcgtcaaaattcttgaactctgacaacaacaacgaacgggtttcggccagcgcaccctttgcctgattgaagactttaggatccttgatggcgtcgccaattgtcgtgtagccaaggtacttgccggtgtaagccgtggtagcgtgaccagtgttgacggagaagagtttccgttcgatataaggttccaagtcgggcacatagtctacagttttgagtttcagatccttgttcttcatctgactctcgtcaacaacccattccttgaaatcttcaacactaacggccaagggatcatcgtgcttttgttgtggcacgattcgatcaaccgcggcgttagggaagccaacgtacgtatcagcaaaggtcttgccggcgtcatcgagatgctcgtagacactcttcttaagtgactgggagccaccgatcatattttcacatgcaatcacatctaatgcctgatgattgttggctgcatcacgtgcctgcaagccttgggcaattagcggtgcaatgattggcagaatcttcggaccaatggcggtggtcaccagatcagcctgcgcaattgccttcacaactgcctcgggatccttggcattgttcaacccgtcaacattgtccacatgaatcttcttctcaccgggcgctgctaaggtgatcgtatattcgccgcgttggtttaacgcattgatgatcgtctcgttaacatcgacaaaattgattttgaaaccgttagcggcaagtgtttcaccgataaatccgcgaccaatattacctgcaccaaaatgtactgcttccatcataatttattcaacttccttcagtaaattgacgatttcctccggcgtttgggcgtcggcaagtttctgaacattttcaacatcactgcaataaagcgcaatttgcgacaacaatttgagatgttcgccatttaagccagcaatcccaaaaacaaccgtgaccaagttctcatcagccggatcatccgaccagtcaacaccccatggatattgcacaatcgaaatagccgttgacttaatatatttcatcccggcctcagtgccgtggggaatagcaatgaagttacccatatacacagaaacatcgcgattccgatcaagcatcgaatcaatataagctggttcgacattaccattgtcgaccaagagttggccggcctgacgaatggcttcttccttggtctttgcttcctgaccaagtttgatcgttttaacgtctagtcctttcatcatgtcaccttcgatcaatttttttgatttcgttcataaatacttctgtgatgatttgatacaactggctataatgccctttttcaaaaagttgtaaattcgttgttgacgcaatcagctttgcgctgacagcgctcaatagcgttagtgtttcctgagcaactgggttcggtgtcaaaagtagcaatacccgatgcaacatgatcgtgcccatatccatggctggaagcgacagcggcgtttttaaatcgaatgcgccgatgtaaggcactgtcacaccctgactactggtatggatcatagcgagtccggtatcgggaatcccaactggcgctaattctagtcgctttagcaaggcgtctttgacgaccggcgcttctgccaccacgtctggtaaatgtgctagcatggcatcgattgtggctcctgaggttgtcaccgcttcggtgatctctgtcacagcgaagtgctgtaacatgtcatcagctgctaataccatggttttgagactttcaaacgccgtcacagtctgatctaatgacggttgtctttgctgggtcgcttctttcggcttgacctgttgcaataaccgtctgatttcactaatctcatcacgcgccaagattggcgtgatgacaagatactgatgcttgaatcccggcaatggcatcgtcgcaagaatcaaaccgtaatgtgccagattctggttcggcagatcactaacctgaatgatcttgatctctcgaatttccggcacctgtacacgtagcttcccagcaatcagactgccggtccccgggccatcgctcgtaatcagcaagacagctgctggcacttcggtgtgggtatggtccaagactgaagcaaagtacaacaccagatacccgagcgcatttccagtaaaggcaccgcgaccaaaaacatcgtcagccgcttgttgaactgcgtggtaaagttcaggataatcgtcgcgcagatgagccagcactggattcgtcatcgtgacgcctggcagccaatcaccgccagcggttcgttggacatgagccaacagcgatgagtaaagctgcgtattcccggaaaatttcccgggaaatgatctggcaacttcacgaatcaattcctgcacttcaaggttaaccgttaaatcaaacggatcaactggttctccagccaagccaccgcgaatggtactgagctcaacggcaagaaactgataatcgccaacgcggactttctggcgaatcgcggaatccatctccgccagaaactcgagagccaattgttggtcctggaaaagccgttcctggtcgaaatggcgttgcgcttcaacatgctgatcttctcgcaatcggcgggtattaactgctactgtcagtaacaccgctttgcgctggttgtcgctgagatccgccaacgccttgatgcgcagcaaagccgcgtttgctgccagtaactcttcctgcggtaatcgttcaacaaaataatgtgtgactggatcgaatgtctgctgaggatcacggagaaagcggaagaaaacgtacggattaatctcagcattcaacacgcctaccaatactcggcgaatatcgccttccgcaccatcaatccagataccggcagctttttggcgatttaattgcagatgatattcattcaaagcgggttcaagaatatccagatcttgcttaatggtggtgacactcacgtcaaccgctgccgctaacgccgtcattgtttccggaccgttggcattcagcaaccgtaatgttaaagcactttgtcgttggctaggatcaaatgtcaccacctgatcctgttttgccaaagtcgcggttaaggtagccaaatcattggtatccccgaccaaccgatacgtgctgccagtgcctttatcgagttttaaaccgattgtggcgatgtcactttccaattgcgaaagctcacggtaaatggtccgacggctgacacccagctgccgttccagctcatctcggctaacaccggcgggctgactcatcatgagtctgatcatttcctgttcacgattcgttagtaacatatttttcgcctcaagcggccgcaacaccgaccgaacttatttcatcttctcaataagcttatcatagttcgttgcgttcaagaggccatcaacggtgtagacctgaacattggcaaactgcaatttaacgcgacgtgctgtttctttcgaagcaataatcagtacattgtccttgtcatcaatctcgccgattgcgacattacgaactttcacgtctttattcagtttccgtaattcagcacggaatgttgcctgtgccatggttgcggaaccaatgttttgatcatgatgcaggaagtcaacttcggtaatcttatcgagatcaagttcctttaattcgtcttccggtgtttcttgtttagctttagacgtctcagttgctggcattgcttcgtcagtaccgccaactgcttcagccttcaagcttgcgatgatttcatcatacttcggactgttcaggaaattatcaaccgcaatatgagcggcatcaggtgtcttgtccttagcccgatcagctaattcttcttgtgtcacaaccagcaatcccggcttgtcttgcaggttactgattgctgtgttggtaaccgaaagatccagacctgccttctttaccttgtcgcgtaagatggaagcgcccatggcactggaacccatgccggcatcgcaagcaaagataatctgcttaatgcccttggcggctgacatcacatctttagctgccgcaacattttgctgacccttagcttcagccttcatggacttcattttggcttcgctttcggctaattcgtcaccgcttgcgctcttatcgcggcgtaaaatgacagccgagatcaggaaagaaacaagtgtagcacctgtgacaccaacaattaaaccaatataattcccaatgttaaccggtgacattgcgaataatgcgaagatagaacctggagatggtgagctcttcaaaccaacattgaagatggagaaaagtgtcgtcccagtaacaccaccagccataacagacaggaacagtgctggcttcatcaaaacatatgggaaatagatttcgtgaatcccgccaaggaagtgaatgatgatggcggaaggtgcggaacctttagcagatcccttaccaaacagcgcaaatgctaacaaaacaccaaggcctggacctggatcaggttccagtaagaacaggattgacttaccatgttcggctgccgcctgaatcccaagcggtgtcaaaatcccctgattgatcgcattatttaggaacaaaatctttgcgggttcaataaagacgtttgctacccacaacaacccgtgattgataatccaatcaaccccagttgccatgccgttagtcaacgtagagataattggacccattaggaagaagccaacgattgctagcaacatcccaataatgccggcactaaagttgttgaccaacatttcaaagccttgtttgatcttatcttgaaaacggtcgtcccacttcttaatacaccagccaccaagtggacccatcaccattgcgccaataaacattggcacatcagtaccgacgatgacccccatggcagcaatcgcaccaacaacgccgccacgatgacctgccaccatcgaaccgcctgaaaaagcgatcagtaatggtaacagataagttaccattggcgaaatcatttttgcgagctgagcgtttggataccaaccacctttaaggaagatggctgtaataagaccccaagcaataaaggcaccgatgtttggcaacaccatgccagaaagcttggttccgaatgattgcataccggctttcagattaaatttctttttttctgctgccggcgtgtttgctgtttttgcacccaaggcaaacacactcctttcccttatttacaagtattattgtaaccgcttcatgtaatcgctgacaaaagcttctttggcacagttgtctgtgccaaacattcaggttgaatccccagctaacagtttactaaggaaagcatctggtttaaaaccataacagtgtacgttaactgtttcacaagttatggaaaacgctaccgctgtctacttttttgctcgcatcatactgaggacgctgttatctgatgttgttatctactatatgtcagttgtgcctgacgccctatcgactcagcataaacacagaaaatcaaaattttcggtattacggtatagaccactattgacatggaggttttttgatgctacattggactagaccagatagggggatatcaatgatggatgtaaaaatttttgataacgatacagaagcaggcaagtacgcatttgatttgatcaagcaaggtatggataacggtgccaaagtgcttggcttggctaccggcagcacaccagtcaccatgtacaaagcaatggttaatagtgatgttgatttcagcaacatgacttccattaacttggatgaatatgttgggttggctccagacaatgaccagagctaccgttacttcatgcagagtaacctcttcgacaaaaagccattcaaggaaacctttgttccaaacggcttggctaaggatcctgaagaagaaaccacgcgttacaacaaagtaatcgccgaccatccgatcgacatccaagtacttggcattggccgtaacggtcacattggcttcaacgaacccggttcaccatttgacgcagaaacccgcaaagtaccgctgacccaaagcaccattgacgctaacgcccggttctttgcaagtgaagatgacgtacctcgctacgcctactccatggggatcggctcaatcttgaagagcaagaagattttgctgttagcctttggcgaaaacaaggcagatgctgttaaaaaaatgattgaaggccctgtcaccaacgatgtgccagcgtccgcactgcaaaagcattcagatgttgttgtcatcttggacaaagcagctgcaagcaagctgagcaagaaataagctatttctttcaatcagctgagataaaacaggccgatgctcatcggcctgtttttttatggaagtgtggctaacccatttagaaaacggcgtgtaagcagccttggctgtgatgaccgggttttggtcatgacccccttgcaagcaggtttccgagctgacaagcgtgtgaatccctttcaccccagtagtatccgttttttctgtaagcgtttcgatttcttgccctctgccgtgcgtattccatggtagaatgaggccatcacaacatttagtaacggaggaaattatgtacaaagctgtcgttttttttgatttagatcaaacgctgctcaatgatgacaaacaggtgccacccgaaaatgttgctgcgctcaaagcccttgaagccaaccagattctgccggtcattgcgactggcagaaattactacgaactggctgacattatggcagcaactggggtccacagtgcaattgctgctaatggtggtgacatttttcttgacggcgatcacatttttcaaagtgtgattggcgagccgcaactcacccgttttctcaatacgagtgcagcacaagacattcaagttgccatgtacaacagtgaagcatcggcgctgaccggccataatcagctcacaaccgataactatgcgcaggtgcggcaaacaccgccgccggtcaagccatctttctacgagcatgaagcaatctgtatgatgttaatgtttgtaccatggaccgatgcaggtgaccagattgggaaacaattcatccaagatttcccagaaatgacgttctaccgcaactcgcattatacgtttgatgttgtcaatcatggcatttccaaaggcagtggcatggccatcctgttaaatcagccatccttacgtggtctgccaacctacgcatttggcgacggttataatgacattccgttgttgcaagcagctgacaccggaattgcgatggggaacgcttatccaaaagttgcggctgttgcggattatcaaacggacgattatcgcgaaaacggtattccaaatgcacttgcacattttaacttgatttaatttttaatgcgtaaaaacacatcaatattagcctattggtgtgctttttttatggcgcttatccagcagcattttccgctaaatttcggttgactttgcaaacgtatgttcccataataataagtgtgaactgtgaacttaaaaatttaattttaggtgcaaaaacactgtcatattaaggtttgtaacacttgctataccgtgttggccaattaaagtcaagaccgcggcagcgcaaattttctgctatactcaaagcatgctgtgcgttatttgggcgtggtcgaaacaccgatcaataatcgtacaacagcgcaaaatctgctgatggaggggtctctcatgttagaacaatcgacaatgcatccggtggtttggatcaatcaacatacttatatcagtatcgtcaaaaatgcggattataatttagaagtctgggagattaccgacgaaaatcggcagcatcggatggcccggatgaattacaaatatcaccgtgataactttgccggattcatctatcgactcttcccacagatcgacttgattcaaattcacaacattcaaaagaagatcaacccgtatttcgacttagaggtttagaggtgtacacatggatagtctggttattcagcttctgatcatggtcgttgttgctttgctggtaacactgctcgtcatttttgcagaatggcgcgctaaaaattttaagccttggcaactcggtgttcaatcggttgtcgccgtggtcctactgggcgttggtattagcttgctaacagttagatgaggcaacttggtaaaacagccaagtctgttctgaggctggcacacttgagctttcaacatgttgcaggatttaaaaaaattattattcactatatagttggtcgctttgcgttataaagcggccttttcgtttggttccacgtggaacaaaaggccttcttctcgtctaatatggcccaacaaccgcaatataatggattttatttttggcatcggatgattggccttcgcagttgatgccattgatcactacttttcttcaaaattaaatgacttggctgatgccctccctctttatgcaacaccctttagcaaataaaacgcgcaaaatacagcattcgaattccttgaagacgacccaagatgttaaaattcaacatcgtatttgtcgcaaaattgaccattttgatgtattaaaatccgaatacccgcgaattgaagcaattttaagcctgtcaaaataaggacacttttccgccaaatagcgtttttattaatggacgtcatccaattctatccgtatacttgcaccaacaaagcgattagggaagcactttcaggaggggcaagtatgaataaaggacgatcaaagggtaaacgtatttcgcaacgcatggtgatcattgggattggtgcattagccatgattggcgtcaccgtttttttcctagtcacatccaaaaaaccgacatcatcacccgcaccgacaacgatagccaccttccaagtgaagaagcatgagttacgagtgccgggacaggtacaggccgtacgtacgcaaaaaatcgacattcctgaaggcaccgtccaaaacatgacggttaaaaatggcgatagtgtgacgcttgatcaacaacttttgacggtttacaagcctgacgtacaagcaaaaattgatgaagcttcacgtgcgcttgaaaaacaacaacgcagtcaagccacacttgatcagcaaatcagccaaatcaaagctactttaagtaagaccgccgccgatgatccacagaagtccgccttgcagacacaacttgatgaggcgcagaataatcgccaagattcggctgatgccatcacccaatcgaatcaggatatcgctaaattaaaacaaagtctgaatacggtggttaaggctccctttgcaggtcggctgtacattgactatcaagcaaatggcagtcagaccatcacggaaacctcggctgaagttgaagccgttggtgaggtctccgaatttgattattcaagtgttaaaatcggtcaatctgcaaccgtacaggcgctggcaagcaaaacaaagcaagcgacagacatcaattttattagcagtgatccggctaaatccagcaaaccgaatctcgccaagtatgaactcacgacgaaattacgtgacggctttttaaacggccaatccatcaccatcacgattcccctaagcggtttgttaattcccaaagaagcggttaaggacggggccgttttcaaaatcgtcaataaacgcgccatccgaactaaagtaacctatgtggcaaaagacgatatgtatgaagtctcagatggcctcagcagcggcgaccgcattcttcaaaaacccgacaaaacaatcaaagacggggcgaaggtgaacgttgatgattgatttacggcatgtcaacaaaagctatctgcaaggcgacacagccttcccagtgcttaaagatatcaacttacacattgatgaaggcgagttcgtcgcaattatgggcccgtctggctctggcaaaaccacattaatcaatattattggcttccttgatacagcttttgagggcgactacctttttcaaaacgaaaatgtcgccgtctttaatcgcgccactgcgtcaaaaatgcgaaatcagcatgtcggctttgtctttcaaaatttcagcctgatcaataacttaaacatttttgaaaatgtccttattcctctgagttatggtggcaatcgacgaagtgatgttaaagaaaaaatcactgagttgctgcattctgttggcctagtcgatgttgaaacgaaattaccgcgcaatttatctggcggtcagcagcagcgggtggcaatcgctcgtgcccttgcaaattcgccgcaattcttaattgccgatgaaccgaccggcgccttagacagccatacttcggcagagatcatgcgactctttaaaacactccatcaacaaggcgtgaccatcattatggtgacgcatgatgaacacgtggcgctacaaagtgatcgcatgattaaagtattagacgggcagatcatcagtgatacggaggttagccatgcgaataactgaattaattcgaatttctttccgtgcgctaaccgctaacaaacgccgcagcctcctaaccatgcttggcattgtcatcggtatcacttctgttgtaaccatcatggcactcggtaacggtatcaaagctgccacactcaaaaatttgcaaactgatcaatctggccaacaaacggctgaaatcaccttccttcctgaaagtagcactgcctccacggctggttttaaggaagatgatgtggatctcgcctatcaaaccgctccagacaaaatcaaaaaagtgactatcaaacatgaaaaagagcgcctacaactgaatggtcagttagccaatcaagatacgatgctatctgccacacttgttacatccatgcctaaagtgcaacttgctgctggaaacaaattaactaccgattccttacaaacagacggtcatgatgtccttttatccaagaagttagctaaaaaagtcttttatggcaacgcagcagcactgacatcatccatttttatcgggaagcgaagttacaacattgttggtattttcaacacgcctaaagcgtcctattcagctttagatgttgacgttttaattcctgaaaaggcttataccgctggccagttaaacccaggagggcaaaaattggccatcaccttccaacgtggcagtgacatttcccaattggcaaacgccatcgttcgtcagttgaagaaatctggtactgaacgccgcaatggctcgtaccaatattttgattatggtgaattactaaaaggcatcggtaatgtgatcagcgggttaacgttgttcgtcggggccattgcgggtatttcgctactgatcgcaggtgtcggtgtcatgaacatgatgtacatttccgcctccgaacgttcacaggaaattggcatcagaatggccgttggcgctaccccggcagaaattatgaaacagtttctgttagagtcagtcatgctgacattaaccggcggcgttgtgggtcttgttctcggtggcttgattgcctggatgatcacagcgttcttgccatttaaacccgtcataacgcttggttccatcatcggcacctttgcaatttccagcattgtcggcattgtttttggcatcctgccagctaaaagtgctgccaataagaacctgatcgatattctgaaatcataaaaatgctcccatctaagtggcagcatgcagctttctatttctacattgaaagttcttgaaccaacgaaaaaacggttagatctgcgagatctaaccgttttttatacgctattactgctactgcttttagccaaaagacgtcattgctgcaggcatcattcagagcgcttcttattgcgaacccctgctaacccaaacaagctcgctatgctagtcaagatcagcccaacaatagacaaatcattcgccgatgtatcacctgtttgcggtagctgatgagtcgttttcacaggtgtttgctgattaattgactgactaggtcgaccagtaacactcggcactttgcctgtctcatgaccagtactcgtaccggtatttgtgccagtaccggtatctgtaccagtacctgtatcaggaagcggccctgatttcgcaacgatttcaaagaccgcttgctgggtatcgacattttcaagcagataatttggcagcaacgcttggatacgcttgaggccgcctgcgctaagtgtcacggcgtaacgaccaacaacaattggggcaataccatcagcaaaagccaagtcactgtcttcaagtatgatgtgactaccatccgtaaaaatcaattcgaaatgttgagcattcagttctccaggttggccatcatagattttttgctgcatgccgctgagctgtcctgacaaaaccgcgggtgtgatcgtaatggtaccattcattgttgtgtcgttaatttgataattaggaccaagtgcaaccatcactttagcaatgccactagcacttaatcgatacgtgtaggtgccaacattaacgctatcattggcaacatctatatctgcattcgttaaggcgactgtttgtgcaccagttggtagttgaactgttaccagtaatccactagcttggcttgctcgggtaaccccgtcatactggaaatgaccattattaacagtggccacgactgtcagtggcgtgatggtgatcgtgccggtcaatgcgttcaaatcggtttcattaagtgcatagttggtgccggctgctgctttcaacttcgctattcctgaatgactaagatgataatgatacgtgccagttgtcgtgttatcgccgtcaacaacaatgtcctgcgtcgtcaatgcaacagttagcctagcagtcccgcgcgagaggtaaacgacgccattgagacctgacgcttcacttgcccttgtacgaccatcataaacaaatgtcgtatcatttaccgttgcagttccttcagccggggtgatcgtaataatacccattaatgctgctagatcatctactttcaattgataatttggtccagctacttgttgaagtttcgtgatggcgtcagtacttagccggtagtggtaactgccaacattgacaccatcatcagcaaccacgatatctgaagcgtctaacttaattgatgttgtatcgtcgccaagcttaaccactgctgttaacccttgagcctgactcgcctttgtttggccatcatacataaatgaaccatcattcaaatcagcggttgttgttgccggtgtaatgttaatgttgcccgtcaattttgctaattctgaaactgttaactgatagttgctgccgactgcctgttgtagttttgctataccggtggcggtcagcgtgtactggtaactcccaacattcacaccatcattggcaacaacaaagtcggctggcgccaaggttaatggcaccgtctcattgccaactgtgacgtttgcagtcaagccttgtgcctgacttgccttcgtcttcccatcataaacaaacgatgtgtcactgagatttacggcaccttcagctggcgtaattgtgattgtaccagtcaattttgccagctcagaagcatttagctgataattgctgccgactgcccgttgtagctttgcaatgccggcgtcagttagcgtgtactggtaactcccaacattcacaccgtcattggcaacagcaatgtcggcggacgtcacggtcaccggcaccgtctcattgccaactgtgacgtttgcagtcaagccttgtgcctgacttgccttcgtcttcccatcataaacaaacgatgtgtcactgagatttacggcaccttcagctggcgtaatcgtgatcgcaccagtcagttttgccagttcagaagcgtctaactgatagttgctgccgactgcctgttgtagttttgcgataccggtgtttgtaaggctgtactggtaactcccaacattcataccgtcattgccaacaacaaaatccgttgacgtcaaggttactggcaccgttgcactgccaactgtgacctttgcagtcaagccttgtgcctgaccggctttcgtcttcccatcataaacaaacgaagtattggtcagagttgcggtgcttgctgcaggcgtaattgtgattgtaccagtcagttttgctaagtcgtcagcgtttagctgataattgctgccgactgcctgttgtagctttgcgataccagtgtttgtaaggctgtactgataattcccaacattcacaccatcattaacaacagcaatgtcggcggacgtcaaggttaccggcaccgttgcactgccaattgtgacatcgccggtcaaaccttgtgcctgacttgcctttgtcttcccatcataaataaatgagtcatcaagcaactccgcagtgccttgtgctggtgcaatcgtaatcgtgcctgttaagctgcccagcaagtcacttggcaactgataattggtattcaacgcctgctcgactttcgctacaccactctgactcagttgatattgataatcaccgacattgacgctgtccgatcccaccacaatatcagtcgagctaagatcaacaactgtcgtgccagaaccggccgttaatgttaactgcaatcctgaagcctgactagcagtcgttttgccatcatatacaaattgtgtcccattaacagttgcagttgcagtagcaggtgtgatcgtgataacccctgggtgagtattgatatctgtctgatcaatcgtgacttcatcacccaaaatcgcttgaatacgtgtcaatccactaccattaagaagatatcgatacgtacctacatctggtgagtctgcttcaacaagtgaaatatctgtcgaagtcaaatcaatggcttgctgtgagccatcactcaaagtcacattaagaaccagttttggcgcctgactggccaatgtcgtgccatcataagtgaacccactattattcaactgacctatagctgtgagaccgatgataagttgtgccgtactcgtaccggtaaaattatagttagccgctgactcaccagcatcatttgtcagttcagcaatccgcgcccatgccgcctttgaaagttcaacacggtagacacccgttttcgtcaatgcatcagcagcaatctggttgccagatgcatcaaaaaaattaaggtcactcagttgtaaagcaccagcattgaagccatccccaagactcagagaaaaggccgtcagatccaccgtaatcggttgacccgtcgcagttgccgtttgagtaccagtcaacgaatatgacgccgccagccgttgattataaaaaattttagctgagccactttcagccccatacgcgtaagtgactgtataccaagtcacctgatcactaggcacactgcctgtgacaacaccgtctctatctttagaggcgatcacagccccgttctggtccgttacagtccaagtcaaatcgctaagtggtatctcaatgatctcagtgccattctttttcacggcgccgccaaagttcagttctggtttccaaacctgacccgtgaaaaggttaatgtcatgggcatggataacggggtcattcagatgaaccttgtaaagaccagtgtacgttgtgccatctgccgcctttaatgaccaattaaaactgaattgttcagttcccgcaggcatcgtaaaggattttgtcgcggtattaaaggccacgccggttccctgaatattcgaaaccacaatttgatcctgactgacacctgaaatcgccacactaaatagatcacgcaaactaacatgagcagaatctgtataggcgtcggcattttgatttagagcatccggggttgtcggtacagccgtcgcggcatgcaaaactgtgatccggttattggaaaacgcctcttgatcaattgtcggtgtcccagcaatcgccacttcaggaatcagattagcattaaaagctttagcaccaatggcagtcacactcgctgggatattgagcgcatttaagatgatgtttgcttcaaacgcctcttggcctattgtctgcagacctgtccccaaggttaagttgctaattgagttatagacaaacgcatatttgccaatcgcggtgacactatccggcacagccaaaccattttgaatcttattgtagccaaaagcactgtcgccaattgtctgtaacccgtcatttaaagttagtgccgggatcttgttgccgacaaacgccgcatttttaattatcttcaaatttggtggcaacacaattgcattgttaatcgtattataggcaaaagcactgtcaccaatcgattccagcgctgttgcccgactgaagtcaacattttgcaacggtccaaactcagtaaaagctagatcaccaattgtctggagattaggaccaaatgctacttggatgaggtgtccaccgtaaaaagcttgatccccaatttgttcaagtgagtctggtaaattaatcgccatcgcactggaaaatgcgaatgcctgaaagcccaatgttgtcagccgactattgtctgcgattgcaaccgttcctagttttgacccataaaaagccgatccatcaattacgctgatgttcgccggtattgtcagcgtcggaatttgattgccaggattatcctgaccattaatgttaggcagatccttcatgttttggataaattgaaaagcgccgcctgtaatcgtctgaacatcaggaccaaacatcagattatccgtgaagagatggaagaaggcttggttgctaatcgttgctgcatcgacggtcacattcgtaatgcgtgcatagccaaaagcagtttcagcaagcgttgttgccttgccgcccagcgtcagcgacgtagccttagtaccgtaaaaggcattcttcccgatcgtcgctgatcctgccacattgatcgtgtcattaatggtttcgtaggcaaacgccgcttcgccaatattagcaacttcatcatccaacgtcagcgactcggccttaagcccataaaaagcattttgaccgattgttgccggacctgcgacactgaccgcaccagtaatcgtggcataggcaaaagacgactcaccaatgttccatgcaccgttcaatgtaatcgcactcgcattgacaccggcaaaagcctctttaccaataacagccgcattatcgacggtgatcccaccagtgaatttactataggcaaaggctgaagcaccaattgtcgtgaccgtagaggcaacatgtaagctagtcaaattactcaagttaaagaatgcaacatcctgaatcgcagtcaccgtataagcttgaccattatacgagacagttggcccaatattaatgtcggtaagcgttgcaccagagtcatgacccgtaacggttgccgttttggttgtctcatcaaaactgtaagttaaaccgtcaaccgttgcgtcagttgtcgtggtattgactgttactgtaggttgagcagcagctgtcgcaaccggttgagcttgactactggccgactgctgtgcactggaagcttggctgctcgcagctgaagatgctgctgtttcactagcagtggcagcctgtgtagcagcttggtctgcagccgcggctgattgagccgccccagaccccgaggccacctgtgccgaggttactgaggctacctgtgacgcatcagttgtctgttcagggacagccgcctgactcgtaagtgtttgcgctgctgatgaactggatgtttgactgctagccgcgctcgccgcagatgaagccttgacagcctcgccggagttagtagcattcacagcattgcttgatgttgtcgcttgatcactagtcaccgcactttgagatgtcgctggctccgctgcctgtgacgttgccgttacttgtgtctgtggcgagcttgtatccgccttaacttcatgacctggttgaaaaaaggctggtataaacagtaaagcagctccggcaataagccaccgcttttttgctttatacatccgaaaacggacatgaaccgtctgttccgcctgtcgagccaattgaatccgtttagaatctagtttcaagatcatgatcctcctacagccatgttaatagcgattcccgtcacgacgcttaacgaaccatcttagaaacgatgattcacttggaaacagtaagcgtgtagaatctgtttttcattatataactgattttattaaaaaaacggaaaaatttgtatccaattttcagaaaataattttataaatattgcgatagaatcagtctgaaaccggcattaacttaagtgcttgtttttaaatgtatcgcctatcctctgttgtttctgcaaatcagctgcatcttcgatcacaataaaaaaacacgatgttggtcaacgatccatcgtgttttttgacaagtatctttttagagcagaccctacttaccaatttttgcgcagttgcttcttttaatcgtgccggactcatcagcaactcgcttcgctcgtaaccttaaaccccttgctgggacctcggccccgttcaccacaccaacaatagatcaatgaattgttaactcgcttacgttgagcttctgaccacacttatcttcaaagcttttcatcattccatcagtatatttttaattaagattcgtttgtttgcattctaaacaaatggcaagcattttgttgtaatcgtaacaacaaggctttgcagattgttttcattttctagttgacttcatacagaacatcgcgtatgttaaaaattatcacataagatgagatttacatgagaggagttttgtcgatgaagttagatttggaactacgccctggggcaaatcgttttgtgagtgagtcaggtgccttggcatacttagatacgatcttagcggattttaatcaaccagttgtgattaccggcgaaaaaagttttactgctttcaccaaggcttatcccggcgaattgaacttgccagtctatcattacgacggctccgccagtgatgagaatggacacgaacttgcacaggaaatcggtcatgctgatgccgtggtaggaatcggtgctggtcgcttgatcgataccgccaaagttgcggccgaagccttgggtgctgagctcatcagcatccccaccttggcctctaactgtgcaccattcacaccccttgccgcgatttatcatccgcaaggtcatacctttagttacgttgaatattttaaaaaatctgcctatattactttggtagactataacctcttattgtccaccccacatgatttctttgttgctgggattggcgataccttggccaaatggtacgagatggacggcattacccgtgataaagtggatcagttaaaggcatacggccagttgagtcgtgccgcggccaaaacgattcaaaagattctctttaaagatgctgaacaggccttggccgatttggatgccggccgcgacaccccggcttttgaagcggttgccgataccattattggcttggctggtgaagtcggtggcttcggcggcattgatggtcgcgctgccggtgctcacgccactcacaatggcctctcctacttaccagaaactcatgccatcttgcacggttcaaaagtggcttacggcattctggtgcaactggctgaaaccggcgatgataccgaaattcgcaacttgattccattctatgaaaaaatcggtttgccattgaaccttgaagatttgcatgtcaccgatcaagtcgatgaaaagattaagcaagtggccgaattcgccgctaaaccagatgaaaccttcatcttggttgatccaactttaacccctgccaaagtagcagatgcgatgacaaaagtggaacaagtcaccagtgagccagcagcttaaagtccgaaatcggacaatctaatgaatactgtttcacaaaaattttaaaaaaccttgcagccctcgtaaaatggttgcaaggttttttcgtttttgtatgaaagcacccatatcaaacaatgaccgcgcaaagtcctacttgttcatcgcgttgtcgattcactttgcaaataccctaacgccgccgcgccaacagccttggcagcaatcagaatcgcatcttcgtccatcataaagtcgggactgtggtgaggatgattagagccgtctggcagctgacagccaatgtagaagaaactgcttggtaccttttgggcaaaatacgcaaaatcttcggatgggtcttgaacgccagtgtccttaatggccttaatctccggaatatttgctgctttgatcgcggccattgcattttcggttaaggtcgcatcattcatcaaaaccggataattgtcatcatagtccagctttgttttaaccccaaacatggtttctagtccttggttcatggtgacgatctgttgtcgaatcgttttgcgcgttgtttccttcatcatccggacatcgcctttcaatacaacgtcttgcttaatcgcattgaaagaaccagcgccgtcaaatgagccgatggtgacgcttgccgtgtcaaaaggatcaactcgccgcgacacaatcgtttgcagtgccgtcaccaaatagctgccagccacgatagcatcgttgctcaggtgcggcatagaagcgtgtccacctttgccgataatcgtatcggtaaagttggcccgcccggtttgggttgcgcctgtatggtagccaatcaaccctgtcggcatcgatgacatgacatgaacgcctaacacattatcaacgccttcgagaacccctgctgctaccatccccttggcaccacctggagagacttcctcagcgggctggtgaatgattcgaatggtaccggccaatttggctttgatcttgatcaattctttagccaacaccagcaaataagccgtatgcgcatcatggccacacgcatgcatcaccccaggattctgagacttgaacgacaggtcgttatcctcttgaatcgccaaggcatcaaaatccgcccgcaacgctaacgtcggtcccggttgaccgccttgaatatcaacgtacatgccatagccctccccacacggtgtcacggggacgttcaaggctgcataatattgtttgatataagcagccgtttgtttctcatgaaacgaaatttccggatgagcatggaggtgccgccgaatcgcaagcatttccgattcatcggcagccaatgtctgcatcaattgttctgttaaagtcatggtctttttcctctctgtgattttgtctgaactttcggcaactttgcaattaggcgaacaagttgcggtcgaacggccttaaaaataacctccgcgaccacaaaaccgactgccagtgccatcgcaatcaaaatgacgttatagatttgctgcgcagcactcgcggcttttcccatggtgaaactgcgcgcacccagataagcaatgccgcccggcaccagtgatacaagacttggtatgtaaatcgtattaaccggcacccggtgacgaatagcaaaataattccccagcaatccgatgattaccgtggccgtgaagttcggtaatatgaggctgtgatcctgcagcctgatgagccagtatgcacaccacgaaacaccgcctgtgattccagctggcagcaaggcgcgtttggggatgttggtgatgacgccaaacccgatgctcgacaagacgctaatcagaaattcaattaataagcgcatgctagcgccctccccaaacattattcagtacaatcgcaataacgaccccagaaccaatcgcgcccgctacaaaaatggcgtctacagtgcgaacaatgccgctgatgatttgccgcgaaagaatttcccgaatcgcattggtgatggccaccccaggaaccaacggcatgagggcactaataataatattgccggaactatcgccccacccgatgctcaccagtaattccgctaaaatggccaccacaaaggcaccagtcgcttctttgaaataaggcgtcgtcgtgcggcgaccgacatactcagccgcaagataaccaaaaataccaacaaaaaaggctaaagccaaatcaccatttgtcgctttgaaaagcagcattggcgcgaccgaaacccaaccggcgcccagaatccgcgcccaccatgggaaattaatgacttggtgatcaattcgcgcaacttcttgcttaagggcttcaaatgttatccgatgagcgacgaattcacgcgacagttgattcaactcatcgaccttttgcaagttgaatccgcctaatgttgatttgattaagcgcgtacgactttcgttctccaaactgacaaaaactgccgtaatcgtggcataacacgcaacgcttgcccctgccgcatgcccgatatattccacggttgtctcaatccgtgatgtctcggcgccggcattcagtaaaatctctcccaccttgccgcagacttctaaaacttcctctgttcctggttgactcatcgcgtttgctcctcaagatcgcgtttccgcgttttgcattttattaattgtcggcttttttgatagcggtggcaagtgatgacattaggcaatcgccagcaaatttttctgaaaaggtttttcatttattaaccccttaaacaaatgaaaacacaagcgcgttatggcgtgttaaaaccaatgaaaaaaataaataacaaaacataaccaatgcctaaaaatgcgattatcagcagtagcgccaaagccagtttcactgctaatgaaaaatcttttctgcgcaaaatgacgactatcccaagtcctaataagaggagcaccagaaataaaaagaaaaaaagtagtgctctagatgtccaaaagcctaacatggttaccactcctctaatttcatcttgctacttagccgttccccattttttaaatcgataattcgccgacagtgacaaggcaaaaaaacgtcatgtccagtagcctttttcagcttatcaaaggttgcttcaaagcacaaaactgttgcttctcatgatcacgcgcccccgtccaaggctacttacacgtcgatctctccccggtctagcttggcatcaaaaaaaccgaatcgccagctagtttggcaattcggtttccaatttattgggccactttactaatgcgtccctgctcaatgtacactgacaaaatcgccacatcagcaggattgacgccgctgatacgactcgcctgcgcaatggtttctggctggattttaaccaacttctgacgtgcttcagttgccaaaccattgatggccgcgtagttaatacgtagcggaatctttttgccttctaggcgcctcagtttggcgacactggcttcttcctttgcaatatagccagcatacttaatttgaatctcaacctgctcaatgacacgatgatccaaagtcggattatctggcaagaattgcgccatcgtttgatagtcgatttccggccgcttcaggaagtcactggccaagacgccatccttaagtggcgcataatgatgggcctctagccatggattcacgtctttaggcttcaaccgtgtcgtattcagccggttaagttcagtttcaatggcctgacgctttgccaaaaattcagcatagcgctcatcgctaattaaaccaagctcatggcccattggtgtcagccgcagatcggcattgtcatggcgcaacaaaagtcgatattcagcacggctggtcaacaggcgataaggttcattcgtgcccttagtcaccaaatcatcaatcatcacaccaatataggcatcggaacgcttgagcgtgaacggccctttgccttgggcacgcaacgccgcattgatgccagccataatgccttggccagctgcttcttcatagccgctggtgccattcatctggccggcagtgaaaagattatcaacgactttggtttctaacgtggccttcagttgccatggctcgatcacatcgtactcaatcgcatacccggcacgcatgagttcggcatgttccaacccagccacactatgcagcattttcagttgaatttcttctggcatagaagtcgaaaaatcaccgacatagtattcggaggtatcgcgaccttctggctctaagaacagttgatgccgcggcttatcagcaaaacgaacgatcttatcctcaattgatgggcaatagcgcgggccaacccctttgatcacaccggaaaacattggcgcccgatccaaattatcgcgaataatttgatgggtcgttgcattagtgtaagtcatccagcaactaagctgatccttcaaataaactgaatctggcgtcgtgaagctaaaatgattcggagtcttatcgccaggctgttcctcggttttatcaaagtcgatggtgttgccattgactcgcggcggggtcccggttttaaatcgccgcaatttgaagccgagctgttcaagattttctgacagcttgatacttggcaggctgttattaggaccagaactgtacatcaactcaccgatgataatcttgccacgagaactggtgcctgcggtcaaaacaacactcttggcccgatacattgcgccagttgccgccacgataccgacagcttggccattttcgacgagcacctcagtagcgaggccttgacgcagatccagatttggcgtgttttcaatcacgtgtttcatgctgcggtgataggctgctttatcagcctgtgcccgtaatgcacgaacggctgggcccttgccggtgttaagcatccgcatctgaatatatgttcgatcaatattcttgcccatttcaccaccgagtgcatcaatttcacgcaccacgattcccttggctgggccgcccagacttggattacacggcataaacgccagcatttccaagctgatcgtcaatagtaacgtcttttggcccatccgcgcggctgccaaagcggcctcacaaccagcgtgaccagcaccaacaacgatgacatcataggtaccggcttcaaattttttgacatcaggcattcgatttcctccatgaataagtttctaattggcactgagctttacttgcccaagcagaattgactaaacaattgggtgattagttcatctggcgcactttcaccagtaatttcaccaagtttatcccacgccgcagtcatgtcgatttgcacgagatcaattggcataccagcatggattccggcgatcacagcgtccaagctcttgttggcttggcgtaatagtccgatctgccgagcgttggaaaccatcactgttgtttggctattttcgatgccgccgaagaacaacttcgcaatccgttcgtctaaggcatccatgcctgcgctagtcgggatagcggtcttgatgatttcatccggcgaaaccaacttcaacaaggcagtggtatctagctgtgcaggtaagtcctgtttattcaaaacgataatccgttttttattagctgttgcttgaatgagctgttcgtcttcatccgtcaatggttcactttgatccaacactagcaaaatcaaatcggcttgtgtgatggcttgacgtgagcgttcaacgccgattttctcgactttgtcagtcgtgtcatgaataccggctgtgtcgaccagttttagcgggacaccacgcacgttgacatactcctctagcacatcacgagtcgtaccagctacatcggtcacaatcgctttatcctcatgcaacatgtgatttaacagcgaacttttcccaacgttgggacggccaacaattgcggtggctaaaccttcgcgcaagaccttgccttgactggcggtactcagcaaattgctgatagctttttgaacggtttgcgccttttcaagcagcattttggtggtcatttcatcagtatcatactcaggatagtcaatgttgacttccacctgtgccaacacttcgaggatttcctgacgaaggcgtttgatcaatgtatgcagattaccgtctagctgattgactgcaacctgcatcgcccgatcggttttggctcgaatcagatccatgaccgactcagcttctgtgagatcaatgcggccgttcaggaatgcccgtttggtgaactcacctggctcagccatccgtgcgccttcgcctaagagcaactgcaaaatgcggttagtggcaacaataccgccatgacaattaatctcgacaacatcttcacgggtaaaggtcttaggtgccaacatgacactaaccatgacctcatcaatcaactcgccgctttcagggtcgacaatatggccataatgaatcgtatggcttttaacctgcgagaggtcttttcccttgaaaacttgattagctgtcgctacggctgtctcaccgctgagccgaacgatgctgatagcaccttcgccaggcggggtggagatggcagcgatggtgtcgtacgcagtgatggatgcagacatttgaaagactcctttttgagatgattcggtaagaaaaatgagttgatgggattggacatggcaggcgactgaggcggatgagtgatgtggcggcctccgaaacgcgcaatggaattgtagagcctgcatgtagggatttgtgtggtaaaggccaatcccttcatggcctctgaaacgcgcaatcaggcgcatctcggctatgcgaaggacagtccaaccagatggccaaagcccagactttctggttagggggctaggcggttccgaaacgcgcaatcaggcgcagaaacctgcacataaggacatcagacctaaatggcaaaaccagccatttaggtctgatgccacttatgctccggtttctaaccgcgcctgattgcgctctacaaaaaaagcgcaaaatccagtctttccccctatcagggaaagactggataaagcactttgactacttcatcgttattaaactgtgactatcatacttaagcaacggtcacttgtcaaaagttagttacggtcttttgggtgtgactacgacatatcgccgaggatcgacgccttctgaatgggtctcaacgtacgtattgtccacaagtgttgtatgaatcgttttgcgttcaaatgatggcatcgggtcgagatagacggctttgccagttgctaaaacctcgcgagcggtgcgttctgctaaacgtgtgacggttgcctgccgtcgttcgcgataatcgccgacatcaagcatgattgtccatttacttttggcataatgattgaactcagtttgggctaagtattgaattgcattgatgattttgccatgcttaccgatcaacaggccttcttcatctgttttcaactgaaatgtgaccgtgttaccttgccgttcacttgtgacttgagtgtcgatccccataccagtggtgatgtcttccagataactctgcaccatggccaatgcggtttgattatctcgctttttggtggtgatatcgttgaaagcactggcaattttcttgcctgcaccatcagttaaagccgttgcaagttttttccctgcccgcggtttggcaggcggatcgtcgcttggcgtcggatcagcgtctatcggcggttccaagggttttaaattaacaatcgctggcttacgcatcaagcccagaaatccgttcttattttctcgaacgacttcaacgctaacggcatcacgcggcaagccaagctgcttgagaccagtttcgatggctttttgaatcgtactgccttgaaaggttggcatcttgcttcctcccgttgttatttacgccgtttggttgcttttttgtacgctcgcttgagtgcccgttctttttctttttcagcctgcgcttttgcttcacgttcgcggcgaatcttgaatgggttctggatcagcaactgctgaatcattgaaaaggcattggtaactacccagtaaatggccagcgcacttggcaaggtaattgagaaaacgaaaatcatgacaggcgagacgatcatcatgagccagctgctagaattacgcgttggttgtgccatcatggataagacactagtacccaacgtgaataaagttgccagaatctgcataatccacaacggatctggttgtgacaggttcatccaaaggaaagtaccagtttgcagtgatgatgtgcgcaaaattgcttgatacagcgcaatcaggaatggcatctggatcacaatcggcagacagcccatcactgggttaaccccagctgaagcataaagtttctgtgtttcatcacgcagtcgtgtctgggtttccgtatcctttgaactgtacttcttttgtagttcttttagctgcggcgcaatttcctgctgtttggacatgctcttgattgacatgtaactcagcgggaaaatcaaaattcggatgatcaaggtgaaggcaataatcccgacaccagggttgccaccgaacaaattcgccagccagataacaaattgaccggctgtgtagacaacatagcgatcccagaaccccgtactattttgcgtaacgggtccggttccgcaggccgtcaaaatgaagaccagacttagcatgctcaaaatgacgagcacacgtttgatttgacgatttttcacaaatgatccctctcttttttaaacgcggtcgctaggcgcagaaatctgcacagaaggacctcaaatttaaatggctaaagctcagccatatagatttgagtccgcttatgctccggtttctaaacgcgcctgctcacgctctggtcagatgacctcgatgtcttcgttcaggatgccagccaatcgcatgacatgaatcaaatttttcttggtgccagccatgtcgagctggttagcagatttacgtgcaataaccaaaaaatcggtttgcgcgtcaatattaggttttaactccagtaaactttgccgaatatagcgcttaatctggttacgcatgaccgcagtgtggccaactttcttccccactgagataccaacacgaaaatgcggttgatcgcgtttcatgtgatagatcacaaaattgaggttggcaaccgaatcgccatggtcaaacacattctgaaattcagcttcttttttgatccgatatgacttgcgcaatgatgctccctcacaatctggttctaagtatacaagatgactcggtgttttcctatatgtatcagcggtttgttgacggtttctaatctgcacattgagcttaagctgttgagcagaaaatgaacggcaacgaccaacgattgggccattgccgttcattggggtcatgctgctgccgccgaaacgcgtgaacaagtgcagaaacctgcacgtaaggacctaagtcgcaatgaccaaagaccggtcatcacgacttaggccgcttacgctccggttcttaaccgcgtttgtttgcgctctaaaaaaaaccactgacgcggtcagtggcttaggcagataatactttacgtcctttagcgcgacggcgtgctaaaactttgcggccgttctttgtgctcatccgcttcatgaaaccatgaacacgttcacggtgacgtttctttggttggaaagtccgtttggttgtcattgacgacacctcctatgaaaaacgatttatcttattaagatgacttgcattatcagacatcatccgagtttacacgaggaagcaactatcgtcaaggttttttccattgaaggcaggatctcatgatgatgacacgacatccacagatagttatgaacctgtggataacttgtgtctcaaatttttaggtttcggtcatttccacaaaccaatcacaggaaattcgcagataaacaggggtgtgaagaaagttatccacaagctgtcaaagccctgttcatatcttgtgaaacacttactgctacaaggtttttgttccacagtgccaatgtgcataactgcgaatttattgtcatcacgctttcgttgtccccgaccttggggatagtctgttcgcaccctgttcatttctcaattttttgtttgtggaaaactgtgctttctgtggaaaacttacgccagcaatgctaaacttatttttacagagcgtgaattggcgcgttcagtaaccgaagtgtaagcggccttgactgtgatgaccgggctttggtcattgcagtcaaggttcttacacgcaggtttcggtgccaatgagcgcgtttttatataggaatgtccgtcatcactcgtcagcatagctataagctggtttgctaccggacataattggaggaggggcatgaatgcccaatttagaggaactttgggcttacctgaatgataaattccgtgaagaattgaccccggtcggttacagcacatggatccagacagcaaaacccgtcaaattaaccaaagataaactcgaaattgaagtcccagcttctttacacaaagcttattgggaaaagaatctcgtgaccaaggtagtcgaaggcgtttacgaattcgcgcaacttgaagttgatcccgtcattatgaccaaggatgagttgcagccagctccggctacagatcaacgtcctgcggttgaagaagacgatcaaaatctgacttttaaggcaaaaacccatttaaatccgaaatatacgtttgaccgcttcgtgattggtaagggcaaccaaatggcccacgcggctgctttggcggttgctgaagcccctgggacaacatacaaccctctgtttatttatggtggcgtcggtcttggcaaaacccacttaatgcaagcgattggtaatttggtgctaggtaataacccagcagccaacataaaatacgtcaccagtgagaattttgctaatgacttcattaactcgattcaaaccaaacaacaggaacaatttcggcaagaataccgaaatgtggacctgctgttggtagatgatattcagttttttggtgacaaagaggccacacaggaagaattttttcataccttcaatacgctgtatgaaaatatgaagcaaattgttttgaccagtgatcgtctgcctaacgaaatccccaaacttcaagaacggttggtttcgcggtttaataagggcttgtctgtcgatgtcacaccgccagatctggaaacacgaatcgctattttgcgcaataaagccgatgctgaagatctcagcattccagatgacaccttgtcttacattgctggtcaaattgaaagtaacgtacgtgatctcgaaggggcgttagtacgcgttcaggccttttcaaccatgaaaaacgaagatatcacgaccagcttggccgcggatgccttgaaagccctgaaacttgatgaccgcagcggacaattgaccattccgcaaatcctgaatgctgtcgcgaaatattttcagctgacggttcaggatcttaaaggaaagaaacgcgtcaaacagattgtcattccgcgccaaatcgcgatgtatctagcgcgcgaaatgaccgataacagtttaccgaaaataggtcaggaaatcggcggcaaggatcatacaaccgtcatccatgcccacgaaaaaattatggcttcaatgacaactgatgagaatttaaaagctcaagtgatcgaattgcggaatatcttgaaaaaccgcgggtaatgcacatgtggataaccttcaaaaacaaaccattttatccgtcgtacttatccacaagtgcataactttctcagttgttgtttctcaaagttttccacagtttgaacacgccctattactattacttcaaaagctttatattatatatataaaagacgttcaggaggctcttatgaaatttacgatcacccgatccacattcttaaaaaccttgaatgatgtttctcgggccatttcaaccaaaacaactattccgattctgactggattgaaaattgtgctcaacgatagcggcttaatcctcactggtagtgatgccgatatttcaatcgaatcacggatcaacgcaacggatgaaaataatgatctccaaatcggaagcactggtgaaatcgtcttgccagcccgtttctttagcgaaatcgttaaacgtttgccagaaagcacaatgacgctggaagttaaagacaatttccaaaccgtcatcacgtctggggcatctgaatttactattaatggtttggatgccaataactatccgcggttgccagaaattacagccgatgcagcgttgagtgtttcagctgatgtgttacgtcagttgattaaccaaacagttattgccgtttctaatcaggaaagtcgaccaatcttgacaggggttcatctgacaattaccggcgatcagttggtagctgttgcgactgattcccaccgccttgcgcaacgtagcctgaccttaccaacagcaagtgcctcggattatgacatcattattccagggaaaagtctgacagaacttagccgcatgttaagcgatgacgttgaaaaaatcgaaattcgcattgcggaaaatcaagtgctgttcgtgtttgggcaaacggccttttattcacgcttacttgaaggcaactaccctgacacaagccgacttattccaacatccagcaatacgcaagcggaatttgacgcaccagcattgctggcctccattcaacgtgccagcttgctgagtcacgaaagtagcaacaatgtggttcggcttgtccttaatattgctgatcaaaaagcgactatctacggtaattcgccagatgtcgggaatgttgaagaagtacttagtttcaacaaacttagcggcgaggatctagaaatctcgttcaaccctgactatatgaaggatgccttgcaaggatttggccaaacggcaattgaagttgacttcaccgcaccattgcgaccattcactttggttccaacagaggacaaggaacggtttatccaactcatcacgccagttcgaacgttttaacacgtgatgtagcaacaaagagcgccaattaaaaaagattctagagagtgatgaattctctagaatcttttttgttatcgaactgatattcgccaaagtttagtgttttcttttgacgaaataataatagacaaatgccaagacacaacccatcaagacgctgaccaagattgtcataggattcagccaattatgaaaatctgtattgaaatttccatagacgtacgtagccactgaagaaattaaaaagataccaaagaccgacttagtagtagatgtcatattttcctccatatatgggtgcagactgcgctttcataaatagaaaataaatacataataatagatagtcaatatattatttttataaaataataagagtctatacaaagctttatgttaaattttatgaaactaaaaagtggattttaatgtaaaaagacacatttatacattgttatatgctctaattatacagaagtgattatagatagccaagtgtgcagcctttcatttttgaagactaatcgcgattcacgatcaaattgcaaaaacgttcatttgcgttgcttgatatttttaaacgcagatttggatattgctggacaaaagtaaaagtagctttagagttggtcaaaatcgatagaaatcaaaatttagccgattttggcctttctgggtctttttagtctagggggacgcacaacgttcagattgcctcagagccgctttaatgccgttttagaattgtgttttaagtagtataagggtataattaatttgtgttcattgacgacaaatcgcggtttaacgcggtttgtctagcacttttcggaatggagggcgacagcaatgacaacaatcgaaatcacgaccccttttttgaccttgggccagtttctgaaagaggcgggattgatcgatagtggcggtgcggccaagtggtatctgggtgaaaactcagtgacagtcaacggcgcagctgaggagcgacgtgggcgcaagctgtatccagatgatcaagtcagcgtggccggccaaacatacgtgatcgtgagcgcatgaaactggatcacttggtgctgaaaaattatcgcaattatgctgctgttgatacaacattttcaccagaaatcaatgttttgattggggcaaacgctcaaggcaagacgaatctgcttgaatcaatctatgttttggcattggctcgtagtcatcgaaccaacaatgataaggaactgattcgctttggtagcgagtttgcacgggtttccgggcaagtttcgcgacaaagcggttcccatcagttggagttgattatcagtcatcaaggcaagcgtgcccggattgatcgcatcgaacaaccgaagctttcccagtatttagggcattttaatgtcatcttgtttgcacctgaggatttagccatcgtcaagggcagtccggctgggcggcgtcgcttcatcgacatggagtttggccagatgagtcccaagtacctttataatctgagccaatataaaacgtttttgaagcagcgcaatgcgtatttgaagcagcttaagtatcatcaggccaaggatctggtttatctggatgtgttgactgactcgcttgcagctttcggggcagagctaattacggcgcgcgctaagttgttggagacgatgtcggattatgctgcaacgattcagcaagatatcaccaaggggcgggagtcattgcatttttcttatcaaacacaggttgaccccagtcttcgcggtgacagtgagcaggtttacactgctttgggcgagatgtttgccaagcagcaagcgcgcgaaatcgaacaaggaaccagtttagtcggtccccagcgagatgatgtgttgttcatcgtcaatgataaggatgttgccaattttggcagccaagggcaacaacgcaccacagcattggctgttaagctggcagagattgaccttatgaaggatcaaaccggcgaatatccagtgctattactggacgatgtgttgtcagaattagatgcggctcgccaaacccatttacttaaggccattcaaaccaaagtccaaacctttttaaccaccacaagtttggaaggcattcaaaaagaaatcatcgcaacccctgcagtctttaaagttgatgaggggacattagcaagagcgtaaaccagcccggttagaaaccggagtgtaagcgggcctgaacgtgatgaccgtattttggccattgcgttcaggttccttacacgcaggtttctgggctggtgaacgcgtttaaagcagagcgtgaacaggcacgtttagaaaccggaacataagtgggtttgaacgtgatgaccggtttttggccattgcgttcaaggtccttatgtgcagggttctgtgccagtgaacgcattttaacaaggaggataaccagtgacggacaagaaagaaacggccgaagagaagaaggatgaactggcggctgagtatgatgccagccagattcaagtactttcaggacttgaagcggttcggaagcgtccagggatgtatattggctcgacaagcagccaaggcttgcatcatttggtctgggaaatcattgataacgggattgatgaagcgctggctggattcgcaacacggattgaagttgaagttaacccagataatagtgtgacggtaacagatgacggtcgcgggattccagtcgatatccagtctaaaacaggacggccagcacttgaaacggtttataccgttttacatgccggtggtaaattcggcggcggtggctacaaagtttccggtggcctacatggtgtcggggcatcagtcgtgaatgcgttgtcgactgatttggacgtcacggttactcgtggtggcaaacgttactacattgactttattcgcggcaaggtgaacacgccgatgaaagtgattggcacggcaccggagcacgaacatggcaccaaggttcattttctgcctgatccggacatttttaccgagattagaacattcgatgataagatcctgaccaccagaattcgcgaactggctttcttgaacaagggtctcaagttgacctttaccgacaagcgcgcggcaacgcacgagaagctggtgttccattacgaaggcggcctcaagtcttacgttgactttttaactgagaaaaaagaaaacctgttacaagaaccgatttatgtggaaggacaagacaaaggcatcacggtggaagtcgcgttgcaatacaccaacgactatcacagcaccttgttgacgtttgccaacaacatccatacgtatgaaggtggcacgcatgagaccgggttcaaaacggcgctgacacgggtcattaatgattacgctcgccggtctggtgcgctaaaagacagcgatgatccgttaagcggggatgatgttcgtgagggcttgacggcggttgtttccgtgaagcatccagatccgcagtttgaagggcaaactaaaaccaaattggggaactcggatgcccgaacggtggttgaccgtaccttctctgaccacttcaataagtttctcatggaacacccagctgatggcaagctaatcattgacaaagctatgctggccagcaaggcacgtttggcggctaagcgggcgcgtgaagtgacccggaaaaagagcgggttggaaatttcgaacctgcctggtaaattggccgacaacaccagtaaggacccagagatctctgaattatttatcgtcgaaggggattccgctggtggttctgccaaatcagggcgtagtcgcctgacgcaggccattttgccaattcgtgggaaaattctgaatgtcgaaaaggcttcaatggaacgcatcttggccaatgaagaaattcgaaccttattcaccgcgatgggtaccggttttgggcaggactttgatatcaataaggctcgatatcacaaactgatcattatgaccgatgccgatgttgatggtgcccacattcggactttgttgctgacgttgatttatcgctacatgcggccagtgcttgacgctggctatgtctacatcgcacagccgccgttgtatcggttacgccaaggcaaaatgacgcaatatattgattccgatgaagaattgcaagacattctaggccagttgccgccgagtccaaagccagagattcagcgttacaaagggcttggggaaatggacgccaaccagctatgggagacgaccatggatccggataatcggcgcttactgcgggtatcgccaaaggatgccgaagctgcagatggcgtttttgaaatgttgatgggtgatcatgttgaaccgcggcgtaaatttattgaagataacgctgtgtttgttgatccgaacaacattgatgcttgattgaccagtttaactaagtcagcttttgcatgagaatttttgagaggagacttttcgcttaatggatgatcgccaagaaagccgaattaccaatgtgaacctcggcgaaacaatgcgtaaatcattccttgaatacgcgatgagtgtcattgtggcgcgggccttgcctgatgtgcgcgatggcctcaagccggttcaacggcggattctgtacggtatgaatgaactcggcgtgacgccggataaaccgtacaagaagagtgcgcgtattgttggggatgtcatggggaaataccatccgcatggtgatagctcgatttatgaagggctcgtacgaatggcacaggacttcagctatcgttacatgctggtcgatggccacgggaactttgggtctgtcgatggtgacggtgccgctgcgatgcggtataccgaagctcgcatgagcaaaatagcagtcgagatgctgcgtgacatcaacaaagatacgattgattttcaggataactatgatggcacggaaaaagaaccggttgttttaccggcacgttttccaaatctgttggtcaatggggcgactgggattgcggtcggtatgacgaccaatattccgccgcataatctgtcagagactatctcggcgctgcacgtgttgatggataatccagatgccacgacagctgacctaatgcaggcactgccaggacctgattttccaaccggcggcgttgtgatgggtaagtcaggcattcgccatgcttatgaaactggccgcggcacgattgttttgcgcgggaaagttgatgttcagacggagaagtctggccgtgaacggatcgtgattaccgagattccatatatggttaacaaagccaaaatggttgaacggatcgcagatttggttcatgaaaagaaaatcgatgggatcgtaaccttgcgggatgaatctgaccgtgacgggatgcggatcgtcattgatgtgcgccgtgatgctagtgcatcagttattttgaataacttgtacaagctcacgccactacaaaccggcttttcattcaacatggtggcaatcgttaatggtgcgccaaaagtgttgagcttgaaacagatcctgcaatattatctggatcatcaagaaaacgtcattcgtcggcggacgcaatttgacctgcgtaaggccaaggctcgtgagcatatcctcgaaggattacggattgcgcttgatcatattgatgaaatcatcacgattatccgtagttctgaaactggcgacaaggcaaaagtcatcttgatggacaagtttaagttgtctgacaagcagagccaagcaatcttggatatgcggctggttcggttgaccggtttggaacgcgagaaggttgaaagcgaatataaggatgttgaagcagcgattgctgattatactgatattcttgctagaccagaacgtgttcatcagatcatctacaacgaattgctggatattcagaagaagttcggcgataagcgccgtactgaattactggtcggtgaagtgctcagtcttgaagatgaagatctgatcgagcaagaagacgtggtcatcacgttgagtcataacggctacgtcaagcgattggcaaccagtgaattcaaggcacaaaatcgcgggggtcgcggtattcaggggatgaacgtccatgatgacgatttcgttgaacgcctgatttcgacttccacgcatgatgtcctgctcttcttcaccaacaaaggtaaagtttatcgcagcaagggttacgaaattcctgagtacggtcgaaccgcaaaagggattccaattatcaacttgcttggtgtcggtgccggtgaaaagattcaaacggttatcaacgtgcatgaaggcgaaaatgatgatcgttatctcttcttcgtcacgcaaaaaggcgttgttaagcgcacaccggtgaaggaattcgccaatattcgcagcaacggactgattgcgttgaatctcaaggatgaagacgaactgaataatgtcatcctaacgtccggacaagacaatatcctgatcgggacgcatctgggttacagtgtgaccttcaaggaacaagacgttcgctcaatgggacgttcagcgactggggttcgaggtattcgtttacgtgaacacgattacgtagtgggttccgacattctcaaacccgattccgaagtctttgtcatttcagaaaaaggttacggtaaacggacggcagcgaaggaatatccgattaaaggtcgtggcggtaaagggatcaagacagccaacatcaccgccaagaatggtccgttggcaggggtcactaccgttgatggtaccgaagatattcttgttatgactgattctggtgtcatgattcgcttcaatattcaaagtgtttcgcaaactggccgagcaacgttaggggttcgtttaattcgagttgacgacgatgccaaggttgcaacgatggccaaggttgaaccggaaagcgacgatccagacgatggcagcaagccagatcagccaactagcccgacagacgcttctgatgcaccaacctcgcagcagccagctgatggttcgtatgctggcgatgccgatcagcaagtgagccaattgcttgatcgcgctgaggctgatcaaccagagcaacatgatactggcgatcagcctgaataatctaataatgctagcatcaattgagctgattcacgctcaataaaaataccggtcgaaatggcaatttgccacttcgaccggtatttgtttgcgtacagataacctcaaatcgtgaaggttgattggttgcccatgcgcgccttaagttcatggatgatcttaacgccgctgctggtaccgatgcgagtcgcaccagctttaatcattgccaaaaaggtatcaacatctctgataccgccagccgctttgacttgcacttgatcgccgactgtttctttcatcaaagccacattttcgacagtggcaccggctgggccaaagcccgtcgaagtcttaataaaatccggaccgacgtccttagcaatagttgccattttgataatttccggcttggtgagataggcggtttcaaaaatgactttgcacggtacattgaccgcatgacagacagcaacgatttgacgcatttcattttcaagataactgtattgctgttccttaagcgccgtgatattgatcacgtagtcaatttcgttggcaccgttttgtaaggcgtctttggtttcaaaaactttggccgcgatgctcgtttggcctaaggggaaagcaattgcggcgccaacatcaatgtcggtacctgctagttgtttcgcacaaaaagccgattggacttggttaatcgccaccattttaaaatgatattgtttggcctcgttgcaaagctggcgcaaatctgcgtgagttgcatctgcatgtaagtttgtgtgatcaatcatgcgactgaattgatctaaagtataagctgtcatgatttttcctccaaagttgaattcggttacatttagcataccactttttgcgtaatgtatatctgacagcgataaatagtacggtgttgtgcaagcaaccatgcagaagaaaggccattgcggtcaaggtccttatgtgcaggttgctgcaccagtgaacgcgtttaaggcagagcgtgagctggtgcggttagaaaccggagcataagcggccttgggcgtgatgaccgtcctttggtcattgcggtcaaggtccttatgtgcaggttgctgcaccagtgaacgcgtttagaggaggagaagcgaatgttgaatagtgtgagtctaacagggcggttgaccaaggagcctgaagttttccgaacggctaacgagcttgatatcgtccgatttacgttggcggtgaatcgcgttttcaagaataaaacgggacagcgcgagactgattttattgagtgtgtcatttttggcaaacgcgccttaacttttgcgggatcaactaccaaagggtcattgttgggtatttcagggcggctgagtaataatcattttgaaaataagcaaggtgagcaagtgtggcggaccgctgtcgtcgttgataattttgcttggttggagtcgcgagccacgacggaaagccgccgggcagggaccttgcaggcgacaggaacagacgacgtcatgccagtagaggaaggcaccccgccacaggtcgcaaccgacgatctgccattttaaaggtggtattcgccgcggatctatgctacaattttaactcgtgagtatccggctattctatagccttagtactctccttgctccggcaaatgaccggggcctaaagtccataaggaggtgaatcgtcatggctgaaaccaaatatgaagtcacttatatcatccgtccagatttggacgatgctgcaaagactgaattggttgaacgttttgacaatattttgaaggaaaatggtgccaacatcattgattccaaggattggcaaaagcgtaagctcgcatatgagatcaacaagtacaacgaaggtctctatcatatcgtgaacttgtccgcagaagatgacaaagcgatcaatgaatttgatcgtcttggcaagatcaacaacgacattctgcgtcacatgatcgtgaagcgagaagactaatcgtaacttttttgaaaggggcgctacggcatgcttaacagtgttgcattgacaggtcgattaaccagagacgttgatttgcgttacacgcaaagtggcacggctgtcggttctttcacgctggccgttgaccgccagttccgcagtgcaaacggcgaacgtgaaactgacttcatcaattgtgtgatctggcgtaagtctgcagagaactttgcaaacttcaccaaaaaaggatccatggttggagttgaaggccatatccaaacgcgtacgtatgataacgcgcaaggacaaaaggtctatgtgaccgaagtcgtcgttgaaaactttgcgttgctggaatcccgggcaacgactcaacagcggccgtccgaaccggcaaatccagctggccaaggtaatcagaactatggcggcgggcagcagtttggcaataaccaaccgcagaatccgccaagttttggttcacaaggcgccccgaacaatgcatcatcatcgaatccgggtcaaaatccggcagcaagtcagaaccaaggaggcaactccgcggctaaccctgctaatcccgatccgtttgctaataatggcaagccgatcgacatttccgatgatgatttgccattctaaggtgtgacgcaaagtcgcactaaccgcggtaatcccttcaggcgaagggttatctaagtggaatctttgataagggaggaattctcatggcacaacaacgccgtggtggccgtcgtcgtcgtaaagtcgacttcatcgccgcaaaccacatcgaatatatcgattataaagacacgaacttgttggatcggttcatctcagaacgtggcaagattttgccgcgtcgggtaaccggcaccagcgctaagaaccaacgtaagctgacgatcgcaatcaagcgagctcggattatgggtcttctgccatttgtttcagaagattaattggtattcaaaaggacgttcctgcttaactggcgggagcgtctttttttgtgtgagcgtgaattggcgcaggtagtaaccggagcgtaagcggcctaagtcgtgatgaccggtcttgggtcattgcgacttaggtctttacgtgcaggatactgcgccaattcgcgcgttatgatgaattttgacgcctttaattgttattttcgatcctgtcacaaagaagagaagtgtatgagaccaatcggtaaaacagcaagcccttttctcgaaataaattgaatactggctaaaaacattttctatcatgaagcagaccaatgtatgacgattgcagtatttatcacaagcttattgttatataaaataacgagatagttctacaatagcggtgatcaggaatacagggaaaaatgacattattggttaatagaggtgatcaaaatggggctcacgttagccacgattccgctggctgtgacgaatctgtcacgcatgcagtttgcggtaaccgcgatcacgcattttctatttgtaacaacgaccattggcatgttgttgacgacgatgatttttgaatttatgtatgcttatggccgtggcgatactgaaaagtatggccggctgaccttattcttcagtcggattttcttcttcagttttgggacaggtgttgttaccgggctgatcatggagtttcaatttgggatgaattggtcggcgtttacgcggttgatgggcgatgttgccggtgtgccactggcgatcgaaagtatgatttccttcttcgttgagtcgaccatcatcggtttatggcgctttacttggggcaagttgccaaaacgagcacatgcttggttaggcgttgggatgttgggcgcatcgcttttttccattgtctggatcattgcaatcaatgcattcatgcaaaatccttatggtttccgtctggaaggtggccgtgcacggctcacgagtctgattacgttattacagaacccgcaatatcggccggaatttttgcatgttttattcgcaatcctgatcaccggcggatttttgacagcagggattgctgcctggcagattctgcacaagcgtgatacgtcagcgttcaaaattgccgttcaaattggcttactcattgctttgccagcagcattcttacagccggcacaaggcgacgatcaaggtgccgcaacagcagcgttgcagccgatgaagtttaccgcaattgaaggacggtatgagacggaaggtagtcccacaactggggcaccttgggcgatggctgcgctgatcaatgaagacacgcacacaaccaaggccgtgtcgattccgaacatggggacttacttcggcaagaacacgttcactggcaccatgccgggcatgaacgctgttgccaaaatgtatcacgcaaagttcgataaaacggttgccaagtcgtacgatggccagatgacttattatccgccagtgaccctgctgttctggaccatgcatttgatggtttatgcggggtacttcttcacgatgttcgcgttgtttgcgacgatcatgctgcatcggcggcaatcggcaatcgaagatcatcccaaaacgttgcggacactcggttgggtactatggctgccatatttgaccttcacatctggctggatcgttgcggaagttggccgatatccatttgtggtttatgggctactcacgcagtacgatgcggtttcaccgagtgtgaccgtcactgaggctggtacaagtctggccttgttcttaatggccgatatcttcttagtgaccacgatgatttacatttcacatcgcactgttaaacgcggtttgccgcaaatcaccggtgattatccagaagatcgcacaattccggatccatttgcaaaggaggcgttcagtcatgcctagcctttcaaatttacaagtgatctttctaggtatcatttcgactgagctgatgctattcttcgttttggacggcgctgattttggagccggcatggcgacattctttgttggcgatgatctatccaagcgtcaacaaattatgaaggttactggaccagtttggggcggtaatgagacttgggcggtcaccgcctttgcagtgatgtttgcggcttatccggggtggtactcagcgttaacatccggttattacccactcatcttccttatgctgttctttctgatctttcgcggggtctcgtttgattatcgcaatcaatggcacagtcgccactacaatcgcttctgggactgggcacttttcattggcagtttaatgccaccattcctgttaggcattatctttagttccacagtaagcggcgtgccgattcgcaatggcttcgtctacgccagcatgggtgacattctgacgccattcagtatcctcggcggcattctggccgttctcttaagcctgaatgttggtttgaatcgggtcatcaaaaaagttaccgaaccggtagcaacaagtttgaccgttgcgttaaaacgaaccacttggatcctctatccggcgctcgtcttgtttgccatcttattgccgtttaacacgcagttctttaccaaccggcctgtcattgtcacgttactgctgattttactggtggccttcctcggtgttgaaacgtgggcaatcagccaacaacgacggcgtgtagccttttggcttagtgtcggcaccatggccagcttcatttacaccatttttctaggggtctttccaaccctgattgttggccgaacggcgggtacctccattacggcgttaacagcaacaagcggtccggtttctctgttatggacagcgtggttgttcggcttcacgattatcttgatggtgggtttgcaggcaacagcctatcacctaatcaataagtactaccacgagccggcatcgccaatgatataaccggcggcgaaaagaaggtgcatatgatgaaaaagatctggatcaatgtcttctgggggctgttagttgttggcttctggctctatcagctcttctggccattattctggaacccgatcagtaagttctacggcatggtggcgttgtacagcattgctgccattgctttcggctttgcagttcgggctacacttaaaggctatgggcgccagaaggcttgagtgttatgaacaaagaaaaccgctgcgacttcatgatcgcaacggtttttttgaatgctgatttggcgttggttattggctgacttgatcgctatctgaaggcgttaaaaaactcaggatgatcaagccgacaaaggtaatcgagatcccaagggctggataaaaatagatgccaatagcagtgatgccaattgatagtgggaaaaagattgaggatagaaatttaaaaggaaacatctgcgcaattttttgactaacagcagtatgcacgtgttcaggtgtttttctaatggcatctgaaagccatagatacgataaactccaaaaaatgaagacaaacaaatatagatactccggtccagtagcttgtggaaacttcccgacccaaccagttgcgacaggcagtaaggacatgctaaaaagccacaagttgttaatccaataaaccttttttgatattctgagggctaaggcaaacatgtagtgatggttgtaccaagccaccccgacaaaaagaaagctgacaatataagcaaaaaagtaaggtaattgatggataatacccgtccattttgcggttcccggggttttaaactcaagcaccataatggtaaggataatggctacgactgcgtctgtgaatgcttcaactcgacctttattcattttttcctctttagcgtaaacttagaatgatttgacaataagattatttgatctgagtttactactgtttgtttctgagggcactttttaaaccccaaatatgggtctgaagaagcggacagataagcaagctcactaagcgtttttgagtttctggtgaaaaaagttttatctctcttaatatgaaaaaattgcgacatcatttgttggtgagtggcgcagtagcaaatgttcataaaggtatatttttcatcgcggtttcctactgttaataatgtgtgattttcgacttttagtcaaagccataaaattgaaaaagcatgcgttgggaaacaactgaaaaaggtcgaagctacgttagccaatcgacctttaagttgagaaacgtgaattattttatttgtgtttttcggatacttgaagactgactaaaagactattggagcataatgaaaacaaaggtattagaacaaatgcgtaccgtgatttcatcaaaaaaatcgttgcaaaacaaacagtcatgatcaagagactaccaacgtttgaaaaaagatacggttcatcacccttaatatgcttaataaagttagcatttccatagataagcaagaagatagggatcattgatagttcaggactgtgcaacataccgccgagaaaaaagagaatataacccccattcagagacaaggcgatcttaccagtttgatcttcggaagtgtgttgagcccatagcagcatgcctaaaatagagaaacgcaaatacattttaaaagtaattttatcaagcaataaatcaccccactaagaaaacgttttctaaacgataggatacacagagacaaacgacttgtcaatgtgttttaaaattaatctataaccataaaaatataattaatatataaatgaggcgatagtcattgaatgtattgctcgtataaatacacttgacatttaaaaagcaaatcaaaagtgaagcaattgttcagtgtgagaccgtcattttatcgataactgcttctacgttcatgtctgctggctcctgcaatggttgctagcagaagcaggactgccgccgccaaagcaaaccaagtccaaccggcaatgggaacatgagcatctgccaaatagccaaagccatacatgataacaaggtggctgccagcaaggactagtgcagcgaacgtcatgctaaggcgctgccagattgtgacggcgttggtgaaccaagccgtgaccatgactagtagctgtgccagcagcaacaaagccatgggaagctgtaaaattgaattgagataagccatcgtatctgtctcctttaagcgtgccataaaggacggatcagtttcgcattttggtgcctatatcctaatcataccaacaaaaattcaggcttgatagtgttatactacgtctcaattgcagacaggtagcggggttggcatactatgagacattagcagccagcaaaaatatcacgcaaaaaaaagcctgtcagaggatcaactcactgacagactatttttctaaagcagacgtagaggagtgcgttcgttgaaaaaacaatatcaaccacgtgtggttatcctaattgttggggaagacttttaagatgatgtttatgcagacgcacgacaatcataataagcagaatcagtagcattattgaaatagccccacgttcaataccaaagacgccgccattcagccattgtgtattcgatgtcggtgtcgaggtgataaataagcggatggcaggaaagccggagacgattgtcccgaagataataccctccgaaaagtgccatgctgcattgatagcgccacacagccagatattaccagaaatcagccgaatttcggacatcaaaatactgaataagaatagacttagtgcagcataggcatcaaatcctgcattaacgacatgtaaaaaaacatacaaaattgagtttgttaaaaaagcgaggacgatacgcttcttttcgagccaataccccatcagatagccacggcatattaattcttcagcgattgcctgaatcgtatagccaatcaaaaagagaaaaaagacgggcagataagaccattgatagttgaagattagcttgtaaccacccaaaagtgtgatgatgccccagttaatgagaacagctgacaatccgattaaggaccctaacacacaagttttaaaagcgactttagttgaaaatttgatcatttgcaactggcttttatgacgttgccacatcaaataggcacctagaaattgagctacgaaacctattagtatgataaaacgcgtatccaacagtgttgctgtattcatggatagcaaaccaagcaacataccaactgcaagtgaaggcagaattccccagccaatcgctgtcagtgacaccgctatgatttctttaagcaaagttctgttatcgaccatatcctcaccataaaaaagagtcctgtataaagtctaatcttcatagaggattcttccctttcatgaaaaataagtaatattagtgacgtggaaaatttcgatgattgccttcgttaaacccagcgacaatatcatcaatgtggccaaatgcttcttgagctaggccaattccgatgtcaacccaacctttgcgtttgctgccaccggtcacggcagcgcaatcttgaagtgaaagcgtggaaaacatagttaatgatgtcatgggatacctccgattttttcagtatttggtagcaacagggaaacaccagatcagcaatgaccaggtccgccatatttatgtgcccggcagtaacctgcatcacctgctgcggcccaaatgatacctagttctttgccgacgccgcgccagaagtcacttgagccgtcccctccaactacgagttgaagctcttgcatacttaattcggttaaagataattgttttaccattttgtccctcctaatatttagccttgcctaacttttaaaacgcattaattcaaggagctagctgccctaaaaacaagttacaatagtgcacaggaattttggtgagttttatataaacgttggttattcaccgataaacgttaggaaatttgctaaaaaacgtaaaaagtgacgttaaaaactattttaacgacgtttatttttaagagaccttgtctaatgactattaagagaggttgatcgggagtagtcttgatttagttgggcgaacagtttctatcttgacgattgcgatacctgttatgtcgcgtgtgattgctagcgggtgtctcgaacaagcgaaatagttgctgataaacctccttaagtgccaaaaaaagaagccacaaggaatgcgatcaaacattctttgtgacttcttttagataactcggtagttttaggttgggaccgtgatgtgatcccaagacgtgattaagggtaggtaaaaattaccggtggatataaacgtagctgcttgcaccagagatggtttgggtgttcgggccggttggtgagctgaagcccatgccgccttggctgatcgtgacactgtcaccggagacagattggacataagcaacgtgaccatatgaaccatcggctgtccattgaccgccaacggattgaccagcggcgaagacgatgattgagccggctgctggcgtgtggttaacagtgaagccagctgctgcggctgaaccgccccattgtgcgccgttgccccagccattaccagcccatggtgcaactgatttgacgtaccaggtgcactgaccccaaggataggtgttacctgaaccactgaagtcagcgtggctgccactgcctgaagctgtgttgttggtgataacagaagaactgttgtttgaagaacttgatgtgttgttggcgatggtgctggttgaagttgcgctgcttgaactgctggtagtagaagaacttgcggttgaagcggcaacggtcttcaaagcggcttgggttgcagcagctgcttcagactgttcttgggcaaattggctttgcaaagcaaccaactcatctttatgatcagcaatttgcttattcaaagcatcttgtttatcgttagcatctttttgtagggaaaccaactgtgatttctgggtttccaatgaagccttagttgaaaccagcgtctgacgggcattttcctgttccgtcttcaagccagctaatttatccttggcaactgtcacggcatcaagcgcatctttgctggcttggctaagtttgccaaccgtcatggtgcgggcaattaagtcagacaagttctgggaattcagaacaaagtcgatatagacattgccgctgacagagttgccagcctttttctgcaaggagatcaactgatctttcaagttgttcttgcgtgctgtgacattcttttgagcggcaacaatttcaccgctgagtgatgaaatcttggcatcagttgcgctgatcttagccgttgcatcgctgatttgaccattcttggtatcgatctgcttgttcaaattgataacttctgtgttcgcatcttcaatttgcttcaacagtgcattggtttcgcttttgttggaagcgatactgtcgcttgtatcagcgaaaactggtgttacggcgctagcagaacctgctaaggtaactgcagcaaccaacgtgatcatgactttattgaatttcatttttgacctcacccttaatttgattaactaaaggctactttactgtgtcaatgttacgtcagcgttacaggactgttaggagttggtctcaatcttcatttgcgcttcaaaattgcgatcatgaacgtttttaatcccaatttttgatgaattttgtatgaaaaaagcagcgccgtgacgacgctgcctgacaaaattgtaagttattcgtttgatttcagggcttcgaccatgtccacccgttggagtcgacgatgcgtgagccaggtgacgacgccggtgaaggccaacatgagtaacgtggccgtgaggtagccgacaatgctgatcgtgagtgggaaaaccacggcctcggtttcggcttgatacaaaatgtaggctgtcagcaaattgccgagcagatagccgaacacgatgccgatcactgtcaacacaatgctctcgcgactgatgtacatggtgacctcgcgatcgaaaaagccaagcaccttgattgtggatagttcccgaatgcgttccgaaacgttgatgttattcagattgtacaagaccacgaatgacaaaaccgcactgagcagaataaaaatcaaaacaataggatctaacataccgctcatattgcttaacgttttctttgctgtcgtcgtgaaactaatcccgacaatcgcgtgatgattgagcaattgcttagcgagtcgatcattttgtttgctgctttggggctgcaagcggactagcaaggtgtttggtttcgcactattaccagcgagctggtgataagcggtgttggagagatagccaaaatggccaacgtaattcttagcaatgcctttaattgtgaatcgcttgctctgaccattagttgtggcgactttaagggtatcgcccgttgtcacgttgagtgccttagccagtttgctggtgatcacgataccgtggcgcggcaaggtcagtttgcgatttgacgccgttgaacggagactgacataaggttcaagatcgttgccgtttgctggggcaaacaaattaacatcgctcaggctatggcctttagcactgagcttagccaccgcgccgctaaccgtgcccgcgctgcgataagctttgcttttagccagaatgtcgcgggccgcagctggctttttgccatcagccaatcgcacaatggcttgataatggatgacatcaccatactgttgaataccagtagccgtgatcgagtctttgatgccaaacccggtgaggatcaaggcggtgccgccagcaatcccaagaatggtcatcaccagccgtgatttgtaccggaaaagattacgatagctgactttttggttaaaagacagacgcgaccaaagcggcgtgatccgctccagcaaaatgcgtttggcggatttcggtgctcgcggccgcatcaaggcagccggcttttcggttagttcattgcggaccacaatggcggcggcccctaatgttgcgatcagcgccaataacaatgacaaggcgatcaacggccattgcaaagagacgacttgttggagcggaatgtaatttttatacaaactcaagacaatgcgcggaatgctcaagttgccagcaaaaaccccgatgatcccacctaataaaccagctaaggcagcataggcgaggtaattgcgcgcaatcgcccatttgccgtaaccaagcgccttgaatgtgccgatttgtgcgcgggcttcttcgaccatgcgactaaccgtggtgaaagtaatcagcgcagcgacaagaaagaagaaaactgggaaaacgttggcaatggcggcaattcgatcagcagaaccgccgtaatcgccaaagccagggagatcttcccgagtttgccatgtgaggctggttgacagttgtttgcgagctgtgacagtggcctgttgctgaaaggttgatagttgcggcttgatagcttgatcggcagctgcggcaacggcggctgccggcatgcctgacgccgctaattgtgcttgagctttggccgtagcggttttaacaatgttggcatatactgctgctcgcagatccttttcgccttgcgccttcacgcgctgtttcaccaatttcatttttgtggcaacggcgtccttgtaacggttgctgaaggtatcgcgtgtttgcaaagctgggaagcgaatgttgagctgcgaggcgaccggcatcttcatctgacttgctgggatgtaggcaaaataacgcacggtgccatcaccgatattcgctgacccacgactagtgtcttcgatgtaggctggcgaatcagcaaaaccgctaattttaaaagtacgtcgagcaagcttgctgccgctggtgaaagtgtaggtctgaccgagtttatagccgctttttttagctgccgtgtcgaggacaatctgattggcttgcgttggcagctgtccactggtgagatgcaggcgattgatggttgtccctttttggtagccgtaaagggcaacaacatcgctggcgcggccgccgatgacatacttaaacttgacggcttctgcctgcacgccgctaactgattcagcggctttaacttgagccttactgacaccagtcgttgccagcaactgactatcagccagatgatcggctttcactgtggtgtttagagaatccttaagtgccggccccgtggccttgacgccgacgaacagcaggacacctagcatgataataatgacaatggcgataaaccggcccaaagagtcgcgaatgttacgccaaagatttttagttagtggtttcatgacgttactcacctaccactcaatgtctgcgacaggcgttggctgcggttcatcatgaatactgcgaacctgcgcatcattaatttcgatgatccggtcagccattttggcaatcgctgcattatgggtaatgatcatgacggttttatgatctttacgactggcatcctgtaacaactgcaagacttgtttgccggttcgataatccaaggcaccagttggttcatcacaaagcagcagcttcggatttttcgccaacgcccgagcaatggccacccgttgttgctcaccgccagacagctgtgacggaaaattatctagtcgcgcacctaggccgacttgctttaaaacagttgtcggatccaaggcatctttgacaattgagccagccagttcaacattttcccttgttgtcaggttcggaatcagattgtaaaactggaacacgaagccaacattatgccggcgaaaagcggtcagttgacgatcagaaaaagtcgcaatatcggtgccgtcaatccatacctcgccttcagtgggggagtccatgccaccgaggatattgagcaaggttgatttaccggcaccgctgggaccaagaatcacggttaatttgccttgatcagccgtaaaattaatgtcgttatttgctgtaatgatggtttcgcccattttgtaacgttttgattcatgtttgacttcgatatatgccatgattgcctcctagcgtggatggtgagcaatgtgtgaagttcttagacgcgttcacaggccaagaaacctgcacataaggacctcaggcgcaatggccaaagcccggccatcacgcctgaggccacttacattccggtttctaaccgcgcctgttcacgctcttcaacacattgtccatttcataacattatgttagatttaaaccggccgttcaaggacagaaatggtcgttttgtttttaaatggacaacttgttcaaatgatgttcggaggatgacgatgtcggggacgaaggataatcggcgggttcagtatacgatggaccgatttaaagacgctttgttgcatattttggcgacgaaaccattggatgaggtcacggtgactgagctttgtcgacaggcagatttgaatcgcgggacgttttacttacattttcaatctccacgcgatttgttcgaacgcattgaaatggatttggtcgaggctattcggccttatctaacggttaaaataaacgatatggccacatggttggtgccgattttaaatgtcattgccaatcagccgcaagcagcagcgattattttgaataatcctgatagcgtggtgttgaagaagataacggatccaattcgacaaaaaacagaaaccagctatcaatcgtggtatggtgagaccgacaaaagtgttctcacttactactacgcgttcttcattgacggggcaattggcgtgctgacaaaatggttgaaaaatggcacggttgagcgttctgaacagattgcggcggtgatcgaaaatgtcgtgactaaaggcgcaccgcattaaattatagcaagtgaaattagacaaataatataggggaattagcatgcagaatgtaaaattaattgcgagtgacatggaccagactttactgacaagtgcagggaccttgccgccgcactttgatcgctatcttcatcgccttggcgaggctgggattgagtttgccgtggccagtgggcggccgctttatacgctacaagaaactttcccacactttagtgaccaaatttcgatggtctgcgataacggcggcctcgtttattcgcacggccaattaattggtaaaagcctgatccctgaggaaaaatatcgtgagatcgtgcaatttatcatgacgaaaacagacggtgttcctgtcctgtgtgccttggatgccgcgtatattaatgctactgatgcccaatattcaccagctcttttgccgttttatcaccaattgaaaaaggtgccggatttgttaacgcagtcgctggcagttgataaggtgacgatttattttccaaataaagacagccgcaaaaattccgaacgttatttccgcccagtatttggcaaggattataccgttcaagtcagcggtgagacttggctagatattcagaacctcggcgtgaacaagggccgcggcatgcgaattctgagtcgtcattttgatattcctacgacacaaatgatggcgtttggcgattatgataatgatattccaatgctcgaaacggttggctacagttacatcatggccaatgcaacgcaaggcatggcgcaacatgccaaatatcgcacgcggagtaacgatgaattcggcgtcttgcatgtgatggatcaggtgttacaagcgcaagaaggctaggctaatggcagttatctcaatacgtgtggcaattggtgtatacggctttttgatgttattaacagcgtggcaagcatggcagaaaaaacaaggggatgtccgtttagaccaactgacggccctggctgcggccttagtgatgactgcggcaattattcctgataagttcagtgcgctcaccgttttattgattgggttattggctttgtccacggtgacatggttcaatggcgtcgcggtatacggtaaaccgcatgtgaatcatcacatcatcagattactggtccatcttgttttgtttgggttagcggtgtggctgttctgagtagcgaaatcagataaaaggttggttgttgaatcaagttttttggtagctagttgctgatagatcatacataatgggcagaagaaccttagacaacttctaaaaattttggttcaacagcctcattgttttttatgattgtcggttgttatttgtctttttaaaagaactgaatcatacaatgccttcagatgttagaaatctaatgaaaagtgagtgaaaaatgtgactttggcagcgaattggattgttgtgatcttttcattactttttgtaagtctcggtttgtcagcttatacgtattacttaagatataggtttaaatacgatcctatgagtttaaggcgggcttttaagagtgatgctaccagcccttatcgatttggagaaagcagcaatcctcaaataagtgtgttggcacattgggcaaagatcgttctagttggttacgctttaagtgccgttgctacgttaggcttccttatgatcattcttacagaaactatttccaccggtacgatagacaattcattgttggctattggcgtcttctcctttactattgttttgggcattgtatcctatgtaatcaaccaaaaaaagttgatgctccagatgaaggagtaccaacttttaaaaaagacagaagagatttctaaaacaataagggaattttttgaagggcaaacaccttcaattggcttgagaatactaaatctaggtatcattaatttagttttctttgaatcagattttaagccttgttttaggatgtttttgaacgatccgttagagtataatctaacggatcaatttttgaaggtttatcagttagtaatcattgagccacaagctgtagccatgttgtcaatatcgcagtcccaatcattaacagtatcttgctgagaatccagcgtttctctcctgcagtattctccactagagaaatattagacaaaggagaagccaacaattttttgtgccgaaattctagcatcatctgcacaatggttaaaataacaaacaagacaattgatgtccacaaaatcattacacggacactgtcgtccaaagaaattatcagaaaatcgtttattgaatagactatccagccgcctaagaaaaacaccaatgataaaatctttgttgtgctttccaatttgaccaattggtttaccttcttaaataaagttggattttcacccagatatttagctacttctatataggcttcactacgcttttgatgcgcagcttgtcgccgtaccagtgttgttaaaaaaagagaacttaataacactgtgaatccaagcacaccaagcattaattgtaacaactccaattaatcacctccttaaaagctaagcagcaatgaatgtcgctggtaatagtttagcagccgttccaacaagcgtagccgctacttctggagccataataattgttgctattaatacaacagctcctgccgcccaaggaatccactccaggtttggttcatgttcagaaacgggaacataaattggtttataatcctcagctgggatccccaatccatttggtttagtgtatatctcaatactcaatgaggttgtaacattttcctgttggccgttagtaacaactgttgttgtagactcacagaccactttaaaccccaacattccatttttagttgacattccaacctttagatttccattgccaatcattggccccagtgtaccaagcaaagccgtaaagtcaaaattccttgcagcttcgtgcgcctctttgaatttatcgatctcagattgtacttgagtgcctaatttgccattagaaattgtaaaacctagtggagccccactgtcgttgctcgcaaaagtacttgatagtttaatataaaactctgccaaaatagttgacacatgaatttcagggccatcaacctctaaggtcggaatatctggttgtaatggttttaactgataggcattattaattaaggtgcgggcaaattcaaggcgtactgcgttaggatctactttaaaagttccacttccttggtctttctctgaagaagctacttggtcaatatcaacacctgcagctgagtattccacaaactgatcaaaggcccaatttttgggcattttaaaacctaggtttccgctccagccatatgacatatcagcgacgtaggaataaagaatattggttccagatgcagcggttacccgattacatacattccgtgttccatatattccaattttgaaaatactattgttcatagcttggctaataccacggaaataaggaataattgtgccatctatatcgccactttgaacatccacatcaactgcaaagtaaatcgtagttgcagccggaaaccctaacttagcagcagtactacttgcaacaaatccgtcatgaattccctgctgtagactaaagtaatcaagctcatagccaccatcttcatatattggcacaacttttagtccagcctcagtaagatttgcaagttccgtggaagtcaagtatttatcacgttcggcagcccctgcaccaacgctgccagttagataacgagcaactattgaaaaatcgaattgctttagttgttttgcctgtgcagcacttaattgagttgctgtatcaaaagtatttgaatcacgattagtattgccgttgctagtcaacaatcctttgatgacggttaggtcagctgtgctattaaatggcggtaaattcataaactttcgaaaagctaccactgccgttgctacgtctgaactaaaatagccaccaaatgcccctgtataaaagccgttcacatacaagccgtattggatgacctggacaacgtcgctattggctccctgattaacagtaggtgtagcggcaattgtccctggaccatagttaccatttgcttgcgcagaactcataccgattgctcgttgtaaggcataaatcaacgctgtattggttgctcgttgataaattccatcacacggcatcaattcttgtaattccccagagaatttacggttgagcgcttgctgcatggttcgaaccttagcatcgccgcttgaaactaagacgaaagctgccatgtcaaacaaagccgccataaatgccactgtcacagagccatcagccgcaatgccagcatcttgctgaagttctttaacagcattaagggtattattcgtgaactcattattaaagtctactggactaattcctttgcaccagaaagccccttgaatgagttgagcaatgttccccttatatcctggtttcagactacctacaacaggtgctaaagcatttttggtcgtatcgccaaagccttcaccaatagcactaataccgatttcgtgctgtaatcccattctcaggctataaattgttggccaacctgtttgtccgttttctggagctgcgacaaagccaggaacactaccatacgttttgttgagccatttttgaacggctcgtactgcttcatctgccattttaaagtctcctttattatcaatgtgtgcaacacgtctgttgcagtataacgaacatgtgttcggtatcgttctacatccattgcattcttttttgcaaggaaatgtttttgtttttgggaggaagaccgtctgctcttgacgctcgatattatctcggaaaggctttgtaaaaaattgctgtgaattgctaaaaatattgaaatagagtgggtcatcaaaaaggctcggcagatatacaagcatctaccgagcctttcactttatgggttctataccaattcgccagggaatcggctgtttcgaagggacaaaaataaataatcccattttttgacctattcctaaagataagcctgcgcaaataacttagctgctaacaaaaaggctaaggctgcgatgatgaatcgcaacagttggaccggcaggcggcgggcgatgatggggccgatatagctaccgatgaacagaccgataccaagcgggatgaccatgagccattcaattttggtggtgaaggcgtagatgacggtggcgatggcattggcggcgaatccggtcagattcttcatagaattggagacgatgaatggttgatcaacggtcaaggttaaggttgccagcatgaccacacccgcagcggccccgaaatagccagcataggcgccagtaacaaaaatgacgatggtttgagcggcttcttgtccaaatgttaaggtgcgtgcaggttctccgggacgatgttcttgagttggcagtcggccgctgaagagtagtaacaggcccgcggcaatgatgaagaaaggcacaactttttcaaatgtggctgccggggcgatcagcaacaaggcactgccaaaaatactaccaagtgataccagtaagatcagccgccagagaaatttaccgcggccacggagctctggcagtgaggatacagccgagccaaccccagtgaaaacgagtgccgcggtatttgtgacgttagcaatgaccggcggcacgccaattgcaagcaaggcggggtacgaaaccagtgaagccaagccagctaaagtagacgttaacccagcaccgatcccggcaatcagtagaaaggcaaagatcgaaaaattcatattgctcctccaagaatttgaatggacgtcatctagcgcatctagaaatgccatgtgtcaggtcgtactgtgaccatggggatgcgacacacaggtcttttacgctagcgaacgttgataggtcaatcatacgctaaagaacagtcatttggggttatgataaaaagcgaagaagggacagatgtacatgtttgaaaatagtaagagtcgacttgatgccatttccgacggcgtttttgcggttgtgctgacattaatggtgttggacatcaaggtgcctaaaacactgaccatggcagatctttatgcgacgggcttctctgtcgtcatttactttatcagttttgcggtggtcggccaatactggacatttcaccaagaactactacataccgttacgcaaccgagcactaatttcttagtattaaattttttctatcttgtgttcatctgtttagtgccatttgcgaccagtttcatcggtgaccatccaggcagtcggatcagtgcaacattatttgccatcattatttttatggtcgatttgtttcaatttattttgttccgatccgtcattggcgaacaaccaaaaaaggaaaacctaaatgcccatgattgggaggaatatcgcgcggtatcactcatggtgctcgttgccgttgtttacattctggtgggcttgctgctgccgaagtggattcttgttgtgatcgccctcggtttaggcgcacgaaccctgaataatacgattggacggcggcttcagcgccaaagcaaagctaagtaaaggcgaataatttttcacataaggggaaacgttcttttctttcctttcccacggttgagttagattgttcaatttttccgaatgtaccgattaagcagtaatcccaatgcgatccacaagatggccgcgatgataatcgtgataatccagccgagtggttcgtgggcgaaaggcaggggcacgttcatgccaaaaaagccggaaacgatggtcggcacggtgagtaaaatcgaccatactgtcatgaaccgcatgatgtcattcaagttattattcaaaacggtgttgtagctgtccgttaagtgatccaaggtgtgggaagataagttcatcatttccgcaatctgatcggcttcaatgatgacatcctccagttgttccccttgtgtgccagtgatgccaggcacacgggttgacgcgtggatctgtttcaaaacagcagcattttggattgttgctcgaaccaaaaaatcagcgctcaaggcaagttcggcgattttcaacaagtcttttttggtcgtgtgttcacgtaagcgtgtggcaatttgacgacgagtggcgtcttgctgcttcaccagtgtgacaaaattatcggtgatagcaagcaggcattgccacaaaaggctgtacaccgattcgctgccaaatcgcgcaactgttttggcgatggcggcattggtattgttcacatcatggctgccaactgtgatgaggcggtcatcggtgacgagaaaagccatgggttcagaaagatagccatcggtatcaggtttatcgctaggcacattataaatcagcagaaaagtatcactctctgcatcgtattccatatgcggttgctcgtaatcgtcacgggcgtatcccagcatttcatcggtgataccaaaatcaatttgtaattgtgtcagtcctgacgcatcgtcgcgcgtgaccggacgccaggtttcagtaggggttggcattagcaaaagtccttttcaaaacagaagtgagcggtaagtagcaggtggctagttcggcgataaggccttgatagcggcggtgatcgcgtgattgacggtattggcgtccaaaggttggtcaaaatacaagaagcctaaaatcaagccaccggtcatcgaccacattgttcgcagaatatcttcaagcggccaatcaacaatcaaaccgcgctttaccatcgcgttcaggtcatgtgtcatggattcccaatattgggtggtgaaaccatcaacgacctgagcccgcacctgcgtatcattcagtaattccgacagtacaattttgatgatctgggcattatcttttaaaaaagtcacgcgatcctttattaacaccgtcaagaaagtttccaatgagacatagtcctgatggaggcgagacttaatgaaatcgtccaactcatcagggaacatttgactcagcaccggtgcgatgatggcattgagcaagccgcgtttattggtaaagcggctgtaaatattcccctcggccaccccagctcgcaaagcaatttctttggtactggccgcggcgtatcctttttcagcaaaaacctcaatggccgcaatgatgatgagtttctgcttagcggtgaaattggtaaaaagttgcgtctgatgcaagatgttgtctgctgagctggccatacgtcaggatcccttctcatgggtttgagtgaaaacttaaagtcaacaagttggtcccattatagcacgcagcctgttgcctcaatagcgattttggcgaataagttaagcaagcctaacctttttcttgacctgtatccaaaagggtgtatatttatgtcggacgatgttgagtaaatactcaaattagacccaaatttcaagccaatggaaagagggcttcacacaatggcatcagaagataaaaaatcaaaacgcgaacacattattcacttcgaagatacgccaagcaaaagtcttgatgaggtgaatggcagtgttgaagtaccgcacaatgcgggcttttggaaaactttagcagcttacactggcccaggcatcctagttgccgttgggtatatggatcctggtaactggatcaccagtattgccggtggcgcttcatttaaatattccttgctatctgtcattcttatttccagtctgattgcgatgctgctgcaagcgatggcggctcgtcttggtattgtgaccggcagagatttagcgcagatgacacgtgatcacaccagcaaagcgatgggcggttttctttgggtcattacagaacttgcgattatggcgactgatatcgccgaaatcattggctctgccattgccttgaagttactgttcaacatgccgctgattgtcggcatcattatcacgaccgctgatgtgctgatcctcttactgctcatgcgcctcggtttccgtaagattgaggcggttgttgcgaccttagtgctggttatcttattggttttcgcttatgaagtgattctcgcgcaaccaaatgtcccggaactgctgaaaggctatctgccacacgcggatatcgtgaccaacaaatcaatgctctatctctctttggggattgttggtgccacggtgatgccgcatgacctgttcctcggctcctcgatttcgcaaacacgaaaaattgatcgcacgaagcacgaagaagtcaaaaaggcgattaagttctccaccattgattccaacctgcaactgaccatggccttcattgtgaactcactgctgctgattctgggcgcagcgctgttcttcggcacaagtagctcagttggccgcttcgttgatcttttcaacgcactaagcaattctcagatcgtcggtgcgatcgccagcccgatgctttccatgttgttcgcggttgcgctgctcgcatccggccaaagctccacgattacaggaacacttgccggtcagattatcatggaaggcttcattcatttgaaaatgccgctctgggcccaacgacttttgactcggctcatgtccgtgaccccagtgctcatcttcgcgatttactaccatggcaacgaagccaaaatcgaaaacctgttgaccttctcgcaggtcttcctcagtatcgcattaccattcgccgtcatcccgctagtgctctacactagcgataaaaaaatcatgggtgagttcgccaaccgtgcttgggtgaagtggacagcatggttcatcagtggggtcctgatcattttgaacctttacctgattgcgcagacgttagggtttgttaaataagtcattgtagcaagcaaaagccgctcgattcgctgatcgagcggcttttagtgtcgatttatttaaaaaggggacagttgactcatcaaatttcggcgtaagggcagcgagtgttattggcgctgatgtcctagtatatagtggctgaaccagagccatagtcattgtgataacagcaagtattgccgtcacgaaggagagtggacctgcgttcaattgacatcagttataccaagtcatggtggcaaagctcaaaccaaatgtctgaacagcgtaacgattcggccgggcactcgtcattttgagttcttcgtgggaaaccggtgaaggcttaacgtaatagacagtgccatcattgtcatgactatacgcaggagcataagcattttcggatgaccgctcgatccttgcgcaaaaggcactttgaaagtgtccatgcatcaaaagctgcgttctgactgccagtgttggtgttaggtgaccgagcacaaagaggccaatgatggtgccgatgatcagtttaagtacttggttcgacgaaggtttagtataggaaaaaacgcccatttcttgaaccgaaaagagagctttatgagcttaaatctttctcataagccccttaagctaagtcgctatttgatcttagctctcaattgacttttgacatgccattaatttatcaagtgtctctgtatacttttttctgtctgctgcattgaggccattgaaaacggtgatggggacagaagtattgtacttttgaattaggttagaaatatctttgactaactctgccagaacattactagacttagtgttttcgtaatatccacgttttggagaaaccaaacgaccggttgtccgaagtcgccgtaatacgccagcgatttgtccgtcagaaaattcttctttaaaagcagtgtaaatttcttccgctttaacaatacggtgcttttctccaacaaattttgtgatctgagacgctaaattatttgattccattttgattttcccccttgcgactaaaaagccagaagtataattcatgctacggaccgattttatccccatatgttcaacatgtcaaacgtttaaacaagcaacaatatcgactaaatcataaaatgccaaacattccaaaaatgaccatctaacttaccacgttcgcctctcccttttacttttcagcatcattagtacgaaccagtgctatcataaagtcatctgaaaggaagcgtggctatggatcagtttgtgaatcacttgagttgtacagcgttgcttgttggtaagaaggcgtcggttgatggatcgacgatgattgcgcgaaatgaggatgctagcggtgggattaatccgaagcgtttcattgttgtgcagccggctgatcagccgcaacggtacgtatcgacattcaatgggtttcagttggatttaccgcaaacaccgttgcagtatacttgcacgccggttgctgatcaaagtcatgggacttggggtgaagctggtatcaacagcgagaatgtggcgatgagtgcaactgaaactgagttcacaaacaccacaatgctgggattggacccgcttgagccggacggtattggtgaagaggccatgttgacggtggtattgccttatattcacaacgctcgcgaaggtgtcgaacgcctgggcgagttggtcaccaagtatggtacctgcgaaagtaatgggatcgccttttctgatgctaacgaaatctggtattttgaaacagttggcggccatcactgggcggcggaacggattcctgatgatcgttatgtgctggctccgaatcaaactggtattcaggagattgattttcaggcaccggaacattacaagtacagtgctgatctcaaagactttgcagctaagtatcatttgaataaggcaaaggaagggttcaattttcgagacattttcggtgaagatacgcaggccgatcattattacaatacgccgcgggtttggtatgcccagaaaatgctgaatcctgaaattgatcaagatcctgaaagccgaacgatgccgtttagtcgtgtcccgagtcacttgatttcagtcgaagatgtagcgatggtattgagcagtcattaccaagccaccgactttgatccttacgggcagaccggcacgcctgagacgcggcggcgctatcgtccgattggcatgaatcgcaatcaagaaatgcatattctacaaattcggccaaatatgccgaagagtcatgctgccattcactggcttgcggaaggcgttaatattttcaacagcccggtaccatttttcgccaattgcacaacgacaccggagaatttccagtacacgccgattgataaaagttcaaccgatagcttctattggctcaacaagctaatcgctatggtggctgatccgttgtttgcagaacatgactgggatgccgagttcgccgtatctgaaagtcgcaagtttggtttcgctgccggccgtgccgctgtggccaaaggggatgcggcttttgccgatgtcaaaccagaagatctgccagcgtggcatgatgcgttgaacgccgaaacggcagcgacgatcacgaatgacctacaatacctcttacaccagctggtttgcatccgcgcggagaaaatgacaccaagctttgaaaaaggcggggaactttaatcggactgcgaacttagcgcaggtgcgaccggtaaaagaagcagtatgtcaaaaaaataaacgctcagtcctactgacggattttcatcagcggggctgggcgtttataataggcaatatgcttttgacaagtatattgacagaaagaaggtcatcgcattaaaaatacgaaaacggaacgctggatcggtttgatggttggcttagttctgaacgctgccggaaatggcctttgtattgttggggctatgggcagtggcttatggacggcggccgccattaacttgaatgactggcaagggtggaatattggcgcggtactgtttacctttggggtactgaacgcgctatcgaatctgttgttaattcggcgctgggattggccgcggttgatcggcgaagtgatttatacactgttcttcagctattttgtcaatgtctttacttggctattcacatggctcggacttggcaactggccaatggtggcgcgcattttcgtctcctgcttcggggtcttctgtttttgtgtagcgatttcgctctatcaacgcgccaacatcatcatgcatccaaacgatgacaccaccaatatcctgcgatttctctattttaaaggcaacgccactgcttcccagattactgattttatccccccaatcatcgtgatcgtagttgcgtggatcgcgacaggtaagctcttaggcatcaatatcgcgacattgttctcatttctcggcaacggcatcatcattgcatgggcagacgagcatgtttggccgcggttggtacataactttaaggtgaagcctagcgaagcgaaatgatatgcctattttcctcaataatcgttccttgggatgcaaataaagctataaacgttttgcacaaaaaaggctccgcaactgacttgattgtctgcggaaccttcttttagtacatggttgatcgaatttaaacttaccgtgattttcgtgctgatgactgtaaaccagtcgattaaaagaaaatcttgggtaaataatacggcgttactgaacttgggatgccgttggtgacggctaggaaggtgaaaccatacaccaccatcaggaacataactagcataaacaagtagcattctttttgtcgctgcaagatggttggcgaagtccatagtaagtcttcgggtcgatggctgtcatcttcaatgagcgccagtaagcgggaatattgataccaccacgtcatgacaccaaaagaccccacgatgcttgccaaaatcagcagcaaattccgcgagccatctgattggcttaaggcccagaggcgagtcatgccaacgggaacgagattgaaaagcagtccaaactgaatactcagtgcaccgacaaaaagtgtcgccgttatgatcaagaagatgcgcgaaataattcgcaatattctgagtagcagatgccgtgcgtaaattgttttcttataaaaaacacgcgcatggtagatttgttctcgggtcatctgcggaagtcttttctgctgaaaggaaatggctttctcatcttcgactcgaatgattcgtgctggcacaaagaaaattgcgaagatgactaatatgacaatcagacgcaacatgaggaatcctctctgaggttgattttgggctattattttagatagcttgattcaagaaaaaacaaacgtttcttttgcaaaatggtgagattgctaagattgtttaatgtacccaatatttaattgtgaacaggccgaatgtcaacaggatgccaccgtgtctttagctcatgtatagaaaacggctggagaaaggaattacaatatatggatgtctatatgcccttcattggaatggtttttatctggctactatcgtctgcaattgtttcaattagtagggaaaaacaaaaaagtgccttgctgcgagaaggaaaatatacaagtgaaagttatttagaaactaggaagcaaatgcaaagatttaccacaaatgagtcaaaccatctctttaatcatatttacaacattgttattgtttggtactttttcatcgttgtattctcattaggtacgataacgaccaatttttcaagtgctgcagttatctatttaattgatacagtattcttcttctcttttgctatctttaactttggtgcatcctattatacacaaaagataagaagaaaaatgaatagtgagttgccggaacttacctttgtagcgaaagcgctaattttaatttttcgagactttggcactgcattaatatttttgatttcttacttgagggcatagtttgctataaaagtgtaagtcacatttcaattagacatctacgggaaaccattgacgtttatacttccgagtggtttacacttttagatcttggtcaattgaaatgattataccaccaacatgaattaacatttttagaaatactgttggcgtatatgcagaaagatcatataccttgaatgatttagggaggaaaaatggactatatttatttcgtaccgcatttgctcgtgatgataatttttgccgtcacgctcagaattaagagtgagttgtttaaaaaagaacgaatagaaaggaaagatgcattaaaaaagattggtgctgtagacaccgttgatcttgaaggtaatgatgataatagcttaaacgtaatcattggtcgtaatctgtatactgaaaaaatgatgaattctcagatgatcggaagctatctggcagtcactttcttgtctgcaggggttatctatggtaacccatcttccgggctccttcttcttcccagtattggctttttttcttttttgcgaacgtgatctttcttggtgaggagcaagtatttcgcctcattaaacagaaaaggcttggaaaattcctggagaattttccaagcttaatgcgtgttcagaagaccggttcgaggtggtattacctctatcttttattgcttgtcgtagttgggggactcaattttgccatattctatgctgctgcagttctcttctactaaaaaatctggccaatgatgcggcattggtctcatttggttttgtgagcttgatcaaactttcatttccattagatttaagttgcaacccgcttagtaaatagtacactaacattaatatactaatgacggagggaccaagatgaatgatgagctgacgattcgaagtggcattcacgatgttatgccaacggtttttgggtatattacggttgggatggcttacgggattgtggcgaaaaccgggcatttatccctgctcatgatcgggttgatgtccctgatcgtgtatgcgggatcagctcaatttgtgttggtgagcatgttggcgacaggtagtccgatcggggcaatggttatttcgacggtgttgatcaatgcgcggatgagtttgatgtcaatgacggtggccccatacttgaaagacgaatcaatgacgcagaatgtgctgattggaaccttgttaaccgatgaaagttttgcgttgtcgatgaacaaactcaattacaccaatcatcatttaaatgccccgtggtttcatagtgtgaacgttggtgcttatttagtttggtttgtggccagtttactaggcgcgttgattggtgggctgattcctaatccagacagttttggattggatttcgccgttgtggccatgtttatcgggctgttgtacttacaaatgatcacggatcggtccaagccgtttttacggcatctgagcgtcgctggggtggtggccgcggcgatggtggtgttggtgcggtatttgccagggacgacagcgattatcgtggcgacagtgattggttgtttgtttggaatgggggtggaacgccatgcagaatcctgaaacctttgcggcaatcctgagttgcggtttggcgacttggctgttgcgggtcgtgccgattgtcttggtcaagcggatgacgatcccaaaatggctgctccattttctcagttttgtgccggtggcgattctttcggccatctttgttgaaagcctgctagtgattcatcccggtcagtggccgggcgtcaactggtcgaatctactggcgtcacttccggctatcgcagttgccattatcacgaagagcctcttcgctgttgtcgtcgctggcgttgcttcgatggcaattttgcggctgctgggctgggcgtaggactggaacgataagacgaaggcaataggctataagtccttcaagcgttttaacgttgactaaaaatcgctagtctggtgcgctagggtaagatcgcccgattgtgtttgctaatcacaattttgcggtctttttactgttcataaaataaagaacagtatatccaaaggaaaaaggatacactgttcttgtcgattggggcggacatgtcaggacgcaagccgtttatcaaaccgtttacaatgaaatcacccttagaatctgcaaacatacgagtactagcatgccaagtagcacgatcaaaaagacgagcgaccctaccttggcagctttaagtctaaaatattcgtagatgaggtaagtgatgagagagaacgggatgacaaaaacccatatcatctctagaacaggcgatcttttagggagtagatagggcatgaaaattacatagaaaccgatccagaacgtttgaaatctgaggacatgttgatagcgcttcttgaacaaggcagttcctttttcattcattcaaatcgcctcgtttttggttaagcacgacaaatgcagagatgcacaatttgagacgttgcagtgagcctacaaccaattttattataagctgagataattgattaggtcaacaattgggctttctggataatcccccacctaaaagcaattttaagcatgaagatggaatcggtatactcgtcaaattgacataggcaaggatcaatttggttttttgaggcgggtgctttttatgatcgcaatagctgagtgtcagcaattaaatacaagatcattgcttggtaggcacacatggaagacgctagaatcaatcgtatgactgagtgtttgcgtggtcttttagcgatttttaatgtagagaaacaatccagcctatgacaatgacggaaatgagatagaaaatctgcagaacgagtgcaccggttatccatccattaagcgcgatgaagtccaaggttgaacgccttttcgtgaaaagataaacggcagggatcagcccgaaaataggcacaaccaatgcaacgatcaacaatacgattaaccacagtcttttaatgtttatcatgatggatcgccccctccttatagccatttattgctaagtttaaatagctttactggcacgattttaccacgaatcaactcgcagtctcttcagtagggatcagaagcgagaccaccagtatcaactcacgctagaacaccgtactgctctttttgacatggaggggatggcacaaaataagtttgtgtctggcataccgtcgtgctagtgctgggtagcggcagatgatggcacttaagttgaatggcgttgtcagtcatcacaaataaacaggcagcgccatcgcgaactgaaaaagttcatgatagcggtgcctgttttctggtgatgatcaaacttaacagccgaatttaaaaaccggcgatagtcgtaccgtataacttccccttctgtttctgtaacagacttagaacccagaagcttagggccaagtataacccgatagttagccaactggcttcgacgccaaaagtgccgccagtaataaatgggctcaaaccggtattcgttgacttcaagatcatgcctgaatcagacaatccggggacagtcacaccaaacaacctgctttccgcgaagttccaagcggcgtggaaggcgccacagaaccaaatgttgccggtgattaatcggatttctgacaggagcatgccgaaaagaaaaatgcccaagaaagccgaaacactaaactcagaattgaagccgttcattagggtgaaaaagatcgtattcgccagacaagcggttaacaacttttgccgctttaaccagtaacccatgatgtagccgcggcagactaactcctcaaacatggattggaaaatgaagccgactaaaaatagtcctaggataggtatgccggagaaagaaaaggctaagcggacatgaaagccttgtaggccaaaaataaatagccagtttattgcaaagagaaggaggccaaataagaatcctttggcatagcggtgaagcattcgtttctttgcgaatggtaagtagtaaggatcgcctttgtagcgaatgacgagcagaataataccaaatagacttgtccaaagcgttaataaattgccagatgttgaattgaagttaaactttctattaaacaaaaggatagcaagtattgggaatgccgtaagcatgaaccatccgaaagcaataaagaaaggcagcagaaacctttttacttttcttatattgataatttttctgaaatatctattcataaaataaatcatatcccatcaaatagtattttaaaccgcgctggactttcattagaatacgactaaagtcattaatttgtctaggcctttttaatctggattacatttaaaaacagagtcggtagcgctttattaacgaaagatacactagataatggattgctttctctggaaagcggtatatcaaaaattgcgctggtataaggcttatgagcactgagagtgtcttaattgaaacttttttaataaaataataaatcaaacaaaaaaacacggctatcaaaagttgccttgataagtcgtgttttttcgttcaaacaagttttttaagttcatgtgcagagcttacttgctaaccataatcgcatcaagctttgcccgatacttcttggctgttgctgtgacaccggcatagtcgccggtcttggcagctgcggtgaggttgttgccggcgccgactagggtcacgccagcatcaaaccaggtttcgaggttattcagtgatacaccaccggttggcatgacggctagttgtgggaatgggccgtggagtgctttgatcatggccggaccagcaacgctgccggggaagattttgacgagatccacgccggcttcgagtgcggtttgaatttcggttggggtgaggcagcctggagtatatggaatagcatagagattacagattttggcaacgtcagcgttgaagctagggctgacgatgaatttggcgccagcgatgattgccagacgggcagttgccgggtcaagcacagtgccggctccgatgagaacatctgcacgatcaccgtacttttcactgagttggtctaatacacgatcagcatgaggtacggtgaaggtcaattcaatcccagtaatgccaccagcgatgacagcatcaactgttttaactgcttcggcagcatcgttgccgcgaacaacaacaacacagtttgtcttgattaaccgattgagataatcatatttttgcatttttttatatctccttaaatgtgttcgattaagcagaagcggatggattatgctgatcgtaattcatctaaggcacagatacttgatactaaaattcgcatcctgctgtatgaacttgttaaactgagaccacatcatatataaggtacttatttagttgatcccagttgaaaggtcattctgaacgcaacgcaagcatcacattgtgcgtgttcaacaagttttaaaagccaaaactgatataacagaacatctctccacgaaaatgatagcgtttactaaaagcgctgtcaatgtttgctagaagtctctataattttgggagcgaagcaacatctttctaaaaaaaataaaagtgttatacaataaaatggataaaaaaggaagcgtgacgtacatgcagatttcgaattatcaagatgaggcctatactgccatcaagcaaatgattctcagcatgcagctgactcccggggaaaaggtcgataaatatgaattgagcacgcagttaaatatcggcgtgaccccgattcgggaggcaattattcgcctgcgtcgggagggcttatttgatgtcattccacaaagcggcacttatgtatcaaaaattaatgtggatgaaatgaatcaaggccgatttgctagagtcgaattggaaaaaactattattgctagcgctgctgagcgtatgacagcggatcaagttgacgaattagaacagcaaattgctcttcagggtgtctatgaacataatcaagactatgggcactttttcaaattagatcatgatttccatgaactcttttatattgcagatcacaaacaatttgtatggacgtgggtacaacaaatgaatctgcagtttattcgttatcgctatctacaattagaaataaacggcatgcactggcatcacattattgcagaacatcaggcaattgtggatgcagttaaggcaaaggatacagggttggcaagtcagatggccaccgatcacttgttagcagttggtaaagatgtcaaatcagttttaaccacgtatcctgattattttaaaagtcatgaatcgaacgagcctcagttaacctgactatgttcttactcgcggaatgattcagttaatcaatgacgtctgaaaacgtagatttttaacaatcctgttttcaggcgtttttgtgtacggtcagctaagttctgtgcatcgtgggtgctgaaacttcggcgatcaaaaataacgacaagtccgctcagtgacgttaatcggcgaaaacccaacgtttattttttgaggaacacaaaattgccgtgcacgattacaattaaaagaagaatcgactttttgcagaatgccgagatggagcactttatgtcagttaaatcagtctggagaacgcattatcgaaatggctttcgtgtcaatcaagaactggggatgccttatcatttgtattgcggattaaaagccacactgatggcgctgccttatggtgtcttcgtcagttccttagggccaaactggtcgtggtgggggcttctttcaggcagcttgtggctattcttttgcttcaattttgagatatacgttcatcagcatattcaaaccagaacgctcgctgccatgcgggtttccaagggacaatggctgacgagactggggggaacagtcctgatttgtggcgttttcgtatatttgcatattttttatatagcagcgccatgacttggttgctttgctattcagaaagttgcttgtaaatggataaggattagaaagcgaggttactatgaaagctgtctataaaggccgttcagctgacgtttgggagatcagtcaaaccaatgaacgaccggcttgggtcaaagccgcttttgaagagaactatctatgttggttagacaatcacctacgcattttaatgagcggactgaacccgtcgcttggcgcaaacttaaaaaccgccgcggttggtacgatcggcggcggttttgctggctataacatgtatgcgcttgggtatctaggtgattatctagatgtcacgaatcatcgagttgtttcgaagaaaaagtttttgaagcagtatcagattcaagagaatgcctagctagtcatttttgtatgttgacaaattggcttcaagacaaaacaaaagaatctgaaattcctacatatctggaatctcagattctttttcaaatgaatatctaagtattgcgatcttcattaggcaggtgtggtgggcatagaagaatcgcatagttgttaacaactgggtaagaatgcttgtaaagatccgctcaccagtctagataactactcattgtcgccattgcgccacgattggtgccaaaaggaacatttttgttaaggaggacctggaaaccgtcataaaatttagaagcatcctgtgacaaacccgtcttcattgcttctcgttgcaaactaataagcgtctgattaaggacggccacattatatcggcctttttccatgtcggcttttgccatgagcccaatttttctctcacgatctgtgatactaggattgagcacaaagtcgtacaatgcacttagtatttcttgattcacttggagattcttttggttgttaaacattatttacaccttgatatatggattctagtgttgtcggccagatgccccagcactgccccagccatttccaataatgccaaagacggtgtcaacagcgccctttgttacagtgtaatgccagtgaccatgcttgtcagtccatgcataaccgttggaaccattgatttttacgccaccacttactaaatggagctcttgcgaagataatgaattgaaatatttcaccaaaacaacctcttttataattatttcgatatatttagcatcctttatatcgatgaattcaccatatcatggttatctgataatatcaacagattgaacgaaaattttttaggcttaaatgatttaaacatggatacacttagtaatttaaaggcgtccgttctgatatctgacacttattttcctttaaaaaggtcttttatttgaatcttgggtcattaaaaataatattattatactttttaacaaaaggaattattcataaaacaagcgaaaggctcggtgaagagattggcttcagcaggcaggcagctcagtattgctaccaaaaactaccagcaaccagtggcaaaaaaaccagcgaaggggaaacgttgtcgacgttgaaataaagcgatttaaacgcagtccaaaataaagacaaagttgacgctggctatataacatggacgcttttggttatatggacgccacgaatcatcaggataccctgagaaaaagtcttttggagcaataccagagttagcttacgatcctgacaacaaaataagtgatcagccgcctggtgcgtcttatgccaataagataatcgaggcggttttttggtttatgggcctttaccagtgacgcttttgcgatcgttcgttcttaatatcacatgagaatcatttacagaaaagacctgtagtaacctcaagccaatgtgcgggaaacctgattgtatcaagtgcttaaacttatgaggatagaattggataagaaagaagtcagttttagtcgttaggttttgtgatattctgcgcatggttacgaattgaacgggaggttagatcatgcaacgaaaatggacagaagcagaacaaatgttgctgcggatgacggcaacctacacagatcaagaaattgccccttatgacatggcaatggcgaatgctaatcattatcctgatggtttgattgaaaaattaattgaaacagggtttttaaccatcatgttgccgaaaacgtacggtggtgctgactttgggccggaagtgacggcggcagttgttgaacgggtggcacaaggcagtgcaagtgtggcagtgacgcttgagggtcattataaaagtgttgaagccgtgatgcgctttgggacaccggcactcaaagcggcgttgttgccacaagcggccaaacgaatttttgccttcggaatgaccgagccgaccgggggctcgaatcatttgggcattcagtcaacggctgtcaaacaaggcgatggttggctgcttaacggcaacaaaattatgattaccaatggcggattggctgaggtctactgcgtgttggcgaagactggcgagcaagagctatcggtttttgttgttgataaagacatgcctggcgttcaatttggcaaacaagaaaactttattgggttacgcgggacgccggttggtgaaatctttatgactgatgtgtgggttgatgacgatcatttacttggaaaaattggtgaaggaagaatcatcggcgatcaagcgcatgacgatgcccgtattttaatgggagccgttctttcaggtattacccaacacgctctaacgctagctgtgcagtatgccaatgaacggacggctttgggagcaccaattggacagctgcaagcgattcaacgtaagttagccgatatagcaacaacacatgaaattaacaagcttttatacgaacatgtggtgtatctaaaagctagcggtcagtcctacactgaggaagcggcgatagcgaaagcgcatggttctcgagcggcagttaaagcgtgcgacgatgccttacaaatctatgcaggctatggttacagccgcgactttccattagcgcacctcatcacggatgcacgcgcgctggagattgctgaaggaacggtggagaaaatgcgaaccgcaattgcgttaagcgaattggcaaaggaggcagattgagcatgaaaattgtcgtttgtgtgaagcaggttcccgccagcaataacgtccggtttgacccagtgacccataatttagttcgttcgggtatgagtgggcggatgaatccctttgatgaaaatgccgttgaagcagctttggctttgcgggatgctatcggcggtgaagtcattttactgtcaatgggaccaaatgacaccaaagaaacgctgcatgacgggcttgctatgggtgccgatcaagcgattctactgtcatctcgggcttttgccgggtctgatacgttggcaaccggttatatcctagcgcaggcaatccgaaatattggtaacgtcgacttaaccatttttgggcggcaagcggttgatgcggatacgggtcaagtcgggccaattgtagcggaggaactgaatgtgctgcaagcaacgtttgtttctaagttaaaggctttagataaacagcacctcagcgtgacgcgcaatctggatagcgaagttcaatcagtgacgctaacactaccagccgtcatcagcgtgcggagcgaactcaatcaacctcgttatgagacgccgatccacattcagcaaagtttgacgaagcctttgatcacctggaccgatcaggacttggatcttgaccagcagcgtattgggcaggcaggctcgcctaccgtcgttcgaaaggtttatgcgccagaggcaaccagtcgtgcagcaaagcgactcccagatgatgcgaccgcagcggcacgggtcgttcttgcgttgatggcagagcgcggtttgcggtaaaaacgctgcagcagtcatcgcgttttcaaaggagagagaaaaatggtagagaaagatgctttatggatcgtcgccgaactgaccggcagcggggtggctcctgtgaccttgcagttgataactaaagctaggaaaattgccggcacgcggtcggtaacagtcgttttgctagaaggcagtaccgatagttatgaaaccgaacttgcagcctatggaccggatgagattttgattgttcaagatgatcggttgcgtgagggctcagatcgagttgtcgcttggcaactcacaaagttggcgcaggattttaaaccgaatgccatgctgtttggcgcgacacctgaaggtcgctcaatcgccccgcgcattcaagaccgcctgcgcactggactgacagcggattgtttggatttatactacgaaaatgaggttctggttcaggtcaaaccgtcttatggcgataatgtgatgtgtgagattacttgtccaaccgcgcgaccgcagatggcttctgtcaggccgaatacctttgaagccgttcgcgccgaggccgagaccaagattttctttataacaggtgatataaaggatgatccttcatggcaggtggaccgcgttgaccggcagatcgcttcacataccgatttaaaagacgcgaccaaggtgcttgcgcttggccgcggtgctgctaaagatgagcaggttcgaacggtgcggcaacttgccaagacattaggtgcgtcgattggtgtgacccggccgctaacagatctgccagattttaccatcgcgcaacagatcgggcagagtggcttgacgattgcgccagcgtttatcttaaacttaggcattagcggtgccattcagtaccaagtcggaatggccgccagcaaactaattgtgagcgttaatcgtgatgaaaacgcaccgatgctggcccagtcagattacgtctatgtgggcgatgccggtgagtttaccgctgcgttagccaagcagttgcagtgaaggctaacttgctggctggaactggcgacttttgctaagttacttgacttgtgtctggtgccggtatgctgatggtgacatgcctgtgtgcgccttgaagtggcggtcaaaattcgcgggattcttataaccaagtgaattggcaatatcgctgatgctttgcatggtgagttccagcagtttttttgcctgattcatccgaatgaaccgcacctcatgtagaaacggtttttgaaataactgatgacataaccgtgagaagtagttcgcttcatagccgaaataagtggcagccgtgcttaacgtgacggtcgctaaatggcgcatcacgtaattcaaaatgatcccggcttgacgggccttgggcgtgtggcgaaggtcgtgttccggaaagtttgattcgatgatcatcatcgcgttgagatcccaccgcgataattcggtcaaaaggagttgtgcgatggtgcgctgttcataatctaagatcgcgtcttgcggttttgcttcaatcaatcgggccaattgatcgcagtaaccgttggcaagaacgtgatcaattcggcgaaaaacaatgtgggtgtcttcagaagttgctagcattgacgcaatcaactcgttagggccgaagtcagcatcgcgacccattggcacttggaaaaggcgagcagagtaagtgttgccggcgattagcggggctagcgaaacaggctcaactgagcgaatcaacgtgatatcaccttggcgaagcgccacgtctttgtgaggcagtcgcatacaacagtctgtgcgacatgccaaaattgcaaacggaatttgcgcttcaggacccgtaatgggtaaaagatcgatctgcgtctcagtcgtcccaatgtaagtattgagcatatacgcacacctcctttagtcagaatagccgataaatgaggggtgcgcaaacaaaaaaataacggaagcattcgttattaaaagaaagaagaaaaagtgatgaacgaaaagtttttagaggttttgaaacatgaagggccagtcacgattgttacaattaatgggcagccagcgcatgctgtgaacacttggatgtcgtacgtcacactgaaagaagatgagctcatcataccggcagcggggatgcatagtcttgaaggtgacttcgccgaagatccccatgttcttttgacttttggttccaaggaggtcgaaggaactgtcggacccggcgctggcttccatgttcgcggtaccggccgcttcgtttcccaaggccctgagtttgcggcaaaacaggcgcaatttccttggctgacacgcgtactgattgttcacattgacgaagttcagcagaaaatttaaagatagatagacgcggtgcggcgagagtgccaaccggtcgatttgctgtacaaaacgacaaaaaaggagctttaggaaagaaatcctaaactccttttttaatggtcggagatgttgtttcaaatatgatacaagccaagtttttgtaaatctttttttaaagcgtcaacaaagtccacgcagttacccgcttttaaagcgaataaagcatcatgaactagttgccggcccttagtttcttgccccgtcttaaatagcaaaatgcctttatagtaattcaatagcacgcgctctaatagaaaagattccggtaaatctttctgctcaagaacggctagcgtttttaaagcatgctggatttgtccgtaccgaatcagcagtcccactgtgtttagcaagacattcatacatgtctcgtaagtattcggtaggccaatgtagatagcgcatttgtctaataaggtttgtgaaaatacggtgatggtctcaatgggaagctgggtcatgggattgccgtagaggacgagttcaaaatttccccagtcttcacactgaaataaataatccgttagtatattcaagggaacatggctaggtaggggtttcttttctacctctgtgcgaacacattcagccataatccagttcagccgatcaaaaatcaaatgcgagttttggcaacgcgcatattcggtgtcgactaagtgattaagtccttgaacattatgacttagagcaagttgcgttaattcggttgataacttgttatcatataaaggctcaaagtggttcatgacgattgtaaattcaaagggagtgacatagatttccttaagcaaatgaaagaatcttttggttgataggtctgatgtgccattctcaaatttcgaaatcataccctttgatacaacatcgtctgctaaggagctaaggcttatgcctcgcgactctctcaagtacttaaatgttgcgccaaaattttcgatgatgagcatctcctcgtttcgttttcgaaacataactattgaaactcagtttagcggttatcgtatgaagtatcaataaaggtcggaggaagtgcttaatcatgaaaacatatttaagacatcagcgaggccgcacagggatcaacattgtttggattattgtgaacgtccttttgtacacaggcacatcagttctcttaacttttacaacgaatgccattttttcgagggatatgaaggcactcttactatggtccgccattaatcttgcagtttggggaacttttttgattagcaattattttcaggcggtttttcaagaaaaactgacgcagcggattatgattgatgtgcgtgataccatttcgagaatgattgtcggaagttcttatgcacagtatcacaaacaaacaaccggagagtatctttctgaatatgttaatgatgttggcaacattgaaagtaacgccattaagaacttattctcgttgctgtctgatgggactaccgttgtcttcgcaaccatagcacttgctgcttatcacttactattcatcccaatgattcttttcttatcgatattgatgctgaaaattccttctcgtctaggtaagccaatgaccgtggcgacgacagaaatgtcaaaagggaatgcagcgttctcgaatcaagtgaccaatgttcttaacggatttgatgttttattgaatgctaataaattaagtaaacttcaagagctggtaaaaacggctgccaaaagatatgcggaagtgaaagtttcatacactaaaaccaacgctcgcatttccaattcaatagcagctttgagtatcttctgtcaggtcatggtcgatattatgaccagtattttggccatccttggtgctattccacttggggcaattagttcaaccggcagtattgctgctagtatttttaattctttgtctagccttagcaacgatgccgtgcagattaaagcaacgcacccattatttgataaagtcattcagggatcttccaactcagcaagggcacgcgaaagcacccaagaaccagcgtttcagcacgctttaaaggtgattgatcttagctattcgattaacgggaacaagatacttgatcacttgaacctcacatttgaacgaggaggaaaatatgcgatcgttggtcgaagcggtgtcgggaagagtaccttactgaaaattttagatggtcaaattacggattatactggacatgtttatattgatgaccaagatttgcgaacgatgacaatgacagcgttaacaaagatttctcaatacgttgatcaaaatgtctatttattcaatgattcagtggcgaacaacacgtcgctttgggcaaacaagcaaaaatctggggacagtttgcaacaggcactattaaaggcaaaggtagatttcgttaagtcatcagatcaaatgattgaagagaacggccaaaatttgtctggcggtcaaaaacaacgcttagcattagcaagatttttctactcaccaaaaccgattgcatttgttgacgaaggcacatctgcgttagacgcagaaactgctagacaagttaccaagcaatttttgaatgaccctgatatgaccttgattgaggtgagtcatcaccttgatgcgcagttgaagggggcatacgatcaagtgatcaatttaggcgcatgacttggcatgttgccagacttgatcgaacaaacatttcaaaaaatactcggaacagattctttcagtgtcccgagtttttgttttgcaccaaaaaaattcccgatttctcgggaatttctgttgctatttggttttcactctttaacaagggaactaagactgtagattattcgcttgcgacccaaccgtagtttcctaattgtttgaatgaaaagacgtcataccaaagaaccttttctgtttcgctgaatgaaaaattgtcagacagtttcttacaagtagggtctttatggcatcataacggcgcgagcatcctagacgctcttttagacgctgcttactgctgatccgcccgcaaccgccattgcacaacaaaggtcaacacagcaagtaccgcgagcacgatgaagtcgatctgactccctgtcgcgtcggcgcccactggagagaggcggtgttgcaaggggatgatggctgataagctggcagtgcctagtgagccggcggattgctgaatnnnnnnnnnnnnnnnnnnnnnnnnnnnnnnnnnnnnnnnnnnnnnnnnnnnnnnnnnnnnnnnnnnnnnnnnnnnnnntattgaacaaggcgttgatgtctgctttggctgagccggttaccatggtgctggcgtctgacatggtgttgccgaagccgaggttgaagcccatgcggaaaatgatataaaagccgacaatcaaggggatgctcagctggtgggtgaagatgctgagtaagatagcgcctacgaacatggcggtattacttgtcaggagcaggcgacgtgcgccgaaccgatcatacaaggcgccgccaatgggtgaaaccgccgcgccgatcaatgaaccgggcagtaaaatcaggcctgccacagaagcattggtatgcagaacgttttcggcgaaaattggaataacgaaagcaatgccaatattgctgaattgtaaaataaagaagttaatggcgcgtgcccgaataccagcctttttgaaaagcgaaaagttaagcagcggtgtggctgtatgttttaagtgatagctcatcccaacaatagcgacagccaaagccgcgacatagccccaaaagccagcagtcagcccagatgccgtgaattgatccagtacttcgatgagtgagaacagaccaagtccaagcagcagcaaacctagaaagtcaaaacgatcagtcgtcgtctgtgctttaacgcgaatcgtggcttcgcccaaggaccagacgagcaggataactggcagtaccagccaaaaaatcatccgccatgaggcatagtaagtcagcaaaccgccataagttggcccaagcgcaggtgccagtgaggtcacaacactggccatccccacgtaaatcccgagatggacttgcgggatcatggtcagaatcaaatgaaacatcaacggggtcgagaccccagttgccagggcctgcaacaaacggccagcaaacaaaattggaaaactcggtgcccagatacacaataaggttccggccaggctgcaaagaatggcagttcgaaacaagcgccgtgtatcaaatcgtcgcaataaaaaagcggttgtgctcatgaccaaggtaaccatcagcaaataacctgatgtgagccattgcactgtcgacaatgaaacatgcagcgttttgataagcgttggaaaggtaacgttcatggaagtctcaaccagaataccgacaaacgtcagtaatcctgctgataaaatagccaattgcgtgcgatgtgaaactggtgaagttgtcatgggagtgccttcatttctatcatttaacctgatacacatgcatcatgcagcaacaggtcactgctgacgatagcagattcaaaaaaatgatgcaaaggcaaacggtttcacttaaagcgaagcacagtctacatatagccgcttaataaacaatttggatgctaaggaatggttccgttagttactgaaagccaccactatgatcaggatcgtcataactgcgaaaacgagataccagaataaccggcctgttggattattggggttaacactaatgccaatgccaaatctttttgggacgaacaacggttgctgttttgtttttggagcgggtgcgtagtgtaagaagcttaagatagtcaaaatgaggacaaggatgagagggacaattcttgctatctttgtatctgagcgcaaggtccacacaacagaaagcagaaaaaaggcaaaaatgaaaagtatggttaatgatagtagtttgcctgatttgtttgagcgcatgatcgacatcccctagtgttatcttcattaaaccactgccgagatggcttcaacttataacagcatcagattcatggcaacaaccgaatcatatagctttctaaacagatacaaaaacacctgcagtcttggaaactacaggtgttaggtctcaacggagagagtgtgcgtgcaacccgtttatttttttgaatcaggtgggacagccgctaaatgaacacgcggtttctgtgacgtgcgcggttccgccggtgttgctgaatggcttgagtttgggccatttggcgttggtgttttagggctttttggtgacgtatgatcattgtcgtcatgtgggccggggccttgtggatgattatttttgttcatctgcttgtcagtcaggctgatgacactggacatgaccagtgggagcaggaagacgaggaggatcaggccgatgatgacggccagcgcgacctgaatcaaggttgtaatgccggatgggatcatcgcggcaaaggtaccacttaggatgatggcagcggagatgacaaccgcaccgatgacgctggcagctttggcgatgcgatgtgtcatggtgccgccttcgagggcattatcacggtagcgcaccatgaggaagatactgtagtcaacgccgagggcaacgagcatgatgaaggtgaagaacggtgtgttccacgtcagcatgtcgcgaccaagcacgtaagttgagaacagtttggtgaggcctaacgaggtgacgtaggccaacagcaacgttgagataatgctgataggttgaatcaaggaccgagtgacgaaaatgagggcgatgccgatgccgataatcatgatcgcagcagttcgttcaaagtcgccattagccagtttttgcaggtcggcggtttgtgaagtttggccaccaaccgcgacggttgcgtcggctagcggcgtgtgctttaatttggccgtcatgtcagttttaatcgcttcgatctgtttggcggcagcatctgtgctgggatcgccctttagaacaacggtcaatttggtaatcttgttgccatcagacatgtaggtcgttaacgcaggcttgaaggttttactctttaaagtggcgttagggatatagaacttcttccccagatacgacttttgcagctcggtcaggtattgtttcatgctggtgcttccgtctgcaatcgtgccgagtgctttgtctgccgaggttaagccgctttgcatggtggtgacctgttcggagattgccttcacttttgtattcagggtttggacaccggtattgacctgatcggcgccactggcaacttgcgccgcgccactattaagggtgccattttgcccggcgagctgtgaggaccccgtgttgagttggttgacaccggaaacaagactcggtacttggctgtttaaggaaccaatcccactactcagttggtgggtgccactggtgagcgtactgatgccgctgtttaaggctgtcgtaccattgttcagcgttttgatgccatcgccaagcgaactggtaccgttcgtcagctgttgcacaccacctgaaaacttggcgatttcttctagaattgactgtgtcagttgactgccattgggaagttggttaattaaggtaacgatttgctgagcactgccggtcaagttctgaacttggctggcgagcttgttcatcccgctagtcaactcaccagatttgtcgctaagttgattcatcccgctggcgagtaccgtactattcccgctaagctgatccatgcccttagctaattgggtcgaactcgtgcttaaggtgttcacccctgaactcagggccggcagctggctgcttaattggccaatcccggtgtttaacgatgcaacgccggaagtatactggccgattccgctgttaagactggaggcgccggatgaaagggtgttggtgccattagcaagggtctgcacttgttgcgtgctgccggcgacatcagcatttgtaatttgcgtattggctgagctaaggcctgcttgcacctgcttcaaccctttcacgctgtctgtcaggcccgcattaatcgtttggagttgattgtcgagatagagcgacttaatctgactgccgcctggttgtgtcacagaggcaactgtcttaacgccgttctccttttgcaggtaggttgtgaggtcatcaatcgtaccaagaaccgtttgtgtattcaacggttgcttactttgaatatagatggttgttggtgaggccataccctttgaataatgatcctgaatcagcttataaccgaccttggattgtaacgtttccggcagttcatccgcgttgttgaaattcaaggtttggttggcattcagcaaaaacggcactgcgatgatgccaatgatcccgagggtgatgagcggtcgagcgatgcccattttggacaggccgtgccacagtcggctggtgctatgaccgttgagattcttacttggccaaaagagcttttcgcctaaagtggccatgaagaacatgttgagcgtgagcagcacggtcaagaggatcagaacaccaatggccacgccaactgcggaacgatagaacttgaaattggcaaggccgagcacggagaagccgattagaactgagaggccagagtacaggatcgttcgcccaccaaaacgtctggcaacctcggcagctttcgttcgtggaatgccttgtgaaaggacggctttgaagtcgtcgtatagcaaaatattataatcggttccaattccgaaaaggacaaccactaggaagacttgagtaaagtttgagattggaaagttaaacttgtccgccaaattcatgatgatgttcaaggaagtcatgaaggaaatggcgacggtgagcagcgacacgagcgggacgatcggggaacggaagacaatgatgagcacaatgaaaatgaaaattgccgcaatgatttctgttttctgaatccctttttcagtgagggtcgcaaagtcgtcgttcaagacatcactgccagtcacataggttttgacgttgctagttttgatttgtttttctaaattgcgcgtttgcggcccgacttgcccttgggctttcacatcgaccaacgccatctgagtcgtaccgtctttggcgtctagctgtttcttagtttcggcgttgtcagatgcttgtgtgacgttgataattttgacagcaccggtactcttaaggttcttgagagtttgatgaatggcttgtttttgcgaggcagtcagttttttgtcaccattgttgaaaaccagtgcataagagcgaaccttctgattattgttggctttcttttcaatgtttgcggcaatttgactctcttcgtttttcggcagcgataaggcgcctttgtctcggacgatgccggaaacatctggcatggtgattaaggtcatgatgatgacgattagccagaaaataagggccggtatgtgacgatgacgaagatttttcattgaaagatactcctttcacaggttaagccgttccagatctgattttttagctcaagggctaactgatcttgatcgggcacatggccttgaagttgttgttggacccaaacgatgtcaatcatgctgacgatgctgccgtataaaatagctaactgggtgcgaacatctgctttcacaatgacaccgtgttcctgaccttccatcagcatattgctaatcaatgtggtaacacggtcgcgagcagcacgactctctgggcgtagcgcttcattaaacacattttgttcaataaaatgcagttcagttgggtaatgttgcatggtcagtgcagcggcatcaaagaggtggctgaaagttgattcgggatcactgacgttgcaattggcagcgtcagccagtgagtcgtgaaaataatccatgatgtcagtaaacgcggtgttaaggatatcctctttacccttaaagtgacgataaattgtgccaaccgctacattggcagctttggcgattgacggtaaattggtttccgcgtagccgcgttcggcaaacagcttgactgcttgggcaatgattggatctggggtggcgatgggtttcattttttctcctccggaatgaacgttcattcgcatatattagaagttgtgaatattcttgtcaagagcatattgaaaattaacagggagcgtctacgatgttgtaactggcacaatgtctataaaagaagcaatacaaagatggcaggtggctatcattttcaaaaaaaaccaccatcaaaatcttgatggtggaaggaaaggtaactaggttaatttttacaacagactgtcacgatgttcttaacgagactcactttgaataacggctcggttttacccgtgaagttttgactttctgatccagattttgttccggtaagctggcaggttcctcgtgcactggtgtggcatggtgtggcgtgatggccgcctgccaagaatcaggggttggagctgccagcggttggacctgactggtcgagatgggaacggcagacgtcgacggtttggccggttgcggattcccggctgttaagaggctggcggcgatggccaaaaaagtgatactcataagtaagactcccttcgatcatttgactgctttcataacagccaatagtaaaagcttaccgaagggatgagacggattcgtaccgactcagtggcggttttgttgaaaaaggacgatgaaaacatggctttttgctaaaggaacctttaagggccgtaaaaaaagacgaccagcaatggccgtctttagggttaaataaggttcatgacgattttaagactctgctttgccttttggttccaagcggcgctccaagaagcccagtaccaaatcagagatgatcgccattaacgcggttggcaatgcgccggcaaggatgatggcgccgccgttggttgcgttggtgccgcgaacaatgatgtcgcccagaccaccggcaccgacgaaggcaccaatggcggtgatcccaatggccacgaccagcgcgttgcgaatgccggccataatgacagacatgctcaaaggaatttcaaccatgtacagcgattgccaacgggtcatgcccatacccttagccgcatccatcaagttcttgtcgacattttgcatgcctgtgtaagtattcttgatgatcggcagcagcgagtagaggaaaacagtcacgatgacggtattcacacccagcccgaggccaagcatgatgatcgataacatcgccagactaggaattgtctgaatgacgttagcgatgccaatcaccgtgctacttaatgtccggtgccgcgcaattgccagcccgatcggaatcccgatgatggcggcgattaacaccccataaattgagatcagaaaatggcgagcaaactgactcagcacatacgagccgttattggcaagatagtaccagaattgctgccaggtatccatgttggccattagtcgtcacttcctttgaaatagttgtgtttggcaagaaacttttgcgcgaccacgttcggttcaagcagttgatcatcgacttgataattcagctcttgcatcgtcttcaggttgattttgccatctaaccgatgtaacagcggcttgagtttcgggtattttttcaaaaagctgttgttgacgacgagcgaacattgataaggtgggaagaactttttgtcatccttcagcactttcaagttgtaactgcgaatgcggccgtctgttgagtaacctaagaccgtctgcatcttgttggcttcgaccgcatcgtaaaccagtccgatctgcatcgggtagactcgtttgaaatcgaacccatacattttggtgaagtcgctataaccatcgcctttgcggttcatccaactggaatctacgcccgcgttgtaacgcgaagcgactttcttcaaatcggaaatggtgctcaaaccgtcctttttggcttcctgttgggtcaccatgaaagcataagtgtcggaaaaaccataagacgggtaccaagtctggtcgtaacgctttttgaattcgcgcttaacaatcgccgtagcttcggcaggatccttgacgggattcatgcctaaggtaccggtaatgtcggtcccagtgtaacgggtagcactgatgtcagcatcgttacgaatcatcgcttgatgcaccacggtaccagaacccaggttgttgaccaaagtcgttttgtagccgagttcatgattaatgagttcggcaatgatatttgccatgatctgcgattcagtactggtttgcgaagcgatccgcacagtaccgtcattaccagagccgcccagtccgggaaagccgcagccgcctaatagcaagacggggatgaggaacagcgataggagcatttttctgaatgtcttcatctcgccacctcctaggcctgttcgcttactggggtcagccgatgttctagccggcccagcagccaatcaaccaagagtgccaagatggtaaccggaatcgtcccgccaatgattaagtctggctggaagaggttcaagccgttgaaaatgagatccccaaggccgccagcaccgatgtacgatgcgagggttgcccaagcgatgacataaatggcggataggcgcacaccggccatgatgaccggcatcgccagcggcacttcgacttgccgaattgattgcaaggccgtcatgcccatgcctttagcagcatcaatcaaaaccggatcgacatcttccatgccaatataagtattacgcagaatcggtagcagcgagtagatgaacagcgccacaatggccggcaacttgccgatcccaaaaattggaatcattaaggccaacaacgccagcgatggcaccgtttgtaacatgctggctagaccgatgacaactttcgccgttttaggaaaacgtgtcagcacaatgcccagcggcacggctaccagcacgccaagacccagtgcgatggcggaaatgtagagctgctcccaagtcttggtgattagctcgctgccatgtgcgtttagaaatgcgaacatggtcacacctccttaggcgtgtcactgttagcaggcgcttccgaagcagcagttgctgaagcggtattttcggtatcgctatcagcttggtcactgtcgatatcgtcagatttgtcatcgttgtcgccccagatagtgtcgtaaacaacatcgaccaaggccgctcgggtgacaatgccgacaagtttcttatcatgatcgacaacagggacatatttaagcccgcgtttgagaatgcgatcagcggtatcacgcaaaagtgagtctttattcacgtagaaaatactggttttaatgatatcgccaacactagtggcactttgataacgcgtctcaagggattcaagatcaatgaaacctttaagatgattctcgtcatctgtgaccagcagcgtatcaacgcggcgtttgcgcatcagcagaatcgcttcggccagtgatttgcctggtgtgatggcggctgggtttttaagcatgatttgttcaacggtggtgacatcggcccgcgcttgaacaagtcggtcttgcccgacaagattttcgacgaatttgttggccggatgggttaagagttctgtcggtgtcgagttttgaataatatgcccatgatccatgaccacgattttagttgcgagtttcaaagcttcgtccatgtcatgggtcacaaaaaccacggttttaccgagtttttcttgcaagttcttaatcagttcctgcaaagcttcacgggtgatgggatccaaggcgccatatggttcgtccatcagaatcagatcctgattggctgctaacgcgcggataaccccgatacgctgttgttgaccgccagaaagttcggaaggatagcgatcaagatagtcttctggaagttcaactaaatcgagcagttccttggctttttcccggcgtttttcttcgggccactttaacagctttggcacgatggtgatgttttcatagatcgtcatgtgtggcatgaggccgatattctggatgacataaccgatttgccgacgtagtttaacggcatcgattttatgaatgtctttgccgttaaacaggatctggccgccgctgggctccagcattcggttgatcatccgcatggtcgttgtcttcccggaaccagacgtcccgatgagacagacaaaatcccccttatggatctcaaggttgatatgttcgaccgcgacatttccgcctcgataaactttctcaacgtccttaaataggaccattggttgttcttctggcatctgacgcgtcctcctttatttgaatacttctatattaccacatggggttaatcagattttaatacatttgggaacgggtgtttgcaggagtgctttgttagctagctcatttaaagtgatcagaggatttagcggaactaaaaaaatccacctctcggaaaaaggatgggtcataattcccgtactggactgatgattcattagattccgaataatctgggaaagatttaagctaaagaatcctttgccgtgccaaactccgcaatctccggccagatggggctggcgatgaggagctagagcggagacggcgcttcgagcccaaaaaccagcctcgaagtcgcctaacaacatcagctccaagcccggtcgctgtgttgtttgcacggctgagccccatctggcctacgattgctccgccttggcactggtatctttaaaattccaatagactacccaaatgaaaaggacaaacaatttccgcacttatagaaattgtttgtcctttattcggtggctgtgaattatggcccaaccgcgttcccgtaagcaaccggcgttcccaagagactgacttcaagtgtatctgcgacggaagtgtctttttacttttccgagattcacaagcgcaacatgactaatattgtcacgataatgttataagtcatgtgtgacacaatgcttgtttttattgttccagaagcttgattgagaagactaaaaccaattgcacaaagaagtaagcacaatgaagcaacaacctcaaatccatggagaaaaacaaaaatgatcgaagtgatgagaactgatggccaatagccaaaaatatttgttaaataatcttggataacgcctctaaatccgagttcctcacatatcggggttaagaaacacagagagataatcattggccagcgcgatgggccagttaatacttttgcagttgacgactgcaacacattgtcagttggagccgggagaaatggcagattattgagtgttattgttaaaacaacaatgaaaatggtccaaatgaccgctatataaaaataacgtgctttgagtggctgattaagttgttgcgttgaagaaggctttatatgacgatcaatgaatagcagtgatggtattgagatactggccgcaataacaataaatagccagtttaataagacaccttcaaaaaagcagtcaactagggagactccagaggcaaggaataagaatggtataaatagaatgatcccgataaccagctgttttagtttattcaaacatttctccaatttgtagaagcttaagaaacaggtagcatcatgcgctgttgataatcttgtcgctactgatgcttacgggcatgaagctttggattagacgcatacttttcatgcaaacatcttattaatacatagattgccgcgcaggttacgatagcgcttaaccccttgagcacattcccgaatatcatattgttcgtccagagagcttcgatatatctgaagatgctacggttaaagagcactatcagcaatgcaccccaaacttttttatcgcgattcattttagtatcatctcccaattaacgcatcatcatggctgaggattggtcatactagaagaccactactcaaatatctgttatgtacacgaatgaaatcttacaggaaattcgataagacagcaattaagcccccaacaaccaagataccttcaagactaagcaaattaattgtaactgaaactgatgatgtttcatcagtttaaaaataaacgtcgtgttttcagcttttttcgtcataaacatgccagttccagaataatcatgtcgcaaatccctaaagttgatcaccgtcaaggcagcttttttcatccctcggtacactggtctcaaatggagggattagcgatgcattttattcagacgcataaacaagaagcgatgattgctggcggtgtgctgacagcaggcggtctgatttttagtcaggcatgggtgctggtgttggcgagtttggtggcgggcttgccgattgcgatcaatgcattggcggcgctgcggtataagcagattagtattgagttgctggtgacgattgccctggttggcgcggtgttgattggtgagccggttgaaagtgctgtggtcagttttctatttttattcggtgactggttagagcagcgcagtttggcgaagacgcgttcggcgattcaaggcttggcggctgcggcaccgaaaaccgcgcggcgactggatggcaccatgattccggttggtgacttggcagttggtgatcaagtccgtgtactggccggcgaaacggtaccagctgatggcaaagtgatcagtgggcaggcgaatgttgttgaagccgcgatcactggtgagccggatgcaaaaagcaagcaggccggcgcaacggtttattccggcacgcaggtgagtgatggcacggtggctattgaagttgagaaaaccggctacaacacggtttatcaacagatcattgatttgattgaagatgctcaggacgcacagtcaccagtcgccacttttatccagaagtttgcgcggtggtatacgccgctggtattgatcattgctttgctcgttggtttgatcagccaaaatgtccgactagccattacgattttggtattaggctgcccgggtgcattggtgattggtgcccccgtcagcaatgttgtcggcttaggctttggcgcgaagcacggcattttgatcaaaggcggggatgtggccaccaaattggatcagattgacacggttatgtttgataaaaccggcaccttaacccaaggtaaaatcagcgttgcaacggctcaatattgggcgaacgatgacgccaaagttgccgagctggtggcggcggttgagcaagcaacggcgcatccgttggggcaggcattggtcgcctacctaaagccgcaaacaacaccggctgtgaccgacgtgaaagtcacgcggggcattggcgtgcaggcgcaagtggctggccataccgttagtattgggaaccaaaagagtctgacgcagccactgaccaccgctcagcaagttgctattcaaaacgtgattaaaagcggtgcttcgttggtcgtggcgacaattgacggcaaacttgctgcagtttacggcttacgtgatcagttgcgcaccgataccccaggcatgttggcgacccttcaagctaacggtaaaaagacggttgtgctttcaggcgactcgcaggcggcggttgaacacatgatggcggatttgccactgagccagacccacggcggtttactaccagtcgacaaggtcacggcgatcaaggcagcgcaagcgcatggtgaaaaggtgatgtttgtcggtgacgggatcaacgacgggcctgcactggcgcaagcagatgttggggtagccatgggctcagggatggatgtggccattgatactgctgatgtcattttaaccagcagtcgcctgacgaatctcggcgttcttttcgatctggctaaacggatggacaataatatcaaacagaatcttgtcattgcgatcggaactgttgccttattgttaagcggcttgctcattgggttagttgatatggccagcgggatgctgttccacgaaatttcgattctgttggtcatcgcgaatgccttacggttacggcacacaccccgaaagttacaaaacttgacgacgatcaaggacgccgcagcacaaaccgttaataatgaaggtaaataaacaagaaaggatttttaacatgacaaaattagtttatcaattagatggtttaacttgcccaagctgtttgcagaaaattgaaggcgcattaggccagcaagccggtgtcaaaacagtgaaagccttgtttaacagtagcaaggtcaaggctcagattgatccaagcgtgaccaacgccgatgctttgaaaaagacgatcacggacttgggttataccgttgtgaacgtgcgcagtcaagaagcatagagcgagaactggcgcggttagaaaccggagcataagcagccttgggggtggtggctgagccaattacccccaaggtccttatggaggaggtttcgatgctatagaacgcttttaaaaataaacaagcgcggttaagaggagaagaacatgagtgtaacgacaggaatgaaaagtattaccgctgatcaagttaaagaacaacaagcagctgctgctaaacaggctgaccatgaccatcatgtgccaactgctggcgcgatgagtggccacgtgttggcgaacttgcaggtgctgacccgcaagttgatccagtttcgggtgactttacgtggtgtgaccagtgaaaccgatcggcaattgttagatcagctactgcaacaagcacagacccattttgaggaccttgtggctgatttagctgcccaaggcgaagattttccgacaacgacagcggagttcggtgaatacacgatgctcaaggaagacccagcgtttcgtttttggacgaatgatatgaagttggacgccgttgtcaatgatctcgatacctgccagttgtttgtcagtcgggcgattccgctggccaacaaggagaacaaggctgtattggcagtagatatgttacaattgcagcgctggcatgaacaaagcattctgcgcttgcaaactcggcttggccgccaagtgacggcggggcgggcattgcttgacgaggatgaagatgacgattgatcaagcttgttgacagagcgtgagcaggcgcgtttagaaaccggagcataagcggccttgaacctaaatggctgggctttggccatttaggttcaaggtccttatgtgcaggtttctgcgcctgcgaacgcgtttaggaggtggcaacatgacgcacagttgtacggcggtagtgccgttattcaaaaatttaaacgatgaggcgcgtgccgccattgacgcgttgacgcacgaacgccaggttgaaaaaggagctgttttgatcagccctgatacggcggcccatttgttggtggttgcgcacggcaaactcaaaacttaccagttggccaccaatggcaaggaacaactactacgggttgatggtgttggtgattatgaaggtgaagccggcttactcaatatcgctaatccgaatgtctataccgaaaccctgacggcggcaactgtctgcaccatcagtgccactgactttcaacaattgcttctcaagcagccgcaaatcagtctccaactcctgactgaaaacgcccgtaaaatgcaggcgctagaaaaacaggctggctatttgggtaacgattcgatcaacgttcggctcacccactacctactggacttgcgtaccgcggcgggccaagacaccgtcacagttccgatggcatggacacaattggccgattatctcggaacaacgccggaaacggtctcgcgcactttgaaacgactcgccgaggaaaaactcatggaacgttcaggtaagcaggtaagaattctgaatgccgaggatatggaagattttgcttggtgaggttgccgagtgatgttttttaaatacaaaaagccacgaatcatgcaatctaaactaattgcacgattcgtggctttttctttgttttgcaagaagcgacatataaataaatcgtcactgaacaaaatttaatcaaaacaatttttcgttttttaagaaagccagcaaacgcaaccttcaatcaaagaatacttattgaccacatacatttaagtccatagactgaccttaggcttagagagaggactaattaccctgttttcttcgtctagcggattggatggcacacacccctcaacattcttgagacgcggaggtgagagccatgccaaaactaggagacgaaaggggttcgccgcgctggatgtggcgtcgattatcatcgcgctaagcatactggttaccagtatcgccaaagcgtatgcgataatcaaaaaagctaaccgcaaggattagcttttacccaattgtcatctgaaccgcgttgaggtcatcggggtaccgcccggtggcctcttttcaacgacttaattatacacaagatgctaacaaggcgtcaacatacttactttaatgaagttatatgtgaacaatgctgatcttggtcacacgattatttcaccgaaatttgctttttagcatcaacggccactcggatctgcttagtaaatttttcaatcgcagccggtgcctgttgtttttccttcgcgacaagatcaacgatggcgctgccgatgatgacaccatcggcgatgcctgccattgtttgtgcttgttcaggcgtgtgaatgccgaaaccgatagcggttggaacgttggtatactgcttaatttctgcgactaatgcctttaagccagcaaagaattcatcgcgttcgccagtaatgcccattgatgaaacgacatagataaatcctgaggcacttttggcaattttctcaattcgatgaccggaagttggcgtgattaacggaataatatcgataccgtacttttcggcaattggcacaatttcatcgcgactttcatacggcagatctgggatcaccaagccggcgacatttaaatccgcacagcgttttaagaaggcgtcgtagccgtatttgaagacaatgtttaagtaggttaggaagacgattggcaccgcggtttctttgcgcgcagcctccacaatgtcaaagaccgttttggtgcgaacgttggcggcgaatgctcttaggtcggcggcttgaatcacgggaccgtcggcgactggatcggaaaaagggatgcctaactccacaatatcggcgccacctttggcaagtgcgaccacgtttttgacggtggtttcaaaatcgggatcatcagcgacgatgaaggggataaagactttatgatttttaaaaacatctgctaacttactcatcaacatcgactcctttgtatttggcaatgcttgcgacgtccttatcgccacgtccggacaaggtacagataatgatttgatcttttgccatctgtggggcaatcttttcaacgtaggcgatggcgtgacagctttcaatggcggcaacaatgccttcttgtttcgcaatgtaggtaaaggcttcaactgcttcgtcgtcggtaatgccaacgtattgcgcccggccttcctgagcgagagcggcatgctcggggccaacgccggggtaatcaaggccagcagaaatggaatagaccggatcaatctggccatcttcattttgcatgaataaggacttcatgccgtggaaaatgccaacggagccgcgttcgatagttgcggcggttctgtcggtatcaacgcctttaccggctgcttcaacgccgactaattgaacagaaggatcatcaatgtaagcagcaaaacttccaatggcgttactgccaccacctacacaggcaacgaccatgtctggcagccgagtttctttggcctgaagttgctgtttcgattccgttgaaataacactttgaaaatgtttcaccatttcggggaacggcgcagggccgactgcagaacctaacacgtagaaagtgtcatcactgcgactcgcccattcttgcagtgtggcgttaaccgcgtcttttaaaaccattgatccgcttgtgactggatgaacctttgcgccgagaagttccatgcgataaacgtttaacttttgacggtcagtgtcttctttacccatgaaaatttcacagtccatccccatgagtgcggcaatggtggcggtagcgacaccatgttgaccggcgccggtttcggcaatcaggcgctttttgcctaaatgtttggcaagcaaggcctgaccgatgacattattgatcttatatgcaccggtatgatttaaatcttcccgttttaagtagattttggcgccaccaaggtcttcggtcatgttcttggcataataaagcaacgaggggcgattggcgtaattaaccaatagatcatttaattctgctttaaattcaggattatcttttaagtcattgaaagccttagttactttttcaagctcggtcatgagggtttcaggaatatactggccgccaaagtcttttccataacgaccggcgcgtgttgactgttgggttgtttcatttaatgtcttcatagatgatgtcctcttttgcttgttgaatgaattgggtgattttatcagcatctttatggccgttggtttcaaccccgctggagacgtcgaccatcgtgggctgaacgagttgaaccgcttggcgcacattcagtggcgttagaccgccagccaaaatgaggggtcggctgatgtgggggatagcttttaagttaagtagttgcccgctgcctttgccgctatcgaccattaaataatcagccattgaggttagatcaatggcctggcgttcaaagacctggatcacttttaaaccggcttgttgaagttgcgtgatttcggctggggtgcttttcccatgaagctgtgcaacatcaatggcacctgcttgatagatagccagaatttcggcgactggctcgttgacgaaaacaccaacggtcttgatcttaggatgaagcaactgttttagggataatgcttgctcaagcgatatttgatgccgcccgggagcgaagacaaagccggcaaaatcagcaccagcagtattgactgccaaaatatcttccgaatgcatgagaccacagattttaacgagtaccattttgggaacctccttaaccgcgccagttcacgctctttctttaaatgctgcaattaattgtctcttttggttagatcgcatgagtgtttcaccgatgagaatggcattgaagccagctgctgccagtttttcaacgtcttcctgcgtcttaatgccgctttccgcagcgacggggatgttgtcgggcaccatggctcttaatttcaaactattgttgaaatcaactcgaaagtctttgagattccggttgttaatgccgattatctttgcacctgactgtagtgcccgtgtgacctcagcggctgtataggcctcgacaattgcgtgcataccgagtttttcagccagttggcgataatcgcgcaattgctgatcggttaggatcgcaacaatcagtaaaataatgacagccccgtttgccttagcctcgtagatcatataaggatcaatcgtaaaatcttttcgaagcgttggcaccgatacttgttggctgatctcctttagataatgaaggtggccgttgaaataatcgggttcggtcaagaccgagatagcatcggcaccggcttgatcgtacgctttggcgatcgccaagtagggaaaatctgtgacaattgtcccctttgatggcgaggcctttttgacctcagcgatcacgtgtaggccaggttgttttaagcgtgttagaaaatccggcttgtgattgcgcggcattttggccacggtttgttttaaatcagcaagtgactgttggcgttggtgacgcgctaaacgaattttggtcacagccaccagatcatctaagatcatgccaccacgtccttacgcttgtcggagaaagccagtaggcgattgagttcttcaaaggctttgccatcgtcgatcgttttagcggctaaatcaatccctgcttgaatggataatgctggatgagccacgtgaagcgctgctccggcattcaacaacacgatgtcgcgttgcggtccgtgatcgccggctaaaatacgccgggtaatgtcggcgttggcctcaggtgtaccgccaaccagatcagcccgctgacgacgtttcaagccaaattgctcaggtgtcactgtgtatttcgttaagtgaccatcatgcaattcaaccaccgcggtttcatcggccgtggtcatctcatcaagaccatcgcggccatgaacgaccatcgcgttggtgacgccgagctttttcaagacattggctaatggctcaagcaaggtttcatcgtaaaccccaagtagttggtgagttgggtgtgccggatttgccagtggcccgagaatgttgaaaatggtgcggaagccaagttgctttctaacaggggcaacgtacttcattgatttgtgatattcctgtgcgaatagaaaggccaaattgttttcttgcaggctttcataactgacagcgggtgtttcattgatgtccaaccctaaagcctcaagaacatcggcggccccgcttttcgatgaagcggcgcgattaccatgtttagccacttgggtaccagttgccgcgacgacaatcgcgctggttgtggaaatgttgaacgtgttggcatgatcaccaccagtaccaacaatttcaagcacatccttggtttcgggaaaagcaagcgcgtggcttctcatggaagcagctgcaccggcgatttcatcaatcgttggattcttggcggttaacgcggtcagtaagctggcagtttgcacctcagatgcttcaccgttcatgatttcatccaaaacggcttcgctttcttcaaacgttaggttttcgtggttcacgactttttcaatggcttgtttaatcatgatgaatgcctccaaattgtgttttgacagggattgttgtgagttttaagtgattgaaagctatgataaaaatcgccatcgtttaatctcgtttgtctgattcatacccaaaacctccttcgataacgcgttcgctggcgcagaaacctgcgtgtaaggacctgaatcgcaatgatcaaagaccgaccatcacgcttcaagccgcttacactccggttcctaagcgcgccggctcacgctcacaaaaaaatccgcccataactttgaaaagttaaggacggattttccgcggtgccaccttagttcgattaattcgagacttcaacaaataatagcatctgatttgtctaagaatccccatttaatcacgcttagcgagagaccaacatctctccgacaactgacgtatgcctttacgtttctccgtacttgaagtctttcgggagaaccctccgtggtccatttaatcatctgcgttcgattgcactctcagcaccggcaactctctttgcgcgcacaatgatcttgatctccacatcatcggtttgttcatggacgaattattaatgattggtttgaatattagaggcttgccggaaaaatgtcaacaattttaatgtgtgtgtttgtaaaaaatgaaagagcatgaacagcagacaactaacatgacacgtgatttaaagcggtgagatatttctctagatacttggtttgatctttaggatgatactgtgtgataaaacgaggatgttctaacggcacgattgtttcaagaataatagaagcttagactcagtaacaatagcagcagcacctagacgtggagaaggagtagaaatgacgatgaataaaaaaatgagtgtggcagtgttggcgctcggatgtttgagtttactgactgcttgtcaaccgagtaacgttgtgagcaaggttaagcagcatacagtgaccgttttaaaccaaaaggatcaagtgtggcgcgaaactgaggcggtttctgccacggtaacgagtcaggggagtttgaaaaacgagcaagtaaaaccggacaacaagttgtcacctgctatcacgaatgccggtaaattttacagtgtcgctactttcaaacagagcgattatgccacgatcaaaaaggctattcagaaaaatgaagcacagcctaagacactccgcttcgtcacagtgaagcaagtgaatgcgacgcttaaagcgatgggggcaaccaaacagattaaagcattaacggatttggtctatacacaacaagcggatggtcacacttttcctagtaatgatggctatctcattgaaggcgatcatttgtatgaagtgatcatggcttacacgacagggggtaatgctggtaccgtcaatcgcggcaatgtttactcgcggaaaatcaagtacgggacaactaagcagctgactttcagtgaagtggccggcacttggcaaagcgctgcaggcgatcaggctaccgtgcaagataatcaattggtgaccattcagaacaagtcgtatgttcgcggcaaagttgaaaatctaagtcacttgcaaggagaaaagttatatcgaaacacggcgtactccctgcgacagacacaattggtcaagcaagatgctaagttgacccagcaatcgttggtagcaggtgacttgtatgacaatatgtatctattcctatcaaagacaaagatggcgcgtgtgaatactaacggtgtgaccatttttacgaaaaaggcagcgcaaagccagattcctgatcaagtttttgaggtttttcggttattagaccagcgccatacagacgaagtcgcagcttatttattaccgcacgggactgacacttattctgtggcactgactcgtagcatcaactatgcaacggtaaattatgaaggcggcgcaacgggagcagaatcagtgtcgattcaggatggcaaaattagtgttggaccagacttaaatcacaattgaacatgactcacaactttactcgccccagtcaaaaataaaaattggtccatactcaaaaaacatcagcaggcagtggttggggcaactgcattgctgatgttttttgatttctcctaggcgatgagaaatagtcaaagggaattattcatgccaagccgccgatccgtccaaaaagctactggtgatagacataggacaatcaaagcgccaatcaggtacgtgtgactaaaagcctgagctaagcgggtgtttttgcgttgggtaatgtcgtgaaaagcggtttgcagggtttgtttctgggcgacttgtttgatgccggtcaaaaaggcagcttgtccttgcgccatggtcgcagcacccgtgcttagttgcacgatactggtggcaagcggtgaacgggtttgttgagccgcttttgccagtgcttccgagccgtttgccaacttgttactgccttgttgtaagcctgcactggcatcatacaacttgcgaagatcactgccagcagcgggctttggtagattagttttaactttggctgcttctgagatggtttgcctcatctttttctgttggtgctttgtcggggttgatgatccggcaaagaccgcagcgagctgctggtgagcaactgttttgacatgtggcgacaaggtttttgccgctatgatttggtcgccagcatgatgaatctgcgtttttgctgtgtcgatattggtatccaatacggtgaccagaatcgcaatacctaaacaggtaccaatttgccgggccgcgttgacaatcccggaaccaatcccacttttatttttgggtagataacggaccgaggcgaccattgagactgaagcgaagccaaaaccgaaaccgttaatgacgagcagcaccacgattaaggcggttgcggtttctgttttgatgagcgacagcaggaaaaggctggcagccatgagcagcatgccggctaaggtaacgggaatagcaccggttttatcgagtagtttggtgccaagtggcatggcaatcatgatcgttagggaaactggaatgatgatgagtgcggcatgcaaaggactatcgcctaatacattttggaggaaatagttcagaatcagactcggtgctactaacgcaaagccggtcatgaagtaaacaatgctagaggcactcaacgttttttcacggaaaagatctagctccaacagcgggttcttcacgcgcttttcggtggcgatgaacgcaatgagggcgaggacaccgccaattaaactggtcagaatcagcaaggatgtccagccgtattggcgaccttccaacaggccaaatgtgacaccgccaagcgcggccgttagaaagacaagccccggaaaatcgataccgccagcgagggattcatcataggattcttttgcgcaaacggcaatgagcacgaaggcaaggatggctaaaggaacattgatgccgaaaatccagcgccaagaagcgacttgcagaatgataccaccaattggcgggccgccagccgctgctagtgccgtgactgctccgacaacggaagcaacgcggttgattttctctttaccgaagacctcaattcccataggcaagacaattggggtgatgatcgcgccaccgagaccttggaagaaacggaaggtgatgagcatggacagagaagtcgccgtcatacaagcagcggagaagccgccaaagagaaggagaccaagtaacatgattttcttgcggccaaaccggtcagcaattttcgaagcggtaatcatgaagaccgacatggctaaggtataaatcgtcatgacccaactcgtattagcaagcgagccattgagatccgtcatgatttttggaatcgcaatattgacgatcgtggtgtcgagggttcccatgaacatcgcgatcgtcaggccaatgaagcaaagtgctttggtaaaacgcgtcatagcatccagtcctttcatctgatacgtttgtgcctatgtgacacatgtgtgactttctagagcactttgagtatactggggcttaggagaagcggcaataggttgcagacaagtgctacaaattggctgtatttgtgtcagataaggggatgcgagcgatgaacggtaaacaacgaatggcggcgcagtctagacagtggttggttgatgccttgattgcgttgatgcaacgcgaagatgtggctgatatctcaatcacggaaatcgtgcagacagcagatctttcacgaaagactttttatcgggcatttagaacaaaagatgacttagtcgattatctctgtgcccaattgacggatggctattttgaaagtttgcaaaaagccacccgcgatcaggaaccgattagttttgaaacaaccatggcaaatttcttcaacttctggtggcagcaaaaagaccttgttcgcttattgattcgacaaggtctgtttgatcgtttgaacggggtttggctgcaagacgcggttgctcactaccgcgcgtttcctgcgccttggcatgtcgccggtaccgatcaggaagtgaactacatcatggcctttgccctcggtggcttcacgaatattctgcgcgtctggctggcacaggatgagccagaatcgccagaacaggtgcaaaaaggggcgctggctggttttggacaactggcgcggagcattggtgggacgaattaagtacttaactgatagtttaatggctgaactaattgcgtatgaatctttatgtacagtatgatgggcatacaaactaagctagtatggaaaacacacaaagttgaaggagtccaacaaactcatgaaagctctcatttgcctcattctaaatgcacttccgtatgccggtatcgcactgttgttagattaccggtatatttctgacggccctgtattgatatactttttggtgcaattaagcatatctctatcaatatgcttaattatgagggaggagacaaagaagatgtggcgcatactgtttttctcccagtttttatcattgcttctaaatctactgacgttatatgctggcaacctgccattctcaacctactttaaaccatttactgtttatggctggtctgtattgacccaattttttgggctactgttgcaggcgataacggccgggcttttcatttgggtgaaaagggttattaaagataaaaattaattggtaacgttaagtcagagttgtcaaacgtgaaaccattttgaatggccttttctcgaggaacatcaatcaaaaagttgatagttttctcttcattcgacttgatcatcggaagcggtgactgcggctgtagcgcgacttgttgattgtctgaataggcagtgaaatttgttggggaaaacgtcagcggaatggcgtaatgatagttatggaaagtgagcgaaatgccggtcttattttgaggtgtgttaggtagatacttggtttgaatcgtaaatagcagttggctgttagcgccgtaataagttaccttgctaccaatagcaactggttttcgataaactgatcggcgcggaatttcgtatgattcaggtagaggaatgatctttttgctagtatggcggtgacgtgaagttttcaaaatcaattttgttgaggtgggtcgcagtcggtttaagctcaccgtgccctttttaaccgttccagcagccaattgattgttattcaaatctttcaatgtatagctggtatttggctgggcatgaaagctaagtttaaggccgttattgccaatcgttacctttacttttttcacgatagacggtttcgtttcatccgtattagtcttggataaggctgattgtcgcggcactaaaaagaagacggttaaaaagctaattagcagaactaacacgcgttttttcacgacggaggcctcctcgatttggatatgaaatgacgatggatcaatgggtgacgagtgtagcaattgcttataattaactatatcataagctgtaggaaataatgctgtccccagcgaaaagaggccatggtacgatgaaggaactgattgtttagtgatgtttcttacggctagtcaaacttaaattaagaggatttcttagaagagagacgacgacaatgaaaaagccaatggcaaacgcttacgtttttaacttgatagcgacagtaacatctgctgttttttcgatttttttgatcacacaaaactttccaaatgtctttcaatttggagtctcgtataaaattgatgcttccaatacagcgcttgttaagcaactacaaatgatgtatacaccagcaattgtagttgctttgattgctgccgttttggtattcacactggtgatcacaatgctggtgctagttaagaaaagaaacgtcagcgctttgggcagtatcattgcactgggtatcacgcttattcaaataggatatcttagcggcttgttttggttggttcagtcggtgcagtcggcattttcgccagccggtgacatcctgcaaaatccttatattggaccgttacttcagttgattaatttactgcttcttgggggatcatggatagccaatctggttgtggcgattgattatcggagaaacgggattaaggaaggccggtattaaggatgcaaggcgcctttcatcgaaacgagcgattttatcctgtagtaactatgcagaagctgttgcattggcggatgcttttagtcatactttcgcgtttttgaaaagtccttcagttgccataccaatctcttttttttaattccttgaaatgaagaattttgatgtcattcgtgtgccatagattgatatgcttggaaatgtactttaaagtgccatcagtgctgattaataaaagaaattcgtcatcttcatttattgctacatcatctggtacagttaaactaaacaactcaccagttcgatgaaccttgaaacgaccaataactcgatcagtggccttttttcactcatgctcttgtctctccattttactgaataaaactaggtgttgccataaaagcaaacaatatctctatcaacttttgaacatcaaaataacgcgcatcccaagcccacagtcggtttcgtgatgcgcgtcattttttgaatttataaaaagttctccaacccaacaaccaattcatcagccgtttgtaccttactaatcgcgactgcgacgccttgcatgaagctttggcggtcgaaggagtcttggcggatggtgagggcttcaccggggccgccgaagaggacttgttcgtgggcaatgtagccgggtaggcgaacggcgtggatcgggacgtcatcgacacgttggccgcgggcgtcattgtcgatggttggcaatggcttttgggtacgtccggcggcgattttgtgggcggtggcgatggcggtgccagaaggggcatcggctttgtcctgatgatgcatttcgatgatctcggcatcagggaagtaggcagcagctgcttgcgcgaatttcattaaaagaactgctgagagcccgaagttcggggcgatcaagccaccgaggtgtttggcattggcaagtttgatcagtcgttcctgattggcagggtccatgccgctggtgccgacgattggatggatgccggcattgatggcagcttcaatgttggcagcaacggcgctgggattggtgaagtcgacccagacatctgccacgtgtgcatgaagctggtcataggtgttgagtacttgcacgttggtaggcaagttgtaactttttggattaaggtcggtaattttagggtcgaaaacggcgcttaatgcgaaatcttgatgtgactgaaccattttgactgttttctgacccatggcaccacgaaaaccggcaacaagaacctgaatcatgcgagcacctccgcttcaatggctgatagttctggcacgcccagtagatgggcgagttcctgctgttggctggcgttcaggggtagtaacggcaaacgtgggctgccgacttgaaagcctagcgcattgagggcagctttggttggcgcaggggatgggaaatggaatagagccgccatttttggcaacagttgacgttgcaaggcggcgactgtggtgatgtcgccacgatcgagtgcggcgtacatttcacggatactgtgagcgtaaagatgggctgcaacggaaatgactcccatcccaccgagtgtcttgatgttgagtgcctgagcgtcttcgcctgtccaaacgttgaaagcgtcgtgcttggtacggtcaatgatgtcactcaaggcagggaggctgccgcattgcttgatgccttgaatcatgggattttgcgccagtgtcgcaacggttgctggtaacatatcaacaccggtgcggcctggaatgttgtaaatgacgatcggcttctgcgccgctgcagcaacggctgtgtaatgggcgatcataccgttttgatctggcttgttgtaataagggacaacaaccaaggtggcatcaataccggcaatgccgccaacttcatgagtgaaggcggcggtttctttggtgttgttagaaccagaattagcaatcacaagtgcgcggccatgaaccatatcggcgaagcgggtataaagcgtgattttttctggatgactgagtgttggtccctcgccggtggtagcaccgacgacaaaaccgtcagtaccttctgcgattaaatgatcgacaagtcgctgcatgacgccatagtcaatttcgtcgcgatcattgaatggcgtcacaatcgcggtgatcagttctgctttttgcatgatgaccctcctataaacgcgctacccagcccagaaactgcgctagttcgcgctctgtcttaatgtaactacgaatgatgacttatactggcttacactttttcaagcattcgatgttcaagaaagtgcacaacggcggtgacaccgggcacgagtgcggcttcgtcaggtgaaaagtcggctgcatgtagctgtgagtcagggtcattgacgcctagccagaacatggtgccaggaatcttatttaatagatagccaaaatcctcacctgtcatgacaggctttgtatcgacaaatgtcacgtcaggatcatctttcatcacttgaataaagtctttggtgagtttgtcattattttcaacgggatagtagccgccttggttcaaggcaactttgacttggcagttaaaactggcggcaatgccttgaccgatgtcgcgtattcgttgttgcagaaagtcaatctgctgctgggtgaagccgcgtaaagtgccttcgagatgtgccctgccggcaatgacattgcggatcgtacctgcgcgcatcaagccaaaagtaatcacggcgctgtcggttggtccgacattacgggcaacgaccgtttgaatctgactgatgaagcttgccgccgcgacgatcatgtcattggcattttgcggcaaggcagcatgaccgcttttgccgatgaggtcaacgttgatttcggttgtgccggcaaaaagggtgccgaggcgtgtgctgatcgtcccagccggtagatctgggcgatcatgcaggccataaaactcatcaatgtgccaatcgccggtgaatgcgcccatatcgtaggcgagcttgccgccatttttactttcctcggctggttggaagaaaaagatgaggttatcttttggttgatgttcagcaaaataactgaggatgccgagggcgacagtcatgtggatatcatgtccgcaagcgtgcgcgatgccggaatgcttagaggcaaatggcaacccggttttttcggcaaccggtaacgcatcgatatcggtccgatagccaatcgtacgctgcggatcgctcccttggaccttgacgagtaaagcggttggcaggtctggcaaggtgcggatggtgagatatgtttggggcagcccttgaatggtttttagcaataaggcgtgcgtttctttttcctgcaaggctagttcggggatttgatggagttggcggcgaagggtgatgaggtcagcttccttcattaataagtcacagctttctgagttcgtcgagtaggacggttttggcttcggtttggtcattcacttgtttgatgactttcgcaggaacaccagcgaccacggtgtgcgcgggaacatcgttaatgacaaccgcgccagcagcaataaccgcgccttcaccgactgtggtgccttcgaggacaacggcattggcgccgatcatgacgtgatcaccaatcgtgacgggcttagctgaaggtggctccacaaccccggcgagcacggtgccagcgccgatatggcagtgcttgccgacgattgcccggccaccaaggaccgctcccatgtcaatcatggtgccagcaccgatttctgcaccaatgttgataatcgcgcccatcatgatcaccgcattgtcgccaatgagcacctgatcacgaataatggcgccaggttcaatgcgcgcattagccgccttgatatccagcaatggaaccccggtgttgcggccggcggtttcaacataatagtcatctaacttggcttttttcaaaatgggtttaatttctgcccagtcgccaatcacggtgccggtatgtttaccgatgaaagcatgaacgcttttggggaaatgcagctcgcttagtttgcccttgagataaaccttaactggggtggtttttttgctattagcgatggtggaaataattttttgagtatctaactgtgccataatcggcctcctatttggttgcggcagtggcgtcggtttgagctggagcaggctgctcagttggtgcggcgtaatgtaagtcatttttaatgagatcagcatcggtttcgcgggtcacgaccagctgggcttggccattttccacgaaaacaacggcgggtcgcggattgcgattgtagttggatgccattgagtagccgtatgcgccagtgtcaaaaacagcaacgacatcgcctggtgtggtggtgggcagcggtgcatcatcgatcaaaatatcgccggattcgcaatacttgccgaccaagtggacatgttcagctggcgcagcatttggctggtcagctaaaacggccgtgtaggttgcttgatacaaggcaggacgaatattgtcgcccatgccaccgtcaacggcaacgtatggccgcaatcccgggacatctttacggctgccgacggtatagagactatagccggctggcccgacaatcgaacggccgggttcaatccagatggctggcaacggccagttaagcgtttgactttgtgatttcaaggttgccagaattgccttaacaaaggcttctggtggcagcggatcgtcttgcttggtataagcaatgccgaagccgccgccaacgttcaggactttggggatgaagccgaattgctgatgccagttattaaggacatgcagcagcttttgggtaacggcttcgaagcctgccacttcaaagatctgggagccaatgtgggcgtggatgccaagcaggttgagatgatcgtcggctaaaatgcgcttggcggcttcatctgcttgaccactagcgagatcgaaaccgaatttactgtcggtttggcctgtctggtcataggcatgtgtgtgcgcgctgataccaggggcgacacggattaaaacgtcctgttgaccaacggtggcacctaaaaggtcatcaaggagatccagttcgtgaaaattgtccacaatgatggtgccaaccccggcatccaatgcttgtgtcagttcagctttgcttttgttgttgccatgaaaactgaccgccgccattggaaaatcggctgcctgagcggtgtaaagttcaccgccggacaccacgtcaacgtgcgcgccttctgacttggcgacttcgtacatcgcaagggtcgcaaaggctttggaggcataactgacggcatatgacacatctgcttcttcaaaaacccgtttaaatgcgcgaatttgctggcgaatggcgccaacatcgtacacataaagtggggtttgaaatgttcgggccaactggctggcagcgaccccgccgatggttaactggccttcatgatttgtggcaaaatccataagttcatcctcccgaatttggcagggcgatggcaaacgaaaagggatccttttgtttggccacgcgtcaaacaaaaagatcccaacttgcaatctacttgaatgatagcgccccgcttaggtttctaagcgacagtacaggacttgttcaatcctggcccaacaggtttgccgatcccggcacccccatttcggcaaccgcccctttggcttgatgtcatcacgaaggatcccgctcgatcaagctactcatgttggttgcaacctctatctgtttgtcaccagcctataataaaaagacgtggacgtcaaataaataatgagagagcgcgaacaggcccgcctagaaaccggagcataagcggcctcaagcctcaatggctgggtcttggccagtgaggcttgaggcccttatgtgcaggcttctgggcctgttcgcgcgctttaagtgagataggtctgtcttcgaggcttttagttctcctatagttggcatttgtccgatagtccgagctggccctgcggtgacagagactggtgactgtgaactcaggtcattaaaaacaaatttaaaaacattgtctctatgcagtaacccgaaaacgtgtcatgttagcgacatgctggggcttgtgtttctgggagagtctgttaaagtacaggataaaatgacaaagttctcatttgtcgtgacgtctaggaggcagtttatcgtgcgtgtcgtaaaatttggcggttcatcgctagcaaatggttcacaattcgccaaggtcgtggcgatcatgaaggctaacccagctcggcaggtgatcgtgacgagtgcgccaggtaaacggcacccgggagacaccaaggtgaccgatttattgattcagtatgcacaggcagtgatgcggcatgaagctgtggctgccattgttgcagaaatcgttgctcgatatcaggcaatcgccgatgattttgagctcgaagcatcgatcatggccacgattgaagaagagctagaccagttaccaaagttgactttcaagaacaatgattatttaatggcaggctttaaggcgcgcggtgaaaagttgaacgcgtttttaatgaccgcggtgttgaatcatgaggggattgaagccacctatggcgaaccgaagtcgttaggaattgtggtcacagatcatcccaatgatgccgaagtttcacgtgaaacctatcgcaacctcgctacatttcgacgaccaatcggggttttggttgtaccgggattttatggctataccagcgatgacgatattgccaccttttctcgtggtggctccgatatcacgggagcgattttggctaacggttttcatgccgatttatatgaaaactttaccgatgtcgatggcgtagcggctgctgacccacgggtggtggcgaatccgcaaatgattcgtgaaatgacctatcgggaaatgcgagagctgtcttatggcggctttggtgtttttcatgatgaagcaattctgccagcgattgctgggcaggtaccgattaatcttaaaaataccaatcatcctgctgctccagggacaatgatcgtcccagaacagcattttgtcccgaagcatgccattaccgggattgtaagttcccaacattttggggcgatctacctgcatcgatatctgttgaataaggaagttggcttcactctgaagatccttcaggtgttagcccacaatggcattagttatgagcacatgcccagcggaattgatgatctcaccattattttagatgatcgccagctaactgaggccaaacgcaagacaatttgtgccgagattcaagcggcggttcatccagatgtgctgaagtggattgatgactatgcgatcatcatggtcgttggtgaagggatggcgcaacgaaccggattgattcaaaccattctacaaccgctcgcaaccgccggtgttcatgtctcaatgattaatgagggggcctctcagatttctctgatgctgggaacctcacgtgagtcggccaatcgcgctgttaaaacgatctacaatgctttttttataccgattaatcaacgtttggaggtgcactaacatggtgactttgcaaaaggttcatggttccgaaaatagtttctttcttttcgatgaaacgcagttaactcagccgttgacaaacacccaattagcaaccgtgacccaacagctaacgaacgctgaaacagggttgcttggcggtgcggacggggtcttggccgtcacggcggcgcggggaacggctggcaaaatgacggtggtcaacactgatggcagttttgctaaattgtgtggcaacggtctgcgcacggttgcacgttatctgagtgaaaaaactgggcaagcgacgttcaaggtgcacacggattttgctgatcttgccgttgctcgtcagccgcaactggcagaaggcgtaccggcctactcagtggaaatttcgccggttagttttgcgcctcaggacttgccgtttgccaatcttggcgttgaccgaattgtggatactgttttgccagcgattcatccgagcttgaaattcaccgccattgctgtgcccaacccgcacttaattgctttcgtctcacctgaggtattagctgggtccgatctcgaacggattggcaagatgctgaatgccaaaaatccttattttccggaaggggtcaatgtgacttttgctgaaatcttagataaggataccttatttgctcggacgtatgagcggggtgtcgggttcaccaatgcatgtggcacaggcatgtcagcaacgaccttggcttttattttgacgcatccagaggaagctgcttttgatcgggtcaataccgtgtataatccaggaggaatggtcaaaacaattgtccatcatgacggcgagcgttactggattgaattgatcgggaatgcaacggtcacggcgacgattaccttgccagacacggcgttactcgtaggcgactggcaacaagctaagattcacgcgactggcgaacaggctgagtatgaacgatttattgacgcactgccgcatcggaagttagcaaacacattgacagaaggagtttagatcatgagtggttatcacgtagcagttgttggggcaactggagctgttggcacccggatgttaaaaatggtggcagaaagtaaactgccgattgcgtctgtcttggcacttgccagcaagcgctcagaaggaaagcaagtcccttaccgtgatgggacgctgatcgtccatgagacgaccgatgattcattcaagggcattgatattgccttattttctgctggcggttcagtttccaagcgatttgcaccagccgcggttaaagctggggctatcgtggttgataatacgagtgcttttcgaatggaaccagaaattccgctggttgtcccagaagtgaatccggaagcgatgcggcaacacagtgggatcattgcaaatccaaactgttcgacgattcaaatggtcactgcgcttgaaccgattcgaaaagcctttggtcttaaacaagtggtcgtttcgacctatcaggctgtttctggcgctgggcaatcagctgtgaatgaattgcttgatgaaactcgcgctgcattggacgacaaaccgcttgacccgcagattttaccaacggcgggtgacaagaaacattatccgatcgccttcaatgccttgccgcaaatcgatgttttcgaaccggatggctatagccatgaagaatggaaaatgatccacgaaaccaagaaaatcatggctggggatatgaatagcgacaccatcaaagtgaccgcaacctgtgttcgaattccggtgccaattgcccactctgaagaagtgtacttcgaagtcgaagacgacaaggcaactgccgatgatattcgcgaggcattggcgcatgctcctggtgtcgttgttcaagacgacccaagcaaacaagtgtatccgcaagcgatgaacgccgttggcagcaaagatgttttcgttggccgcattcgaccagatgccgaaaacccacgattcttccatatgtggaatgtttccgacaatctattgaaaggcgctgcttggaattccatgcagattgctgaaacgatggatgccatgggtctcattcaacctaagtaaattattcggtgaaaaagccggtatcatcattgttcaggcggttctgaacggcgacgatgccggcttttgtgttgctttgagattattcaaaaataacattcggatttcttgagagaagcttaaggttggtacgcaaggattgaccatccagattaaataactataatagttaaaaaacaaaggagcagttgtcaaatgaaaaagcatcgttttgtcatcgcactggtgggtctgtcactctttgccgccagcagtacgattgcggctgatatgacgcaggcgaatatggatcaacacagtgtgacctacacgatcaaaggcgacgggttaatcatcttcgacaaaactcgaacctatcgaacaaaatcaaccgctgctgcctataaaggaactttcgccgccgatgcaccaacggccagctttgaaaaggtcgggacattggctaaccacaaggactatcgcgttacccgcaaaatcagagtgaaagccaagatgcaaggcgttgctgcacagacctttttctatgtgaatgggcatggctgggttaagggcagtgacttgacgcgggagtgatttgttttaaaatcaataccttcatctaatttaaataaccgtgatgaatcttttatatgaaaaaggttcatcacggctttttatttccttatcagatgtatgaatatatttatggtaataatagttgacgtagcactggcaggcactatacaatcaaagctctcttgatggactagtctcatcacctcatacgtgagtgaggcttctaagctagagatgacgcatcatcgttttatctacttctagaggatgtttgaaatgcgagataagcaaaggggggtatcctgtggtaaaggttcattttggtctcactcataaaaaagttgattccgttctaatcattcaattctttaacgccggtattatctgggttcataactcaaagcgccgttgggagttgactggtggcaagttagaaccgggcgagacgatggtgcaagcagctgtccgcgaatcgtatgaagaatcaggtgctgttgttcaggccagtgcgattgtgccattgggctactatgttttacctactggacacacaacagcagtggttagtgctaaagttgaacgtttgcaagccattcctacgtcttctgagattgatgatcggcaagtatgggttgagcctgtcccggatgctgagcgatcatttcatgatgatatttacgcccagatttttcaacatatcgggtggccagatgagtagccgccaatacgggtttctgctgaatattttatcggtagccgtgatggctgtgacaccggtcatgaacaagttctcgatgatcacgctctcgccattagccgcaagtttctacaatgcgctagtgtcattgatcctgactttgggcacgatcgcctttaccaaaacaaaattagtttggattaagcagccgattatttggacgttgggtttgacgaattgtttaggcatatttttgcaatatatgagtcttttcttccttgatccggtcagcgtcgggttggtcggcaggttttacattgtctttgcgatattgctttcagtgcttctgctacgtgaacgatttgatcgaaaagagattgttccgatcgtcttatgtatgattggcacagctttggtatctgacttttccggcgatgttaataacatactagggctggtctgtgcgcttggctacacgtttagctttgccctgaccaacaccttagccaaaaaagctcttatcaacatagacgagaagatactactcttatataaccaaggcaccgccgtcgtcattctgggcggttttttactcggaagtggccaattatcccttgcgccgaatcttggcatgggtgctgtcgccatttcagctttttgttctggctttttgggactgctactcttttatcgcggcctgaagttgatttcatttcgcgatgctaatcttattcgggcattgaatcctatttttgtcttagtgtattcattgccgttcttcacaattcaaatgacgccagcgtttctgcttggcggtttctgtatcattctttcgattgtttggatgtcattgccgatgaagaaggttggcgttgattgagatgaatgtttcttatacgttcagcgaaagtataaatggcatacaaaatagatttattaaagtatggcgcaagaatgctttctttttattgttcaataaatcatttctttgttgatgcgaaaaatgaaacaaaaagttgctgcatatattcgctaataacaggtgctattgccaagagctgaagttgcttggtagtggcgcttgttttccttttaggatagagataaatattttagaaccatcaaaattacttggctgataaccatctcaaaatatatcgatataacagcattaaccatattatgatctcttatagataataaaatacttcgtttttagtagactcttatgtataataattggtgtaaacaattgcctgtgggtgttggcaatgataaagccagaaaacattggagggaaatatgaaattttctagacgttcaaaaaggtttgttatagtcagaagaagtgccgcagtcgtttttgccctgattagtatgacactattttttcaatttagtagtggggttgaggtccacgcaacgactaagactgagtttaatgacactgaaatcaacagagaaacaagtgaacaattaaaaatgatcgatccgtacttaaagaatattgatggtatcacaagttttgactatgatgctgccatgaatgacaatgttgatcccgttgtcctaaaaattggcgcagaaataaataaatgggctcgcagtcttaaaaatgatggtccagaaaaaggcatgctgctctcaatggctaggtttaatttgctggtgtatggaaattattgcggtaaaggcaacaacggcaaagcgccgattgatgatcttgatggtgcctgccaagcacatgatacatgttatgcgtggggcggaaacaatgaaaaatgtaatcaggaatttcgtcaacgcttattgacaattatgcagaagacatcgctttttgattacaagcacattgttgccgttgcggcatataagttgtttggtggttgaaaatcaatcatgaataaggcttagaagaaggctttcgttttatctaaagggatctgccaaaggcacttttaatggagaactgaaaaatgaagactaaagcgaaaatggtcattggtaatggcggtatcttgactgttatatttgccttaatgaccatcataactttctctgggaaaaagaacttcgttggaatcgagcttggcactgggtttattgggctattagtgattgccttgctgattatctgttggcaaatttaccttttattagaaaagtccgcccttggctggagctttaacattatcctcggtagttacacattggttgttggagtagccatttttttcattgcctcatttttcattggctttgcgctatttccgtgattttcccacctaggaataacggtgaagggcctgggctataatgcgacgttaccaaacagactagtgagaatgatttgccatgtttaggcaaatcattctttttatttttccataaatagtctggttaagtttaaagattgtggcgtatggcatggcaagccacttcatagaccggccttgttgccactattttgtaaacgtgatgctatcaagcaatggctaggtcactcgcagaatctaattgcacagtatggtagaatagctaaagaaatccttaagtatctgcgctaagtgaaagcgagtttttctatatgaagaaattgtttgagcggattcgtatgccggagtttcttgaagacatgcgaatgcgatatgcagctattgcgatggtcgtgctggcggtgatcggtattctgatgggagcactgatccgtccgtggttggctttgttgatgctgctgattttgattagtctagtggccacgattttttatgccctagaaaccattgccaagaataccaatcagtatatttcggacctcagttatcggatcaagcgcggcgaacaagaagcgctgatcaaaatgccgattgggatcctgatttatgacgagaatctcaatattgaatggacgaacccattcctgcagaagtattttggcgacactgacgttcttggtcagccgttggaacatgttgatgcggaattggcggagttgattcgcagcaacgagaacaccaatgaaacgaaaatggtgacttggggccagcatcagtttgagattatcgtgcaaaagagtatcggggttgtctatctgatggacgtgactcgatatgctgagattgaagagcgggcagaagacgagaagatcgccattggccagatcttcattgataactatgacgagatcacacaaaccatggatgatcaggtcattactaatttaaatagttacgtcacgaatcagctgacggattgggccaatcaatttggcatgttcttgaagcggattgacaacgatcgctttttcctgctggcttatgccaagtcgctgaaggatgttgaacgtgacaagttcaagattctagatgtgattcgggaagaaacctcgaaacagaattatccattgacgctgtcgctggggatcgcatatggcgatgaagacttggctcagttagcggtgacttcgcagagtaacttggatctggcgcttggtcgtggcggcgatcaggtggtggtccgcgccaaaggccacgaagcccgtttctatggcggcaagacgaatccaatggaaaagcggacgcgtgtgcgggcgcgcatggttgcgcaggccttgcaagaattgtttaagcagacggacaaggtctttgttgtcggccataagcggccggatatggatgcagttggcgcctcgatggggattcgccggattgcgcagatgaatggcaaagagtgttacattgtgattgaccctgaccatctgcactccgatgttgaacgcctcatgggccaagtgggtcaagatcctgaagttgctaatgccattgtgacgccggaagcagcgctgtcgcaagcgacggatcagagcctgctgatcttggtcgatcacagcaagccgtcgatctcagcggcgcctgacttgtacaaacggttggcggcaagaacggttatcatcgatcaccatcgacgcggcgaagaatttccggacaacccgatgctggtttatatcgaaccgtacgccagctccacttgtgagctgattgcggagatgtttgaataccagccaacaaatgtgccaagtcttgataagcttgaggcaacggcgatgctggcagggatcacggtggataccaagtccttcagcctacgcaccggcacgcggacgtttgatgctgccagctatctgcgttccatgggcgctgatggcatgttggctcagaacctgttaaaggaaaatatcgacagcttcatccaacggaatcatttgatcgatacaattgaaatgattgcgccaaatatggcactatgtactggggaagaggataagcgttatgacccagtgattgcagcacaagcggctgatacgatgttgtcactcaatggcgttgatgccagttttgtcatcacaaaacgcccaagcggtgatgtcggcatttccgcccgctcgactggggatgtcaacgtgcaggtcatcatggaagccatgggcggcggcggtcacttgagtaacgcagccacccagattaagggcaaaacgatcgccgaagttcggactgatctgcttgctcagatcaagaaagcagacgaagacgcatagaaagcagggattttgatgaaagtcatctttacacaagacgttcgtggcaagggcaatcgcggtcaggtgaaagaagtacctgacggctatgctgaaaactttttaattcgcaaggggctggctaaagcagcgacaccgcaggctatgagtgctttgcgcggccagcagcggcttgaagagaagaaggaagctgaaaagaaaaccgaggctgaggccatgaaggctaagatcgaagacgacaaaaccgttgttcagatccaaagcaaagccggcgaagattcccggttgttcggttcgattcctagcaagcagatcgcgcaggcgttggataagcaatatcagatcaaagttgataaacgtaagatcgatctgaagcagcctatccgttcactgggtttcactaatgtcacggttaatttattccctggcattgatgcccgcattcgggtacacgtgattgaacaaaagtaagaatagttattctgccagaagacgcgaccagatgatcgcgtctttttgtctatctggtccaaattagtgggttgtggactgagtcaatcaccggtgatacagcagtgaccattgcttttcgttaaattgtttgtgtagttcgactgtatgcggtgatgcttgtcttgactgcgggtttaacgtagactgttagggataagcgacaaaaaatttttgacgattaatctgaaggaggacgcgcatggataatcaattaattgaccagcagccgccgcatagtgacgaagcagaacgtgccgtccttggcggcatttttctgaatgctgacacattgccggatgcacaagagtatgtcacggcggatgacttctataagaaagcacaccggctgttgttccaagctatgaccgatctacaggataacggcacagcgattgatacggttacggtgtcggattatctggacaatcataacaacctcgacgatattggcggggttggttatattacagatttggttgcggcgacgcctattgccagtaacgtggtatactacgccaaaatcgtgcagcagaagagcacgttacgcaaactgattagtacggcgcaaaacattgccagtcgcagctatacggaacaagacgatgttgaaggactagttgaagacgccgagcgccagattatggatgtctcggagaaccgcaatcaggccggcttcaaacagatcaaagatgtgctgaatcaggccatggcgcagattgatcagttgtatcaaaatgatcaggcaatcaccgggttgccaaccggtttccgtgatttggacaaaatcacgacggggctgcatgaggacgaaatgattattttagcggcgcggcctgctgtcgggaaaaccgcatttgctttgaacattgcccaaaatgttgggacgaaaacagacaaaagtgtcgccattttcagtttggaaatgggcgctgaacagctggtaaaccggatgttgtgttcagaaggtagtattgatgctaatcacctgcgaactggtcagctgaatgaagaagaatggcagaacttgattatcgccatgggtagcttgagtaaggcgaagatctatatggatgacacgccaggcatcagaatggcggagattcgcgcgaagtgtcggcggctagcgcgtgagcaaggtgatttagggctgattatcattgattatttgcagttgattgaaggttctggccaagaaaaccgccaacaggaagtcagcgccgtttcccggcagctgaaaaaactggcgaaggaattgcatgtacccgtgattgcgttgtcccagctgagtcgtggcgttgaacagcgacaggataagcggccggtgttgagcgatattcgtgaatccggttcgatcgaacaggatgccgatattgtggttttcctgtatcgtgatgactattaccgcgatgcagaaggcgatgaggatgacgacgatcaaggcggcaatgatgacggggatgacaatgttggtgaagttgaagtcatcattgagaaaaaccgttcaggcccgcgtggtaccgtcaagttgttgtttgtgaagtcgtataacaagtttacgaatattgcctataatggtccggatcaataaaccattagcaagaaagattagaaagttatttttagatttaagcgcaagaaagtgagggatgccgcatggatgccattttgatgagtttaatgacagcactcaatgaacacctgctgatcaatgtgtatcagcgcgataccgacgatttttacaccggatacgtacaggtgttaggtcatgatgcggttgttctgggaacctacaatgattcagggattgccgatggatgtgccttgatcgcattttctgcgattgatcaggttgaatttgccggggatgatctcgatagcatgaattttcgaattaacttggcacaggcccagcattttttgacgctgcaaggccaagaaaagccattgcagttcgatgcgacacagaacttgattcagcaactggcgacgcaggctaaggcgaatggtcaaatggtcatggtcgtggtggccgatgatgatgcctatcttgaagggcaggtaacagctgtggctgaggatcgctttagtatggcgatcttcaacaaattcaactacaccgatgtgcgcgccttgcaggttgatttctcggatattttagtcatggaattccatggccttgatctcaaactggaaacggaactggtccggcaacgtgatcatctaaaacacgtggccaccaagctgtaccaaaatgacggtcaactggctggcgtgtttcagaatgctttggcgaacaatcgcttgatttcagtcgtacccaagggaccggaagaccagttctttgtgggtcgcgtcaaagcggtcaacgaccgggttgtggtgttgagtcttaaagacatggccggccagtttggtggctacattttactgacgttaccaagtatccaaaatgtcgcgacggcctcggattatttgcaaacgatcagcttttacgaaaaatgggatcaaacccatcacttcagccagcagccagtgttgaatgctgatcgtgagttcgatccgaatgatgacttgattcagaccatcatctcagaggccgctgggtttgaacgggtggtgcgcattaaagtagccgacagcgatgaacattttctgggttatccggaaaatgtcggtgaaaccgattttgacttaaatctagtcggaccagatgatggcgaaacagcgcaaattcgctatggtcagattcgtgaaattgcctttggccacatctttgcgtatttgcaagaggcacaattgaaaaatgctggacgctaattatcggcaaggtgatcaatgtgacgccaagccgaaccataatcatcatctaagacttgtgatttgctgaattccgaataatcggggaaaacaaggcaggctaaaaaatcccttgccatgccaaactccgcactctccggccagatggggtggcgacgcgaagcgaagctagagcggagacggcgcttcgagcccaaaaaccggtctcgaagtcgcctaacaacatcagctccagagaccgtcgctgtgttgtttgcacggctgagccccatctggcctacgattgctccgccttggcactgagatttttaaatgctatcagggcatctatcaaaagacgaattgtgtatcaaccgcaagcaaaaaatcgttcctagagaaactgtgctttctctaggaacgatttttttagttggcacacacgatcactcaaatataaggttaagtcaatctgccgtcgactttcatatactaactttctgattggctggtgacgcgcaggacgtcttcgccagcagtgatcgattgatctgtgaagctggtcatggcggtgacatgggtcatgttggtgatgacggtgatgattgtcgtacttttgccagctgttttaatagcaggtagatccatttcggcaatttgctgacctgcctttacggtttcgttttctgtcacatgaacagtgaaagggtcaccgttcaatgcgacggtgtctaatcccatgtggacgagaatttcaagtccagttgccgttgtcatagtccaggcgtgtttggtcggcatgatgctgacgatggtaccgtcaacaggtgcgacaaccgtgccatgacttgggacaatggcaaaaccatcccccaccattttttgagaaaagacatcatctggcacttcggacaaggcttgaagttgaccagcagcaggagccacaaattgagtcgcatccgggctagctgctctagtggaaggggtttcaggaacagctgctgtatttactgcgagcggttcaatgatggtgccgtcagcgctggtcggcaccatcgcgctttctggcacaccgaagaagtaagtcgccagaaaaccgcctgcataggaagccagtaggccgaaaacataacccagccattggtgattggcgatgagtggaatcagggctgcgccggaaggaccaatggtgatggcaccgatatggccgatcatgccgataacggcgccgccgatgccaccgccaatacaggcagttacaaatggccggcccagcggcagactgacaccatagatcaacggttcaccaacccctaagatgccgactggtagagcgccttttatcaagcggacgagctgttgattttgtcgacacttgatccatagtgcaagggcggcacccacttgaccgccgccagccatggccaagattggcagcaggccggtgtagccaatgctcttgatcatttcaagatgaataggcgtcagaatctggtgtaatcccaacatgaccatcggcaagaaggcgaggcctaagatagcgcctgagaaggcaccgccaacttgtaacgtccagttaatcgtgccgaccaatgaacttgagacccaaccggcgagtggcatgatgaagaaaatggtcagcagcccgatggataagagactgagcatcggcgtgaaaatgatatcgatggcgtccggaatgagtcgatgcaggcgtttttcaaccacagccaacaaccagacggcgaaaatgacgccgatgatgccaccttgaccaggagataacggttgatgggtgaagacgttgttgatcgtgatcggggccacaacgccaggcagatagactaagccgccgatgatgccgccaaggccagcggttgcgccaaactcggttgcggcgtttatcccaacatagatattaagaaaggtgaagagcccgccgttgatgacttttaagacagtaataaatgacgcccagctggttggtaaatcgccagcggttaacaaattggctaaaataccagcaacgccggagattaagccggcaccgacgaaggcaggaattagcggaatgaaaatagcggaaatatgttttaaagcagcccgccaccaagtttgctttaacttggctttatgcgctgcccgaacctctgcggctttagcttcaactgccgattgattcgattcagcaggcggttgcgtgttggctgggaaagggtcacctaatgcaacccccactcgatcaaccatggcctgtgcgactttgttgacagtccctggaccaacaatgacttggagcgtttcttcttggacaacacccagcacgccaggcacttttttaagtgcggcttgatcaactttggcctcgtctttgatcgtcagccggactcgtgtcatacagtggatcaatttggccacgttttgcggcccgccgatgtgggcgtagataccatcgcccatcgcttgatacttatcttgtgccatctgttttctcctccgaacttgctgtgacagtttggctaatgaagccgttcgtttgtgtcagtagtttttgagcgtccgtgcttgatcgctgtgtcagaatcatgacgatcgccaatttaacgtgctgatcggctgcttcaaatgcctttgctgcagtggcggcatcgcaaccagtggcttgttgaatgatgcgctggctgcgaaccacgagtttttcattcgtcggcagcacatcgaccatgagattttggaaaactttgccaaggccgatcatggcgccagttgacagcatattcaaaaccaatttttgggcagtgccagccttgagccgagttgagccggtcaaaacttctggtccaacaggtacttcaatggcgatctgggcgtgctggctgatttcggcgttggtgttgcaagcgaggctgatggttgcagcaccgacagcctgtgcataatcaagaccgccgatgacataaggtgtacggccgctggcagcaatcccaacaacggtatcgtctgcggataggtgccgttgcagcagatcggttttcccgagctctttagaatcctccgcgccttcaaccgcgacagtcatggctttcatgccgcctgcaatcaggccttgcaccatttccggatcagtgccaaaggtcggcacgcattctgctgcatctaaaacgcccagtcggccactggtgcctgccccgatataaaacaggcggccgccttttttgagtgaatgactgatcgtctgaatagctgcttcgatagccgggagtgcttgttggactgattgggcaacggtttgatcttcggcattcatgacagtggcaaaatcatggaccgtcatcgtgtctaatgccattgttttctgatttcgagtttccgtcgtcatttgatctaaattaattgccatgtttttagcctctttctttggaaaatcagtctgacaagttggctgataaacgttacgtcaagttaaagggcaggcgtcgtcggaaaattgatggaagccctttattgataaaaacgtacctgatatccacttttatttcaactattttcttttaaatgtgaaataaaatttcaaaaaaggctaaaaaaaaagacacgtcagctgcagacgcgtctgaaatgtgaaagcttcgaagactcatttaaagccgttgcgtaaaaattcacgataggcagtcactgcagcttttgattgatccgtggctatttttgctgcatcgtagtatcggctgacataggcatagtatagaatgtcgatgagcataaactgggtgtggagtgattgggttgcagcgaagcggttgcgggcctccatcggttgggaggtttgaatgctcacatcagcatacttggtgagcgaatttttcccgagtttggtggtaacaatcacctgcaagccagcctttttggccaatttggcagctaacacgacttctggcgattcacctgaattcgaaatgaaccagcaaagtgtctgttcgacatctgcagttgctgcaagtggcaagaacaaattgaggtcatcactgaaatgacaaggatagccaagccgcccccatttttgggcaatgttttgcgctgctaagtaagaagcgcccacgccaaacacaagcagacgatcactttgatgaattaagttgataattgtgtcgacattggcttcgttaatctggtcgacggtttcacgcaaagattggttggcatctatgagcagtttttgcttgatcgttgtcagggtggcgtttttttgaatttcttgatcatccgattgattggtatcacccttcagatcagccgctaactgcattttcagctcgttatagccactgaattgcagccgacgcgcggcgcgactgacggaggccggactggtaccagctgctttagctagatcatgaacactcatcgttaagactgcttgactgtgtgccatcacataatcaacgattttcttctcggtttcagatagctcgctgcgggtactttgataattgcctttaacactcatttgaggaccctccttgggaaatcgggtgttgattagccgacaagtcttaatttgcgacagatgttggggtatccagcgttactgaaaacttttcaaccgtgcacatcatgataccaaagggcttgaggatttcgttggtgaaaacgtcaacacaattttcataataggtgatttcgtcaggcacaacaatgactactttcgtttccttcgtgataattgtacctgatttcgtggtgaagactcgtttaaaaaggcgatatgtcgatagttgtaaaatccgttgcttgaattgaaagatgagggcattctttcggattgcggtgccaaagggggagaatcaaatattttcgttcgtgtttttgataaaaatgtttttcttatcaatttaaagttcggattttgcttgttttcataccgctatcctgttagactaccagatggcgggtaaaaatgcccgcactaagccgtgaggagcgatcagttaatgggaactgtagttattgtcggtacacaatggggcgacgaaggtaaagggaagattacggatttcctgagccaaggcgccaaggtggtcagccgttatcaaggcggtgacaatgcaggccatacgatccatgcaaatggcgaggtttataagctgcgcctcgtaccatcaggggtactctacccgcatcagttatcggtgatcggtaatggtgttgttgtgaatcctaagagcttggtcggtgaattggcccggctcgcagaacaaggcgtgactggcgaaaatctgcggatttcagaccgtgctcacgtgattttgccttatcatattaaattagataaattgcaagaagcagcaaagggtgccgacaagattgggacgaccaatcgcggcatcggcccggcctatatggacaaggctgcgcgggttgggattcggatggccgacttgctcgacaaagaaatctttgaagaacgcctcaaagctaacttgaaagctaagaatgaagaattcgtcaaagtttatgatagtacgccgatgaattttgatgatatctttgaagaatattatcaatatggccaacaattgaaacagtatgtttgcgacacctcaattgtgttgaacgacgcgattgacaaaggtgaacacgttttgtttgaaggcgcgcaagggattatgctggatattgaccaagggacctatccgttcgtaacgtcatcgaaccctgctggtggtgtgacggttggtgccggcgttggtgcctccaagattgatcgggttgtgggggttgcgaaagcttatacctcccgcgttggtgacggtcctttcccaactgaattgctcgataaaaccggagatttcattcgcaatgctggccacgaattcggtactgtgaccggccgacctcggcggattggctggttcgatgctgtcgttgttcgtcattctcgccgtgttgccgggattacggatctgtgcctcaactcaattgatgtgctaaccggtttggacaaagtcaaaatctgtgttgcctacgaacgcgatggcgaacgggttgaaaactacccagcttcgctcaagttcctcagtgaatgcaagccagtgtatgaagaactgccaggttggcaagaagatattaccaaagccaaaactttggatgatcttccggaaaatgcgcggcgttacgttgaacgcatcacagaattacttggtgttgacctgctgacattctcagttggccctgaccgtgaccaaaccaatgtccttgagaatgtttgggataaggtatcgcgctagactcaccgcgatttgataattcaatagcgattttttaagagctgctaggtgaaaattcactggtggctctttttttgacaaattaggacatcattcattggattctaaaagagcccagtgccaaggcggagcaagtgtcggccagaggaggctcgaagcgtcgtctccgctctaccagccccatctggtcggagattgtcgcaatcaaggtattttcatgattgacaccgtcccttaaagtcggtatattgaagatgatatatgaacgtatgctcatatgaacattaaatgtaagggcgggatcaaagatgaaaaaaaacaaggccattattttttatatgcttggcgtcatcaccttcattggcggcttactcatcacccaaccgatagctcgcgcggcgttgttggtttttgccgcgattgttgcgggttatcaagtgattgcagaaggtatcatggcaacgattcaagcaactagaaaacggcgccgtttttcgccaaatattcatctcctcatggcactggctgcacttggcgccattgcgattggcagttttgaagaggccgcgatgctaattctgatttttgctggcgcgcattttttggaggagtacgttgaaaacaagagccgcaaagaaattacggcactgctggctatggcgcctcaagaagcgcggcgctataccgacaccggtgcattagaagttgtaccagtgacagcattaaacatcggtgatcaattacagattctgaatggcgctcaggtaccgacggatggcgttattattgccggcactgctagtctcaatgaagctgcgatcagtggtgaaagcattccccgtgaaaagcaaaccggcgatgaggtttttggtgggaccatcaacggcaagtcaacctttgatatgcgggttaccaagtcaagtgatgaaacagtttttgctaagattgtccagatggtgcagtcagcccaagactccccgaccaaaacagccagcgtgattcaacgttttgagccgatttacgtgaaggcggtattggcggtattgccgattgttttacttgcgggaccatttttacttcattggtcatgggcaaccagcatctatcgcacgatcgtcttcttagtggctgtgtcgccgtgtgccttggccgccagcgcggtgccggccacattgtcaggcatttcaagtctggcgcggcaaggggttctttttaaaggtggcagctatttagctaatctgacccagttaaaagccattgcgtttgataaaaccgggacattgacggaaggcataccagtggtgacggacagcgaatttgtgtcggatgtggatgaagccgccttgactcagattattacagcaatggaaatgcaaagtaatcatccgttggcgaatgcgattgtgagccattattcaaaaagtgatgtaccaatcacggatgtgcataatgaaattggcaaaggcttgaccgctgagtatcagggacacacttacaccattggtaagccgcagcgattcaagcaagttgatccggcatttcgcaagcgagccgcaacactcagtaagcaaggcaaaaccgttgttttcgttgcggtcgatcaaagggttgttggcctgatcgccttgatggatcaagcaaaaagcagcgctaaatcggccattaattaccttaaacggcacgacattcaaccggtgatgatcacgggggatgcgcaacaaaccggtgaagccgtggccgccgacctgggcattgatcaagtggtcgctaatgtgatgcccgaacaaaaggttgccgtggtccgtgagctgcagaccaccatgcggcccgttgccatggtcggcgacggggtcaatgatgcaccagccctagccaatgcagaggttggcatcgcgatgggatcaggaactgatgtcgccattgatgtcgccgatgtggttctagtcgaaaatgacctttcacgcctagcattggcgcatcaagtttcaactaaaatgaatcgcattgtgatcgagaacctgctactctccatggctgttgttgtcatgctggttgtcctaaacgtcttgcaactcaccaacattgcttggggcgtcatgttccacgaaggcagcacgctgattgtcatcttaaatggcctacgcttgttaattccgcagagagcttaagggaaaactgccgacatccgccctcagtgaaaagtgcctttcgataccaaagtctgttaaaatgggccataagtatcttaaggagcgcagtgctatgacaactaatgatgttcgtaatgcggacatgaatgagaacgcggtgcctagtgacgccgaattgcgggatgtgcttgatgtgtttaaaaccatgagtgacccgacccgcatgcggattattcttgctattgccaaggggccaattacggtcaccgatctggccgccatgctcgacctcggtcagtcagcggtttcccaccaactgcgcctgctcaaacaagcgcggttggttgtgggggatcgctccggcaaacagatttattatcatttggtggatgaccatgttttggaaatctacgcgctgacgaaagcgcacattgaagaaaagcagcatggacaagaaaattagtcattgcttattttaaaagcacacaaaaaccaccagtccgaatttgaagcggatcggtggttttttggtaaacaaagcccgcattatcatgcaatctttaaccaacggaagacagcaactttaaggaaatcaagcacgattgtggctgccagtgtcagtagcagaatggtgactaaaagcggtgagctgatggccggcatgagccagccagtcaaggctaacagcgcaaagatgacaattgtgaaaagattgacagctagcaaggtgcggcttggccaagatgtccaaaagtggctccgttcccggacgatcagcagccggagctgggagttgaagaccaaaccaattaaaacagcggtttgcaagactggcaagctgaggtggaacagatttagccctaaccaaacgatcacgaggtcgactaaggcgaaccacaagcccaaaacgccggaagccgcggttaacgggccgagtcgccattgattaggaccggcagttgactggacattatcggtagcgatggacatggtcgcaaagtcattggcgaacacgagcagcgacatccccagcagtgacactaggctgacttttaaccagaagaagccgagtgtaaacaagataatgatctcaatgactttggtgattttgttgatgacccaagtcagcatacgctggtaagtttggcgactggtcgtgatagcagcgatgatgtcatgcaagcccgggtgcgtcaaaatgatgctggctgaagccttggcaacatcactggcgctgctgacggcggtccctaactctgcctgtttcagcgcaggggcatcgtttaccccgtcaccggtcatgccaacgagatgaccatcttcttgtaacaacttaacgatttgatacttgtcatctggaaaaacattggcaaacccgtcactttcatgaatcaattgaattttatcggctgcggtgccggttttcaaagctttggctggtagaattttggtgccgatgccaacttgttcggcaacatcacgggcaatcggtacactgtcaccggtgatcatcatcggcttgatacctaagttttttagccgtgcaagcatggatgctgaatccgctcgcggcggatcggcgattgccaaaacaccgactaacgccatttgcgaatcgacgacgcttgcgacagctagggaacgataaccttttttggcgttggcagttgctagttgttgaatagcagcgctggcaggcgcagtgtcagcaggatgctgcttggcgtataacgccagaatcgtcggaacagcacctttgatgacccgcatttgccggtgatcagtggttgtgatgaccgcctcggtgcgcttggtggcaaaatcgaacggcgtgaactgctgccgtttagagaaatcgaggggatgcttgatttcggcggcatagttgagcaccgcctggtcaatcgcatcaggatgttcttgatctgccgctaaccctgcagcatccaacagttgctcggcagtatagccggtgagcggttggcaagcaatgatcgacaatttgttttgggtgatggtgccggttttatcaaaacagaaaatatcgattgaagctgcgtcttccaaactcgtcaagcgactgacgatgatgccttttttggaaagtgccattgccccgacagcctgaacaatggttaggacagcaggcaaggcgactggcacggagccaatcaggaaaatgagcacgaaggacagaataaaaaccggactttcatgcaggtaaaggccgtaaatggcgacaatgaccgatgcggcaatgccaagatagagcatataacggacaatggcaagcatcagttcttcttgttttgactttggcttggcggttttcaccaacgtcaccgtttgaccgaagtaagtcgttgtgccggtgtttaagacgacggcctgaacttcgccgcttttgacaatgctgccagagtaaagcaggtcgccagcactggcagtggctggcagcgattcgccggtcagggcggactgatcgacggtgacattgccagcgataatcgcaagatcagctgggacaatggcgccaattttcagttgcacgatatcgccaggcacaacttggctagcggcgagtgcttgccaagcctgatcgcggcgaacagtggccataatctccagcttcttttttaaaagggcaaccgctttttgcgaattgttcgactggacaaagccaatcaccgcattaatcgtcagcaatacgaagatgatgatgctttcagtgtcatggcctaaaatcaaggtcagtacaatcgccaattccaacaaccacggcattggaccccaatagcgctttaagaaatcaagcaagttattgcgcttttgctcaggaatcgcattcggaccatactgagctagtcgctttttagcttcatgactcgtgagaccatccgttgtcgtgttgagttgctttaacactgctgcctgacttttatcttgataactgcgagtatctgcaagcattcaatcatcccatcctgaatcaaaacattaacgacaaaatttttagttggtgcgaaacagttcatggacctcgtcggcatgactgaccaacttatcagctgcttcatcacacgcttgtgactcaagtgtaacgcgtggtgagcaatataaaaaatacatattcgaggtactatccatacaatttgtgtatagtggagctgaaggattgcgaagctgacgattaaaaatgaagggatcaatcgcgatgaatctcaagcaaattacctattttttagcggtagcagaagctggccagatgactgcggcggcgaaacaattgcacatggcgcagccgccgttgagttatcaattgaaagcacttgaagatgaactgggtgtacgcctgtttgaacgtgggtcgcgcggtgtccgactcactggtagcggccaacagtttatgacatacgcacaacagatcgttgagacggttgcggcagctgagaacgcagcgcggcgtagcggtgaaggtgagattggcacactggcgctgggactgacttcttcggccggtgatgtcctgccgaagcaaaaattgcaggcctttaatcgccgctatccgcaggtcgagtttgcactttatgaggacaacacttatggcatcctcgacaagttacgccgcaacattctggatttggccatcgtccgaacgccatttaatgatgacggtctagcttcatgtcgtctaagcagtgaccacatgatcgccgttgctgccgcgtcgcagcccttgccagccacgctaaccattcccgacctcaagcagcagccgctgattgtgtatcgccggtttagttcgctattcaaaaccacgtttgccgagtatggcatcacaccgacaattgcggtgttgtgtgatgacgcgcgcacggcgttgcattgggcccagatggggatgggggtggcgttagtcccagcgaccatggccgccttggcgagtcagcaaagtcaccttgccgtgattgattatgagccatgggtgacgcacatgacgctcgtttggcagcctgaggcgttgcacaatccattggtggcaagatttgtgaagcaactttcgggtggggaatcggagaaatattcaaaataaggttcgattagttttgtagaaagagtcctgagccgtgccaaactccgcaatctccggccagctggggtggcgacgcgaagctagagcggagacggcgcttcgagcccgcaaagcccgcggtctcgaagtcgcctaacaacatcagcgacaaagcccggtcgctgtgttgtttgcacggctgagccccatctggcctacgattgctccgccttggcactgggatctttaaatccctatgaattatccataaaagggccaacaattctgaggcaaaaattgttggtcctttttcatggatgtgaatgatgtccaaatatctttgcattttttgacgaattacaaatgcttgttttgttgagatgaattatgagtatcccaacagttgatttaacgatgggtaagttaacaaccgctcgatatacttacccatattgagccgctacaatgataagtgaaaagagggaacaagatggaaattaatgtcggtgctgtgatcagtgctcatcgcaagcaaaaaggcatcacccagcaagctttggcagattttgtcggtgtttccaaagcctcagtttcaaaatgggagacagggcaaagttatccggatattacgttgttgccgattctagccgcttattttgacgttagcatcgacaagctgatggcttatgatgcgcaactgagtagcacggaaatccgccgcatctatacgtcaatgaagcaagcctttgaaacccaaccgggggaagcggtgctgaaatcgattcgtaacttaattcggcggtattacgcctgctatccatttttgctgcaaatggggctgctgattttgaatcattacgatcttttaccgggaacatcacaaaccgcgaaagttaccgaatatgtgaatgaagcccgtctattgtttgtccgtgtgcggcaaaatagccaagaggcgcagttaacggccaaggcggtcgaactggaaggctatagtctgctgttgctccaacgacccggtgatgtgttagcgttgctgggcgaatatgtgccagaacaactgcctgcagacagtttaatcgccggtgcttttcagcaaaaaggcgacttgcggcgtgccattgcaaccagtcaaagcggcttgatgcaggacttgagcatcatcatgagtcaactgactaattacatgaccttgctaaaggatgatcctaaccgattggctgcgacgtatcaacgtgggcaagcgattgccaaggcttttgatctagcaacactcaatccggcagtctggctcaatttccaactagctgccttgaatggctttgcgcaacaggataaaacggatgaagccgtggcccttttgcaggagttcacgcatgttttggcggcaaccaaaatgccattgacgctgcatggcgatgcttactttgatgccattgagccatggctagaacaactggacctaggtagccaatcaccgcgggttagcggtcaagccaaacaggatctggctgatttcgtcttgcaaaacccggcattggctaagatcagaacactgtcagaagtgcaaccgctgttggctgagttaaagcaagtgagcgggcatcgctagaactcgtatatacgggcattcagagtctaaataatttaaatcaaagcaaaccttggaggaaagaaaatgaataccaattggcaactatttgcagactactggccatttttagtgccactgatcattttagaatttggcttgatgatcgctgcagtgattcatatcctgcgccatcagcattatcggttcggcaatcgtctattgtggctgttgctcgtgattttcattcagatcattggtccgattgtgtactttgtctttggacgggaggatgaaaattgaacatcctaactttgcaacatgtcagcaagcattttggtagcaagcaagtgctgcaagatctgaatctgactgtgccggctgggtcgatttatggctttgttggcgaaaatggtgccgggaaaaccacgactatgaaattgattctaggcttggatcaagccagcgccggagccattgaagtcgctggtcagcctgtgcatttcggtgaaacggagacgaatcggcagacagggtatctgcctgatgtgccggctttttatgggtacatgacggcaccagaatacttgaaattatgcggtcagctgacaggtttgcgcggcgctgaattgcagtcgcgggtcgctgccatgttgatccaagtcggcttggcagatgccaagcaccgtatcagtggcttttcgcgggggatgcgccagcgcttggggattgcgcaggccttactcaacaccccgaaactcttgatttgtgatgaaccgaccagcgcgcttgatccacagggtcgcacggattttttacagttattggctagtctgcgtggtcagactacgattctgttttcaacgcatattctgagtgatgtggagcggatttgcgaccatgtcgggattctacatcatggccgtctacaagtgagtgcgccattggacgatctgaagcaacagtatgctaaaaaccagattgccttgtcgtttgcgacaactgcccaagcgcaacaagccgcgcatttgttggcaaccttgcagcagcagggccagctgacgcaccttgagcaacaaaaaaacagtcttcaagcagcatacaccggtacctatgctgccgctgctgatcgcgtcctcaccatgttgcttgaagccaaactcattccgatcacgcttgcccagcaagaagccaatttggaacagatcttcatggaggtgacgcgatgaacgcagccattattttcaccaaaaaagaactgcttgaaagctggcggactcaccgcttgttgattttgacggttgttttcctcattttcggcattttgagtccgctgatcgccaaactcatgccggaactgttaaaaggcggtctgggtggcattaaggtggcggtccctaagccgacttcgctggatgcatggacccaatattacaagaacatcacccagatgggcatttacgtgttcgccctcatgcttggcggttgtgtcagtcaggagattcaacaaggcacactggttaatttggtcaccaaaggcttgccgcgctggacggtcattgttggcaaagcgattgtcgggatgttgctctggatctggatcaccagcctcgcctttttggtaacgtgggcttacaccgcgtactactttcctgatacgcgcagcccgcatgtggtactcgcgttcttaccattattagtctttggcttattcttcctcagcctgatcgtgtttggctccacactagcaacgaataattatggcggtttgctgctgacgattgtggtgatggcactgttgtatttggcacaaatggtcaaaagttggcaacatgctaatccggttgccctcattggcgacaatatgaaaatccttgtcaacagtgatgcgctaacgaaattgatgccggccatggtcattgctgtcgttgccgccgttgttttatttttcgcggcgagcaagctgctggatcgaaaaaagctttaaaaaattagccgaatttttgttgattaaactcaaacttcaacaaaaatatcggttatttttgggctatgatcaaacgatttttgaaaaagcagaagtcgtgttcacatgcgcaaacgttataacactcgggcttaccgtcgttatcgtcaagatgaatcgtgaacaaccaaataatgcaaaacacactatatagtgtatgcagtcgataattaaccacaaaatttagtggataacccgttacttttcctgctgagtcttgtatactagatacattgttacaagcacttcaagttaacgtaatgggggattagccatgatcgaattttatacacaaatcaagaaacgagacgggcgcattgttgattttgatgcatccaagatcagcactgcaatcacgaaggcggcagaaagtgtggcaaaactggcaccgagtgacgtgctgacgatcgatcacttgacggatacggtcacggctaagattcgcgatcgctaccacgatgacgtggaaatcgcagagatccaaacagtggttgagcagaccttgatcgctgcggaaaaatataactgggctgaagcgtatactgagtatcgcttgaagcgtgatttagcccgcaaacagaagcaagatgttaattataacgtctcgcgcctagtgaatcgcgacgaaagcgttgttaacgaaaatgccaataaggacagccgggtcttttcaacccagcgggatctaactgcaggcgcagtggccaaggcaatcggtctgaaaatgctgccgcctgctgttgccaacgcgcatttacgtggcgatattcattggcatgatcttgactacaccccgtttatggccgaaaccaactgttgtctgattgattttgactacatgttgaaccatggcttcagcattggcaatgccgaagttgaaccggcccattcgattcaagttgctgtgacgcaaatgacccagatcatcgctaatgtggcctccagtcaatacggcggctgctccagcgatcgaacagatcaggtcttggcgccattcgccgagaaaaactatcaaaaacatttgcgtgaattcggcagcgtgattgatgatccggctaagctggaagcactggctgtgaagcagactaagaaggatatttatgatgccttgcaaactttggaatatcaggtgaacaccctttattccacccaaggccagacgccatttgtcacagtcggcttcggtttggggaccagttggattgaacgcgagatccaaaaagacatcctgaaaatccgaattctaggtctgggtaaagaacggcggacagccatcttcccgaaattggtctttactttgaaacgcggtttgaacctgaaaccagaagatccaaactatgatatcaaacaattggcgatcgaatgtgccaccaaacggatgtatcctgatgtcgtttcctatgacaccatcaaacgattgaccggttccttcaaagcaccaatgggctgccgtagcttcctgcagggttggactgatcccaagacaggcaaagaagtgaacgctgggcggatgaatcttggtgttatcaccgtcaacttgccgcggattgcaatggaagccaatggcgacaaggcgaaattctggaagatttttgaagaacggatgcgcatctgtaaggaaggcctgctctataaggttgaacgcaccaaacaagcaacgccagaaagcgcaccgatcctctacaagtatggggcctttggtcacaagctggctgacaccgacagcattgacgatcttttcaaaaatgggcgggcaacggtttcactaggctatattggtttatatgaagtcggtactgttttctacggctctgcatgggaaaagaatcccgatgccaaggcattctcagtttcaatcgtgaaggctctggacgatcactgcaaggcttgggaaaaacaatatggctaccacttctcggtttatggcacgccaagcgaatcgctaaccgacaccttctgccgagcagatacgaagaaattcggtatcgtgaaggacattacggacaaggaatactataccaacagtttccactacgatgtgcgcaaatcaccgaccccatttgagaaacttgattttgaaaaggattatccgcaatacagtgccggtggcttcatccattattgtgaatacccgaacctgaagcagaacccaaaggcactggaagccgtttgggactatgcgtatgacaagatcggctatctcggcaccaacacgccaatcgatcaatgcttcaagtgcgggttcaaaggtgagttcaccgcaacggccaaaggctatcaatgcccagaatgcggtaaccatgatccagccacttgcgatgtcgtcaagcgtctttgtggctacctcggcaacccgaacaagcggccaatggttcacggtcgtcaggaagaaattattcaccggaagaaacatatcacgtttagcctgaatcaagtggctaatcggcgagacaagtaagccttagccaatgctcaggttgggatagtcgcgtaacgaaaaaaatcgtccttcgtgggcgatttttttcgtggttttgtatcatgaaccttcctcgaatattagactttaacctaccgtattttgagctagacggtttttattctgttagggcgcgtgtacaattcaaatcaaaagttgtgtctaaatgaagcatgttcctgtggtgacaggatggaggtgcgccatgatcgcagagatatttaccgcaaaacaatggcaaacagcagagctacggagagggtctatcgtgggtgatcttttgcgaggatttagcgagcatgttgatgacgtggccatactggtttagtcatgaggatcgtaacgaagccactgagcgttatcaacagcacttgaagatcaacatcttgaaccgtgataaggacgacacctgtcagtaaaaggatcaaaccgagcacagaaaaaccaccagcaatcagacttcgactcaaaaccgaccagtcagcaaaaatgtccaccgattttggactgagcatataactaaaaagaaacagaaccgccacataaggccacaaaatcagctgtgcaagccattgtggaaagaatccaaataaggttgtggctgccatccctgacatcatggcaacaacagtcgtcatgaccgccatgatcatttgatggcgacttattttgctatcatggatcagtttttcatttagttttggatcgtcaagaatcaacgtatcaagagagacctcaaaaattctggcaatacgcgtcaccatttctagatccggcaaattgcggtcattttcccagttggagacagtatggcgcgaaatatgaagctgttccgctaagttaacctgcgtcatctggtgtgccatgtggatctgatgaagctgctttgaaaaattcatgctactcacctcgcttgggcttattgtggcaaagatggatggcggtggcaaggtagcgggctggataagaaggcgcgttattcgagactgggtcattacccgggaaatagtgctggaagaagtcgggcaaacgaacccacattcgttctttagcttccggtataaaacattggtgtcctatggttttaagaattgcaacctttacgtaagggtgtaccctattgtcgttgatataattgatgaatatcattaattacataataagtgtttcactggttgtttaaaaaagactttgaatttagttagatgaataaggagacggtcaaatgacacttgatatgaatgttatggctttctggcaaaataagttaaaggctatcggtccgcggctaacagctactgacagtcacgccaaatttattgagttattgcaagacgaaattaagaatcttggttttaacactatcgaatttccttttaaaattaatagatgtcttcaaagtagctgttctcttgagaatgattcaacaaaagaaaagataccaaatttaggaccagttccatattctggaatcaccaaagaaatgggtgtgaaaggagaaattagattctttcaatcaaaacacgatgtgaagatgaagggtaaagtggccgttattaaagtgaaaaactttacgatccctaagcttttattaatgcatcaggttgccaagtaccctcggcatactcacattggatttagcataagacacccattagttgcagccacattgaccttaggtaaaattcaagccgccaaagataatggtgcagtcggcgttattctggtttgggaacacatcagtgaggatctcgctaaccgcgaagttctaccttttactaatagttatctggggattccttctgtttgggtatatcaaacccagctggaagccttgaagcgatgtcgtgatagaaaggaaccagtaagactaacactaacgggacaatatgagacaaatgtaacaacgaaatcatttgctgttcttgttccgggggaaaatcggggcaaacaaatccttataaatacacatacggatgggccaaacgatatagaagaaaatggggcaattgcattgctcactgtcttacatgccattaaacatgacaaccttaaatttaaaaatacacttgtgtttggatttgtgagtggtcattttcaaattccacaaagcggaattgaaggaaggcaagccacttcgcgatttctgcgtgatttaagcatgtatgaaactagtcagcatcttgaaatgaaaaaggctttaggcctaaccgttgaacacttagggggccttgattatgttgatagccaaaaggaaaacaagcttattgcgaatggattatatgatcctttatatgtatatgcttcgactaaagaaaacagggatttggttttgaagagtttaagtggtaccaatgttagtggaagatatcaaatcctgaagccacgaaaaaatgcctattttggagagggccaacccttgtaccaagacggatggccaacaatttcattcattggcatgccgcttgcactttgccagatggcatctccaataactgaaccagatattaagagtatgtttgaccaaacgaagttgatttttcaaatactagtcgcaagtgatcatcagttttaaatcaattgcgcttatattttagaatgataacttaagctatcgaaccaatgactgactattgatcctgttgatagctgttgatagctgttgttagtatcgcacccggatttttaaagttaagaatacgagaccctgcttttaatctttgttaggaaagggaatcatattaatgaaaatagcagcattatatgatattcacggaaattatcctgctttgaaagaggttttaaaacaggtaaagaaactgtctccagacttagttgttttgggaggtgatctgatcgcgggacctatgcctttggaaacattgtcgttattaaagcgcgtttccaccacattcaaaactgtgggaattatgggaaacaacgatcaagatatcgttgatatttatgcaaaaaaaagagttggactatctagaaaggcaactgagcaattgacttggatagcaaatcaattgagctataagcaagtgtctttcctaagaaacttacttcccagtattagtattggaaattatttcttttgtcatgctgtgaaaaatgataacactactgttttttctccacgacaaaataaagcctacatagaggctttatttaaaggagttcaagaatcgtatattatttgtggacatactcatatacagtttgaattgtccttgcctaataaaaagattatcaacgcaggcagcataggcatgccattctcaaaccaatttggcgcgcaatggttgtggctggacgataacagaattgaatataaaagaaccattttcaatcaacaagctgcaatacaattgattagtcagactgaataccccttcaagaacgaatttattgcgaataatcttcgaagtacaatatccttgagtcaaggatatagcatcttaaatacactaattcgcgcccaaaatgcgcaacacgatttaagttaatacgtaaaagcatctggaattatttctcaattaagccgcttgatgttaaagatcagtgagtatgaattccctgttaaccgccttagtgaattcgaaacagattgcctagggctctttaaagtcatgggtaacgactgaaaatactattgaggggtattgtctatgcaacttggcagctaagcggtgatttcaccacagaaataacgttcggtggcatcgagattggacacgtattaccaatagtgtccttggttaaacagatgttgtggatcatactttgttatcagttttctcagtttgcgacctgtttcttccggccaaatacgttgactttcttctatcgatagatcacttgagtaggaactatagacacccgtccctaaatcttgtagtgggccaaaaacctccttagcatgaggctctgtgtccttttgcaaccacatagctaagaatactttcgcttttcgatcatgccatgcagtttcatcagcattaatggtatttagcgggccgtcaattgctctcatttcaataccaatgattcctggagaaacaagtattttgctgataatatcgccaatattagcattcatggtatccagtaaaatattttttacgaaaacaggttgttgtccagaatgcgggatatgaggagccttgaccaattcagcatagctttttgtctctaattgctgtttattcacttcagaaaggcttagagctgatttaaacaaggctttcgcatcagaatttatagaacctgcccaaaaattactagcatttatgtgaacagtatttctattttcggcagtcaacatgagattgctgctcattttactagatgcgtgagttatccaactttgccattgctgaatgaactttgtcaaattgctcgtttgggattcgatggtttgtacagtaaatggtagcgaaatatcggatttctcttcaaccaacttacttgctttaaaagtgaatgctgtaaccattcctaactgtgaatttccacctcgaataccccaaaaaagatcaggatacttttgatgatcagtcacacggatctcaccatcggcggttactagtctagcgctgacaatatgatcgattgtcaaccctagacgacgaacgagtaagccaatgccaccacctgtggcgagtccaccaacacctgtatcaccaaaatcaccacttgagatgattaaattaaacggacgtaaagcctcggcaacatctccccagactgcgcctgcttgaacctgaaccaatccctgttccgcgtcagtgacggtaacgctatttaactgtgaaatatctaaaatgataccgccatcattcaccgaagccattgaaatgccatgaccgccgctacgaaatgaaaacggaatactgtggctaacattttctctaatttttttgacgtattgaatgctagcaatgacatcacgctctgtcgttgcccttaagattagctttggacgaccggtgacaaaatagtttgaacacataagttcatagtcatcagaagtgggatcaattgcaatcttctttagtgctactggtaacttaggccacgtggcgttaacatcgttattcatcaaattcctcctaaaaattttttcatggttggtaaaaattgctcttacagatgctaaaaaatgattcatcatcagcgacagtcgtctatgttagaaaacgcctttattaggctctgcggctaaacatcctcattctagtatactttttgacgagaagtgaaagaaagagacatgaagacttcaaaaacataaaaactcttaccctagcgtgaacgtggacttcacaaaaaatcttgatgtttgtttatcagcagcatttgaagaccaacaccttgaaccgtgatgagaacgatgcttacagtagaaagatcaggctaagcacagacagatcgccaagtaaggatcaaaaaaatttgttctggtatactaaccagaggggatagaatgccatgaaaattatttgtatcgtcatcgcgatagctgcggggtatgtggcgaataagaggcggcaaagacaatgataacagtttcaatttctttgcttgtcatacctcaagcttccgtgctatactccatgacggtgccaaaccacggtgagttcgtaacgatcggcgcgtaagcgttcagaaggtcgaagcggctcgccattttttgtgccctaatttagtataaatgttgggaccgaagacggttttgatgaacaagaacaacctttctgactgatcaggaggttggcagaagcatctttaaataaatcaaggcaaatatgagcgcattaatcgtgatgtttactatcctgggctttcattttctgcatctcccgcttttgcttacttaattttgattgccgtccgccttcccacaggctaatcaaagccaacaatccaatgatgggcatggcaatatctccaaaagagagttgaagcaaaccgtttgctaaaaagtagatgtcggccacaataaccgcgattggcagaatggcacctagcagtttattttcaatgtagccaaaaaaggtttgaagagaaatgacgatgacgatgatcagtgtttcaatcattggtagtttccttgtatttttgaatgatttcttgggccaaggctaaatcgagtttgtcgtcaatgaccatctgcatgatgctaacctgaaacttgtttttctgatccaattcggccgcttttagcttgcgaatgacgcgatccaaacgtagccggatggttgggtaagagaccgagtacttttcagaaagcttcttgagtgaaccggaagataaaacgaattgtctgacaaactcctgatcgtcttcatctagcaacaaaattggattcattgtcacgactaaccgccttccaactttaactttgttgatataattttaacaaaatgaaagccgcgggttccaataaacagcttgggaacggactgttactcatataccacaacaaaaaaacacagcccatcttcacaatcggctgtggcgaaataaattagcattttgatataagcggtgttggtaagttgcgtttcaggagattggctctgtgtttaagtgcttcgctgacgagcggacggttaaggcttcccaatcgactaatggttgttgtacaaccgcggctaggatcagaatgagcgaccatgtgaggatcagactcatggtgacatcaccagtgaaatgggcgaggatgcgcacgcgggtgtaggccatgacggcgccgtaagcgaaggtgagccagaagaccagccgctggcgttttggcttgtcacgatcgacgaaccatgtcaaagttagcaaggtcgcagcggtttgggtatgaccagatgggaagctcatgtgaccattggcgccgtttggctggaaccagcttgtgaagtgggtcggattgccgtttaattcataaggacggaagcggccccagaaagttttcatggcattgacgatttggtcagatagcaggcagaccaaggtggcgacaacggccattttcaataagtaatgaagctgttcatcggttttgtgggcgagccagtactgactgccgatgaacacagcgaggtagaggatgaggaacaaaatgatactggtggcacccggcagtgttagcttgctgccgtcagagttagccatgcccattggtttgccagcgttgatatcattcagcgaggtgatcaccatggtcatggcatacttgaggtagccggcccaaagttcccaaccagcgtagatgacactaccgatcaccattaaggtgcgggtataccacgccagctgttgtgaacgaatggcataatgacaaacaatgttgcaactgagcatgatgatcaacggtgcggtccacagcccaacgtcttggaacaaagtggcgaatgggtcgttcatatcaccgatggtttgcgagatttgccagtcaaaaccagcagcggcagctaacaataaaagcagtacaccagcaacgatcaagaaaatatgtttgcgaatcggagcattcaatttttgcgtttggtccatagcctttccctccttagacgcgtgcgcagtcgcagaaacttccgtgtaaggaccttgaagcaaagggaccaaaagacggttctttcacttcaaggccactgacacttcaatttctcagcgctcctgctctcgctctttgaaaatagcacatagtttacagaaaaggtcgggatttacggtacctgtacgcaacatttaagtggtcgatacgaagtttacaacttatcagcaaaataaggttcatctaccgtaacttgacgctgatcgaaatcgaccgtcgtttgcaggccgtatggcaggacggttcgcggataggcgtggccaaaattcaggttgtacagaatcggcgtcttgtatggttgggtgacatcaagcagcacctgctggtaagcgtcaaagtaagtttcattttggggcttgccaacgagaatcgccttcacttgtgcaagaacgccatgttcatcaagatgttctaaataggtgcggtaagttgcgggggttattttgtcttctgatgtttcaatgaaaaggatcttgttggtccagtcttgcgggaagagctggtactttttggccacttctggttcatcctgatagcgaaccgggtagattaagtcgtggagactatcgagacagccaccaagtaaggtgccagtgacacggccttgaccccgcagcgcgaggtagccatgctgttctttgtgtgattttcgcggtacccctaactgactttctgaaaagtccgtgcgttcgtcgtaccaagtcgggctggaactaatcgccgttgtggccggatttttgaaataatgctgaaaactggcggcggtgtacggcaacatgtgcgtgtctaattcagctagatcatttaaaaaattaggcccataaaagctagtcatgcttaattgacaaaacatgagatggtcaatggtcgtgtcggaaaaaccagtgaacagtttgggatgatcagcgactgcttgcgtgaaagccggatcatctagcaggtaagggatgattcggtaagtatcatcgccgccgatggcacagatgatacctttgatgctcgggttaaggaaagcggcttttaaatctgctgcgcgtgcttctggatgggctttgagataggcttggccgcgtaaggcgtttggcataaagcgcggttccagcttcatggctttcaatcgctcagtcccaagttgaagctgatgagctgcaaagctttcacctagtgttccggcgctgaggctgacaatggcaacttgatcatgtggctgtaatgcttgcggctttatcataaagatctccctgctttctcatacaatgcattaattatctattgaacatgcaggaaacgcaagcgggcaaaaagatgacaccatcgtcgttctaaccgtaaaccggttgcttgtttttccggctggcaacctgttacgatcgaatagaagacctatcaggaagtgttggttaattaaactgtgcgatttttaacaagacacagtatcagggggaaagcgatatgtataccatccaagcgactgccacgattactgggcgcggtacagtgatcacgattgcgcctccggttgaacgcattcagccgggcgatccgatccgccttaatggcacgacaacaggtaaagtctgtgcgattgagaagcggcaacacccgcaccatactgacgaagtcccgtgtctcgggttgctcgtcacggcacctgtcaaagtcggggatacaattgagtttccgcagtcgccacggtgggtgtgaactgtaggcgatacgcgctcccagttgcagaaatctgctcgtactcaaagaaaaagtcgctatctgaatcgtcaacggcatcacgttgatttcagatagcgactttttatggttactttgagcaaaatgaagatatattttggccgttgtggcttacttcgttaagagtccagcctcggtcatgccgtcagcgtagagcttgagcttgccgttgacaatatccatcaccaaatcgccgtagtcaacaccgtctgcttcggcttcttgcggcaacagtgacagtggtgtcatccccggcaggttgttggcttcaatgacccaaacacctttttcgttggcgaagaagtcgattcggccgtaattttgcaggcccagaacatccatcgtttggacggcaacatctttcatagcctgatggacatcttcatcgagatcctttggcggggtgatgaagtcggtgtagccggcttggaatttatgcttgaaatcataccaaccagaacgcaccttgatttcaatggccgagtaagcgtggccattgacaacgcctaacgagaattcgcgacctggggtgaactcttcaacaatggcactgttgtcgaagcggaaaacatcttcaagaccactttcgagttcttcctgattatgaataatatgtgtcccaacgctggaaccgccggatgttggcttgacaacaactggaaaatcaaacgggaccgtttgttttggcccttgatcgcgcttgaattccttgaatcctgaagtctgaatgccatgatacaacatgacttccttactgaaaaccttgttcatggtgatgcctgaagccagcgggccagagccagtatacttgaccccgttgatgtcaaacacagcctgaaccttaccgttttcgccatcgccaccatgcaaagcgaggaaaacaatgtccgctgctttgcagatcgccataacattgggaccaaatagctgggtgctgccatctggccgtaacttattgatgtcttcatcagtcagaatcgcatctgaaatattcagatccttgctggtgttggcgtcgtcaaaaacctgctcgaccgtcttcccttcgaggtcgtagccaagaaacaggtcaataaaggtggcctgctgccctttttgccgcaaggcgttcgtgatccggtagccgctagaaatggaaacattgcgctccgtgctccggccgcctgctaaaacgacaattttcatgtgatagtacctccgcgtattatccgagtttgatagaaacctcagtttagcacaatccgggctcatcggcgataaagatgctaaaaatggtgtaatattaagaaggcttttaaaccttctgccacggttgtgaacgcgctttctctaaacagcgcagataaggagtcaaagaatgcaatatacacggttagcaatacccaatcacgcctattttatcgtggccgaccaaggaaaactggccttcgtcgggtcaccggatgcgccgcttagcgaggcggctgattatgtcagcggtccacttgaatttaatcaagaagagatgttgccatttcagcacgccattgatgattatcttactggcaaggcgcaaaccatcacagtaccggtgacttaccatgggacaccgctgcaagaagccgtttggcagtatctgcagacgattccttatggagagacccgaacgtacgcacaggtggcagccgcagtcggtcatccgcacgccttccaagcagtcggctctgcggtcggaaagaatcccgttatgatcgctgtgccttgtcatcgcgttctgcgcaaagatggtggtttgggtggctttcgtggcggtttgccaatgaagcgcgacttgttggcacttgaacaagggcagcggccaattttttaaagatgctttttcacagaggcatcttgtatactggtgagtggacaaattggaaaggaagtttaacacatgaagattattgcttacggtgcacgcgttgacgaaattcaatatttcaagcaatgggccaaggatacaggcaacacacttgaataccatacagaatttctcgatgaaaacaccgttgaatgggctaaagggtttgatggcatcaattcattgcagacaacgccatatgcagccggcgtttttgaaaaaatgcatgcgtatggtatcaagttcctgacgattcggaatgtgggtacggataacattgatatgactgccatgaagcaatacggcattcgtttgagcaatgtaccggcttattcgccagcagcgattgctgaatttgctttgaccgatactttgtacttgctacgtaatatgggtaaagtacaggcgcaactacaggcgggcgattatgaaaaagcgggcaccttcatcggtaaggaactcggtcagcaaaccgttggcgtgatgggcaccggtcatattgggcaggttgctatcaaactgttcaaaggtttcggcgccaaagtgattgcttacgatccttatccaatgaagggcgatcacccagattttgactatgtcagccttgaagacctctttaagcaaagtgatatcattgatcttcatgttcctgggattgaacaaaatacccacattatcaatgaagcggcatttgatttgatgaaaccgggtgcgattgtgatcaacacggctcggccaaatctgattgacacgcaagccatgctcagcaatcttaagtctggcaagttggccggtgtcgggattgacacctatgaatacgaaaccgaggacttgttgaatctcgccaagcacggtagcttcaaggatccgttgtgggatgagctgttggggatgccaaatgttgtcctcagcccccacattgcctactacaccgagacggctgtgcataatatggtttacttctcactacaacatctcgttgatttcttgaccaaaggcgaaaccagcacggaagttactggtccagcaaagtagtcaactgaatagcaaaacgtgccctgcctattgacgaatacgttaatggcagagcacgttttttttaatattggggttgattgcttaaaaaatcgaattgccacgaattgccatgatataaacgaacaaggcagcgccattgacgaacaaggagacggcaatgattgaaaaacgaatggtgtacggtctggcgcctatgtcaggatcataaaagtgtgaacggcgtttgccacggtaagagaagaaaaagcctaccagaataacgacaatgatgctctcaacaatcgtgagcaaccaaaaaaccggttgcgttgtattggcagtgaccagaaagtacccgccaagagcgataagatcgagcaggatcgaaatgagaaccatcgtaaattcctcctttgaagtgagcgtgagccagcgcgggtggaatcgaagtgcaagtggccttgggcgtgatgaccgttctttggtcattgcgaccaaggtccttacacgcaggtttcagcgctggcgagcgcgttatggcgtgggactaagacttgggatgtaaaggctgagccgtcagttttgtgagtacctgaatggtagtttgaacatcttgtggatcaagggtatgaagtacagaggcgagttgagcatttgtgtgatgatgcatttgctgatgtaaggcagcgacttgttgaccaagcggagttagtgcaacaatgtaggccttgcgattgtcgggcaaggataattttgtcagcaagtttaattgaacaaggcgagcaacatagcgtgagactaggccttgtgagaacggaacagcagcggttaaatcctgattgcgcagttgtttgcgactgctttgatccagcgttgtgagtaacgtcaattgggcatgattaaaccgaactgtttgcatttgccggcgagtttcagagggtaaagttgccagccaacgatcaaaaagcacttgccacgcttgctcatcggcagctcgagtatgggcattgagcaagcgaatggcttgttgtaattgggtgaaatcagaagccataggtatctcctttttaaattacaagtaatatattttgacaacagaagatcttggagttacactctagaatatattacatgtaattaaacttcaagaaattaggtggtcctttgaaagcagcgattgtaactcatttagatcaagcacctatttatggcgattttccagccccaaagccagcacctgaggaagcattgatctcggttttggccagcagtgtcaatcaacgcgttcgctcgcaggcggatgggtcccattataccaaaacccctgagctcccatttgttcccggacttgatggcgttggtcgcaccagcgatgggcaactggtttattttctaacacgcgatccaaaattcggtgctttagctgagcaaacagtgacgcagcaacagctaatgtttccactgccggaagatgctgatcctgcgcaaattgccgcgagtgtgaatccggcaatggcaggctggatggccttgcacatcaaagcggggcaggttgttggtaagcgggttcttgttcttggtgcaacgggggcggctggcaccgccgctgttcaaattgctaaaacaatgggtgcttcacatgtggcagcggttggtcgaaatcctgataaggtggcggccttaagtgatcttggtgctgatacaacagtgcaacttgatgacaatattgccttggcggctttaccgccagccgacattgtgcttgattttctatggggcgcacccagcgcaaccgtgatgatgacactgctaaaagcgcggcgtgatcatgctgccaagttgatttggattgagattggtggtgccgctgggccaacattgtccttgccggccgctgctttgcgcagtaccggattaacgttggttggcagtggccaaggcagtctgacattggctgactatcaacgggaattgcccgctttgttcacggccttagccgctggaaaatttgtgacaccaacaacggttctatcactcagtcaggtgcatgatcactggcaagatcgcggtgcggctcgacttgtgttccaaccttagcccatgcaaaaggcgttctcgtttgtgagaacgccttttgtcatgatcgtggttttcatgatgccgaagaacgcattaagtgaagcattcaggatgtacgccgcacattggcttaacgaatcagttaaaagaataaggtcaggcaggtaagggcaccgggaattgcttgcacaaagtagatcttcttgctaacggtcgcgccgccgtatagacccacgacggtgacaaagccggttaacagccgcaaggtaatcaattgatcaatgccgtgcagcagtattaggctgagcaacatgacaacagcgagagcaccgttatagatgccttgatttttcaatgcaatttgagcattgggttgtttaacaaaatcaagcggcatgctgaagttttcggcctgactttctggtttgccgaacatttccaaagccatgatcgtcaaatgcaataaaccgagcaagccgacaagtaaggtgctgataagtgacacgatgtcacctccgtttctttctaaacgagattggttcccaatttttctaaacttgcctgagagcgctctatgtttataggaacggtcggaattgggctaaggcaaatccggcgactgtcaccaatactaacgctgcaagggtgctccacacaatcggtttgctcaggcgatggtcctttttgccagcgaaggcgatctcgattaagccgatgaggccaattgcgattagaattttaactaccgtcaacaacggattgcgcgcaaaagcaaagcgcatcaagacaatgccgctcacaatggaaacaagataacaaacgcgggtgatcatcgtccataacataaactggcgagtcttgctaaaaagagcgatccccgctgcaatgattagaactgcccatgaaacaagatgcatccagagccacataaaaatgaccttctttctgtaaatgaatgttgtaatctcatcataccgctttccgaaaagcctgacgagcgtgtttaaaattagggaaaacacgaacattaatcataaaaaaaagaaaaataaacgtattttctattgcaactgccgtcagtctcgggtacacttttcatattcacagtttaggggagcgtgtcatggaaaacttttttcatttgaaagacaataagaccacgccaatgaccgaggtcatggcaggtctaaccacattttttgcaatgtcatatattttattcgttaatccccaagtcctatcacagacggggatgccggcacaggccgttttcttggcaacgatcattgccagtgcggtcggaacgctggtcatgggtcttttcgctaatgtgccgtacgcgttggcaccaggcatgggactcaatgctttcttcacttatacggttgttttcgcgctgggattcagttggcaagaagccttggcgctggtcttcatttgtggcgtgatcaacattttaatcactgtcaccaaaattcggaaattaatcattgtcgcgattccagaaaccatccagcatgcgattggcggtgggatcggggtcttcgtggcttacattgggatcaagaacgccggcttcttacaatttacttctgaagcttccagcattaacaccatcaacggccaaccgttgaaggcgggcgcactgacgctcaaacatggggttgaatcggttgtttccaacggtggcattgtgccggcactggttaacttcacccaagcaggcgctttgctggccctgattggtttgatcatcatggttattctgaacgtcaaaaaagttcccggcgcaattctgatcgggattctgctgacgaccatcattgggattccaatgggcgtgaccaacttgcatctgagcgctgcaaattcctttagcagcacttttgcatcattgcagacaacctttggcgccgctttttccgctaaggggatgggatcgttatttaccagcccagacaaaattgccctgtcaatcatgaccatttttgctttcagtttctccgacattttcgacacattgggaaccttcatcggcacaggccggcgcaccgggattttctcagatgctgacgaacgtgctctggaacaaggttcaggcttctcgtctaaaatggatcgcgccctgtttgcagattcaattgcgacaggtgttggctccatcttcggtaccagtaacgtcacgacctatgttgaaagtgctgccggcatcggtgctggtggccgaactgggctgacttcggttgtcgttgccggcatgttcctgctcagctcagtctttgcgccattcatcgccattgtaccgacccaagctttggcacctgccttgatcttggtcgggatcatgatgatgagcaccttcaaggaaatcgaatgggaagatctttcccaagccgttccagccttcatggcatccatcgtcatgggctttgtctacaacatctcatacgggatcgcggcaggcttcattttctattgcctgatcaagctgatcaccggcaaggttaaggaaatccacccagttttggcaattgtcacaatcgggttcattctgaacttcgtgattctggcatcgctgtaacacacaactaacggctgtcttttaaaagaagctgaaacagacactgccactgcgctgtaaccaaacgcacagggcggcaatctgtttcagcttctttttgatgggcgactcgtggtatcctcaagctgaggtgagacaagatgacactaaaaacaatttttcatttagatacaactgaacgctggccacacatggcgtccaatctcgacaactatctggcggcggagccagatgcagacatcgaagtgctggtgaatggtgatggcatcaccgtcttttttgaccaaaaggtagccgccttcatcgctgcgcatcctcaggttcacttttttgcctgccacaattccctacagcaacgtcacttggacgaaacaaaattaccggctggcgtaccagtggtgccggtcggggttgttaaactggcacaagctgaggcggctgggtatgggtatataaagccttaaaaatagacctgctcattttgagcctgccttattatattgacgaggtcatgtcatagaggagaaggtgttaattatgccttccccgctgtctgcggttccgtgttaaatggtaccaaattccgttcgattgcttcgcgctgatcttccaagaatggtggtaattcgaggtgaacaccggcttcttcgtaggtttcatctagtaggaagcctggaccatctgtcgcaatttcaaacagaatgtctggaattggtcggaagtattcggaggcgaagtagaaacgatcaacgaagcctgacgagttcaaaccagcagcaccgattttttcgatccaatgctggaggctgtcgcgatcatcggtgcggaaagcaaggtgatgaacgccgccgaagccttgataagcggctggaatcaaccgttgatagtcgataatgacttgcgcaccgtggccgccgtcattgagttcaagcaaggtatattgaccgtctttggcgatttgcttgaagccaagcagatcggtcatgacaccgaccagttcgtcgtagtggtcggtggtgatgtactctgggccaaggccgccgatcgcaaattgcgggtcaacggttgaatggcgccaaggcgtgcctgctggaacaccatggttatgctcgtcactgatgagctgatactgttgaccgtcaaaatcatggaagcggaggatcttcgcgccgaataagtcatcaatcgcatcgtgatgcacccgatacgtatcaaagcgatcgatccaataggtcagcgcggcatcagacggaacgcggaagctggtacgagcgatctcattattaccatgctgagctttttgaattcccggaaagtcgaaaaaggtgatgtctgtcccagcagtgcccatatcatcggtgaaatacaggtgataggttcgcacatcgtcctgattgacagtcttcttgataagatgcaggcccaaaataccgctcataaaatgaaaaatccttggtgaacttgatgtgatggcggtcaagtgatgcaatccagtgagttgattagccatggtcagcgctccttttacttacatttagtaagtaaaaggtaccacgtctcttgtgaaaagacaagggttgcgttttcgttaaagtgcttaaggtcttttcaaaattcttggctctgaggctaatggtcctggcaggcgtggtatgctctcgacattgaagacttgtcagaccaaaaggagcgcgtgccagcgatgtttaattttttggataatcctgcagagtacaaacgattgatgaagatggagattttggtagccgtcatggcaattgtggctagtgtggtcatgtttcgattgagtgtcatgactggtgctttgttcgcggccattgccggggccttctttatcatggatgcgattgttgaaggcttgcgactacttggtgcgtcacatggttttagccgcttgataggtaccttaattgcgattccggcgttggcggggtatttgctcgtgatgatgaccttgtttccggcgccaatggtctaacgataggcgcgtgccaagactgggtgtcagtcggcagccaagtatgttgagcaaatgagcattaaaacaacgaaaaagatctttgtacggacgcgtgtggcgttctgtacaaagatctttttttgagcgcgagcaggcgtgtttggaagtcggaacataggggacttgaagccaaatgacccaggcttggtcaattagcttcaaggacatcacctgtaggtttctgcaatggcgagcgcgttatggtgcgttgattaaaaatgaaaggcgtcattatcggcaacagcatcagctgtcaattcaaagcgcgccagtggaactttggtgccatccggtaaagtgcggtcatggtgataatcaccggcctttgtgaagacgttggcagctaacaatttcgctgctcgttcattggtggctggcaaaatgacataaacccgtttgagacctaattcaaagaaggcaaagccaagcatccgtttgaggacttcactcataacgccttcaccttgacgctcggccaaggtttcgaagcgtacttgggcaacggttttcttttcactgaagttccaaatacagaaactgccaagaaaatcaccattagcacgatccttgatcccgtataacaaggcgttgttactcatgacgaggcgcatggaacgattgatgtagcgggccgtgtcggtgattttttgatcgaattcacggcctgattcggcggcaatttgccgatcggcgcgcaactggaaaatatccttgattttaaatgtcgtcaaccagtccatggtgtaatgcacggacatgattggatggtacttctcaaaactttgcatgtgttatagcctccgtgatggtgatgacgttagcttaccatagattgcgcaacatgcgtgttttgagcctaatggcgaacaatccgttgacgctgcgattattaaaaaacgctgatttcatttttgagatatcagaccatctgtcaagacacgatgcccttagtggttattgatggtcatttgagaagtggccaaaaagtgattgtgtgaggatttacacaaatcattttttattttttcatgattcaaataaaaagaaaaaatgacagaatatagaactcgcttatataatcaataatattgagaagggggagtgatacgaatgaagcagcttttttttggcttttgtctgggttgatgttgttacagccgcttgtctcaagcgcgagcacgcaacttgctaaatcgctcatgccaagcgagtcttcaacctcagcgactgacagtttagtgtctggcgctgaaagtatccttgattcaagtaagacatctcagcctagtaccagtcagcagaaaacgacacaggcgaccgcatcaagtgtcaaagcatctgccagtgtcgaaaaaccgacgcaagccaaagaatcgtcggcaagttcttcaaaagaagctgctgcatctgctagtgtcgcagtatcggcggccaaaccagaaccgccaactgcggccagatcaaaaagatcaattgaagatagtcggttgcgatctggtgcagcgccagtgtttgatcaagatcatccatgcccggtgaaaacaaccgccgagttaaaagaagcgattgagaaagggattccttatgtgcgattaacggctgacatcaatattggccgcgaagcgattcccgtgaaaaactcagtcacgatcgatggtgatcacaagtatacgtacatgtacaacagtggcgaaagctggcatcgtggcatctactttaacgccagtaacattagcatcacctttaagaacttgaaaatcggtgatcgtaatgtcgctgaatcagccaataactactatgggatcgcaccagccgacaatcacactgaaaacagcaagatcatcgttgaaaatgttgattactattctgatcgcggcgcccaaccattccatatccgcaagccaagcaaccagatcgttttcaaaggtaagaatacattttatacgatgaaaaaaggcgcgttagttcaggaatttgctgaagcgacgaattacctttttgaagaagattcggataccacgattgaaatggcggacaatccgttgctcggaacattctgggcatcagccggatcgctgaacttggaattgaagaagcgcgctcgtctgaaagttgtgagcagtaatgctctggtttacaccgatgggctcgctcatcacaacaatcgcatcacaattggtgaagatgccgttctggatgcttacctgacggacaaaaatgacggtgccctcatgtatcaccatgacgatttagtggtagatgtccaaaagaatgggcagttgttgatccaaacaaccaaagccacgccatttacgaaatcatcaagcatcaatcttggacccggcgccaaggcggaattaaaaaaccttcgcggtgatttcttccattcaggagatggcacgatcaagattgacaatgccgacgagttatcgttcgggtctggtgatcacggtactaaaagtcccactggtttaacggcaggaaagtccgcgaatctgatttttgccccgttcagtgccgagacaaaaggttatgacatttatgccgataatcagttgttagaaacccaatcagatgattccgattggcaactgaatggcaagaaagttgaacgtacaccaaccaagttagacaaatcggcggcgaatcgcattcaaaagagcacagccttgaggtttacccgcaatggctcaccatttaaagcaacgtctccagatgtgaagccgccggatcaaccgaagccagatgagaaagacaaacagtcgggcgcattaaaactggtggaagtgcctgactttgattttggcaccttgctcattagcggtgagactcaggttgtgcgaccgcagattcgtgggaaattgttaattgaggacagtcgaaagattgccaaaaaacagtctcggctatcgatgaaagtgattcaaccattcaaaaatggtgagatcgatgtgactggcaacatgagttatatcagtcaaacagggcaggaacaggttctgtctgaccagagcatcttagttgaagaaacagctgatgttgatcaacgcgatgtcagcagtgagtggaatcaaacgattgacagcagtgcccgtgggtttaagttgacgattccagttgagaaacaaaaactgggcactttctcgggaaaagtagaatggtcgctacaagatgtgccagctaattaagggggacagaatgaaatgaaaaaaatgattttactgactgtcctcttattgggcttcgcctgcaacccgttttcacgggttgatgcagccgaagcaggggatggctatacctcaggcgctgaagttggcttttacgaatcaccgtcatccgctagtactgacagtcaggctaaaaaagcagggacagggcaaactgatgacgcgaaagacaggcctgatgcgcaaacaacgaatgcagatcaatttggcttcatgccacggcttggtacaacgcaagcttggctttgcagcatggccggcttgttgacgatactcattatcacattgcttttgattctcaaacgaaatggaaaagacaaggaagaggaaaattaaaaaatgaaaaaaagttatctagtggcatcactggcagggttaaccctgattggtctcagcagcatgccagtctcaatggttggggcaacgactgaagttgtatcagacggtcaggtgatgtttaaaaccgatgtcacccggacaccagcaaagaatccgcttgatccaagcgacgccaagccaggtaagccgactaatccgaccaacccaactggcacggcaaccaatggtaccaccggaccactatccttggactatgcttccagttttacttttggcgaagcaatgattagcgcagatgatgctaagtactatgcgaagccgcaagttttctcacaggatgacggcaagaccgtggatcgtcctaactttgttcaggtgaccgacaagcgcgggacgtttgaaggttggacattgaaagtgaagcaagaaaaacaattttcagttaaagatgatgacactaaggaattaaccggtgctcagttgaagttcttgaatggaaatgtgacatcaacaattgatcagcagtacgcgccgactggtcaaaaggaaatcacgcttgtgccaggcagtgctgaggtcgcaccgcttgcggctgctaaagatcagggcatgggcacttggatttatcgattcggggatgaacagacgatggccaagtcaattgagttggcggtgcctggaacttcgccgaagatggccaaggaatatgtcactgaattgacctggacgttagaatcaacgccaaccaacacaacaccgtcaccaaaaagttaaagatcaacgtggaacagtgattcgggggaacttagcaccaaagcagcaaaccaacaaagatcattagcttcgcatagcgtcatcactgacaacaaagattgctggcacctgacaaagatgcacgatgaaaactaaaaaatggagtgttatgatgaaaaaatttgttttattagcagccgctgcagccatgggtaccatggccgtcaatgccacgaccgtactcgctgcccaaactaatggtggtgtgtacagcacgaacggttcaatcgaatttaagccaacagaaaaagtgaccaaaccagtcgatccgcttgatccaactaaaacggccaccccaattgatgcggaggatccgaagaaggttgttcaaccagggacacaaggcccattgtcgattgattttgcttccagcttcaattttggcaagcaagaaatcacttctgaaaccaagacttactttgcagcagcacaaaaatatcaagatgctgcaggtacggaaaaagtgggacccaactttgttcaggtcaccgataatcgcggcaccgaagccggttggaaattagttgtgaagcaaaatgaccaactcacgtccgttagcgggaaagaattaactggtgcacaaattcggcttaagaatgggcatgtggtcaccgcctccaccgcagcacaccctgatggtacagccgagatgaccttggtcccaggcgcagagcaaacggtgatgaacgctaaaactgggtcaggtactggcacgcacctattgaactggggcaaagatgccgatgatgcggcacgcagcgttgaattgaccgtcccaggcgccacgacgaaatacgctgaaaagtatgcgacaacattcacctggactttaacggatacaccagataacaagtaagctcatgattctccgaaaatgttggacgcaattggtttccgttagcgcacatacattttctagcatctagttccaacttgaatagacatgaccgatcacatcttaaaagacaaggagatcctttgtgaaaaaaacaattttctgtatagcagcgtttgttgccatgttgatgacccctgcagcccatgtttttgcctcagaattgaactttgcggccaaggcccagatgccggacaatcaggtcaataaaggtgttagctattttgacatcaaaatggatcagggtgctaagcaggccctgcatgttgacttgcgaaacgatacagaaaaagaggtggctgtggatgttggcattgccagtgcaacgacgaatattaacggcgtggttgaatacggtcaaaatgccatcaagccagcgaaaagccttgcctttaacatgaaggattatgtcaaaacgccagctcaggtcaagatccccgctaaaggcagcacggttttaaatcttgatgtgaccatgccaagcaaaccactccatggcgtgatggcaggcggcattaccttgaaggaacatcagccaggcgatcaagctgcaaaagatgcaggtaaaggggttgccatcaacaatcgcttctcctacgtgattggcttattgatgcaacaaagcactgatcaggtagcggctcatgtgaaattgaatgatgttaagccgagtcagatcaattaccgcaatgtgatcttggcatccatggaaaacgatgccgcgacgttcgtcaacaaagtggcggttgatgccaaaattacggctaaaggttcggataaatctgtctatcaagtggctaaagaaggcttgcaaatggcgccggacacgaccttcgattttccaattgcgttagaaggcaagacgcttaagccaggtacgtatgttgctcatcttgaggtgtatggcaatcagcaggcagatggcgggatgactcgtaaaacagctgatggcaaacagcattaccatgatcactggacgctgacaaagcaattcacgattaccgataaagtggccaaaaatctgaatcaaaaagatgtctcgattaaaaaggataatagctggcaattgtatgcactcattgctgttgtcgctgtactgatcatgattgtggcgcttctactcgtcattgttttcaaacgaaagaagaaggagcaagcgtcctgatcaaggatgaataagaataatggtacaatattcgtaagtattcagtgattaaattagtcgataaaactaatggacagggctgcgaatgaatcaatggcaacattgagacgttggcgaattggaacagtcatcttgaaacggtatcttgtgtcgaacctaggtccgcatgggatgcaccaacattgtcgtgacactagattgactaagaaggaatatgagaattcgtgaaggacactgaagcggaagaaaaagcagcccaacaaaatttgcacatttggttatcggacatgtttactgccgatgaccaaagtgtgcgaatttttgatgtggacaggtacaaacaaagtgggaaaacaacgcaacaacaagcatatttggccgatattgcttaccgttttgctgggaaaacattgctggcacgtacaggtacgatctcaaaaacaaggtggattttgtgaaattacttgaactgatggaaaagaacgatcaaaagaaacttcagttactgtattatcttgatcagcatccgaatcgcaaattgaagaacagcgagttgcaagataaattgcagatttcatattatctttttaaacgccagaccaaagagattgctgaagatattgcagcattcgacttgagtgatttttttgcgatcgaagtgacgaacactaccgttatcttgcatgaatatcacaatacgaatgcatcggtttttttggaacattatctaaagcagtcacttcaaattaagatcttgatgacgctgatgcacgaaccaccagcatttaatctgaccgaatttgctgaggaacactttggtagttatgcctttatgtacaaacggtatacggctctgcgggatacgctcaaaagttggggcattgtgctgagtaatgatggcaagctgaccggtgatgaattggcgatcagactgcttctgacgaaaatcatggtggttgcgcatattgatgaaaccgggtttgatgacaatgtccgcagtacgctgcatgagctgttgcagttgctgaagatgacagaagcaacgccgtcaatgagtcagctcattgagactaaagcgtattttttgatcagtttggttagattccagcaagggcatgtcattgccacatcaccggaaattgttgatttggtgcgcaatattcgcgagcgcacgctggaaaccagaaaacgggttattgcgatttatcaggcgcattttaccgcaagcgaccagacgattgacagcgagtgcgattattttgggacgttccttgccattattggcattattacgtcggaggagatcgtttttcccgatacaatcaaacagcacggccgggctttcattcaagggtttgaagccaattttgatgtacagttgacattgtctgagaaggccaatatcgaatacgttgtcaacaagtgtttgattgatgtgctggccttgccgtttaggagtgaattctttgatgatcatattgaagtcagttacttctttagaatgtatcccgaattctttgactattgtcagcaatttgtccagacacggtcggttaagttggataggaatcagtcgaagtttatgttttaccattgtttgttgaccttggcagccaatgtgcctttgaacaaggtgctggagccactttatgtctgtgttgatttcacgctgggcaaggagtacaacaccattattgaacgcgacatcaagtacttttcaacattgaatgtcaaggtgaccaacgaagtccggccagaaactaaattgattatcacggatttggtcaatgcttatcatgatacggacatttcaaaagtcatctggctgtcaccgccgcgaccagaagattgggagaatgtcattgaagaactgctggatttgcggctagccgatcgcacggtgaaaaaggcatgatgagagcagtgtgatcaacctgttcagtggcatgccgaagccagtgcataaaattcttaagtttatgaaggttataaagttttggtgagatgaccgcaaatggtatactcgccttaacaaatacttggaggcgaggcacgatgaaaagagaaaacgattttgggccggctattaaggactttttctttcgggccggtgactttaagggtgttagttcacgaccacagtattggtggcttttccttgcccaatttttattagggttggctgctggtgttctgttcggcattgcgattccattttctctcatggatagtcattcgttaggcagcaatatcatgttcacgctgacaacgttggcattttcaatctttgggtatcttggctatccacaattgagcttaacgattcgccgttatcgtgacgccaaagttagtccgtggtggtatctgggtattattatcattagttttattggcccgttactagcggttaacggcatgggttggtggttggcattgctgtttcctttaattggcggcattgctaacttggtcattctattgttgccgagtcgagaacagaaagttgttccgtttccggctcaacctaacacgcgcggtacgattggtgttggttttggtacagcggttaaggacttctttatccgcggtggtgactttactggtgaatccagtcgcagccaatattggtggagcattctgtttagcgtgattatcattatccctacttttttgtttatgctcttctcaattatgtcaattattattggtggcgcggcagtcagcggatttaatagccaaaatgttgaccatcttgtgaattcgcttgggactggtgcaatcatcatcgttttcattcttttcgccatcatttacgcgtggtcaatgttagctctgccagcgttgacagttggttggcggcgattcaaagatgcaggcgttagtccatggtggttgattgctttcaacgtcgtatcagcatttctatcaactcttgatcgaaatgcgggtaatgtgccgttaagcttaattgcgttactcctcatcatcgttcagattgtcattcttgctctgccaaccaagtttcgtgacgatgaggcataagcactactcaatgtattaaaaaatgcagccgcggctgcattttttaatgaagtaaaggcctcttcacgttggctaatagatacccttttcatcctcatctactagcggatcattgaagtttttgtggaagtaggtgctgtcaatgatcttgaatttgccattggtgaagcgagcgatgatctcaccgtattgtacaatcaattgctccgtgttggggatgtcaattttgagacggccaatcggggttttggtgaggtattggtaatttgcgccaaagaagcctttcaagtcgtcagtgctggtttcttgtgagtaaggtaagaagtgggtcatttttgcagttgaaaaagctgcgaattcaccttttggaaatccttgtagtgatgaaggcatttgtgtcatggtgtgattcctcctgattaaagtgctttgctactgtggccaaaacgcgtgattcagcagcgctgtttggttattaatttacttatcatgatggtaacacaataatagaacaattgaatgtttgcgccgcggcctgaaaacgcttaatattaagtctggacgttgatcggaggtgagcatatggatcaaagtctatttcaaaatggtaacttccaacctttggcgagtcgtatgcggccacagacgcttgatgagtttgtcggccaaacgcatttgctagggaaggataaggtgctcagcaatcttatcgaacatgacgagattagttccatgattttctggggtccgcctggtgtcggtaaaacaacattggcgcggatcattgctcggcgaacgaaggcacagtttgtgacattttcagcagtcaccagcgggattaaagaaatcaagcaggtgatgaaagaggctgaacagaatcgggagctgggtcagaaaaccattgtgtttgttgatgaaattcatcgtttcaacaaggcgcagcaggatgcctttctgccatatgtcgaacgcgggagcattatcctgattggtgcgacaaccgagaatccttcgtttgaagtcaatgcggcgctcttgtcacggacgcgggttttcgtgttgcacggcttgaccagtgctgaattggttgacctgttacagcgagcgttaaaagatccgcgcggttatggtctgcagaaggttaagatcggcaaaaagctcttagcccagattgctgattttgctaacggggatgctcgaatcgctttgaacaccttggagatggcggtgacaaacgccgaaaccaaaggcggcgtggtaacggtcacccaagcagatgtggcccagttgttgacgaagacagccttattgtatgacaagaatggtgaggagcactataatctaatatcagcattacacaaatcaatgcgcaattccgatgttgatgcggccatttattggctggctcgcatgctggaagcaggagaagatcccttgtatgtcgctcggcggctagttcgatttgcgagcgaggatgtcgggatggccgactcacgcgcattggaaattacaattgctgtttatcaggcgtgtcaatttattgggatgcctgagtgcacggttcatctcacacatgcagtcacttatttggcacttgcaccgaaatcgaatgcactctacacagcgtatgaaggcgcaaagaaagatgcgaccgaaacgctggccgaaccagttccgcttcagattcgaaatggggtaacggatttgatgcaggatctgggttatggtaaggactatcaatatgctcacaacacaaaagataaactaacgaccatgcaaaccatgccggataatcttatcggcaaaacgtactatcatcccacgactcaaggcagcgaagccaaggtcaaggaacggctagagcagatcaaggcctggcatgcgcaacaccctgaccccgattcgccgaaaaccaagaaaaagtcatgatgctgtgcgattacgtgtgcggcaatccgactacccgtttagaggaggaaaaaaacaatggcaaaaattctcgcagtcaacgcaggcagttcaaccctgaagtggaagctttttgatatgccagctgaggttcagctggcagaaggtttggttgatcggttgggacagccgcaatcaaaagttaaaattaagtatggtgatgggcagaaatatgaaagcgatacgccaattgctaactatcaagaagccgtcgccagtttgatgggtaacatcaaggcgttagggttggttgaacatctgcatgagattactggtgtgggccatcgtgtggtagccggcggggagacttttgccgaatccgttgtagttgatgatgctaccttgttgcagattcaaaacctgcgtgactatgcgcctttgcataatccggttgaagcagattacattgatgttttcaaaaagatgatgccatgggccacagaagtcgcagtgtttgatacggcgttccaccaaaccatgcaacctgagaacttcctttacagtattccctatgactattacaagaaatatggtgctcgcaaatatggcgcccacgggacaagtgtgcgttacgtcagcgcgcgggcagctgagatgcttaacaagccgttagaagacttacggatgattgtgatgcatttaggctcaggctccagtgttaccgcagtccaaggcgggcagtctattgatacttccatgggctttacgccgttagccggggtgacgatggggacacgatccggggatattgacccatcacttgtggcttatctcatgaagaaacttgatgtccctgatgtggggcaaatgattcatatcctgaacaacgattccggcctgctcggtatttccggcatcagcaacgacatgcgggatctagaagctgacgaagataccaagccacgcgccaaactggcattggatattttcgttaaccgcgttgtgaagtacgtgggttcttacgcagccttgatggacggcgtggatgtgcttgtcttcacagccgggatcggcgaaaacggtgacgagattcgcgacaagatcatgcgttcactcgattacctcggggctaaaatcgaccatgacatcaacaacaagtcgcacggtgttgaagctgatctcagcacaccagattcaactgtcaaaacattgctcgtgccgaccaatgaagaattaatgatcgtccgtgatgtcatggcattgagctaagcgttaatgacttctcaattaaaaaaccatctctcgactgaaggagagatggtttttgtgtctgcataagcttctgaggaatggacgagcaaacagacaattaattggcgttaatcccctgatctgaatcaatcatgacccctttcgtttcatcgaaaacacagatattgccgtaattttctttataagtcatatgattgccgccatcaataaagtaccgtggtgattcgtcaggatattgaatgactttaaccgggcatttaggataaccgtcactgaatgaagttggtggtagagatggtttgacattgttttcatagtcgccataaatcaaggcagttggcgtgtgaccggtgacaattgttttagcgatcggattgtgagcaaaaatgggatgttcccgatttttggtttcatccatattatagatatacggctcacggacccacattcgattaaatggcgtcgtttcttttaaagggtcttccagcgagaggtctagaccggcgtgaatgagcaacagcttgtcaaactcaacagcagttggcatctcggcgatgaattgaatcagcggtgacatgtaggtcaacacggcttgttgtaggttgcttttgcgtgctttagctggcgcgtaatcttgcaccatttgacgtaaggtagccttgccgccattgatgaaccatggattatctttgtcggcgagataatccagcagcatctgatcatgattgccacggatcgcgattgcctgactcgcctgcacttgctcgcgaatttgagtgagcacccgcccgccgtatggatagccatcaatgtagtcacccaaatagacggtcaaagtatggggatactttgcttgcatcgcccgcactcgatccattgtttccagatgaccgtgaatatctgagaccacgatcatggtcataacgtttgcctccttataaaacgcatgctccagtcccaaaacctgcagatagggcttttggtcgcaatagtcagcgcttgactgtcacgcttaaaacgacttatatttcggttcctaacaggactgcgccgcgttttgcaaaaactgctgataggaccagtttactttatttttagaagaatgtgcgatattaataggggaataggggtgaaaagatggataaacgcttaatcgtcatgcataatctgagccgtcattatggcaaacaatactggtggcagcagcattcattggaagattggctgatgatgattctcattcagcgcaccagttcaaagaatgttgcccaagccgtgcataatttgcaaccttacatgcaggttgatcgcttgatggcgttatcgcaatcagagctggaaacgttggtgcggccagccggcttttatcggcaaaaagcgcagcggattcacgatctattgacgtggtttgtggcccaaggcggtagttttgagaagattgcagaaaaaccggcagctgagttacgtgaaactctgctggctctaaatggcattggcaatgaaacggcggatgtcatgctaatgtacacttttggcaaaaaaacttttgtagctgatacgtatgccatgcgtcttttcaaccggctcggttttggaccgtatacgaactatgccaaaatgcaggccgattttgcgccagcacttgatcaaatcacgttagacgaagctcgcgaatggcatgccttgattgacgaacatggtaaaacgcaagttcggcatgcgtatgacgaccggtttttactgcagccagatttgactgaggctgcatggccgccggaagcggttcaagtggagccgccccatgatgatccgggtagcggcaagtggcggcacgccgccgatccgtcagcgatgactcataaataaatgctttttgctcgtgagttgttttggaagtcttgtcacaagggagacctaaaaatgaatgctagcgttgctgtgcaagtgttaccgatgtatccagagaaacaaaaggtcttggcagtggttgatgcggtgatcgcctatatcaaatcaaccggaattaattatgaagtcagtgcttttgaaaccacaatggaaggcgattatgatcagctgatggcgattttgaaagaaattccgattgtcacagcgaaggcaggcggtactagtcaaatggtgtattcgaaaattaactattttcctgaagatactggcttgacgattgctgacaaagtgaacaagttcaagcattgaagaaaaaagatcacggcgattgtcgtgatctttttgcgtcttgaagcttatttttcgacagcttggagcttttgattgtcgtcgagttgtgagatacccattaagtgatgacgttgtaagagaatcattgtgccccacagcaacaggagcgagccgatcgtgaaggcgatcaataccatgaagccgagggtgacagtgctatcggcaatgccgccggtgagcgcgttccggaaattcataatggagtaggtcattggcaggaatggatgaatggcgttgtagaactgattggtgatctccatcgggaatgtcccgccggcaccacctaattgcagcatcaaccccaccatcgccacaaatcgaccaggattatcgaatgccattgagaggaacataatcagatacattgacgtaaaggagaagaggatcgcggtcagatagaacaagccgatgttgtcgaccttgagaccagtcgccatcatcagagttgcttcgagaactgcggtgccaagggcaacagctccgccaatggctactttgctcaggaaccactgagttgccgtaccatctgctctggaaactttgcgaattggataggcaaagttgaagaccaaggcgccaacgtaaagtgccagactcaaaacgtatggggcaagtgcatggccgtagtttggcacataagaataatgcttttgcgctgtcttggtgggtgcagcgaacatctttgccgtatcaccggttaacgtaatgccattgaccttacgggcgctgctggtaagtgtcttagcgaacttcttgtcgccgtcttcaagctgactggaaccagatttgagtgtgtcgctcttgtcattgatttgaccggttccgtcggcgagttgattgacaccggataccaatgtcggcacactagcgtttaattgattgacaccgccagcaacttggctggcaccattggttagctgaccgacaccattggtaagtgtcggaacttggccatttaaggtaccaagaccgccggatacttggctggaacccgtgtagagttggttgataccactggtgagagcaggaacttggttgtttaagctaccaaggcctcctgaaacttggttagaaccggcgtaaagttggttgacgccgctggtgagtacaggaacttgatggttcagggtgctaaggcctcctgaaacttgactagagccagtataaagctgatctacacctctaactagtgaaggtgtttgtgttgccatttgccctatgccgtcagtcagattgtttgcgccagttaccagttggtcattgtttgcaataatttgttttgaaccgctttgaaggccaataattgctgccgttaaagtcggaacttgttgattcaaagtcgttaaaccgtttgttagttcttccgaacccggaatcaagctttggttgagagtcgtggccattttggcgccattagtttgagtctgagaaatcaaagcgttgacgcttgcttgaatttgctcaaagcccgcaatcaattctgggttttgattgggttcggattttaacttagcttcatattcagtgagagtgttctgaagcttgggcaaggatgcggcagcttgctgattttgtgaatcaacggatttgcctacttgttgaagaccttgtgttacttgagatgaaccggttaccaatgcttttgttccattatctaaggaactggtactgctagcaagctgatcaatgccgttagagagtgtcgtcacgctttgcgtatagttcttgacaccagttgttagcttttttgaaccagtttgtaattgagccgtaccgtcaacaagtagtcctgcttggctctgcaatgtgtctaggccactggtgaccgcatcagatcccgttactaattggcctacgccggatttgagcggggcagtctgagactgcaaagacgctaaaccactagtaactttattggatcctgttgctaattgccctacaccagatttaagtgtgccagtctgcgattgcaaggttcccaaaccgctcgtaacttggccagatcccgccgcaagctgattaacgccacttgctaggtttgtcgtactgccattgagcgtttgcaacccacctgtgacttgattagcgccgcttgcgagcttaggtatttgtgaggacatcggtgcaactttaaccttcatcgtttgcacgccgtcatttacttgcgaaacggcgacggtgtactgatcaatgccatcgtcaagtttgacttggccagcatcaatttgggtagcggcgccggctgccgttttcatgccattaccgatagtcttaatttgatcaaaaaccgcgctggcataggcgttggtcacgttggcacgaatttcggagttgagactgtcaacgccgatgccggagatgacttggccaatatagttgagtgaatcatttgtctcgtacttcagcgtcattttcttaggatgctcgtctaagacggtggcggcatttttggaaaaatcctttggcagcgtaatgacagtgtagtatttgtctgccttcatgccttttttagcttctgcttcagaaacgaaatgccagccaagttgatgatttttcttaagcttggtcaaagtctgcgcaccaacatcaagctttttgccttgataggtgacaggttggtcaaggttgaccactgctactggcagattcttggtgtcaccgtaaggatcccagactgacttcaaaaagaagatacagtagagaaatgggattaaggtaatgacgagaactgagagcaaaatgagtttgtttttgccgatgaacttaaattcatctttgatcatgtcgagttactcctttacttcactgagatagagatccagcagggattcaaaagtcgtatcgcggctaggttggccatctggcaaaaagcccatgacttccagaacggtaaaaccgagcacgctgctgataaaattttggacgaaactttcttttgccatgtgtttgaactcggtatgggtgatcaagcgttttaataagccgatcacatcgccggttgcctgaacaaatggactgctttctggaaaatgatgcacaaagtaaataatttcatccaatgattgttgctgttcgaaatagcgatgcgtggtttgcgcaaaagtgcgaatggcgtctttgccagcaatgccactgacttgttcaatgagttcttgatgtaagttgtgcatgaactcagtccccagcgcctcaatcacggcatccaagttactaaaatagttgtatagcgactgggaacgaatattcaattccttagccagtgtctggaaggtgagctcacgaataccatcacgggtcaccatcacccgggcagcggcgagcactttttcacgatccaaaatacgatgcttgatagccatgcgacctccttgagttatctatattacgttagacgaatatacgccgatgatttgaagaatgcaacctacagattgtagattgtcaaaaaataggagtaaccagacgtgtggtgttgcatgtgcgtggctgttcagtggccgatcaccgatgtttttttgtcatcatgcgcagtctggagactagctggttgatctgcgtgcacgaaaaaaccgcacccaaatgttggatgcggctgatcatttaacggcggtttattgaatgacgtggcgattaggatcgcgcaaattgaggataaacacaagcaccatcacgatgaccaccatcacgaaaacaccgtgtaagccagtgagaatggtggcagctacctgaggatcgtggcttttggcggcagcattagcactaatcgcggcattgacagctttaaaagtgttaccgtgcaaattagcgcgaatcacgagcgtcaaagtggcaccatagataccggtcatcacagtttgcccgagcgaacggccaagagttaggatgctggtggcggaaccaacgtattctttgccaacaagatgctggctcaaaacggtattcatactgatcacaatgcccatcaccgttccgttaatcatggcaatgacataaaaagcccaaaccggaaaatgcggggaagcaatggtgagcaataagtaagctaaggtcagaatggcgacgagccaaagtgtcatggttcgcggcacaaagcgtttgattaatggaccgaccaaaaatgaagaggcgagccaaaggacagaactcgatgtcacaactaaaccagctgttgtcgcgccgagatgatacaacgactgaagccagatcgggaagtaaacttgatagccaatcaagacaccgctaagtaacaaggcagttaaaatttgcactgtgaacgtgaagttatgaaacattttcggcgcgatgagcggatcgggggctttctgttcttgatggtacaatagcaagccagccacaagtgccaacgccaacaaaacaccggcgagcaccggttgccgatcaagcgcctgaatgccaagtagaagtgcaatcagcgtcaccgccaaccaaagaattcctaaccaatcgatcgtgagaacgccgtgttcacgactaggttcccgataaccgatttgaataagcaaaaaaacgagaataccaagcggcacattaacgaaaaagacccaatgccaagacaattgatcaaccagaaaaccgccaattagcggtccgaccaaggcggaaagtccccaagctgtgttattaagggctaagacattcgcccgatgagcaaaatcataataatcagcaataatggtaaatgtcagcggcatcacggcgcctgcaccgataccttggagtgcccgcgccaaaatgagcaagaagatatgcggtgccaacccgcttaacagggtaccaagcgtgaacagtaccacgccccactgaaaaataccgcgcctgccaattgtgtcagctaatttaccataaatcggtgtggtaatagcggttgtgagcaagtaggcactcatgatccaactttgatatgccaatccatgcaggtcactaataatcgctggcaaagcagttgtgacaatggtaacttcaacggaagtcatgaatgtggcgataaaaaccgccgccatgacaagcccgcggttttgaggctttactgatgtggacatcttgacatctccttgataaatccattttaccagtcagggtcaaggctgcagcacaaaaaaacgcccggtaactaaccagacgcgtcgacgttctagtgacatagcaggcagctgcggtcaataccgatggcacttccatcaggaaaacaataataccagcagctgtcaattggccaatgattacaagtccaacacttccgatcaaagcgaagagtcgcaatcaccaatcaaactgtgacaatgacaaaacatctccgaatgttcaaactaaaagtcagtccaagaatctttgttggccggtgcatcatcaggtgaaacatacacgacgagttcatcactaaatcgtttgagacagtaagcggcggcgccaatcagcgtcacggccatgaccgtttttaaaagatgtttgcccataagtgacctccttagtttgccttgattaggaaccattcatcattaccttcattctagcacggtaatgttcaggatgagtccagtttagcagcgagcgttttcagaatagtttctcagtagggtgttgtgcacgctaaaatctggtacaaaccgattttttaaaatatttaaggcattttaagtgaatttaagtcaaagtaagtgattttttcggaatctgtgttatactgaggtcattaaaatcgaaagtaggtatgagcatggatacaaaagtaaagattgttgattactcatccaaggaatactttgacaagatgaccgcttattggcgggcagccaactatatttcagttggtcaactttatttgaaggacaacccgctgctggaacggccgctgaagagcgaagacgtcaagccgcatccgatcggccattggggcacgattgctgggcagaacttcatttatacccacttgaaccgggtgatcaataagtatgacttgaacatgttttatattgaaggcccgggtcatggcggccaagtgatggtttccaattcctatctagacggttcgtattcggagatttatccgcgtgtgtcgcaggataaagaaggcatgaagaacctatttacgcagttctcatggccaggtggcgttgcttcacatgcgagtgcacaaacgccaggttccatccatgaaggtggcgaattaggttatgctttgagtcacgcaaccggcgcgattcttgataatcctgaggtcatcgcggcggttgtcacgggtgatggtgaaactgaaaccggcccattggctgcatcatggttcagcaatacgttcattaacccaatcacggatggcgcgattttaccgattgtgcatatgaacgggtttaagatttccaacccaactatcttgtcacgtaagtcagatgaagatctagacaaatacttcagtggtatgggttggaagccattcttcgttgaaggcgatgatccagagaagctgaatccggaaatggctaaagttttggatgaagcaattgaagacattaaggccattcagaaacatgcacgtgagactggcgacaccacgatgccacactggccagtgattattttccggtcaccaaagggctggacaggcccgaagagttggaatggcgaaccaatcgaaggttccttccgtgcgcaccagattccgattcctgtcgacgctgaagacatggaacacgctgattccttggcaggctggctgaagtcctaccatccagaggaactgttcgatgaaaacggtaagttgatccctgaattggctgcattgccgccaaagggtgagcagcggatggctgctaacccaattacgaacggtgggattgatccgaagccgttggtattgccagattatcgcaagtatgcgctggacaataaggaacacggcaagcagattaagcaagacatgatcgtgtggtctgattatctgcgtgatttgatcaagctgaatccgcataatttccggatctttggccctgacgaaaccatgagtaaccggttgtatagcttgtttgaagtgaccaaccgtcaatggctggaaccaatcaaggaaccggctgaccaatatttggcaccggctggtcggattattgactcgcagttgtccgaacatcaggcggaaggctttaacgaaggctacacgttgaccggccgtcatggcttattcaccagttacgaagctttcctccgggtcgtcgattccatgctcactcagcacttcaagtggattcggaaggcacatgaagaaccatggcataaggcttatccaagtctgaacgtggtctcaacatcgacttccttccagcaggatcacaatgggtacacccatcaggacccaggtattttgacacacatggctgaaaagaaggctgaatacattcgcgagtatctaccagctgatgccaacagcttgctggccatttctccgaagttgttcagctcacaaaataccgtgaacgtgctcatcacatccaagcagccgcggccacagttctatagcattgatgaagccactgttttggctaattccggcttgaagcggattgattgggcttctaacgatgacggtgtcgaaccagatgttgtcattgccgctgccggaaccgaaccaaacatggaaagtcttgctgccattaacttgctgcacgacgccttcccagatttgaagattcgcttcattaacgtggttgacctgctgaagctgcgcagtccggaaatcgatccgcgcggtttgagtgatgctgaattcaacagctacttcaccaccgacaaaccgatcctcttcgcttatcatggctttgaagggctgattcgcgacatcttcttcactcgtccgaatcgcaatgtgctgattcacggctatcgtgaagaaggtgacattaccacaccatttgacatgcgggtactcaacgaacttgaccgttaccacttggccaaggatgttattcagcatgtgccagcctacgctgaaaaggctgccgcgtttgttcagaagatggatgataccttgcaatatcatcatgacttcatccgcgcaaacggcgatgatattccagaagttcaggaatggacctggaaaccaattaagtaacttcagttgtcttgcaaacacttctgcttgcgcaggggtgttttttttgtgccggactagcaagttggcgatggcgtggcgattcacgaaattcacatatttaaaaagtgggacgtgagactttgatgagtaacttctgctgctaaaaaggccacgaaaacaagtaatatctgcaaaatttctctttactttcttcatactctaatgtattctcaacgtaatatcattttgagggtgagtaaatgaaagttaaacgattggtagcaggggcaatggtatttgcctcagctgcactcttggccgcatgtggcagcaagagtagcagcagtagctcagaaacttttaatcgaatggaaaaagatgttatttccacaatggataatgcccacattacggatgttattagtgggcaagccgccgttgatactggtgatgggttgtatcggtataaaggcaagaaattggaacctgctgttgccactaaagtcgttaagccaacgaataacggccttacttatacattcaacttgcggaagacgaagtggagtaacggcgatcctgttactgccaaagatttcgtcttcgcgtggaagcgagcagcagatccgaaaactaagtcagaatatgcttatcttttctctggcattaagaacgcggatgacatcactgctggtaagaaggctgcttcaacccttggtgttaaagcagaaggcgattataagctggttgtgacgatggatcggccagtaccgtactttagcacgatgatggtcaatccggtcttcttcccattgaaccagaagacggttgataagtatggcaagaagttcggtacgcaaagcaagtacttggtcttcaatggcccgttcaagttgactaactggaacggcactggcaattcatgggatgaagtgaagaacacttcttactggaacgccaagcaagttaagctcgataagattcacgttcaagtggttaaggattccaacactgccgctaatttattcgctacgaagaaacttgacgatgcggttctgaccggtgaaattgctaagcagcatgccaaggacaaggattacgttggcgataagcaaggtcggactacttacttggatatgaacgaagaaaaggtacctgacttcaagaatctgaagttgcgtcaagctgttgcgatggctattaatcgtgatgagtttgcgaataaggttattggcgatggttctttcggaatctcaacgattacaccagaaaactctggcagtaatccaaagactggcgaagacttctctaaggaagccgctaaggaatctaagacagttcagacatacgatcttaagaaagctaagcaactttgggctgaaggcctgaaggaagtcggtaaatctggtgaagatgtgaccctgacgaccgatgacacagacgttgctaagaagtctgctgaatatctgcaatctgctttggaacaattgccaggcatgaaggtttccatctcttctgttccattcaagacccggatccaacggtcattagatggcagtgcccagttcattctctccggctggcaaggtgacttcccagatccaatttccttcttggatctttacacgactggcaacacttacaactttagtcactggtccaataaacaatatgatgatctgattaaggcttctaagggaacggatgctaacagcgaaaccaagcgatatgatgatcttctgaaggcacaggaactgctttctaaggaatcacctgttgcaacgctttatcaaactgttcaaggccatttgcgcaatcctaagctgaaaggtgctaccttcagcccagccaacatgtataactttgttggggcttatatggctaagtaatattatcaaaatcaaaaaacatctccattttgttcagttcaaggtaagttgactggcaatggggatgtttttttgttctgaataatgctgtgcagacagacaaaacatgtcttgggttggtaccgaggagggtagggatcgccagtcactttaaaataacaaaattatatttatgtatcattgacaatgatagtgagatccgtttataaatccaatgatgaaaaggaaataataatcgaaggttgtgaagagtctctaaaaataaaaaacgataaatgattgacgttttagtgaatgaaatgtacttttaaccatatccaatgcaatggcgttacatcaagggctttatcgctgccgattagaaacatggaaaaagtgtaggcttgtaaggaggctaacatcggtgtttagcaagcagtattggaagactagatcaacgatcgctgccttcttattggcgttgctgtttctcttagggcatctcttgggcaatcttggttatgaagttaatggtggtaagcaagtggcgggatacttctttttctcaccatacatgaactggctaccagtcgatatttcctcaaatttaccgattgcttggaacatggcagcaccgttgttgtcagtacttgctggtggtatgtttgccgctaaccaaggtcggaatgggtatgcaaggctgctccgaactcgccaaagttttttaacttaccggcgacgaacgtttcttgcggctggattttggggtgccatgttgccaattgttgttttggggctggactttcttggtctgcttgtcattcacccgaatgtattaccgagtcagtggcttaacaacaatgtcgcaataagttatttaggcttcggcggcgatcttttctatacgcatacttggctatacatgctcggttgggttttattggtggctctttatggtgcaagttatgccattttctctaactttctctatttcgtcacgaggaaaatggttgtggccttgctgggattgatgggactgcaactgttacttttgagcgtgagtctaatgtcgcaagtgagcttggcaccgattgcttatctgcaagttgtccccacgattgcccaaccatcaatcgcgtatgtcattttgtggccagtggctttaattggtattagtctattagcacttcgcgtacccacgatagaggcgtgagcaatgccaaaaagaatttgctttctaacagctcaatttgcccctcggtggcagcgagtagcctttcttttggcgacattgctggtgtcactttgttttacctctatagggctgacgaccgggcgattccagtcgggtttctttgatgcgaatcgatcgatgcagcgcctttttggtcaactggtcctttttctgcctatgacgggcatgatgtcggctgcgctcctacaactgttacaaaacaccagtgttctaataagaattgacgcccgggtcatgattgctcggcatattttgagggaactgatttttttgacagctgtcgtcactttttcagtctggggaatttggttcactgccgtcctgttatggtcaagggttggacaaagtggcaccgccgtcgtggctaatgtcaatttggtcatgaatgttgcaacagcactctttacttatacgacgctgacactgataggatgtcttttatttaggtcgcgagcaattggcattttctgtgggttgagtttggtgattgtttttcaggcggcacctgttttcaatctgagtgaaatcgcgactctgatcacacccaaattagccgtaaacgctatgtggccaatcagtgttgttaaacagtttttgatgatgatttttgtgacgggcttgatggtgttaactttgaggcgtattcgcttaccggtagaggtgtgagtggcatgcaaaaacgatggcaagtacgaccgcaaaaacaaagagtcatcattgtgacactgctgtttgtcgggcttctcatggggtcagtggcattgtattttgaagatcgcacaaatgggttgcttcgccaggttcacgacccagtcatgatgatctttatcggtgcatcccccgaacgttttgccattagtcaattactgtggctgctcctttggtttggctacatgttgttaccgatttttgctagtgctggtagcacgcatacttatcagcagggactatatccttatttgaatttacgatttcgcccgcgagtcttaacttatctgtggccattgaagcaaacctggatgattgaagcgggagttttgctgttcatgggtgttggggttggattagcctcttttttgttctggcaagagcaacagctttttaatgccggcttgtttaccagcttgattgtgatgagtcaactgttgttactggtcatggaaacggttcttgaaggttattttggcatcgtcatcggtgtcgtcggccccttggtcatagttttcctgagttttcttcaaatgccattgatgccgttgcgctttgcgattggcagtacctttgcgagcgatcagcagttattaggcgccatcgggtaccagttgggtttgatcattggattagtccttattcagattttttatatgccgggaaggtgggggcgttatgccgcaaatcatacatgagccagcagttcatttagaagttgagcagttgtctgtcacaattaaacgaaaaaagattctcgatcatctgtcactttcactggtgtcaccaaacatttacggcattgtcggcccaaatggaacgggtaaatcggttttgttaaaaacattgttgggatttattcgaccatctgctggtagtgtcaagatgaatggcgtacgggttgacccgcgtcatgatctaccagtcagcgttggtgcgattattgagcatccaggatttattggtgatctgaacgggcacgacaatttaatggcattaggcaacattcgcagtcaacttagtgacgccgatatacggacgattatggaaaaggtcggcttaagcgatgataggaaagccgttgccgattattcacttggcatgattcagcgacttggcattgctcaagccatcatggaagatcagcaattaatcttgcttgatgaaccgactaatgcgttggatcgtgaaggggtggattttttgaccgatttattaagagagcttcgtgatcaaggcaaattggtcgtggtagctagccacgatttcatgtggctgcagcttttagccgatcagatttttgaattgacaggcgggcaacttaataagctggaagctgggcaaccactatgaaaaagttgcatcgacgtctcttggctgttgggcttttggcaatgattatgattttcgtagcattgtttagttggcgttatcaaacactcaacgcgccattggcccacccagcagtgaagacgcgtagcctaagtctgcctgcaaaagttgtgttacatcgaacgacggtttcacttgaaaaagtggaagcaactatcgtacacggtcagtggcgtgtccggcttcattttagacaatcgatcactaaacagaatatgaaacatatgaaatttcaactggcccaacagcgggaggggcgggaagtaccaaacgaaccacaagccgacttgagtcaagatcagaaagtgatcacaatgatggatgcgtactatagtcgggcgaccgacaatcgggttgtgatcacgaccttgccacaagcgctaaactcgcagaatctggttcagatcgtgccatttgagccatcgagaaaataaggcgcaggcatgtggtgtgagtcacgtttaactgaaaagaggttgatgatgttggtgcaagaaccgaatgatttacgctttcaagtgcatccgcaggctaaattcgatgtccgggcggcggtgttgttggtgcatgcaggccaacttttagcgacagttaactcggcaagcggtatcgcccttgtgccaggcggtgcagttaaatttggtgaaacggcggcagaagcggctgctcgggaaattcatgaagagctaaagctgaacgtggtgccgcaactggtggggatcgtggaatcgttttggcaacaacctgaacgaacttaccaacaactcatcatggtacatcgggtgacgttgactgatgcacaaaaggctggcttggtttggcaggaaggtttggagggtgagtggctgccgtttgcaaaggcagctagggtgttgcagccacgatcactggcacagtttttaacgtccggcgatgcaattcgccactttgtcgaccatcatacagaatgacgcctaggttgacgctggtagagaggtaaggctattgatactcggatcaacagaagcgcctaattataaatagtataattaaagcggattactttgcctttcatcgttttcattgatacgcttaaggtaggctaaaggccggaagggagttacatcatgatggatatgacgactagaccgacactgcagcactttttatctgacacgaaacatggaccgtatgtttcgctttatatgtcttggccagagaacacctcggttgaggccctgaggttgcggttcaaaaacatggtgaagcataccaagagcgtcatgaccgagacttatcctgaaacggacttttcggcatacgcggctgaacttgagccatatgagcaagatccaacattctggcaaacctgcgaaacaaatgggtttggcatgttgacaaatggcgcacagacttatgtgacaccgatgtatgaagcggttgatgaagtggcaatggttactgacatgccgcagattctgccactgatgctggatgaggcaacggcaaccgactttgatatcttagcgttaaatgccgacagcattcagctgtatcataaccacggacatcaggtgcggccgacatcgttgccagacgatgcaccgcagactttgaagggaacgctaggcaccgaaattcgcggtggcgaaatgaacagcgtgtcccaaggtggcggacgtgtgacccatcacgggcataatgagaagtcagcggaaaaagccagcgatcagcgccgtttttatcaagcggtggatcagtatgtgctggcgaatcactccaatccacataaaatgccgctcgtactcatgggcttagcggaaaacgtggcggtattccgcgaaatttccaagaaccatcatctgttaccgaagctggctgtcgttaagagcccagcaaaccttgattttgttgaattagacgacttgttgacgccagtacgcgaaactttgcgcgatcgccggcgccagaactttgccgagatcatcgaaaatgctcgcggaaatgacagctacacggatcacttggaagaagtcgttcaagcagccgttgccggacgaatcgccattctttttgtccaagccggcgcacggattcatgcgcgtcttgaaggcacccaaattgaacgcgattcgatcaatgcacagcacgctaatcttttaaatgacttagctgacatcgtccttagtcatggcggacaagttgaactgctgacagaagcctacttgccagtcgaagtcggtgcgatggtgcgttacgcatagtggcagttgattattaaaaaacgagttgcctgttgcctggcaactcgttttttgggctctacgccaactggtgttgaagaataaatttatcatttgaggcggttctccatttggggagccgtctttgtcatgttatgccgtgatttggtagattcgtttgaagaagttcagctgattcttgaagccaaaacaggatcgtttgagtgacttgatgaggcggttaaccccttcgatcggaccgttggaataagggctggtgacagcggcgagaacagcgattttgtgtcgcttaagcgtcgcgatcgtcatgtccattgccgtaccgtttggctcgtaagtagctaacaggtttgccagttccgcgggatgtttcttcaccatcaaagcatcatgaagcgctaagtaggtctcgtaggtttgcttgagcttgggctcagtatcaagtgcgatatcgatggcctcctgttgcgtgaggtattcattcaaaccaaacaggaactgtttgtgtttagcgtcaggcgcagtttgatgaaaaagccgccagtttgtcttcatgatcttataaggacggatgtgtttgtcatcaagctgtttgagcgcttggacgcgtacctgatcaagggtacgagccgcaagttgaatgatatggaaccgatcaatgacgacttgggccttggggaaaacctcatgaataatcgtctgataagctgcattcatgtccatggtgaccgtctggacccgagtgcgttcagcgagtgaataatgagcgatgaagaagtttttaatcgtgcggttgaatcgatcaccaagcaaggcaatcagacgatgtgaatcggcattaagacagataaacgacatcatgccatgagtggaacggaactcatcaaagcagagtcgcgtgggtagccggcgagccggtcggagtttgagattttggtcaatgatccgttgaaccgaggaagctgagatcccgataatacgggcgatggttttgactggcaaccgttcatgcgctaactt

SEQ ID NO: 87 - DNA, 1100 bp, Lactobacillus paracasei
aaactggatccgtacaaaaagcaaatcaatgaaaagttagatatttcgtgctctgccatggcaatttacaaattcatcgtcaaacatggcttcactggcaagtattcaatcgttcgagactactgtgccaaatataaggatcatcaagtacataaagcgacgattcgagttgaacatactgcaggtctttcagcacaagttgactggaaagaagaaatgacactgtacaaccgtgatggcaaacccttcacattcaatatcttcttgtatgttcttccatattctaagttgaagtacaccacattaatctttgaacgtagccaggatacgctgtttagttgtctagatgacgccttctaccacaccggtggtgtgccaaaggaaatctggttcgataatatgaaacaagtcgttgatcacgcaaaatccgacatcggtaagcgcgtggtattgaatgaacggttcaagcaattcagccaagatgcgggctatcagccaatcgtttgtcgcgtatttagaccgcagaccaaaggcgtggttgaagctttagctcgcacgactgagcgattgcgagtctacaactacgagttcgacgacgaagtcgacttgatcgagattgtggacgaattgtgtgacgacctcaatcacgaagtctcacaagccaccaatcagatcccaactgataagtgggagtacgaagaaaaagagtacctgcatgaattgccagataatcttctcgatccatattttgaagaagacattacccgtgtcgtctccaaagaatcgatggtgattttccgcaaatgcaagtactccgtagatccgcgctacattggtcgcaccgttggcatcgagttgaccagtgatgagcagcatatccaaatctattataacggagagatgattcgcgcgcacgatattacgactcgccaattcaattacaatcctgaggatcgtgttgagattcttggctctgaccttctaaaaggccgaagtaccaaggatatcaaggcctatatcaaagagcatttaagcgattacgatgaagtgtgaggcgtaaatcatgacaaaatttcaagaactactgactaatttagaca

SEQ ID NO: 88 - DNA, 43067 bp, Lactobacillus paracasei
  misc_feature (38222)..(38266): n is a, c, g, or t
atgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggcaagtcaatctacagcctgatctatccgggcgagagcctgtacatcaggtaacaaaaaagtcctctgctcgctaacgcgggtggagggcttatttttgttgctttgaagcacgggcataatgctgtaaaataagatacgtaagcaactaaatattttagtcagcctgtaataccttgtcgttctgcctcccttgctcagggaggcttatttttgtgcacagagttgacagaatcgactcaaaaaggcaaaaggtttacatatgccggattaggtaacttactatgagcaaattgtttgcatacccagcatagccatgcgatactgacggtgaaggagcaaaactccaatagctaggagtaaaaagctccttaggagttggcaagctaagctgctacccaccccaagaataatcgcgcatacggactgtatactgttaggaacctgcccccctcggcgggtcttccagataaaagcaattccttgccaactccgccccatcctatatggatggggtttgcgttttgattgcttttgtgcgctaaattatcagccacagcaaggccgttgaaacacgatttaataacttgcttctggatgcttctagatttgtcagtcaaaggggacaaaaaggggacaaggatacctcaaatgttgatacatagctatcagttatgcccggtggaggcattctttaaagaacgtcccgacacaaaaaatcgttgcaagcatgctcgttgcaacgattttttggtgtctcattatttctctgcagccgtcaatgcctgcgccagatcatcaatcaaatcctgctgatcttccaacccaatcgcaattcggacatgttgcggtgtcaggcctgaggtggaccgttttttttcgggcagtttgaaccatggtaacttgactaaactggagacggtgccgagggagtcggcgaagtcgaagaccttggtgctgttgacgaacttaatggggtcaatgttgtcggctagtttgatggataggagaccgctggcaccggtggtttcttgttgggctaaggcatagccggggtcgcttttgagaccaggataataaacatgcgcgacgtcgggatgttgttcaagaaattcagcaaccgtctgggcattgctggtttctcgatccagccggacagcgagcgtggcgatgccgcgacagacaagactacagtcgagcggtgcaagaatcgcgccgatggtattttgcaagaagccaatcttttcactgatttccggactggctgagaccactaagccagcgatgaggtcgccgtggccgccgatgtatttcgtggcgctatgcaggacgatgtcggcaccgagatcaagtggccgttgataataaggggtgaggaacgtgttatcgacaatcgtgagcaggtcgtgggctttggcaagagcgctaatagccttgacgctgctgactttgagcagtggattggagaacgtctcgaagaaaatcgctttggtctcaggccgaatggctgcttcaactgccgttagatcgcgcgggtcaaccggtgtgaaggtcaggccatgttgagcaaaatactgattgagcaaccgatctgttccgctgtatagtgaatcaccgataataaagtggctgccatccgggaaaatcgcgagaaccgtcgcaatcgctgcaaccccgctggaaaaggcaaaccctgcatcgccattctcgagagtagcgatttgacgttcaagatagtcgcgggttggattgctgctgcgggcatagtcccaatcgctagtgccaccatcaggcgcaaagcggtacatggcgctttgataaactggcggtacgaccgcaccagctttatccgtttgcaattgtggaccatgaactagtttggtattgaattgggtcatatgcccgacctcctcatatgattggttgacaacttatgtcgcgtcacggcctacatatagtcgcgacttttagccaatagttaatgggtaacgcaaagcgattatttagtggttaaatcagcgccaaagtatttctcagacaatttctttaaagtgccatcgcttctaagctcctgaatgcccttggataaggctttctgcaagttaggcgatttcttactgatcattccagccacttcgtcaggcttcacatcgctatctttaagtgtctggctctttaaaccggttgtggaattgctcttagcgtaggcataccaggcggcggtggcgttgatggtgccatctgcgcgattttccttaaccagattgagcgaaacagtgaagtcgccagaaggtgtaatgttggcaccgtattttttagctagggcagcatttggggtgccagtgccttcaacaaaagtcttgcctttgatgtcgtttaaacccttaatcgaggtttcatcgctgcgagtgatcaaagcatatcgggagtacatgtacggtgtggtgaagttgtaaactttcttacgctggggtgtttcactgatgttattgagcacgaggtcgaacttttgacttccaaggccagcgatcagggaatcccattgggtaggaacaaacttggctttgacgccgactttcttggctagagccttgccaagatcgacttcgaagccttgcagcttgccatctttgcgataagagaagggcgcataagtgccttcgaggccgatggtcaactcatttttattgataagttcgctcgtgaccgtgcttgttttactgctgtcagctttactgctagagcaagctgtcaaaacgaacgcggaaagggcaacaattggtaataagacccacaactttttctttaacattagaatcttccttccataatggtgtttttagttacagctgcgttgtctgcacattgctggtatagcgtgacgtgactttttcaagatagcgctgtccccaagttaagacggtgcagacaacggcataaagcaaagcgaccagtgaatacatcaataatggctgatagttctcagcagcgatctgctgactcacctgaaacatttcgacgatagtgatcgaagccgccagtgaggtgtccttgacgagactgataaaactgtttgatagtggcgggacggccgtgcgtagtgcttgcggaatgataatttcacgcagaaccaagcgccgcggcaagccgactgagtaggcagcctcccattgaccgtgatcaatcgacagcagcgccgctcgaattgtttcagcacaataagcccccgtgttcaacgaaaaggtgatgataccggcaaccactggatcgagtttgataccgtgaggaaaaatgcccggaatgatcagacttggtagtccaaagaagacaatgaacaactgcaccagcaacggggttgaacggaaaagccaaacataaaatgaagcgaagccttttgcaaaggtgatccaaaagccttttcgtaccgagatgcgcgtcagtgccgtgatcaatgcaatgatgaggccaatcgcgaatgaaactagcgcgattgggatcgtgtatttgattcccgccgccgccatttgtggaacggcatcggcaacaattttccacatactttttcctccttgaatcgactcacacaggcggtgataagttgattgaactgggttgcgcgggtccctgatcgtgctaggaaatgcgatcacaggcgtagaaacctgcgcataaacgtgcctgtgatcgctctacaaaaaaatccgcccaagtctattgtgacaatagacaaggacggattttccgcgttaccaccttgattaaccgatcgaaatcgattctctctaagtacttcgcaagtttgcgttataccctgactcagtaacgggagtgcccgtcagttgcttgcaagatgtgttcgcaactgaatgcttcaaaagaccatcttcgccagtgcccgatcattgtctttcaccaaatgacaactcgctgcggaccttcgactggttactcatcttttcgcctgtgtgatattgacatcacattaggctaaaaaacgattgttgtcaatagtgagtgtagaaggtttctaaccgcgcctgcttacgctcttttaaacgcgtgcacaggcgcagaaacctgcacataaggacctcaagcacaatgacaaagtacggtcatcgcacttgaggccacttatgctccggtttctaaccgcgcctgcttacgctctccgcctaaagtccagtgactttccaaaataagtgcggtatatttaacgcggagtgaataattgaaacgctttaaggcttcaaggagggtaatatgaaaaaagcatgggtttacgggttagctgccatgcttggcttgggtgtatcagcggtgattgctaatcaggcatcagcttccgcagcaacagtgccgattgtgattcaatcagcgacatcgaaatgcgacactggttctgcgccggatcatggagcatcaaaatcagcgatcgtaccaccgcttgctgacaacaaggttgaagtaccaattgtcacggtttcaagcgatgatgatcaaaaggcgggcaataccggcagcgcggatagttcatcggtttcatctagtcagcaaaatggggcagcaacatcggacacaggtgcggaaactgtgggcagtcaagcacctgtcacaaacgggaatgttacatcgtcagcaaccgcgcagcaagatgatcgtgatgcacacccgtcagtttctgaaccaatgattaaaacggcacaagaagttaatgcgacagaagcaagctcgtctaaagcaccgacgagtaaagagcgggatgaacaggcaattgttgctgcagcgcaagcggcaacacatgataatgtgaaatcaggccgcacaatatctgtggtcccggagagtgtgacttcttttatcggttcaaccaataagcagccgcagaatgcttttgagattatttggcaggcgttgattgagactgttcagatgcgacagcaatgcccaacaaatctgattcaaaatttagtgctggggatgccgcagccgaattttgactttgtgcaatcgacatttatcgcaacgaaaagggaactcagcaaggcgttttcttcgcctgtttttgggaagtcccttcaactagatagcctgtcgccgttcaatcaggtttttggcaagatgatcaacttgatcgatcaagtgttgttgacacatcttgttttcccagattaacttacttaaatagttccgtgatggtgaatgaaaggcgactaaatttgtcaacgggttcttcttagtcagaggggagcccgttttttgatggcactgacacgttttttgaatggccccaaaacttgatgaccgtaaaaaaagcctatctcttcagtattcgttacaaacacgaagaggcatagacttttccgaaataacagctgatcaagcggtatgcgcgattgtcaggcatttccggcttttgggttgatcggctattgttttggtcacttttaattttcttcggcacctaatttggcgacagcaacggcttttcgaactttgaccgcgtgtgccacgaggccgacagccagaccaacaccagccggaactaaccagccaaggcccatgccagcaaacggcaggaaatgtaattggaaactgtgcaatgccagaccaagcgcactttgactgacaaaggctggaaaggcagcaaacatgtcgagaacggctgggactgcggtgaagccgacaacgaaccgatacaccagtggatcatgatggaatgccttgccgaaaacggaaaggagaatcaataccattgagaaaggatagaggaacatcagcatcgggacagaccaagcgatgatttgctccaaaccaaagttcgccgttaagaaggatagaaaactggtcagtgccaaccagacacgataactgacctttggaaaatgacgatggaaatcttgtgcaaatgcagcaaccaagccaactgcagtggtgagacaggtcaacgtcaacaatgttgccagaaccgcatgaccagcagcgccgaagtaataggttacaacttggttaaaagcagtcccaccttcagggctaagtttgaagtgagccaatgacatgctgccgagcaggattaaggcaacatagatcagaccaatccagctagttgccatcacgccggcttttgcagtcgacttggccacatcgtcatcattttttaagccgagaccgcgaactgctgtgaccacggtaacgccaaaggctaaggcagccaaagcatccattgtgttgtacccttgtaggaaaccattcatgaagctggcatttttataagctgctgtgacagtttgggttgctggatttcccattggatgggagaaaccaataaagaagacgaagaatagcaagacaaggaaaactggattgagaattttgccaacagccgttgtgattttgcgttccttgtaggataggaaaaaggcggcggcaaagaataaggccgagaagaccagcagaccaacctgtgcccacgcttttggcagcatcggcaagacgccggttgtaaaggacacggttgcggtccgcggtgtaccgaacatcgggccaatggtagcgtgaattaaaaccatgaaagcaagagcgaaaaagcggccaagtggacgaccaatatcatacacaccttctgcatgcgtagcggcaatcgccaacacaccgagcagcggcaatgcaaccgctgtgactaagaagccaagcattgctggaaaccagttggcaccagcgagttgaccgaggtgcaatgggaaaattaaattgccagcgccgaagaagagaccgaacaaaagtgatgcaatgacgacataatcgcgtgttttgagcttcttttcagataattccatttgagttcctccagtgtttttagatgtatcattgattcattaatttggcagctaatgtggctaatgtcagattccaattgcatcacatccttcaatggtttgagttacatgtttgctaggcgaaaattcaagcttggggaagcgcttctgctcgcgctccgctataacgcgttcgtcagcccagaaacctgcggccaaggcccttacactccggtttctaaccgggttgactcacgctcacacaaaaaagtcgcccttagatttttctaagggcgactttgcgcggtaccaccttaattcaccaaagccagctgcgccttggtcttcatcgcatacggtccaatgacgatatgctagcactgtaatgggtgcccccatgacacgttactgaagttcggtgtcctgcttgaaagggatattcgccatatcatgaatgcttcctcacaccaaccgaagctcgctgtattcacagacacgggtacttgtctttcgcgttgcatttatatttgatttttagtttagcatggattgttttcttgtcaataactaattgaaatttaatcaaaaaaagcttttgtccgatttgcgtaaaaaatggcacaagaagttttcttcacaatgttgaagctgattgaataaataaacttatttgataaatcaatattagctgaaacttgcaagcctatcgagttaattatattgatcattattgggtcagttaacgagtttttaagaaaaatgattttttaattttaaatatgacttgaatggaaagcgcagagtgattaaagcaaaaatgtgaaaccgctaacaatcactatataaataactaagtaaattacaagtgctaatgtggtgcataaagagctatttatatgccataatactatcagtaggagaaaattgaagccgagtcatgtacaaaacccgatattaaagggatctgtgccagctctaattcattgattcttctcgctcaatcctgtattatgagtagtatagagagagataaatgaatttcaataacgatatggaggcaaaaagtgatgaaaaaagttaactatattgcagccggaatttccgcattaacaattgctggactcctgttgccaactggccaagttttcgctgctgatattaacaaaacatctgcggccgagattaacattacccctggagaaatcattctagacaaggtcccagacttgaactttgacaagattccaattgctgacttgctggcgggcaacgtagacaagccgctggttgataatacggttggcaacggaccagtgaagaatgcaacggaagccaaggatggtaacgccactggcgacctgagtatcattgataatcgcggtacgaacgctggttggacgttgtctgcacagctaggtcagatgaaaaatgatacaggcaagacactaagcggctcattgacgcttaaaggtgcaagtcttacgacagataaccctgattatgatcaggcacttaatcctactgttgcgcaaactctgaatatcggtggtgacgcagttccgatctggaatgctgcagccgggactagtacaacagacggtcaaggacaaggtaaaaacaacgcgttgattaaggatgcaagtacaatcctgcatcttaccaagaacgctgctgtcacagctggcaaataccaagcggccatcacctggactttagccgacgcacctaagtaatctatggcacctaaactaaggggcagcggtcattcgctgcccttttcatgactgtgggggcggaaccatgaaaaagaaaatcattttcagcctgttggcaattctgagcttgttgtggttcggcggtgcccatcaggttcaggcagctgaaggcgctggctgtactatcagcccggcgttgccgcaaaatcaaattgatcaatcaacctattttaatttgctggtaaaacccggcgagacccagcggctgttgatttatgttaagaacacaacaaaaagtgctaaaaagttgaaggtcagtgcggtcagtgcgttcactcaaagtaatggtacgttaggctattacccaaataaacacacagacaagtccgctgagtacactttttccgggctgacggaagcgcctaaaacaattgatgttggtgctgaggcacaagtgccagtcacgtttgatgtgaagattcctgaaaagggtttcaccggtcaaattctcggcagtttatacgttgaagatcccacggtgcataaaagcggcggcagtggcatggcgattaacaacaagttcgccatgcttgtcggagttgttttgcagacttcggaggccaaggtggcaccagaattgaagctgatggatgtcaaaccgggcactcaggataatcaggccagcgtcttagccaccattcagaatatcaaacctcgtttatttggtgagatgacacttgatggcaaagtttatcggcaaggctcaaaagatccttacctgacacgttcggaaaaagggtggtcatttgcgccaaactcgcattttgactacgccattttctccaaagaggcactggcaccgggcacctatacgcttgatttaacagtcaaaggtgctgacaaaacttggcattggcgccggaactttacgattacgcagcagcaggcggatgtcattgaagaaaaactgggacgtgccccacaaaccccttggctgtggattatcattgcgatcatactggcgcttgtgatcttgatcctgctgtggttaatttggcgccaacgacgcaaaaggagggagaccgatgagacgaaacaagcctagtttttggatcatgctgctcatgacaatgaatctcatggtcggcgttggcgcgaaggcgcagcaagttcaggcagacacttctgttgcacaagttgaacttgttggtgaacttccgtcaacgaaccctgatcctaacccaacgccaacccctgatccgacaccaacgccagaaccggttgatcatcaaaccactgatcagcatggtcaagccacgccgctaacccatacaggctatctgccgcaaactggcaatgctgttcaactttggtacgtggtcattggggttgaacttctgattattgtcattttaggcatcgtgttactacgcggccgatcacggcagggaggtaaaaaatgaaaaagaaaacctttatcatgatttgcctcacggtgatcttcggcatggtgcttggtccgctgcagtcagtggctgcagcggaggcaacttggccgagtgggatttatccgccacctgcaacaggaagttttacaagtcttaatggtgtttttgacagagtctcgacagattctagtatgattatgaacggcgctgatgaagtgggaattgaattgaatcctgatgccaccaatcaagctggttcaatgtggagcaaaaatccgatcgttgatttgacgaaaagctttaagcttgaaatgcccatgttctttggtaacaacatgatcagtggcgcagacggaatgacctttgccttagcaggaacacgaccatctgcaaagggaaacagcggtccatctcttggagcgtggggcggacaaggcggcacgggcttgaaacccgaaagtattgcggcacaaggcttacaaaacagttttgtggtcgcaattgacacgcataaggatgatatggatcaaaatgcggactatccaggattaaacccaaatcaacaatatattggttctggttatcctggtcaagccagcatgtacgccattggatttcccttgtataaaacacagttgaagttcacacccacaactcaagaacctttgcaaaagttttctgataatatcaaggacaatgtctctaataatctttggcataacttaacagtttcgtggacttccagtccaacaggcggaacacttaattatcagttaacgtatagatctggtagtgggagcaagacgaccccttcccggtccatcacttggacgaaagatcaaattaagcaaatttttggaaccgataaagtttatctaggattcactagtgggacaaattctggtttggtgcttaaatataaggagccacatgttttaggaatcaagagtcttgctgatttcaacacggtaaagggcacagttactttaaagcgtggcaatgacaacgtgaccgaaacaacgcgattaaatatcggtgataagctcacttatgattatgcattagacattaacaatctcgatggtcggccatggcctgccacaaagattgtcctaccaaagggagaacatcttgaatacctgaaggaagatggaactgcagccaaagctggtgatacgttgaagattcaggctatgattggttcaacgactcaaacggtggatgcagttgtacaaagtgataatctttcggcagttattagcagtgataaactggtgttgccaaaaaacaccgattcaattgttaagtttagtttgccagctcaagtagcttctcacgaccttgtatctgatcaagcggtgacggatggcgcaggaacgctcactggtggaacaccagtcaaggattacaaactgattaatgccgttgatcaaacaaataatgttaagtatgtcattgccgcgaatccaggcgaactaactttagagaaggttccgggattttactttgaaaaacttggagtcagcggtttagaggatccaacagttgccgacgtgatcaatggtatccctggacaaaatccatttcccgcaacttcagccggaatagatcccacccaatggctgaatacactggggcggaagacgccagcaggctatgatggattcataagtgtcaaagactcacggccaaccaaaccggggtggactttaagcatgaaattatcaccgttcacaagaacagaaggcggttatgttctcggtgataacgggaatacggatggcggcaaggcccaaatagtgctcatagacaccaatcctcaagcacagctcaaagttgccagcataaaagacaatggtaacgatactgtcgtcaaaagtatgccagctggtaatagcgactgggatctaaaggacgactcatcaaccgcaccgatcacacaagcattgatgtcaattgaaaaaacgccttctgtacatgcgggcaagtacagttccactgcaacatggacgttagcaaacgccccgcagtaatagcgaaataagtcaaaaaattcaagatctccttgaaatgaagtaaccatgagaatatgatgtgcttatctcttagattaaaggcaagtcagtcatgagcacagacaaaggggtcttaggatgaagaagaatcggatggtttcgcacacactcatcaccatggcggtagcggttttggccgtgatttccgagatgccaattcatgttttgatcgccggattcagtagattaggttaataccatcaacagttgtcagttgactgtttaatgagctatacaaggaagtcgcttcttttcggagaagcggctttttgatttgcccagaataaagttgcgagtgtgaagatcgtccaagtagcaaagcaaaggaaaattgcttgccatggtcaatctttcgtggccagatcaaatgtttcagtgcaaactagaagttttataagcctgaaaaactgtaaaaaagtagcatactatcctaaaacgcccatgaggtcaaaaaatcatattattaattcaaattattgattaaaggctgataatacgggacttgcaatcgtgatttataagtttaataaatggccatttttgagatggaaccaccgtttgaaaatttattatcactgtgtaaataacgagtaattattaatttggatcatctgttatgttggaacacatagcatatctaatgaaacggaaacgagagaaataacgttgaatacgtttacttaatagataattatggttatatgtggactgtatagttgatatataaaaaatattcgtatactattagtattgtaataaggacttaaaacatatttaaaaaacaggaggataaaataatgaaaagagttaactacatgtctgctggtttaatagcaatgacacttgcaggggttatgctgccaatcacaagtgtctttgccgcagacgaaccaatcaagaaaacctctgttggtgaagttcgagttggggttgatccagataatcctgatcctaacaatccggacaatcctgatgggtctaaggatattttgtcattggtcaaggtgccagatctgaagttcaagagtgtcagtgttgagcaactggcaactgggcagcaaacattgccgctcacaagcaacacagttactgacaaaccggttaagaacgaaccagcaggaaatgccagcgatgggaataatcaaggtttgttaaatatcactgattatcgcggcaccggtgccggttggaagttggaagctcaggcgggcgaactcaagaatgcggctggacaaaaactggctggtagtcttttgctagctggggttgcgaaaaccgacgagactgataataatccaactgctattagtcaggctgagttggtcttggaaggcagcggggtgcaggtatggaatgccgcaagtggtcaaggccaaggccgcaacacaggtgtctatacttcggcagataccgtgttgaagctatcgcaaaatacagcggcatacggcggcaagtatcaaacggctatcacttggacgctgaccaacgcaccagcttaatggatcgtatatcaccagaaagggggcagcgatcgcacgctgacccctttttgaagaaacgcgctttgaatcgactacgggtgctgcgctgctactgggttgatcagatgaagttttcggaatggcaaatgtggggaaaagggggagaccgatgacacgaagtatatggcgctttttgatcagtttgatcattgtgttcggcgtcctcggtgaagggatcatggccgctcaccaagtgcgagcggcgacctccatcggtgaagtcgtcgtgattgacgatcggccaaaacccgacaaggatcataatgcaccaggaacagaagtatcaaaaccaaaggaagagccttcggtaccgccacgccaacaggttgatcgtttgccacagaccagcgaaggcggacaaacctggtattcgctgatcggttttgcactcctgatgatgagcagtttgcgtcttcaactgcggtttaaacgaaaagacaggggggacgatgatgaaaatcgtgactaatttcgccatcgcttttgtcaccctgatgcttgcaagtttcgtcgggccgcaccagtcggttatggccgcagatgatctaggcccaaaaaagtccagtgctcaattgacggttgatgctggcaatatcatgattcagcaggtgccggatttgaattttggtggcatttctgttcatgaaatcgtgagtgggtcctttcagcggcatccgttgaaaagcaatctggtgaatccgggaccgattaagacggcaacgaatgccaatgacggtaatgcgactggactattacaaattgccgattatcggggcaccggggctgggtggcggcttgaagcaaaaatggacgcgctgacggatggcaaagggcatttcttggcggggtatgttgatttggttgggtcacagcttaccgcgagcaatcccgatatcaacccgattaatcctgccggcagcaatgtgccgcggctgaattttgccaaagacaacacctctgtgagttcaaccgttgtttggcaggccgatgctgaggcgggtactaagtcaggacaaggacaaggcaataaccagaccacaattggtaccggaacggcattgacgttagttgcaacgaacaccaacgtcactattgccaaaggcaggtatcaaggcgctattacttggaccctgagcaatgcaccaaaaggttaagccatgggaaggattaacttttggaggagccagaagtgagatgggtggacgtggttgcttgctgaggtttgtagcaaaaaaatacggtgcaattgaacttcaagtgcgatggcacctgcaaccggactacttgcgaaaggaggcgttctgatgaaaaaacgatgctatctgctagcttgtctcggcatgctgttgtgtaccctgctggcgcctgtgacgagtgttggcgcggccgtcacgtggccgacgacttccggctatccagcaccgccgtcatttggtgacgtggacggcctcttttcaccaacgatgggtgactcaagtttattgacggatccgaccagcggacatgcagtcgggcttgagattaacaaggatcaagcaaatcggtcaggagcaatttggagtaaggcgccgatgtttgatttggataaagatagttcgtatacgatgtacttttatttaggcaataagacagttactggtgaggggatggcatttgtccttgctgctaaaccagctgcgccgacacgggttgatcctggttcactgggtgtttggggagttgatcgtcttcctcctaatagtactgccaagcaaattgccgacacagcgctgcctaacagttttgcaatggttgtggataccataaaaaatggtggggacgcggctggtggttatgatcaatatagtgcctacctcgattattactttggtagcgggtatccggcacaaacggccatgtatcgcatttcaaatccacactggatgtcgtggttgtattttaatggtgatccgccatttggagggtttcaaacaggtttaggcttgcaaaatacactttcaaaaacggcggctaacggtaaatggcatcagttgacattagattggaagaaagacaatgctggcggtggcaccttaacttacacagttacaatgcaaaaaagtaccgggtcaccttatcagtttgaccgaaagattaaatggtctaaaagcgatattcaaaaatacttcgcccaaaaatcagacgatcctgttccgcgaaaactgtatctaggctttaccggtaccacgagcagtcaatatgaaccgcatgtggtcgcgatcggcgcgatgccggaagcaacggccatcaatggcacagttgctctgatgcggggtgcggaaacggtggaagcgacaactcatctaaaagtggacgatgtactgcactatgattacaccgtgaacgtgaaggcaaccagtcaggcaacctggccggaaagcggaacagcaacgatgaacgtgccaaaaggaaaatattttgactatctgaaggctgatgggacgcccgccaaaccgggcgatacgttgcccatcaaagtcacgataggtaattcggattatcaggcccaaggaaaggttcaaccagatggcaatcagattgctgtcaccaatatgccccagattccaaaaggagcaacggcaacggtgaagttttcactgccggccaaagtcaaacatcatggcctgctggaaacgacaccggttcaggacaaaccaattgggaccatcacaggggatggccagacttatgatctgaagacacctgcgggcaaagattttctcgcttatattcttgatcccgaaacaggtgaactcgtgttagagaaagtgccgagttttgtcttcgaattgaagaatggtcaaaccggttatcgtaatccgaccgtgatggagatggtaaagggactgccaatgccaacggccactaattgggatcaggcgaatgcagatcagtggctgacgaatcagcaaggccgcgaaccgaccaattcgacaggcaaggtgttgagcgtgaaagatacgcggccaaccaagcaaggctggcatttgacgatgcaactatcgccttttacattaactgataatagctatgtgctaggcgataatgggaacaaattaggcggcaaggcaaggttggttctgacagatcagacaacgcaaattgcggctatcaaggataataacaacgcgacaccggtgaaaaatatggcggctggtgggacagattggtcgctaggcactcaaaccggtaatgtagcggcctacctaggtattgaaccaacagcgactgctaaggctggccaatatcaggccacggctacttggctgttgacgaatgcgccggaatagtaaggcgctggaggtgcaccaaaaaatggttccgaaacataaggctgacttatgtttcggaaccatttttacttagctatgatttagttttctgtgaaaattgccgagttaatcgttgctgaacgtggtgaattttgttaaacggcaatgcttgaaggagtgtgttcaaaatgattaagatgccgcctagccactcggccggtccgaacgcgatgtgcaagcgggtgacggctagagtggtggcagtcaacggttcgaaggcactcaacatgcccgtggcgactggcgagatgtagttgaggctgcccaacaccagcaagtaagcgaacatcgtgccgaatacgatcacgaaggcaatggcaccaaaatcaggtaaagttagtagcggattgggatgcagcacatattgcggtaaaaatggcaagctccccaagagcatggaccaaccggtgaccgctcgagcgtcatatttggccagtaacgtgcgcggaagcaacgtgtatagcgcctgactgacacctgccataatgccccagaaaacagcggccggcgcaagacttaaccctgtcagatgaccgcgggtaaccagcaaataggtgccaattagcgccaaagtgatactgacaaagtcaattcgccgaggcatttggtgagttgcaaatgccacataaagcaagatgaaaaccggccccaggaactgcaaaatcgttgctgttgcagcattacctgcattaatcgctaaaaagtaggttagttgtgacggtaccatgcccaaaaaggcgaacacgatcattagtatagcatcgtggcggtttttccaaattgcaaggaacatccgcggttcttgcacgccgctccaaagcaaaagtaggagaccagcgaaaaacaagcgaatgccaaccagccacagcggctttactcccgcatcggtaaatagtgtttgagtgaaaataccgctggcaccccaaaaaatagccccgataacggcgaaagaaacaccttttagtttttggttggtatggcgagcgagatgagcttcagtgcgtggcatggcgggatcctttcgaagtaagactgtccaagccattctacgcaaaaaaactagggttggctagttcgtgcaatatcgatcaagcttcctgatggcgtgtcttgaagttgcgatgcaagtgcctaaaaagaggcaaccattcattgaagaatgactgcctctttgactcattcctgagtcgtcttaatttttaattcgtagcgcaggttggtgcgatagaaatgcccaagcagcatgcctagcgttagtcctaagacaatgagaccgagcgggaaaagccaaccaccgaggaacccgccgatgccgatcacaatcatggcgatgatgacgccaaaaaagatactggcaaagccaagcgcgccaccgctgaagttggcattagctgaatacacactagcaaatggaaattgactgccaaccagcggccatcccatcattaacgtcatgccataggtgaaaatgatcacggcaatgccggccaacaaggcatcaaagccgccaagcgcagtggtcaaaatggtaatgaacaatagcggtggtaagaatagtcgggcgaacatggccttgactaccccgcgcagtaacaagccgtgggtcgtaaaaggcacatactggaaaattgccatggcttgaggttgactcgaaaaccgcagattaaccaaagcgggagccaacgccacaatgacgccgatgccagcgtaggcaataaaatgcttcgccgagctaaatggcatgtcgcgcagtccaccgccaacaaagatcagcggtagaataatgccataagccaactgcggatagacccgcagtttataatcgcgttcgctgcctagcacacgccaccctaaagtgaagtatgtccgttcttcaccaggacgagtcagcagagcactcacgccgcggaaccaccaaccaagtttacgcgtgcgggcatcgccttggttcaatttttctagataggcttcaaacacaccagaaaaatgtagaaagacgagggtcaaggcgattgggacgacgacacttaacacggtgagcgtcagacttaataccgttacctgtcctgcaaacaacatgggcagaccaacgaaccaagcggggacagctggtaagaaaagccaattaaactgaccgctgatggacatgccgaaaagcgacatggaacgcggcagcaagttaggcagctgaccaccaacgtagataccaatcatcagtaagatctgcactaaattcagcatgttgcgcaatcgttcgccatcaaaaaagcgcaagactagcaagtaaacaaaaagcgccatgaccagacttaacacgccgctcagcagcaaaccgatgagaccgccaagtgccacgattgggccataatggataccggccatgacgagtccaggcccgcccattgccagcaacgtcatgcccagatagaagcaaatattgatcaaccgcgcaaaacttaacgtttgatcattgacgcctcgggaggcaaaaacactccggtcgcggggatcaagaatcaggcttgagtaagtggtcaaaatagcgagaaaactcgtgagtagttgaatcgtcatgaaaagggtaaaggtcgtgagaattgaggtcgggagaaacataagcagccctaaaatcaggccaaagaagagattccataaaaaggcggttttgatacttgcgtcttgaccacgtttgcgtttattgaacatactgcctaagccgctagattcacgagcggccaagagacccttagtcgcaaggattagccgcaattgatcaaactgaataccacgtttttccaataagggcctaaagcgcgcgagccatgcaaatgctttcggcaaaggcaacgcggctgtatcagttggatcagcggtgtctagggacgtctttttaaatagtttcatgtgattcaccgccagtcacgatatccacgaaactttgtgccttttgaccgtgttcggcaaagccggttagatcgttgaagagctgttgcaggttggtgtcggcttccttggcaatggacttgaaggggccgtcagcaacgaccataccgtcatttagcacgatgatgcggtctgacaacttctgaacaacatcgagaatatggctggaataaaaaatggttttaccacgatcccgcaaatcctgtagcacttcttcaatgacaagcacggtgttggcatccaggccgtttaacggctcgtcccaaaaaagaatgtcgggattgtgtagcaggctggcgataatcaaaatcagttggcgcatcccctttgaatatgatgaaatgcgccgatcaaaagcctcccgcaaattcacaagatccgccagtgcaaaggccttttgttcagcatcggcagcgctgagtccgtaaagttggccaatcaagcttaaatattcacgagcagtcaaggcgtcaaacacgtcggcactttcaggcacatagccaatccgccgtttataactcgggtcgttgggtttgattggctgaccaaacagctcaatggtgccgccgtctggttgcatcaaaccgagcatcattttaactgtcgtgcttttccctgcgccattaggaccgatgtaaccaacaatgcttcctggagtaatcgtaaagttgagatcttttaaaacctccttggatccgaaacttttctggatgtggctgagtgttacgattggttctgccatgataggcctcctcttgtagggttgagtaggtacgcgtctaaaaaggtgtcagcaagaaatgaaacgcgcttgtctgcatacttctttgggccgattatgacagaaaagattattgttgtatagagaaacaacttttgaataacgctttttggcgacaataaaaaacatcacgagagacaacgtgatgttaagaggttcgctaatttaatggactaggccaaacgagagccaaataaaaaacggaaaatcggtcagtttgtgaaccgacgaaagagtggccgaagaataaaatataatactggtacgataatggccgttgcaattgaattgatcacggtggcaggcaaactcaggaaggcaccgaccacggctgccttgaaaacgctaccgaccatgagcgcctcaacaaccccagtgagataagaagtgacgatttttgtcaggcctgcgagaataccaattatgatgatattgcgcggttgatcgttatgcttaaaggctttgaccaaagcgctgacaacgatggccatcacaatggcttcaagggcagtcaaccatgaggtagccgcatagccgttcagcagatcaaacccgcccaaaccgatgacagcggccaaaccacctaagcggccacctaggaaaagaatggcaagcaccattaaaggattaccaaagtggatgaatggccgaccaaccattgccggaattggaatccgtaagagtgaaatgccaatgaagataatggcagcaaatagaccggtgaaaataatattctttaacgtattatgggatgtttgcatcgtaatcgcctccaaaatattgatagtaatgcacggtatgtggcagtttatggcagttgtttgcttagcgcaggaatgacgccagtcagattcaggccgtactttggatcggcatcagtggcaagcgtggccttgatcgcaagccgggcggcaaccatgccagttgcggccgcttgccgcaagttttggccttttaacaaacccgtcgccaaggcagcagcaaaaagatcgccagtgccaaaataatggcccgtttcttttggctgagccaaggccagcgtggtaccggatgcatcgatgccgaccaccgcaatttgtttgtgaaaaggcacgccggtgatgagaacggcgctgtcaaattgggcatgcaggcgtttcgccaaagccgtgacggcagaaggatcggtgagcgttgttggcttttcatccaaaagcagctgagcttcggtgatgttgggcgtcaagacagttgcccgatgcgccaactgttgcatggtcgccacataagcagcatcaaatcccttgtaaagtttgccgttatctgccatgacgggatcgatcaacacgagcggggcatgaaatttaggcagccaacgatcccattggccggccgccttttgaccaagataaccaaggtaaatgccatcaggctgcagttgcagttgttgccagtgcttgagaatccccggcatttcggagctaagatcaagataagtattggcgcctagtccgccagtgtgactagacagcagtgcggtaggcaaaacatacggcgtcaaccccagcccagccgctaacggcagcgccacgctcatcgagacttgacccacaccacaaagatcttgactgatgatcagactttttgtgttcacagcacgaatcctttctgaaaagatagttgttaataatgagaatgcgcaattttaggtgtcttgtcaacaagagcgcgaacaggcacgtttagaaaccggagcataagtggcctcaaacaaaatggccccggcatcgggccgtgaccatttaatagaaagaatcaagctgaattaagcattccgaatcgtctgagtcgcagcagcaatgcgcttgacgacggttggattgtccatcgtgtagatatggatcccatcaacgccatgcaccagcaaatcgacaatttgatcaatcgcgtaggcaataccagcatcacgcatcgcttctttattgccagaaaaatgctgcatcattgcgacaaattttggtggcaagttgacaccggccatggtggccatccgttcgatctggtgttcattgatcactggcataatgccggcttcgataggcacgttgatcccggctaattgtgctcgttcgcgaaatcgataaaaaacctgattgtcgaagaaaagttgactgatcagttggcttgcgccggagtcgactttttctttgagatggtgaatatcactgaccacatcaggagattcaggatgcttttctggatagcaggctgctactacgttgaagtcgccgacttggtgaatgtgttcgatcagatcacaggcatagggaaaatcgttactaacgcggccgcttttgggtatgtcaccgcgtaaagcaaggatgttatcaatgccagcatcttgaaaaccgcgcagttctgcatctacctgttctcgggtgagttgagcggctggcagatgggccacgggttccatatcaaactcatctttaatcagtttggcaacttcgagtgtccccatgtgaggcttgttgccattggcgccgaaggttacggaaacgaagtcaggatcggcttctttgaccgcatcgagggtgttgagaatcggagtcaaagcaatattgctcgcatttttgcgcggggggaaaacttcaaatgagatgacttgatgatctttaaagcactggttgattttcatgagtgagttccttacgtacttgtttagccgctgccaccatgttgatgaggctggccttggtttctgggacatcacgagtcttgaggccacagtcaggattgatccaaacatgatcggcaggcagacgtttcagaatttcgtggatgatgtgcacaatttcgtcctttgaaggaatccgtggggaatggatgtcataaacaccaggaccaacatgagtctgaaaatgggttgccttaaggatgtccaagagactgaagtcggaacgggccgcttcaaacgagatgacatcggcatcgaggtcgtcaatcgccttgatgatatcaccgaactgcgaatagcacatatgggtgtgaatctgtgtttcaggcttgaccttgctgccgactaaccgaaaagctggtactgcccaatcgagatacttcgggtaccaatctttcttgcgcaacggcaagttttctcgcaaagccggttcgtcgatttggataatcttgatgccatgcttttcaagatcaagtacttcatcttccaaagccaatgcaatttgttcaacgctcgtcttttggctcagatcttcacgcgggaaggaccagttgtagatggtgactggaccggtgagcatccccttaacgaggtggtcggtttgactttgggcaaagacagtttcagcaacggtgattggcttggtgcgataaacatcaccccagataatgggtggtttcacaccgcgcgtaccataactttgcacccagccgttgtccgtgaagcggaaaccgccaaagttttcaccaaaatattcaaccatgtcatttcgttcgaattcaccatgaacaagaacatcaaggccgatttcctcttggaatctgatccattcgatttcttctttgtgattgaaggcggtgtattgttcttcagtgatttcatgccggcgaagttttgcccgattgcgtcgtacttcagcggtttgcgggaacgagccgatcgttgttgttggcaatagcggcagcttgaacgccttagcttgaatcgccaaccgggttttccgttccggcgtccgcgtgtagtcggccggagttaaggcagcaatcttttcattcaatgccttattttctgcgtaccggggcttgctgaacaaagcgacgttggcttgataggctttgtgatcagcatcggtttcgaagatagcatccaattcgtgcagttcactgagcttttcttcagcaaatgcgaggtattgtttttcctcaggctttaaatgagtttcattgcgtaaggtgtatggcacatgcaacaaggaggttgaggtgcttaacaccagcttatctgtgatctttgccagcgttttaatggttgctaaggcatcggcatactgtgtgcgccagatgttcttgccattaatgataccggcaaaaagagttgcgcctgcagggaagccttgcgttttcagaagatcaaggttggcatggccttcaacaaaatcaaagccaaaaccgtcaaatggcaacttactgatgcgatcaaatgagtcggtcaagtcgccaaaatacgtttggactaacactttggcgctttgcttttgagccagaagtggggtgtacagccgttcgaacaaggcgaggtcagcgtccgtctggtcatagaccaaggccggctcgtccacctgaatccactcagcaccagcagcatgcaagcgtccgataatgtcggtgtatgcagcaattaagtctgctacaaaatcatctggggtgacatcaatgaaccgtgacagctttagtaacgtgtatggaccaaccaaggtcgggcgcgcattgatacctaatgcttttgcttcttcaaactggtcaaatagttgccagtctgtcactttaatttgtgtgtcctgatcgaattcaggaaccagataatgatagttggtgttgaaccattttttcattgccaaagctttgacatcaccagcctcgccttgataaccgcgcgcctgggcaaaataggtgtccagcggcgacagacccagcgcttgatatcgctttggcacgatattcaacaagttggcaacatccaaggtgttatcgaagaaggaaaaatcgccagtcggaatctggttaatgctagccgcttgaacagtttcccaattatgctgccgcagggctttcacttgttcctgtaattcctgtgctgtgatttgatgtttgaaatacttctgggtcgcaaatttaagctcgcgatgttcgccaatgcgtgggtagccgatgattgttgttgtcataaagaaatcctcctcagttagtgagcgcgagccagaccggttgctggtctgacaaacgcgttatagcggaaatttagttgcggaaaggtgcggtgcttgtttgggttcacgaaagatgtttagcgagaaaatcgtgaatgtcaaaaaagccgccctcagcgcagacaaattgtctgcgctgaggacggcttaccgtggtaccaccttggtttgaaagccgttcacacgactttcctcaatcagtccgacagcaaatagctgtgagacctaacgcaataatgggcgtccccatgaccgcctcgcaatcgctcagcgttcctgcatcaccaagaccatattcgctgccgtttcttgatgtcctttcaccaaatggacactctctaagcaaaaaactaacaactactcatctttccgcatttcaatgttgaggctagtttactgacgaagcttgttattgtcaagaactttgttcgaagagcgtgagaagtagcggttagttcggcgtagcgaagtgcgactgcgaacccttttttcgcggcaacagcagacgatttaaacgcttgaactaaaagaagagaactggcggagcggcgatgggctcagcactgaaatttgtctaggcggagtggttttctccgcctagacaaaggccgagcttcaagaccgcgggttttgcgggcttgaagtcgtgcccagtgcgctagcttcgcggtcgccaccccgaatcgccgcgtagccaactcggcatagaaagctaaatgtaggctttgttgccctatgctccggcttctaagaggggtggctcacgctctgcttcgaaacgcgatcacaggcgcagaaacctgcacataaggacctcaagcacaatgaccaaagtgcggtcatcgcacttgctgccgcttatgctccggtttctaaacgcgcctgctcacgctcttaaacgcgatcaccaccccagaaacctgcgtgtaaggaccttggacgcaatggccaaagcccagccatcacgtccaaggccgcttacactccggtttctaagcggggtggctcacgctcttaaactttttcactgacttgttttccaaattgcggtaagctattaaaacaagttatagaaggagaaagacatcatgagggtattgtttccgtacatcaaaaaatatcggtgggacgtgatctggtcggttttggcgattttgattgtggcctttgcaacgttgtggcagccgcatttgttgcaggtaatcatgaatgccatcatgaaaaatgataagcagacagtctggattaatggtctgtatttgatcggactggcgatcatcgggattattggcgggatcgtcaacacgatttacgcggcgcgggttgcgctgggtgtggcaacggatttgcgtgcagacgaatatgctaagattcagagtttggcgtacgcggatgttgaaaagttttcgccatcgaacttggttgttcgaatgaccaacgatatcaatcaagttcagcaaatcatcatgggcttctttcaacaagtcacgcgaatcccgattttattcgttggcgcggtcattctcgcgatcatgacactgcccgaattgtggtgggttattgcggtgatgatgattttagtttttggcgtcagctttttctcgttcagtcatatgggcaaatactttggccgaatgcaacaattaattgagcgcgtcaacacgttagcccgagaaaatctgatgggcatgcgcgtggtgaagtcgtttgttcaaggcgcaaatcagatcaagacatttgctgagtccagtgatgaaatgcgggatgtcagcgtcaagatcgggaacttgttcgccctgctaatgccggcgttcttccttgtggctaatttagccatggctggtagtatttggctgatcggacaggacattactagtcatcctagcaatctggcggcaattacaagctttattaactatttgatgcaaattctgtttgccattatcaatggtggcttcatgttgacatttgcttcacgtgcgttggtttcactcaaacgtattcaagaagtcatggacacaaagccgagtatgacattcgtctctggcccgcaccgtgacttagatggcgcggttgaatttgatgacgtgacgttcacctatcctggtgatgaaaagccaaccatttctgacatcagtttcaaggtgaaatctggtgaaatgatcggtattgttggcgcaactgggagtggtaaaaccacattggcacagttaattcccaggctgtttgatccagataccgggattgtcaaggttggcggtcacgatgtccgtgctgtcaccgaagccgatttgcggaaaacggttggcttcgtcttgcagcgatcaacgcttttttccggtacaattgcggaaaacttacagcaggggaatcctaacgtcaatctagatgcgatgcgctgggcggcaagaatcgctcagtcggctgaatttattgaacgcttgccacgcacttacaacgccgaagttgaggagcgatcctctaacttttccggtggtcaaaagcagcgtctgtcaattacccgtggcgtgatcggccagccgaaaattttgattttggatgatgcgacctcggctttagatgcccattcagagaaattggttcaagaggcactggcacacgagctgggtgatacgacgacgattatcattgccgaaaagatcagttctatcatcaaggcagatcgtatcttagtgcttgatgaaggccgtttagtcggcagtggcacgcatcatgatttagttcagcataacgatgtttaccgcgagatctatgccacccaaaaggcattggaagagggggtgtgattaaatgaaagacttgaaaaatgcaggtaaattttatgcgcattatctgaaaccttattggattgagtttttgatcacgacgattttggttggcatctcgacctgggcaattgtggtcgcaccgacttacatgggacgagcgatcgaagaactggcaacctatgttcagcagtggatgaacccagcaactagggcacaagcaacatttacggcatttaaccataccttggcgattttcgtcttgctttacatcattgatgccactagcatccttatctcaagcttattgttgtctaaaatcagtggttactcgactggtaccatgcgggtcggattattccgaaaaatgcaacggatgaaagtgaattatttcgacagtcacagtgacggcgatattttatcgcggtttacaagtgatctggataatattttcaacgccatgaatcaggcgttgattgaaatcttcttaagcggtgcccagtttatcgggattatctggatgatgttcacccaaaatgcgacgttggcctggatcacaatggcatcaacacccgttgcaattgggctgtcggccttcgtcatgcatcaagcgagtgtctcggttgatcgccaacaagatgatattggccgcctaaacggttatatcaacgagcagattacaggccaaaaaatgttgatcactaatggcttgcaacaggaaagtgtcgccggtttccagccgtataatgcggcggtgcgtaagtccaacctgcgcggccagatctggagcggtattttaaatccattgttgatgggcttgtcattgttgaacaccgcgattgtcatttttgctggttcttggttggcactgaatggttctttgagtcaaggcgcggcgctggccttggtagttgtgttcgtcaattatgcgcagcagtattatcagccaattgtccagttgaccagtctattcaacatgattcagctggccatcactggcgcccgacggattactgaagtgcgtgagcaacctgatgaagtggatccgccagaagggaaaacgcttgacggactcaagcatgagttactgatcgacaatgttcattttagctatatccctggcaaagaaattttgcatggcgtgaccatcaaggtggataagggcgaaatggttgccttggttggcccaaccggtagcggtaaaacaacggttatgaatttgctgaatcgcttctatgatgttgactcaggggcgattacatttgacggcgtcgacgttcgcgaattcaagctcgcctcattacgacaaaatgtcggtattgtcttgcaagacccgcaactcttttccggcacaattcgcgataatattcgcttcggcgatcccgatgctgatcaagcgcgggtggaagcagcggccaaacaggctaacatccacgatttcatcgtgagcttgccagaaggctacgatacctttgtttcagatgaacaaagtgttttctcggcaggacaaaagcagttgatgtcgattgcgcgaactattttgaccaatccgcggttgttaattctcgatgaggcgacaagtaatgttgataccgttacggaagccaaaattcaagcggcaatggataacgtcattcaagggcgaacgagttttgtcattgcccatcggttaaagaccattttgaatgccgacaaaatcgttgtcttgcgtgatggcaacatcattgaggaagggagtcatgagcaattactcgcgcaaaatggcttctatgccgagctttaccacaatcaaatggtgtttgaataacttgtaaaaagattccgaataaaatcggagtcttttttatttttattcgtttgtgaaacggttgcaatggcttcctagcctcaataatatatgttatcctttttatatcagaacaatgggtaggacggttctgataaatattgggatgatggaggtaacgaatgagcaagcgtagatatctggtcgctatcggcggcattttgcttcacctgatgattggttccgtgtatgcatggagtgttttcacgggaccgattgccaaacaaaccggttgggcgttgtcatcggtgacagttgcgtttagtatcgcgatcttcttcttggggatgagcgccgcctttatgggtcggctggttgagcgatttggtccgcgactgacagggacagttgcggcgttgctatatggctccggcattctgttgacaggactggcggtgcaacttgagtctttgccgttactttacattgggtatggtgttgttggtggtttgggattaggtgcgggttacgtgaccccggtttcaaccattattgcttggtttccagacaagcgcgggctcgcaaccggcatggccattatgggcttcggttttgctgcgatgctgaccggtccgattgctcagaacttgattgctgggattggactggtgccaacgatgtatgtgctcggcaccgcatatttacttattatgctcacagcagcgcaggttatccggaagccgcgtccgggtgaggttccggctgctgatattgctaaaagtgtcagtttgaccggtactgccatgacagccaatcaggcagtcaaaacgcgttcattccgctacctgtggctgatgtttttcatcaacattacctgtgggatcggactggttgctgttgcgtcaccgatggcgcaacagcaaaccggcatgtctgcggctacggcagcgatgatggtcggggtcgtaggtttgtttaacggttttggtcgactggcttgggcaacactctcggatctgattggccgtccgctgacgtacacactgatttttacggtggatgtcgctatgttagctggcattctggtgttcagctcaccattgctcttcgggatcgccttatgcctgatcatgtcctgctacggtgcaggattctctgtcattccggcctaccttggcgatgtttttggtacgaaacagttaggtgctattcacggctatgtcttgacggcgtgggcagttgctggagttgttggaccgaccctgcttagccttagcgatcaatacttccacagctatacttacagtttgattttcttcgttgcgcttgaattggttgcttttattctctcgattcgcattcgccggcagttcagcgttgtggctcgtgatgaaaaggtgacggattcactcgaaaggcaacattgattggctaatactgtgacagcctcgaaaaaggctgctcgtgatcaacgaatgaatggggaaattgacggttgtattggtctataacaatgaagtttataaatgaataagctatggaaaaatccatacagatgtatggattttttttgcacgctaaaatcccggtatatcaacattaatgattcataacgcgaagtatttaaaagcgtttaaacattattagttgacatacctgtacgtacaggtaaaataaagtttgcaagtgaaagcgatttctgaaggagaaggcatgcggaagtatgatgtgatctatcaggatttgaaagataagatcgaggccgaaatttatacgactggttcattattgccgagcgagaatacgctgcaggatatgtatcaggcatcgcgcgacacggtacgtaaagctttgcggctgctcaaagatgatggcttcattcaatcgcagaaaggcagaggatcaatcgtgatcaatcgccaagaatatgtctttccagtgtcaggtgtcgtcagttatgccgaattggctaagcagcttcacttgcagacaagaaccgtggtgttggccaatcattttgccgcacttccggccaagtcctttaaagatgttgatccggatgttgaagtcaagcagatgcgtttgctgaagcgagtgcgttacttggaaaaagagccggatatcattgatatcgattatttggatccaagagtcgtgccgccgattccggagtcggtggcaagggattcgttgtatgcgtatctcgaaggacaaattggcttggaaattgcttatgccacaaaagagattacggttgaaacggcaactgaagaagatcgtcgttatctaaatcttcctgagggcgccatggttgtagttgttcgcagttgcagtagtttggcagacactagaaaatttcaatacacagagtcacggcaccgggcagatcgcttcaagttccacgacttcgcccggcgtacaagaccatagagcgtgagcaggcgcgtttagaaaccggaatgtaagcggccttgaacgtgatggcctgggtttggctattgcgttcaaggtccttacatgcaggtttctgcgcctgcgaacgcgtttcaagcatagcgtgatctgatatgttgagactcaaaatttaagtggttttgaaagcctttgtgtttaggtctcaagctcagcaaacgcttttcaggaaagggagtcaccatgggatttcataataaagtcatttatcagctataccccaagtctttttatgacagcaatggcgatggggttggcgatctgcgcggcattatcgacaagatcgattacctcaagtcattacatgtcgacatgatttggtttaatccattttttgtttcaccgcagtatgacaatggttatgacgtcgcagattatcgtcaaattgatccacgctttgggaccatggccgattttgacgaattggccaaaaaacttaaggcggcaggtatcgacatcatgctggacatggtgctgaaccataccagcacagagcatgcttggtttcaaaaggctttagcaggtgacaaacattatcaggcatactattacattcgaccaccaaagccggatggcagtttgccaacaaattgggaaagcaagtttggcggcccagcttgggcaccgtttggcgatacaggcaattattatttgcatttatatgaacgacgccaagcagatttgaattggcacaatccagcggttcgacaagaagctgctgccattatcaatttttggcgagcaaaaggtgtccatggttttcggttcgatgttctcaatgttattggtaaagccgataagcttgttgatgcaccgccaagtgtggccagcaaaacgttgtataccgacacaccgattgttcaggactatttgaaggagctggcagcaaacagcttcggtcaagatgataatcgtgtgacggttggcgaaatgagttccaccacaattgccaattcgattgcttataccaaaccggacaaccatgaactttcaatggtttttcaattccatcatcttaaaacagactacaagaacggtgaaaagtggagcaaggtgccatatgatttcaacgccttgcgcgatattctccacacttggggtcagggacttgatcaaggtggtggttggcaggcactgttttggaacaaccacgatcaaccgcgggccatcaatcgatttggcgatgtcgggcaatatcgggttaaaagcgcggaattgctggcagcagcgattcatttgagccgcggcacaccttatatctatatgggcgaggagattgggatgactgatcctgattacaccagcatggcagattatgtggatgtggaagctaagaatgcttatgcagcactgctgggaaaaggcatgtctgaaaaagaagcattcggcattattttggcgaaagcccgagataatagccgaacgccaatgcaatgggatgcctcggaccatgcagggtttaccactggcacgccttggttgcgaccaacaaatcaagctgcaattaatgtgcaggctgagcttgcacatggtgaaatttttaaattttatcagcagctgatcgcattgcgtaaacagtatccagtgatcagtgacggtagctacacgccgtttggaactgaaattgatcggttgtatgcctatataagaacatatggcacacaacaattgctggtgctgaataatttcagcgacaagacaatgaccgtaccgctacccgaaaagtttcaaactgcaaaagtattaatcacgaacgaagctacattgacgccaaccgcaaccatgacattgccgccatacgtgacgattgggttattgcagaaagcgtgatttggctggttcgctagaagaaggcacttaagacaaagcgcagctgggttttcgtgccagcaagcgtgttgataaaagggggaacaagaaatggcagatacgaaaaagttgcagctcatggcaccggtctccggcttggccatggcaattaccgatgtttctgatccggttttttcacagaaaatgatgggtgacggttttggcatcgatccgactgatggtcagattgccgcaccagttgacgggcggattatgatgatcgcggacaccaaacatgcgattggcatcaaagccgataacggcgcagaattattggttcatttgggaatcgacacagtcgagctgaaaggcgcaccgttcgaaattgatacggctatggatgcccgtgtcaaagcaggtgatctcatcggatcgatggatttggacgcaattaagaaagctgggaaaaagacaaccgtcattgttgcgattaccaatagcaaagaagtcctcgatcatctcgacgtcaatgctggtgaagtgaaccgcggtgaagaagttgccgtgatgacgccaaagccaatggccgcaacagccgctgctgcgccgaagaacgaaagcaaatatgccgcaaccgctcggcagattattgccgatgttggtggttcgcagaatgtgaatagcctgattcattgcattacgcggttacgtttttatctgaaggatgaacagttaccagatgatgacaccgttagaaatattcctggtgtgattgatgttgcgcatggcaatggtcagtatcaggtcgtcattgggcaagcggtcactgacgtttatgatgaagcaattaaacaattgggtcccagttatgctaacgcggaaggaacggcgcaggcaatccaggagactcagcaagaagctcaagataccagtgcgatgggccgaatcaaacacgggctgcaggcactaattgggacaatcacaggctcgatgattccgattattgggcttttggctgccagcgggatgttaaaagggattttgctcggcttaacaaaatggggcggtttatcaacgactaatccgacctatgaaattattaacgcgatgggcgacgcaaccttctactttctaccgatacttgttggcttcaccgcggcacaaaaacttggctctgatccggtgattgttggtattatcggcgcgttcctgatctatccttctattgcgcaaatcgccacagcaggtaaagtcagcggcacattgctaggcatgagtattaatgccaacttcttcggtttgccagtgcacattgccaattacacgtattctatttttccaatgatctttgcggcgtggatggcggcgaagctcgaaccgtggatcaagagttggatgccattggtgcttagaatgatcttcagtccgttggttgaaatcttcttggttgggatgactgttgttctggttgtcggaccattactcactgtggcatcaggcgctttgacatcagggattcaagcattgctgaatttgaccccaatgatttcaggtgccatcattgccggtctctatcaggtgctggttatcttcgggctgcactgggcggtcattccgattatcgccgcacaattatcatcggcacatcctgaatcaattctgaacgggattgtctcgatctccatgatcgcacaaggtgccggtgcgttggcagtttgggtgaagacaaaacacaatccagccctgaaaggtttgtcgctttcagcctttatcagtgcctgttgcgggattaccgaaccagccatgtacggggttaacctgaagtatggccgggtcttcatctttgcaagtatcggcgctgcaatcggcggtctggtcaatgggctgcttggggttaacatgttcggcttcaccggtagcttcatcgggttcttctcgtttgatgcgccggcttgggcaaacagtcccaataacttaatgaatttctggattgcttccattgtgacgcttgtggctgccttcctactggtttacttctttggttataaagatgctgacgccaatcaagcaaaaacggcgccaaagaaaaagcgtttaggcaaaacagttgaataatggcgtgttcaccaacacgtacggttttcatgtgtgcgtgagcgtcaacaattgattaaaaaagcacgatgtcagcggacatcgtgcttttttcgatttcaaggcatgccgaagagcaaggtgctcgtatgacgatacatggtactaacgcttggttaaaaatgagcaaatcatggcaatggtggataagcacttttaattaagcgtgttattcaatttccctgtccttgctttaaaaagtgatcctatttgaattaaattgcttgcagttgttgtaaaaataaggcaaactaagaagtgctctcatggaaagctaattttagatgaaggaggggccaagatgtataaacggtacaaagatgtttcgttgatcttaaaaattgtcattgggatcattgttggggcagtgttaggggtaatggtgccctcctggtcctttattgatgttctcggtaaattattcgttggcgctttaaaagcgattgcgccactactggtctgtctattaattatgtcggcgatctctaagtatagctcaggtgcgaagaaccactttggcaccgtcattgtgctttatctcagtgccacgttgttttcatcaattgctgccgtggcggtctcgtatctttttccgatcaaattggtgttgcccggtgcgatgaagatcgccgaaagtgcaccgaaagatctggggactgttgtgacgagcttactaaccaatgccgttgccaatccaatctctgcattggttgaaggtaattacctagctattcttttctggtccttactgatcggttccggtttacgattgaccagtgctgtgaccaaaaaggtggtcacggaattggccgatactgtcagcgctgtcgctcaaaatgtcattcagttcgcaccgtttgggattgtcgggttgttacacgagtccttgagcaaaactggtatcaaaggggtcatggcatatggtcagctgctcatgctgctggttgccacgatggtatttgtttacttagtcgtgtacccattcatggtttggttgatgacccggcaaaatccgtatccgttgactttttggacgctgaaagtcagtggtattccggcattctttacaagaagcggcgctgtcaatattcccatcaacttgaaggcatcaaaagatctcggattaaatgaagaaagttatgcgatctcaattccgcttggtggctcggcaaattctggtggcgcagcgattacggtgtcgatcatgacgttggcaaccgccaataccatgggggtacatgtcagcattttcctagccttattgctatgtttcttgtctgccatctcggctaccggggtttccgggatcgcaggtggctcactgttgttaattccaatggcggcttcattgtttggcatttcaaatgnnnnnnnnnnnnnnnnnnnnnnnnnnnnnnnnnnnnnnnnnnnnnatgcaggttgtcggtatcggttttatcatcggcgtggttcaagattcggttgaaacggctgttaactccgcgtctgacttgctgttcaccgcgactgccgagtatgccgacgatcgccgtgaaggacatccggttgatattcgagctaaggtcaaagcggcaggcaagggaacggcagaagttgtcacacctgaaaaggctaatgaagctgaagaaagtgaacaagtttagttcagtcaaaagaatcgcgaattttcgcgattctttttatgtccagctaatttgagacaaaatgataacgagtgtttttgaattcacatcagacaataacgaatgtctttaaactcacaacgctttccagccaagctgaaatgtgctaacctatttctcatacgttttttaaatatgtgagagactgactgcttgatgagcagtgccatggaggttaccgatggggcaagtttggcaacgattgattagaaaagaagatccaagtgtttatgaagataaggattcacatttaccgcgcgttttacgcgtccgcgattttcttgcgttaggggtcgggacgattgtgtcggcttcgatttttacattaccaggggtggtggcggcaaaacatgctggtcccgctgtgtcgatttctttcttagtagccgcgatagtcgcagggctggttgcgtttgcctacgcggaaatgtcagcggcgatgccatttgccggttcggcttattcttggatcaatgttgttttcggcgaattttttggctggattgccggctgggctttattggcggaatattttatcgcagtggcgtttgtggcgtcaggactttcagctaatttccgcgggctgctggcaaccattggcgtgaattttcctaaagccttggcgaatccggttgggaccgatggtggcatggtcgatctcgttgcagtggtcgtcatggtgctggtcggcttgttattgtcgcggggggtatcaagtgctgcgcgcgttgaaaacatcttggttgtcatgaaggtgctggcaatcctgcttttcttggtggtcggcttgactgcgattcaccctgaaaacttccatccattctttcctgcttatcatctcaatgctgacggtacaccatttggtggttggcaggggatctatgccggagtttcaatgattttccttgcttatattggctttgattccatcgctgctaattctgcggaagccattgacccagagaaaacgatgccacgcggtattctgggttcgttactgattgcagtgttcttgttcgtttcggttggtcttgtgttgttaggtatgttcccatatcaggattatgccaataacgcggagcccgttggctgggcattgcgtcattctggccatgcagtcattgccgttgtggttgaaagcattgcggtcttaggaatgttcacggctttgatcgggatgtccatggctgggtcgcgcttgctttacagttttggccgtgatggcatgctgccgaaaaaactgggtaagctgaacagtcgtaagctgcctaatcatgccttggctgttttgattaccatcggcgttttgatcggcgctttcttcccgtttgcctttttggcccaactgatttcggctggcaccttgatagcctttatgttcgtgacactgggaatctatcgattgcgtccgcgtgaaggccaagatatcgccaaaccgcgcttccggatgccactgtatccagttttgccagcagttgccttcctgggatcacttatcgttttccttgggctcgacattcaagccaaactgtattccggtgtctggttcctgatcggctgtgccatttacttcctgtacggcatgcgtcactcggctctgacaaagggatcagcggttgagcaagaaactgctgcgttaggacaagaaaaagattaaaaaagccgctgcctgagattgcccgcgttgtgacgcgcggtctcggacagcggttttttggtacggtggcttagtgatactcgtctggagagacaccgttaagctgagcgcttaacctgacgagcctaagcttcttgagccttcttcagattttctttcaaaatagctgcagaatcggctaaacgcttatgatcttctgggttcaaatccagctcaatgatgcgttccaagccattagcgccgaggattaccggtacaccgatggaaacacctgacaagccgtattcgccttccaaatggacggacattgcgaatgctgcgcgatcatcattcaagaaggcgctggttaaacgggttaatgaggcagcaatgccgtagaaagtggcaccttttttctcaatgatgccataagcagccgttttgacgcgctcgctaatatcaggcagatctttatcctggcgatctttaggaatccaatcaagaatcggtttgccgccaatgttggtgtagtcccaaactggaaattcagaatcgccgtgttcacccatgatgtagccgtgcacaatccgggcgtccacgttataacgcagaccgatctcagaccgtaagcgagctgaatcaagcgccgtccctgatcccagcacctgattacgtggcaagccggattcttgcaagactaattcggcaaggacatcgactggattggatgcgactagaataaacccattgaacccgcttgccataatgttatgtgtgatttctttcatgatctttgcgttgatggccaaaagttgtaggcgtgtctgacctggcttttgggcaattccggctgtgatgacgataatatcggcatatttgcaatcttcatagctggccgcataaatattcttctgtgacgtgtaaggtagggcatcagaaagatcttcgacgtcaccttgcacgcgtttttcgttaacatcaataataccaagactctggccgacgccggtggtgagacagttgaacgcataacttgatccaatcgcgccatcaccaattaaaataatattgccgttgttccgcatctcaaattcctcctcatgaagatcttgacgacaggtacccaaaactgcgacaaacgactaagagtgagcagtcatgaagccgattacgacgcgccataaaatcgattgccgccaaagctgttgcatgtatccgatttcattgtaacagaggtctgcatgcagggcttgataaacgactgggaatatttttaatatcaagataactttcttatcaaactgccatctttctgttagtcttgaaacaacgcttgtcacattttcttccagaaaggtggttcctcatgtcagcagcatcttacgtacagtccattctcacaaccctcaaacaacgcgatccgaaccaaccagaattttttgaagcagcatcagctttgttaaaaaccatcacaccggttctcgaaaaacatcctgaatatatgaaagctaatattctcggacgcatcgttgaaccagaacgagcgattcaatttgccataccgtggcaggacgataaaggccaaatccagatcaatcgcggcttccgcgtccaatttaattcggcaatcggaccatacaaaggcggtttgcgcctgcatccttccgtgaatttgagcatcgtcaagttcttgggctttgaacaaatctttaaaaacagtctgacgacattgccgatcggtggggcgaaaggcggcgccgattttgatccgaaaggtaagtcagatgctgaagtgatgcgtttttgccaaagctttatgacggaactcagtaagtatatcggaccggatttagatgtgccggcgggcgatattggcgtgggtgcgcgcgagatcggttatctttatggtcagtacaagcggcttaaaggcgcaaaacgcggcgttctgactggcaaggggttgagttatggcggatcgctggcgcggacagaggcgaccggttatggcttgatttactatacagacgagttattgaaggccaacggtgaatctttggctggcaagcgggcggtgatttcaggcgccgggaatgtcgccatttacgccacgcagaaagctgaggagcttggggtcaaggtgatcacggtttctgattcaaacggctatatcgtagacgaaaatggtattgatgtcgcggtcgttaagcagattaaggaagtggaacgtgggcgcataaaagcttacgcagatcgggttgctgactcccattattatgaaggctcggtttgggacgcggatcttcagtatgatttagctctgccttgcgctacccaaaatgagattgacggcactcaggctgcgcgttttaaggctgctggcgtcatcgcggtggcagaaggtgcaaatatgccgagtgacccagaggccatcactgcctacactgatgctggtattttgtacggcccggcaaaagcggccaatgctggcggggtagccgtttccgcactcgagatgagtcaaaattcgcggcgcctcagtgacagttttgaaaaagtcgatggccaactgcatgacatcatgcagcatatttttaaagctagcgcggatgctgccgctgaatatggtatggccggtgattatgaggccggcgccaatattgccggctttctgaaagtggctgacgcgatgtattatcaaggcatgtaggtatatttagcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacat

SEQ ID NO: 89 - DNA, 543 bp, Lactobacillus paracasei
tcttgatgccgattcacatcatctgattgccttgcttggtgaccgattcaaccgcacgattaaaaacttcttcatcgctcattattcactcgctgaacgcactcgggtccagacggtcaccatggacatgaatgcagcttatcagacgattattcatgaggttttccccaaggcccaagttgtcattgatcggttccatatcattcaacttgcggctcgtgcccttgatcaggtacgcgtccaagcgctcaaacagcttgatgacaaacacagccgtccttataagatcatgaagacaaactggcggctttttcatcaaattgcgcctgacgctaaacacaaacagttcctgtttggtttgaatgaatatgtcacgcaacaggaggccatcgatatcgcacttgatactgagcccaagctcaagcaaacctacgagacctacttagcgcttcatgaggccttgatggtgaagaaacatcccgcggaactggcaaacctgttagctacttacgagccaaacggtacggcaatggacatgacgat

SEQ ID NO: 90 - DNA, 371 bp, Lactobacillus paracasei
tctcttgacgaccaatggtcggcctgatcgattagtcactgatcaatatcgggcaacactgaaagcagtgaagcacctgataaagcaagactatttgagcaaatcagcccaccaatgttccaaatatcgaaataatttgattgaacaggaccaccgattcattaaacgtcatcgtgtccgctcagcaagctttcaaagcattcgaaccgctagtgcaacgttgagcggtgtggaaattgttcacgcaatacgcaaaagaacccgacgagagttaagtctcatcgggttctcagtcgtggacgaattagaagcattgttagctgcataaccttcaacataggatcaatagctggttagatggtcatctctca

SEQ ID NO: 91 - DNA, 391 bp, Lactobacillus paracasei
ttgccatgagctattaagccgccttcgtgcggcatatgaaaaaggagatctcgatcgtagtatcagtcggtatgcgcggtatgagctactggtgattgatgaaatcggctatttgccaatcgaccacgatgaagcaaatctcttgtttcaactcatcaacgccagatacgagaagtgttcaacgattatcaccagcaacactgatttatcaggttgggttgagatttttcaaaatcccaccgttaccgcagcaatactggatcgccttgttcaccatgtccacgttgtgaagattaccggcaaatcgtaccgcttgaaaggtgtcggttgaccgccgaaaacctacatttttaaaccgccataaacctacatttcaaaaccgcccttgaca

SEQ ID NO: 92 - DNA, 619 bp, Lactobacillus paracasei
aaaacaccaacggactgattagagaatactttcccaagaacacagacctagaccttcagagcgaccaggaaattgagacttacattgaacaactgaataatcgaccacgcaaggtcttaggctggaagacgccatcagaagtcttcatgggtaaaaagttgcacttgagttgacaattcgtcttcataaaaaacgacacccccgctaaaaggtgccgtcctggtgccaatatctggacttggtcgctacttatactacttgtggttgtccagtaggtgtttaagcaatagcaaaaacacaccaacgagtagtggcgcgatgatcgcttgatcgaaagtattcatgacaaatcaccacctctgagcgcggtatcacgccaaaaggcatagcgactgaataagtataccaaagaaccgtcaaaacctcgttatgaattaagggatctggtgcaaacagtctgagagatgaccatctaaccagctattgatcctatgttgaaggttatgcagctaacaatgcttctaattcgtccacgactgagaacccgatgagacttaactctcgtcgggttcttttgcgtattgcgtgaacaatttccacaccgctcaacgttgcacta

SEQ ID NO: 93 - DNA, 448 bp, Lactobacillus paracasei
cgtgtggttgggttgcacgagtggcgtcttggcactgactgtgtggtaacagttatgacagcgccatcgttgcttgtgcaagtcaatgactgtcggtatttcaaccccgttgaggacgcgcacgtgggccgtataaaacccgttagggtgcaaggcctcaaagccacacagtgggcaccgggttaaccggtaagtcagctcggcatcaatcacatgatactggcggcgacgtaccccgttgccgcgatattcatgacgaacaaaggctactttgatattatggtctggtattccaaggacggacagtgtaggatcgtattgggacatttactcataacctcgcttgcttttggtttcgacgctaacaagcatagcatggacactgagtaggtgtctttttgcgttatccaaaaagggcctacacgttcagtgttgattatttctcaac

SEQ ID NO: 94 - DNA, 6269 bp, Lactobacillus paracasei
aatcatgaagttagcgcatgaacggttgccagtcaaaaccatcgcccgtattatcggaatctcagcctcctcggttcaacggatcattgaccaaaatctcaaactccgaccggctcgccggctacccacgcgactctgctttgatgagttccgttccactcatggcatgatgtcgtttatggggttaatggaacatccatacgaaaagtagcggtaggaagccgaacactcagaatgtttgttatctgaatatacggttttctaccgctattttaaaattcgtattggttacggacctactgattcctcagaggttaccgacttttgctaagtcaataatctgctgctcaatttgatctctgaccttccgaaaaactactattctatcctgttcggatccagctgctaaagccgggtctggaagtggccaatgctttttcttgaccgttggtggggtgactggacagcgatcacgagcgtctccacataaggtgacaactaggtcactgtgaagcaaataatcgggatcaattaactttgatgtttgctgggaaatatctattcctttttcagccataactttaacagccaatggattcaagccatgcacctcgactcccgcactggcaacgcgccaatcattgcctaaaatttttttagcgaatccttcagccatttgacttcgacaagcatttccagtacatagaaaataaatttgtgtcatcattaatcctccatctaaactattagtgaaccaaagcagctactaaatccatgtctaagtaactgctaaactcgttaatggttgggtattcaccggtttttaccaactgaccatccactaacgtaattggtaaagcatttataccctgacgttttagttcttggacaacaatcggatttcgaacaaaggcatcggggttctgggctaaattacgacgaatgaacatggcctgcccctgtgcattcacactgacataccgctgaatggcagttgtttgaatcaattccttatcaacgctgggaccacaaacaccggttgaacaacacattgctggttcaaaaagctctatttttttcattctattcatctccaaagtaattgtgatttatattttctaaccaaaaatcgataatgataaccagaggccacatagggtaataaacaacactgggatcgtggttacaattccaattttaaaataagtcccccatttaattttaactcccttttgagctaacacatgtagccagactaatgtagccaaagagccaattggggtaatcttaggtcccaaatctgagccgattatgtttgcgtacactaacgtatgatggatgagccctgaaacgtcagcgcctttgattgatagtgcattaatcatgacggtcggcatgttattcattaatgacgataaaagtgctgctaagtagcccatgcccattgtggcagcaaaccgaccaccttttgcgatttcggtaatgacacctgataataatgttgttagaccaacgttctgaaggccgtagactacgacatacataccgattgagaaaaagacaatgttccaaggagctcctttaatcgctgccatcgcattaacatgggaacttctttgaccaactatcagaaaaatagccgcaatactcagtgcgataaaggagacggggattcctaagaaaccgctactaaagtaaccaatcaataggaggattaagacgacccatgaaaacttgaaaagtcgctgatcttttagtgcagaactgggttccgcaacctgagtggcatcaaattttcgtggcaatgcttttcgaaagtaaagatacaggataccaatactacctaacagcgaaaatagatcaggaatccacattcttaacgcatacgctgaaaaggaaattccaaaaaagtctgcagagacaatatttaccaagttactaacaatcattggtaaagaagtggtatcggcaataaagccactggcaataataaaagggaaaacttgcttttcatcaaaatgtaaggcacgaaccattgctaaaacaatgggggtaagaatcagagcagccccatcattagcaaaaagggcagcaacgacggcgcctaaggtggtcaccaaaataaacatgcgaataccgtgaccgtttgcccagcgagccatgtgtaaggcggcccattcaaaaaatccgatttgatctaaaatgagtgaaatcagaataatagccacgaaagatagggtggcattccagacaattccggtaactgttccaacatctttaaaactcaccacgccaaacaataatgctaaaattgcaccaccaacggctgtccatccaattgataatcctctaggttgccagataacgaataataatgtgagtaagaaaattccaacggcaaaaaagacttgcatgatacctcctaaactgattaattatttttttcctttaattaattaaaccgttaaaagcgttttttcgtaatttggttgccattgcataacagcaaaataattattcgaaagctcttttacctgatcaatccatttaacttcgctttgcactcgagccagcaaacatggatcagtggtttgagttgccaacatactttggttgaccacccaccaagtatgagctagactggctcgcttcaaatcgtcatctaaccgaattgattcataaaccggcgtggcttctggtagcgttaccataacaatttcagtttgcttaggatcttgtagtcttggtaacagattaacgactgcttgtgggacgctgccggaggtatgggcaacttcttgagcatagctttgggtcgagtttaacagtaagagtgtatgaccagtcggagccgtatcaaccacaacgacgtcactatcattttgggcgactaactcagcaaaagctcggaagacagcaatttcttgagtacatggtgaacgcaaatcttcagcgacataatcaacatcattagacttcatggtctttttagcagtagtgagaacttcgttttgatattcttttaaagactttttctcatcaatatggctcaccttgatcagcggacttgtgattttgaagtatttcaaatgatcagctgggtcagtggtagccaagtgcacggttttgtgttgagcagctatcttttgggcaatttgaacggcaacggttgttttaccaacgccacctttgcccacggtgaagataatttttttatttgactgcactaaattcttcacgacaacatccagatcaggaaagtgactagcagtaaccggttcctcagtgatttgcggctgctggtctttcaatagtagtcgtaaattagctaatcccaatacgttgtatgctcgcaatgggattgctaacttgggtagctggtctaaagtgactggcatattctgcaaatcagcttgctgttgtttaaaaatagtctgagaaactgcgtcggttggctgatttaagataccgttaatgattagttgctggttcttaatgtttaaggctgccaactcatgtgaagcgcgttgtgcctccagaagggcgcctttttgtggtcgggtaactaaaaacaaagtcgtcgcttgaggattgcctaaagtttcaaccgctttttgatacatagctttcttatcatttaagccagctagttggccgagacaggatgcaccacgatcattcttatccaggtaattactccaagcagaaggcaattgcagcattcttaaggtatggccggtcggcgcggtatcaaaaataatatagtcaaattgctgattaatcttggaactagttagaaagttggcaaattcattaaatgcagcaatttcaaccgtacacgagcctgataattgttcagccatattctgaatggcttctttgggcaacacgcctcgataaggttgaataacctgctcgcgatactcgttcgcagcaatgaccggatcaaagttggcagcaaacaaaccggaaatgtttggaatcggctttggctgattggttaaactaactttaaaaacgtcctgcaagttactagctggatcagtggaaacgatcataactcggtgaccagcatcagctaagctaattgcagtggcactggcaaccgtggttttgccaaccccacccttgccggtaaaaaataggtacttggttaaattaatctcttgtggcgaatacttttccatcatttttcagctccttacatagacacgcgtctatgtgttgcttaaaaaaacttaattggcaacatctttttcacaatcagaccgttggcaaaggcagtgctcatcagcggctaacagttggtcggtattctgtttaaactcttggacaaaccttttttgtagggaatagtgttgccatttcccatcctttaccgcaaacacaatacctgcattttgcaaaaccttcatatgatgagacaaagtgggttgagaaaaatcaaaatgctggaggatatcacaagcacaaagtgatccacatgaaagcagatcaatgatttttagacggttcgggtcagccattgcttttagcatttgaacgtaattttgataatccattttttctccttacattacatagacgatcatctatgtatagtataagagctactccaatggcttgtcaactttgttaaaactaaaggtcgtaaatcttttttggaatccataatatttagaagtcagttgtgagaagcagatgggtcatcttttcttttaagcttttttagttttaaccgattcacttcgcggtaaaaagttcctgaggaaatttggttggtggccaaaatttctttaactgaatagtcaccactttgatacatccgaatggcaatatccaacttttcttgggcgattcgtggtcggccaactgtcacgccacgccgacgactggccgcaatcccttctttaacccgatcagctaataaattccgctccagttccgcaatcacactcatcatttgcagcatggctcgaccagttggggtctcggtgtccatctgctcctttaaagaaacaaacttaatttgtttttggtgcagtaattgaatcagatttaaaatgtccaacgtattgcggcccaagcgggaaatactttcaacgaccacgacatcatgagcccgaatggtttggagaagctgggtaattcccggtcttctttgccgggtcccggtaaacttttcttgaatgattttttcggcaccataagccattaattgatcaatttggcgattgagattctgatcatcttttgaaacccgtgcatatccaataatcatgagtgactccttagttttttgatagccagggtaaatttagctatattttggcaatggtttattataaactttttgataatgagtttttgaaaactcaaaacccggttaaatcaacctaatcaaagtatagcgaaacctttccaaaaactatagttttttaaaaacattggagaataatatgccgactaacccgcatcaccaacaaagcttcggaacttttgagggcatctcttctgccgatcaactgcggctgtattttcaattaactgattttgatcgcgcgttaattgatgaaatgcgttccgcaacgactaaattaggctttgccgttcaattgagctcagttagatttttaggaacttttccaactaatctacaacaagtcccagctgaggtaattgattatttagctaaacagttaactattgatggtcgggcataagcaggctacacgcgaaaaatgaccattagccaacatatggcgctgagaacctgtctagtatcttttaagaactatcttcaggaaggccaatacaaccatttgaagactgctgttaagggcgcgttcacagtttttccaaagtcgccgacatttgtctagccaacgccatgaacgttcaatgatccatcgttgcggtaacaccgtgaacgtatgcaactcgttgcgtttagctaccgtcgtcttagcattcaaaatgagcttcacctgatccgcaaagtcattgccagtgtagccaccatcaaccatgacatgctgaaccagctctaaattttggctagccaaactaaacatagccaatgcacctggacgatctgatacattagctcgtgtcacgagaatggcttgtggtaaaccgttaatatcaaccgccatatgacgcttaatccctgaaatctttttgccgccatcgtagccactatttttcgttaaatcagtggttttaacactttgagcatcaacaatcacaaacgacgttcgggccgatcg

SEQ ID NO: 95 - DNA, 1638 bp, Lactobacillus paracasei
tgccaagcgttatgatctgcataccattagcgatcttggcaaaattgcaccatccattcgcgccggatttgatttagagttcattgaccggcaagatgggtataagggcatccaatcaaaatacggcttgcagtttaaggtggattcaatggatgcttccttgcgttaccaagctttagatcgcgggcagatcaatttgaccgatgggtatacgactgatgcgcaattgcggcaatatcatctggtggcgttgcaagatgataaggggttgtttccgatttatcgcggtgcaccattgatgcgaacggcctttgccgaaaaacacccgcaacttgtagctgcattgaacaagttggctggtcaaattacggaaaaacagatgcagaccatgaattatgccgtgagtgtgaaaaacgaaaaggccgcaactgtggctcaccgctatttggttcagcatggcttgctgaaggaggtgcgctgatggcattgatcagtcttgaacacgtcacaaaggaatatgacggcaagcccgtggtcaacgatcttagcctgaaggtcgatcaaggggagttgtttgtgctagtcggcacctccggcagcggcaaaaccacgacgctgaaaatgatcaatcgtttggttgatccaacgagcggcgtcatcgaatttgccgacaaaccgctcaccagttacaaaatgcgcgacttgcggtgggatctggggtatgtcctgcagcagatcgccttgtttccaaccatgacagtggcgcaaaacattgccgtgatccccgaaatgaagggctggtcgcgccaaaaaattcggacggcaacagacgagttactcacaacagttgatttgccgccagccgagtaccgcaatcgcatgccaagcgaattatccggcgggcagcagcaacgcatcggtattttgcgggccttagcatcacgacctaaggtggtcttgatggacgaaccgttctcagcattagatccgatttcccgcactcagcttcaggacatgctgctgcatttacatcgtgccttgaagaccactgtcatttttgtgacccacgatatggctgaagcaatgaaacttggtgatcggatcggcgtgatgcgcggtggcaaactcttgcaggttgatacgccggaagaaattgcgactaatccagctaacgatttcgtggcggatttgttcaagggagcgcaagctaatcagggtctgcaggtcacgctcagtcagttagcaccatttgcagcggatgtttcggcccggcatgcggttggcggcaacttgacgctggccgaagcgttgccgcttttagatgcgcatgaggcgttgcgcgtgaatagtgaacatggtgcgtttgtggtcaatacccatagtgttgtcgcttatctcgcaagtgcattcgtttcgtaaacgactaatatgaattcttaactgtgacaattacttttcaaggttctggtgcaaattttcctcgctgacttgattttagtatactgggtgccaagaaacgagggattgcgcgcatgaatcactttaagggacgccactttcaaaaggacatcatcttagtagccgttggctactatttcagattcagtctcagctatcgtgacatcgttgaattgcttc

SEQ ID NO: 96 - DNA, 2521 bp, Lactobacillus paracasei
agaacttcgctactattttccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggcctgcgtcagtttgtccaaatgccaaagccatgattttgttaccattaactccgcaaataacaacaatttgatttacgcaatttccatctatgtcttttgcctcctttaacgtttccttaacaaactgttggatcacatttacgtaaagttgccagtttaactgagctccgttgctttgaacatgtaatcgctttatgaagtcctttattatgtcagcaacttgagcgtttcctgtagttgcaatcaaaatgtttgattcggctaacataaattttttatagttttccccaaccgtttttgctccttgagacattcttccatctgccacaattgagcaaaagtctttagtcaaaaatccagaaataaagctcatttctaatcacctcaaaaaaatagtaccccagcgtgaactggaatactacattgaggtgatatctgtgcttcatatgtctgctgctcgctctcccagtgtcagatggggtcatcgcaagctgtgtccggtcgctaaactggacaatgaggccggtgggatttggtcccacaacatctcgtttcttcggcctcgttctatgccaagccgctagacatagacgacaaatgccatatcacacatttgggtatcctagcattagtcttttaacgcacctcctgatattttaagcggcacttctttatcaggtcgggttgccaaagttcagattttacgccttagtttggcaatgtggcatgcgggaatcgaacccgcctgactatctcagccagtccatttgccacgccttgccacagctttatcatcactgaggctcggaggaaaaacgcggtgtctcaggtttctcacctttggcacaataacataataaggcagaaaagcgtgttttttgttgcatcattgttgcacggatgttgcatctagtttcactagcggacatatttcagcaaaagcatagagagcttcttgtgtttgtcgccaaagggtcgttcggtcaacatgcaagtgagcggctaactgaaggctggatttacgtgtcgtctttggagtcagatagctctcaactaaaatgatccggtagtcttcattctctatagattcaatagcgccttcacagcacgctatatagtacagctcgtcagcgtgcgatacgagcttgtcctcggctttatttccatagctaggtgacttaggcatgccgtccatcacgggacttctgagcgctattttggtgcgttgagcgagccgcttgtgatgccagtagttccccaagacctctttggcgttttcaattgttttatcatgatcaattgggctaaaatatctcgttgctcgcaccactgcgtccactccttatggtatgatttggttgggtttgtaggataagcgtgccttcgtggtgcgcttttgttttttgtgatatacctgctgttcaaataattcgatttgttagactgagtcgtcctgttaatccagggcgacttttgctatactacctttggagatgctttcttatgcgtgttaaccttataagttgggggaacaatctgattcaagcacctcccgcgcgttgcttatgtgacgcgctttttggtatactgcatacggaggccaactccttttaaatgattccatttgctatcaatcacgtgtacgtttggcctccagagcgcgtcaacacccggcgcgcttttttgatgcttttaaatgtactttcaacatgtgcgtttgctatactgtcattggaggccaactcctaatctttgatttcatttactctcaatcgtacgtctggcctccagcgcgtccctcatcaggcgcgctttttatttacattgaatcaggattattcctgctaatatttaagttcgtttggatcgtcaatgttgattggcaaggttaatacaatcccgccagaaacttctgcagcagcttcagcgtcatgccttagcacaaatagtttagatgaatcaatttcgcttgatgtattaaattccttgctacatttgctgaagtaagatacatattgctttttgccaattctgacgatgaagaccgtgctgccaatttgaaccgtcttgctgcgcctattgctaacaaaatgatcaaaaagcagccaaaagaagtatgcacatatgactacagtaataaccgcgcaaataagtagctttattaacctagattgcaataataaagttaccacctagaaagaggcttgctcactgcttgaactggggtttgccaacggagacattttctaggtttgttattgataagcgctgtggcttgttgaatatcggtctctgaaacctgatcaaactgtgttcccttcgggaaatagtagcgaagttctc

SEQ ID NO: 97 - DNA, 469 bp, Lactobacillus paracasei
tatgaccaatacagctattcgctacacccccgaatttaagcaaaccttgattgatcttcatgaaaaaggacactcattcaaagaactacatgaagaatacggtccttccttagacactattcgcaaatgggttcaggcggccactgtcattgccattgatcatcaaggtactgctgtgaccaacgaacagttcaagcaacttcaaaaagaaaatcgccgtttgagggaagaactcgatattttaaaacgagcggcggtgttgctggcaaagcgttggatatactcctttttgggtagacaagcaaataattaaagcttgtcttcctagggaggagtttttgtatgggccgaaagggttccagatacacgctggaggagaaattattctatattggtctggttcgtgagggtggctgggcaccttgggctgtccagcgagaatatggtgttaggcataatcaggttcgac

SEQ ID NO: 98 - DNA, 1340 bp, Lactobacillus paracasei
atttaccggattgagttttggcctggccctggatccacttatgaactgttgaatagccaatgccatattctctggccagttgggcagctgattcgccttgcttatataggttgataatgttttgtttgaattctttgtcgtaacgagttggcatgtaaaaattccttccttttgagagacaatttattcattataccctctcttaaaagttgtctcaggaatcagcttacatccagaatgagttctttataaatggatcttcacttcctatattatgtggcagatttagttatttaactataaatatgttaagcttacttatatatataaaaattacttggaggcataacatggctgatttgtggcggacaatttctgaacggcacggcgagttgcttagtgccttggggcaacatatcgaaatatctttaattgccttgatgattgccgttgtgattgcgattccattggccgtttgggtccagacgcatcacaaaaccgcggcagtgctgctgcaagtgactggtgttttgcaaaccattccttcgttggccttgttagggttgttgattccgtttgtgggtatcggtacgctgccagcgattattgctttagtggtgtatgctttattgccgatttttcaaaatacatatatcggtttacgcgatattgatccttcctatgaagaagcagccgatgcgtttggcatgagtcgattgcggaagttgttcaaagttgaattgcccatcgccttaccggttatcttgtcgggcgttcggactgcaatggtcatgattattggaaccgcgacgctggcagctttgatcggcgccggtggcttaggcacgttcattttgctaggtattgatcgaaatgatgcggcgttaactttaatgggtgctttggcagcagcgctattggcgattgtcttttcgtggctcttaaatgtcatgcaaaaagtgagttggaaggtcagcgtcggggttgtggcaattgctatctttggcatggttggcagccaagtatacacttatgtgaccgcaccaaaggaaactatcacgattgcgggaaaactaggcagtgagccggatattttgatcaatatgtacaaagaactcattcaaaaagctgatcctgatgtcggggtcacgttgaaatcgaactttggacagacgagcttcttgtacaatgcgttgagaaccgataagatcggcatataccctgagttttccgggacggttctggcaagtttgacgaaaccatctgccgctcagcaacaacaggtgacggctggtaaagataattatccacttgcaaagaaactgcttgctaaacaaggc

SEQ ID NO: 99 - DNA, 1081 bp, Lactobacillus paracasei
ttataatgataatgtatcactgtgaatgataaaaatgttgacacggtctgcaaaatatggcaaagtagtgttaccttcatgagggtattattgttagtcgctgaggactttaggaggatcactatgaatagtagcgaagaattccccaaaaatagttacaaaagcaacgatgaagtcattgcaaaagtatcgtcagaactctcatcctttgagaacgaaaatagcacctttgatgccggttttgggatcatcttctcttctggtgggggctcacgcctccgtaccatgcctgcttagccgtaaaatccaaatgctccgacgaagaccaagtatatttcggtagcaaggtttatttgcacgaaatagtacattgccttctatggagatggcaagctgtcttccttatgatttgcctgcacatttggagagggagccgaaaggctcctttttgtttaggaggattttaatgttaactgttaatgaaaaactaattccctttaaagactcggatggacaaccttcccttttcaatataaatgataataccatcagacccgtttcgtcctctctattcactattctaactaccattattcaacatggctcagctgacgaaatatctaaagatttgattaaccagttaatagctatggaatgggtccatgaatcccgtgagttaaaacaggattattcaaagtccggcatctttcatagtaataaggaatctttacaaaaagctatttgcgcccctgaaagcaaaaatcacttcctcgtacttggcgtaccctatgatcttgggaatcctgttcgtccaggtgctagatttggtcccgacgaaattcgtgtcggaagttggtcccttcttgagtacacccattatcaagaacacgtaaaaaaggacaatcctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaataca

SEQ ID NO: 100 - DNA, 361 bp, Lactobacillus paracasei
tttactggggcttcaattctgggcttcgcttgcgctaactcatcctcttaaccttccagcaccgggcaggcgtcagcccctatacatcatcttacgatttagcagagacctgtgtttttgataaacagttgtttgggcctattcactgcggctgaccttgcggtcagcaccccttcttccgaagttacggggtcattttgccgagttccttaacgagagttcgctcgctcacctgaggatactctcctcgactacctgtgtcggtttgcggtacgggtagtttatttctcactagaagcttttcttggcagtgtgacatcaggaacttcgctactataatttcgctccccatcacagcttg

SEQ ID NO: 101 - DNA, 978 bp, Lactobacillus paracasei
taacttatttgaaccctggaaagcattaaatcaggcggccatttggctcgtaagtgttgcaatttcaacttgtaagggggtctggtagcccagtgaactatgaattctcttcctattgtagaaagcatgcacatattcaaaaaggacggcagcggcagtttcataatcttcaaagaccggtactggataaacacattcctttttgagggaagcgtgaaaggattccattggcgcattatcatacggacaacccttacggctgtacgagtggcggatatgtagttcagttaaacgttgattgtaatcatcgctggtatactgtgatcctaaatccgtatggataatcaggtccccagtaatggttcgatttttaaccgcgctttcaagggtctttaagactaaatcagtatccatcttttttgagaacgaatagccgataatccgtcgtgagtgcaggtccatgatggttgataagtaacaccagccattacgcttcgtttgaatataggtcatatcagcggtccatttttgatttaaaccagtggtcgagaaatcctgcttaagcaagttgggacgctgttcaaccttggttttggaagccgaagccgctttccacttattgacggtaacggagtggatatccagttccttcatgagccgggaaatccgtcgtggactgcaccgaagctgcagtggttgaagttccagattcaattcatggtggatcttcataacaccgtatcgctgcttaaattccgcaaagatccgcagaatccgttgtttcaagtccgcatcttaggcccggcgttttgaaggtttgggggatcgataacgataatactgagctctggaaacaccgaggattcggcacatcttggttacctggtggtgatggctttcttggtgaatgtaatcaaagatattggttacttctgcgcaaggaagcccagggctttttttaggatttcgttctcctca

(The sequence listing continues in the following parts.)

The invention claimed is:

1. A method of improving growth and/or productivity of an animal, including a step of administering at least two bacteria selected from the group consisting of *Lactobacillus paracasei* T9 V12/022849, *Lactobacillus buchneri* Lb23 V11/022946, and *Lactobacillus casei* Lz26 V11/022948 to the animal, and measuring at least one growth and/or productivity characteristic of the animal.

2. The method of claim 1, wherein the bacteria administered to the animal include *Lactobacillus buchneri* Lb23 V11/022946 and *Lactobacillus casei* Lz26 V11/022948.

3. The method of claim 1, wherein the bacteria administered to the animal include *Lactobacillus paracasei* T9 V12/022849, *Lactobacillus buchneri* Lb23 V11/022946, and *Lactobacillus casei* Lz26 V11/022948.

4. The method of claim 1, wherein the animal is administered a composition comprising the at least two bacterial species.

5. The method of claim 4, wherein the concentration of the at least two bacterial species in the composition is at least about $10^5$ CFU/ml or CFU/g, at least about $10^6$ CFU/ml or CFU/g, at least about $10^7$ CFU/ml or CFU/g, or at least about $10^8$ CFU/ml or CFU/g.

6. The method of claim 4, wherein the composition administered to the animal comprises a sugar syrup, wherein a concentration of the sugar syrup in the composition is between about 1% w/w or v/v and about 10% w/w or v/v.

7. The method of claim 1, wherein the animal is a ruminant animal.

8. The method of claim 7, wherein the ruminant animal is a cattle animal.

9. The method of claim 8, wherein the cattle animal is a calf.

10. The method of claim 1, wherein the step of administering the at least two bacterial species to the animal is or includes administering the bacterial species to the digestive system of the animal.

11. The method of claim 10, wherein the at least two bacterial species are combined with feed for consumption by the animal.

12. The method of claim 1, wherein the growth characteristic comprises live weight of the animal.

13. The method of claim 1, wherein the productivity characteristic comprises milk production or meat production.

14. A method of improving the growth rate of an animal, including a step of administering at least two bacteria selected from the group consisting of *Lactobacillus paracasei* T9 V12/022849, *Lactobacillus buchneri* Lb23 V11/022946, and *Lactobacillus casei* Lz26 V11/022948 to the animal, and measuring the growth rate of the animal.

* * * * *